United States Patent 10,706,955 (BIOINFORMATIC PROCESSES FOR DETERMINATION OF PEPTIDE BINDING) - sequence listing, part 44

SEQ ID NO: 1683563 - protein, 37 aa, Staphylococcus aureus
MNEMLMANYLFNTSDNPRFKRWVIGSILSRTYYHNMV

SEQ ID NO: 1683564 - protein, 19 aa, Staphylococcus aureus
MSILTLLKIPDIEPYFHKV

SEQ ID NO: 1683565 - protein, 20 aa, Staphylococcus aureus
NGFIAFVRVNFYDGKDVLQP

SEQ ID NO: 1683566 - protein, 20 aa, Staphylococcus aureus
NHGINLLDTAYIYGPERSEE

SEQ ID NO: 1683567 - protein, 31 aa, Staphylococcus aureus
NNAPYQFVDIKTLVYPGFATDLQQPITPLLF

SEQ ID NO: 1683568 - protein, 24 aa, Staphylococcus aureus
NTERRIQRLYQALEPLGDSKPDWK

SEQ ID NO: 1683569 - protein, 17 aa, Staphylococcus aureus
NVLIAKLQAIYRRVYEF

SEQ ID NO: 1683570 - protein, 19 aa, Staphylococcus aureus
PADLVVMAVGIRPYTEVAK

SEQ ID NO: 1683571 - protein, 30 aa, Staphylococcus aureus
PSPDCLMLFQHHNLLPWKTINDNIRIGFQQ

SEQ ID NO: 1683572 - protein, 21 aa, Staphylococcus aureus
PVELRRNIGYVIQQIGLMPHM

SEQ ID NO: 1683573 - protein, 25 aa, Staphylococcus aureus
PYSQFKVGAYLKTKDGRTFYGTNVE

SEQ ID NO: 1683574 - protein, 24 aa, Staphylococcus aureus
QAQAILDMRLRRLTGLERDKIEAE

SEQ ID NO: 1683575 - protein, 23 aa, Staphylococcus aureus
QDIPEQFSIMRYHSLISNPDNFP

SEQ ID NO: 1683576 - protein, 20 aa, Staphylococcus aureus
QEEIFINKLLNTMNNHISNQ

SEQ ID NO: 1683577 - protein, 18 aa, Staphylococcus aureus
QEYFMKHLLGTKSGLLAT

SEQ ID NO: 1683578 - protein, 24 aa, Staphylococcus aureus
QHNHSIYFDGIPNMDIFKKCYKAL

SEQ ID NO: 1683579 - protein, 22 aa, Staphylococcus aureus
QMQKPSVFFLKDGKAREVIKRQ

SEQ ID NO: 1683580 - protein, 21 aa, Staphylococcus aureus
QTKWFPVVGQAVSASISYYFM

SEQ ID NO: 1683581 - protein, 19 aa, Staphylococcus aureus
RAIKYRTRIVTLEGDIVNP

SEQ ID NO: 1683582 - protein, 29 aa, Staphylococcus aureus
RDLLAEKGLELGCLFAFYGHTHVAKYEYI

SEQ ID NO: 1683583 - protein, 20 aa, Staphylococcus aureus
RGIVISLLSLDHIEVSDDAI

SEQ ID NO: 1683584 - protein, 26 aa, Staphylococcus aureus
RKNNYFFKLAYFRKNFEKKNGGYFIE

SEQ ID NO: 1683585 - protein, 20 aa, Staphylococcus aureus
RLNPTYFIRIHRSYIINTKH

SEQ ID NO: 1683586 - protein, 25 aa, Staphylococcus aureus
RLTSPNPFHLIYSILSKHQSASIPD

SEQ ID NO: 1683587 - protein, 23 aa, Staphylococcus aureus
RMGTYDVIVGINLLREGIDIPEV

SEQ ID NO: 1683588 - protein, 24 aa, Staphylococcus aureus
RVICKHMIALLFTASPEAANKHIM

SEQ ID NO: 1683589 - protein, 20 aa, Staphylococcus aureus
SAFGFIKMKNGATIILESAW

SEQ ID NO: 1683590 - protein, 18 aa, Staphylococcus aureus
SFENILDIYFKTFDPTDD

SEQ ID NO: 1683591 - protein, 43 aa, Staphylococcus aureus
SFKNKEGYNLTFFAFFVKAVADALKAYPLLNSSWQGNEIVLHK

SEQ ID NO: 1683592 - protein, 18 aa, Staphylococcus aureus
SGLTLLQIPEGVDWDGEV

SEQ ID NO: 1683593 - protein, 22 aa, Staphylococcus aureus
SGNIHGMPLRILTGEGPKELLE

SEQ ID NO: 1683594 - protein, 21 aa, Staphylococcus aureus
SLDYLLQFKIDNKALLQCIEA

SEQ ID NO: 1683595 - protein, 27 aa, Staphylococcus aureus
SNGFAMPMLLAISHVHQLLIKADLRMS

SEQ ID NO: 1683596 - protein, 24 aa, Staphylococcus aureus
SPNLYPEIECKLLAFLEEKKVDAT

SEQ ID NO: 1683597 - protein, 27 aa, Staphylococcus aureus
SQFPARIKCATLAWKALEKGTVAKEGK

SEQ ID NO: 1683598 - protein, 26 aa, Staphylococcus aureus
SSYDTFLVANIINKALFNQKIRKDIL

SEQ ID NO: 1683599 - protein, 21 aa, Staphylococcus aureus
SVPMGLFSGDFIFVGDIGRPD

SEQ ID NO: 1683600 - protein, 21 aa, Staphylococcus aureus
TDMFKALLHETFKAYGVLFID

SEQ ID NO: 1683601 - protein, 24 aa, Staphylococcus aureus
TEGAIYEGFLEYARNFKKYEGKDQ

SEQ ID NO: 1683602 - protein, 19 aa, Staphylococcus aureus
TIRIAPRKVRLVLDLIRGK

SEQ ID NO: 1683603 - protein, 24 aa, Staphylococcus aureus
TKGRYSVVIFDIYGTLTLDNDVLS

SEQ ID NO: 1683604 - protein, 24 aa, Staphylococcus aureus
TLAQEVYQEWYLGSKLYEDVEKKI

SEQ ID NO: 1683605 - protein, 23 aa, Staphylococcus aureus
TSHTPVWFMRQAGRSQPEYRKLK

SEQ ID NO: 1683606 - protein, 24 aa, Staphylococcus aureus
TTTTERILYYTGRIHKIGETHEGA

SEQ ID NO: 1683607 - protein, 29 aa, Staphylococcus aureus
VDEGTYYPRTFIQQLFVDGYFGEAALRKN

SEQ ID NO: 1683608 - protein, 19 aa, Staphylococcus aureus
VDRLLVVTFTNLSAREMKH

SEQ ID NO: 1683609 - protein, 23 aa, Staphylococcus aureus
VENVEMIAFCDVDISKAASAAEA

SEQ ID NO: 1683610 - protein, 20 aa, Staphylococcus aureus
VHLLRKYYAFIKLDHNDIIK

SEQ ID NO: 1683611 - protein, 19 aa, Staphylococcus aureus
VKIYEYFNDALRAYGLTVK

SEQ ID NO: 1683612 - protein, 26 aa, Staphylococcus aureus
VLEKFKSLIFISGTLKFNHSFEAFKQ

SEQ ID NO: 1683613 - protein, 20 aa, Staphylococcus aureus
VLNLFYKLHPSFEGQGYACE

SEQ ID NO: 1683614 - protein, 23 aa, Staphylococcus aureus
VTEMKMFEFKQGVKLFGANVILS

SEQ ID NO: 1683615 - protein, 25 aa, Staphylococcus aureus
VTLVDRMPFHGLKPEFYALAAGTKS

SEQ ID NO: 1683616 - protein, 30 aa, Staphylococcus aureus
YAFAYTLDDGKAYAYLIFVQETWTMLHENM

SEQ ID NO: 1683617 - protein, 20 aa, Staphylococcus aureus
YATISFLNWFLDEQVEEESM

SEQ ID NO: 1683618 - protein, 18 aa, Staphylococcus aureus
YEEKLYQAYRYTEKMKTR

SEQ ID NO: 1683619 - protein, 21 aa, Staphylococcus aureus
YQLLLDEGYIYSRPRSGYFVS

SEQ ID NO: 1683620 - protein, 24 aa, Staphylococcus aureus
YQNKPIMYNLDRIVVYMRLRRVGN

SEQ ID NO: 1683621 - protein, 28 aa, Staphylococcus aureus
YRSAYHILDMVFWFGNLQILAAHQYPTT

SEQ ID NO: 1683622 - protein, 19 aa, Staphylococcus aureus
AFKNDKIDFIWSHTLKSIN

SEQ ID NO: 1683623 - protein, 17 aa, Staphylococcus aureus
AHVMHTHLLINFVTKSE

SEQ ID NO: 1683624 - protein, 17 aa, Staphylococcus aureus
AMIEAVRITLKNALAMV

SEQ ID NO: 1683625 - protein, 24 aa, Staphylococcus aureus
AQHPQYVVRPFIDKIKHFQETANG

SEQ ID NO: 1683626 - protein, 32 aa, Staphylococcus aureus
AVQTSKPMIRKGPNIKLPSVSLLEEPQVIESD

SEQ ID NO: 1683627 - protein, 18 aa, Staphylococcus aureus
DDIPSTLPVFDKVTSGQL

SEQ ID NO: 1683628 - protein, 25 aa, Staphylococcus aureus
DKEAQIDLFKQFKAIADKKKSVSDR

SEQ ID NO: 1683629 - protein, 22 aa, Staphylococcus aureus
DKFIHYTPAYMYHEPLVRLAKK

SEQ ID NO: 1683630 - protein, 22 aa, Staphylococcus aureus
DLGDIFHSVLKYISERINGDFK

SEQ ID NO: 1683631 - protein, 23 aa, Staphylococcus aureus
DNEIAYLTMLFGGSLRRQDENFD

SEQ ID NO: 1683632 - protein, 18 aa, Staphylococcus aureus
DPKNILSKLIKRIRFATG

SEQ ID NO: 1683633 - protein, 17 aa, Staphylococcus aureus
DREGEAIAWHLSKILEL

SEQ ID NO: 1683634 - protein, 26 aa, Staphylococcus aureus
DSYFPIKHPFEQALYQTYLIDDMTSI

SEQ ID NO: 1683635 - protein, 19 aa, Staphylococcus aureus
EDIELFKDIADKVKQTNSY

SEQ ID NO: 1683636 - protein, 24 aa, Staphylococcus aureus
EEFYTFIGQFYSLNQHILPKEVHV

SEQ ID NO: 1683637 - protein, 27 aa, Staphylococcus aureus
EISIAQRLLIQTFFSTFSNKRTDHYGA

SEQ ID NO: 1683638 - protein, 26 aa, Staphylococcus aureus
EIYPHHHPKFNISEKSLLISAEAVGT

SEQ ID NO: 1683639 - protein, 23 aa, Staphylococcus aureus
EKQLSIVKPLPNGSFQILTEINL

SEQ ID NO: 1683640 - protein, 19 aa, Staphylococcus aureus
ELRIGTWSILPFDIEHDAN

SEQ ID NO: 1683641 - protein, 19 aa, Staphylococcus aureus
EMLTEREMEILLLIAKGYS

SEQ ID NO: 1683642 - protein, 22 aa, Staphylococcus aureus
EPGVFGAAWLNDALHTEMIVDG

SEQ ID NO: 1683643 - protein, 20 aa, Staphylococcus aureus
EREMEILLLIAKGYSNQEIA

SEQ ID NO: 1683644 - protein, 20 aa, Staphylococcus aureus
EVLKMPFHYVLSIYQNKNND

SEQ ID NO: 1683645 - protein, 30 aa, Staphylococcus aureus
FNDSPLFKVKLFQFADAAYILLDFHVSIFD

SEQ ID NO: 1683646 - protein, 20 aa, Staphylococcus aureus
FNFLKNQKNIIWLDCNIDII

SEQ ID NO: 1683647 - protein, 25 aa, Staphylococcus aureus
FTKANPFTRFIRAKATLTSAGATVV

SEQ ID NO: 1683648 - protein, 23 aa, Staphylococcus aureus
GDAHVDYLVTWNIPEGITMDQYL

SEQ ID NO: 1683649 - protein, 18 aa, Staphylococcus aureus
GLQLEGLNFDRQGQLFLL

SEQ ID NO: 1683650 - protein, 22 aa, Staphylococcus aureus
GNPQPRMFRLLEDDALINRMGF

SEQ ID NO: 1683651 - protein, 19 aa, Staphylococcus aureus
GRELLLDYQFVEKIKDGRE

SEQ ID NO: 1683652 - protein, 23 aa, Staphylococcus aureus
GSDWEGQFANKVKDVLLIMAKFQ

SEQ ID NO: 1683653 - protein, 17 aa, Staphylococcus aureus
HQILQHSLTIRQYEMQK

SEQ ID NO: 1683654 - protein, 18 aa, Staphylococcus aureus
HVLDYLLKPVDHAQLEVI

SEQ ID NO: 1683655 - protein, 24 aa, Staphylococcus aureus
IAEKSIEMIIAMIGVLKAGGAYVP

SEQ ID NO: 1683656 - protein, 19 aa, Staphylococcus aureus
IEERYLLFMLEQAGIDENT

SEQ ID NO: 1683657 - protein, 26 aa, Staphylococcus aureus
IHANDFDVLLMVYLSNYKKANIVYDA

SEQ ID NO: 1683658 - protein, 20 aa, Staphylococcus aureus
IKGFEMLPQMKAVDLRIEYD

SEQ ID NO: 1683659 - protein, 20 aa, Staphylococcus aureus
IKHYLLMLDEKMKNLDDYMR

SEQ ID NO: 1683660 - protein, 24 aa, Staphylococcus aureus
KDHFNFFSLFTFSEPIEQVVTHFL

SEQ ID NO: 1683661 - protein, 29 aa, Staphylococcus aureus
KDHSSIEIELPFADQFWGGKMGVFTDKYG

SEQ ID NO: 1683662 - protein, 19 aa, Staphylococcus aureus
KIQYLNFYHTELSNALFAI

SEQ ID NO: 1683663 - protein, 18 aa, Staphylococcus aureus
KIVRWRAAMFIFDEGNAE

SEQ ID NO: 1683664 - protein, 23 aa, Staphylococcus aureus
KNGGYFIEFAYLSDLATIDMKLR

SEQ ID NO: 1683665 - protein, 17 aa, Staphylococcus aureus
KRYDIIIVDTPPVNTVT

SEQ ID NO: 1683666 - protein, 37 aa, Staphylococcus aureus
KVFQSIYMTWNSQKFFDLIKYFELPLQTKIKTFSRGM

SEQ ID NO: 1683667 - protein, 21 aa, Staphylococcus aureus
KYNHYLFNAELFKHFKKGAVF

SEQ ID NO: 1683668 - protein, 24 aa, Staphylococcus aureus
LCKDTHRTIIRLSPPLVIDKEEIH

SEQ ID NO: 1683669 - protein, 17 aa, Staphylococcus aureus
LEALILVGAFDAFGKTR

SEQ ID NO: 1683670 - protein, 20 aa, Staphylococcus aureus
LEEFFEMYSWAQIGIHEKPI

SEQ ID NO: 1683671 - protein, 17 aa, Staphylococcus aureus
LEGIFKTLLNKNSQVVF

SEQ ID NO: 1683672 - protein, 22 aa, Staphylococcus aureus
LGRENYYMYKKFGVIPEMEYEM

SEQ ID NO: 1683673 - protein, 20 aa, Staphylococcus aureus
LKGIAYRKFDTAKEIITSVL

SEQ ID NO: 1683674 - protein, 21 aa, Staphylococcus aureus
LLNIVNFHTLITTKASRIRQI

SEQ ID NO: 1683675 - protein, 18 aa, Staphylococcus aureus
LTDMIKFKYPRLFENVRL

SEQ ID NO: 1683676 - protein, 25 aa, Staphylococcus aureus
LVSAASSCYIISLAATLERAKFTDI

SEQ ID NO: 1683677 - protein, 19 aa, Staphylococcus aureus
MHDWLKGKIIVDSLGLHSN

SEQ ID NO: 1683678 - protein, 18 aa, Staphylococcus aureus
MKIALTIALSHDVKLLIL

SEQ ID NO: 1683679 - protein, 17 aa, Staphylococcus aureus
MMLFQEIHQLEQTILMV

SEQ ID NO: 1683680 - protein, 19 aa, Staphylococcus aureus
NDIFKFEKELKRLGINATI

SEQ ID NO: 1683681 - protein, 21 aa, Staphylococcus aureus
NRVSWLEKWQCLEKKGRKEIK

SEQ ID NO: 1683682 - protein, 24 aa, Staphylococcus aureus
NTKNLIYHLYDDRGLWLAFNNNED

SEQ ID NO: 1683683 - protein, 21 aa, Staphylococcus aureus
QDLSNRLIQMRKRRGEIDFDI

SEQ ID NO: 1683684 - protein, 24 aa, Staphylococcus aureus
QEHGLDMIVIDYLQLIQGSGSRAS

SEQ ID NO: 1683685 - protein, 18 aa, Staphylococcus aureus
QIIFIDTPGIHKPKHKLG

SEQ ID NO: 1683686 - protein, 29 aa, Staphylococcus aureus
QLSLYHSLPLLKYPSFELFLEKINEFNAE

SEQ ID NO: 1683687 - protein, 22 aa, Staphylococcus aureus
QRVAIARALVTNPKILLCDEAT

SEQ ID NO: 1683688 - protein, 21 aa, Staphylococcus aureus
QTIINYLRRINRKTALLIQIS

SEQ ID NO: 1683689 - protein, 30 aa, Staphylococcus aureus
RAAGKDVTIFFTFWGLNALKKVQTVNVKKQ

SEQ ID NO: 1683690 - protein, 25 aa, Staphylococcus aureus
RDVATKAWFNTYLNIYAATTVNHLL

SEQ ID NO: 1683691 - protein, 27 aa, Staphylococcus aureus
RGIIDKFRLPYLLGKADYIFVDDFHPL

SEQ ID NO: 1683692 - protein, 22 aa, Staphylococcus aureus
RHGQTLFNFKGLIQGFGDSPLT

SEQ ID NO: 1683693 - protein, 31 aa, Staphylococcus aureus
RIKDGTMILKPVFRDYLLKLVEAHDIEHQYY

SEQ ID NO: 1683694 - protein, 22 aa, Staphylococcus aureus
RQTISLIERNNFMPSVLTAIKI

SEQ ID NO: 1683695 - protein, 19 aa, Staphylococcus aureus
RVLLALINKGMVREEAYDK

SEQ ID NO: 1683696 - protein, 28 aa, Staphylococcus aureus
RWNRSHHQLIFFGRYHCLARKPKCDICP

SEQ ID NO: 1683697 - protein, 27 aa, Staphylococcus aureus
RYSYHFNKIYFLRISTLPLSLGQESCV

SEQ ID NO: 1683698 - protein, 33 aa, Staphylococcus aureus
SDTAVMIAWLVKIPHRIMPILGTSQLKRIDQAI

SEQ ID NO: 1683699 - protein, 18 aa, Staphylococcus aureus
SHDAIDPQFYIFHNNYKK

SEQ ID NO: 1683700 - protein, 19 aa, Staphylococcus aureus
SLPNDRKFHPLEKLGRYLM

SEQ ID NO: 1683701 - protein, 18 aa, Staphylococcus aureus
SPAELPFLSFDHDKILSS

SEQ ID NO: 1683702 - protein, 21 aa, Staphylococcus aureus
SQLYQDFFKAKAKQLPQITVK

SEQ ID NO: 1683703 - protein, 23 aa, Staphylococcus aureus
TAIFPKLVFSIKKGTNFSPQDPN

SEQ ID NO: 1683704 - protein, 23 aa, Staphylococcus aureus
TENLAQIVGMAKALQLAEKNRDD

SEQ ID NO: 1683705 - protein, 24 aa, Staphylococcus aureus
TGRPIYHAIVWQSRQTQSICSELK

SEQ ID NO: 1683706 - protein, 23 aa, Staphylococcus aureus
TNQKILLPSSELARPLLLAALSK

SEQ ID NO: 1683707 - protein, 21 aa, Staphylococcus aureus
TVHIALMHDWLKGKIIVDSLG

SEQ ID NO: 1683708 - protein, 18 aa, Staphylococcus aureus
TWRKVIDGFFSSFKQDVE

SEQ ID NO: 1683709 - protein, 27 aa, Staphylococcus aureus
VAKRLDKIVAILLDTKGPEIRTHNMKD

SEQ ID NO: 1683710 - protein, 17 aa, Staphylococcus aureus
VCILEAMKLFNEIQAEI

SEQ ID NO: 1683711 - protein, 25 aa, Staphylococcus aureus
VFVPKIITSTYLYHDFDFATEVIDT

SEQ ID NO: 1683712 - protein, 17 aa, Staphylococcus aureus
VIPQLPLVDIHQYIEHG

SEQ ID NO: 1683713 - protein, 21 aa, Staphylococcus aureus
VLINDVVIPQLPLVDIHQYIE

SEQ ID NO: 1683714 - protein, 17 aa, Staphylococcus aureus
VSVATFTLAVNRTFTNA

SEQ ID NO: 1683715 - protein, 17 aa, Staphylococcus aureus
VYVNTNCYFMDGGQITI

SEQ ID NO: 1683716 - protein, 18 aa, Staphylococcus aureus
YARCEKLFVIGSYEPGSF

SEQ ID NO: 1683717 - protein, 20 aa, Staphylococcus aureus
YLERISELCNVQISIFSVGP

SEQ ID NO: 1683718 - protein, 18 aa, Staphylococcus aureus
YLNMLIEHGEMAELFGLD

SEQ ID NO: 1683719 - protein, 21 aa, Staphylococcus aureus
YNIEPLVHITCRDRNLIGLQS

SEQ ID NO: 1683720 - protein, 20 aa, Staphylococcus aureus
YSYHLGMMFQIKDDLLDCYG

SEQ ID NO: 1683721 - protein, 26 aa, Staphylococcus aureus
YTHIQRLLMNVLLNIKPTDVTSNIHA

SEQ ID NO: 1683722 - protein, 23 aa, Staphylococcus aureus
AKRLLDFGVHPPTIYFPLNVEEG

SEQ ID NO: 1683723 - protein, 18 aa, Staphylococcus aureus
AVKTGLQKTMQQAVSRIS

SEQ ID NO: 1683724 - protein, 26 aa, Staphylococcus aureus
AVMVGIIYQFIVANALFDSKHDINHY

SEQ ID NO: 1683725 - protein, 19 aa, Staphylococcus aureus
CGALMQYYRETGIYAERTA

SEQ ID NO: 1683726 - protein, 27 aa, Staphylococcus aureus
DGLLIGEALMRCDNLSEFLPQLKMQKV

SEQ ID NO: 1683727 - protein, 20 aa, Staphylococcus aureus
DIVYIPYKTPILEEAERKGN

SEQ ID NO: 1683728 - protein, 24 aa, Staphylococcus aureus
DKKKLADWHIGLPEIVQLQYDFEQ

SEQ ID NO: 1683729 - protein, 23 aa, Staphylococcus aureus
DKRDFMLNILNNLFKDIAHWEVP

SEQ ID NO: 1683730 - protein, 21 aa, Staphylococcus aureus
DLMKIANDVRWLASGPRAGLA

SEQ ID NO: 1683731 - protein, 17 aa, Staphylococcus aureus
DMELGQISAVYLNDLAQ

SEQ ID NO: 1683732 - protein, 25 aa, Staphylococcus aureus
DNRHISLIADVFKAFQSLYNGHYNQ

SEQ ID NO: 1683733 - protein, 25 aa, Staphylococcus aureus
DPMAKIIRQKLKKLGIRKGIPVVFS

SEQ ID NO: 1683734 - protein, 24 aa, Staphylococcus aureus
DQDAATHLPYIYLSAGVSAELFQE

SEQ ID NO: 1683735 - protein, 20 aa, Staphylococcus aureus
DVPTFAICHGPQILIDTDDL

SEQ ID NO: 1683736 - protein, 17 aa, Staphylococcus aureus
DVYCALKHGVNISKTAN

SEQ ID NO: 1683737 - protein, 18 aa, Staphylococcus aureus
EDGWYVSALTRNKNNRKL

SEQ ID NO: 1683738 - protein, 32 aa, Staphylococcus aureus
EETGVTFAGIPLGHEFNSLVLAILQVSGRAPK

SEQ ID NO: 1683739 - protein, 23 aa, Staphylococcus aureus
EFEPRKFVFTNGEIKYNSNFEKE

SEQ ID NO: 1683740 - protein, 23 aa, Staphylococcus aureus
EFHHPIFAVSPILKCLILKGLVK

SEQ ID NO: 1683741 - protein, 31 aa, Staphylococcus aureus
EGTEAFIETAKIVLRWLKEQGIQVELLNLGG

SEQ ID NO: 1683742 - protein, 28 aa, Staphylococcus aureus
EIAALAGMVVLSCINPVAGAVAIGAYSA

SEQ ID NO: 1683743 - protein, 24 aa, Staphylococcus aureus
EIPKDFILLPTHPYQINVLRQHPQ

SEQ ID NO: 1683744 - protein, 24 aa, Staphylococcus aureus
ENERSYDVFQYLKHEMNYSEDAQR

SEQ ID NO: 1683745 - protein, 24 aa, Staphylococcus aureus
ENKPYPLYLLLDKEYQLIEPVMKF

SEQ ID NO: 1683746 - protein, 20 aa, Staphylococcus aureus
EQFRDEFHFAKRRSTEALYE

SEQ ID NO: 1683747 - protein, 31 aa, Staphylococcus aureus
EQKHLDAIIILSDYNRRYLSGFTGTSGALII

SEQ ID NO: 1683748 - protein, 22 aa, Staphylococcus aureus
ERISLSIKDTLPTPFENIKGQF

SEQ ID NO: 1683749 - protein, 17 aa, Staphylococcus aureus
EVMGIPSLLVFKNGDKI

SEQ ID NO: 1683750 - protein, 18 aa, Staphylococcus aureus
FDNLKWLGLDWDESVDKD

SEQ ID NO: 1683751 - protein, 21 aa, Staphylococcus aureus
FEDLWELYRGLANVRPALPVS

SEQ ID NO: 1683752 - protein, 17 aa, Staphylococcus aureus
GAQLLIDFLSNNNLMRI

SEQ ID NO: 1683753 - protein, 24 aa, Staphylococcus aureus
GKAHAIRRRAVPTWGVFLDEEAQG

SEQ ID NO: 1683754 - protein, 20 aa, Staphylococcus aureus
GKPMENIFKAVRRLIDEYTD

SEQ ID NO: 1683755 - protein, 22 aa, Staphylococcus aureus
GTYYFHGHIVPGWQGVKKTFDT

SEQ ID NO: 1683756 - protein, 23 aa, Staphylococcus aureus
HAPNLRTFLHRYDLYETKYSSVF

SEQ ID NO: 1683757 - protein, 25 aa, Staphylococcus aureus
HCENMSKILGIDLYVKYEGANPTGS

SEQ ID NO: 1683758 - protein, 21 aa, Staphylococcus aureus
HHLTPNLWHQFNEGFYPLPRK

SEQ ID NO: 1683759 - protein, 17 aa, Staphylococcus aureus
IDQLLYAIADKLEEYKD

SEQ ID NO: 1683760 - protein, 25 aa, Staphylococcus aureus
IGKRPMDRVLRPLKLMDANIEGIED

SEQ ID NO: 1683761 - protein, 25 aa, Staphylococcus aureus
IMAFEHIRFPVFGVQYHPESILSEY

SEQ ID NO: 1683762 - protein, 27 aa, Staphylococcus aureus
INEITYRLSKIFGIKSISPVLKVEKTI

SEQ ID NO: 1683763 - protein, 17 aa, Staphylococcus aureus
IPTLIVFKDGQPVDKVV

SEQ ID NO: 1683764 - protein, 29 aa, Staphylococcus aureus
ISNMEVIPTYKYLIHLDTQRLNKLEREFE

SEQ ID NO: 1683765 - protein, 20 aa, Staphylococcus aureus
IVPWQQLAKRKNATLKFIPM

SEQ ID NO: 1683766 - protein, 21 aa, Staphylococcus aureus
KATNPEQLFAAGYASCFNGAF

SEQ ID NO: 1683767 - protein, 21 aa, Staphylococcus aureus
KHPTHFFSSSPIFYSNNNPFN

SEQ ID NO: 1683768 - protein, 19 aa, Staphylococcus aureus
KNQLAFIQAVEKHYKLYVN

SEQ ID NO: 1683769 - protein, 21 aa, Staphylococcus aureus
KRLSGQTVLFLGTGAIATRTA

SEQ ID NO: 1683770 - protein, 22 aa, Staphylococcus aureus
KTNIDFMSDYYFYLIEIGQKEQ

SEQ ID NO: 1683771 - protein, 24 aa, Staphylococcus aureus
KVKDVLLIMAKFQEELVQPMADHQ

SEQ ID NO: 1683772 - protein, 17 aa, Staphylococcus aureus
KVNRLFIDCKVPQWVRD

SEQ ID NO: 1683773 - protein, 22 aa, Staphylococcus aureus
KYDKIEIVGLMTMAPLTDDEAY

SEQ ID NO: 1683774 - protein, 18 aa, Staphylococcus aureus
LASPNNILGISYLKAIAK

SEQ ID NO: 1683775 - protein, 20 aa, Staphylococcus aureus
LEHPSVLEVVRYLEAHEGFK

SEQ ID NO: 1683776 - protein, 34 aa, Staphylococcus aureus
LEKMIAPFYRKWDHQVFEFYLEKFDLPINKSIKT

SEQ ID NO: 1683777 - protein, 49 aa, Staphylococcus aureus
LFKDIAHWEVPSGGYFVWLVFKIDIDIKYLFYELLSKEKILINPGYIYG

SEQ ID NO: 1683778 - protein, 18 aa, Staphylococcus aureus
LIKMWQLSQIYKPSSKQS

SEQ ID NO: 1683779 - protein, 18 aa, Staphylococcus aureus
LKVPEYVKTSLAPGSKVV

SEQ ID NO: 1683780 - protein, 31 aa, Staphylococcus aureus
LLDIINLIELYNVKVVVLKPFRLGGIDKVQT

SEQ ID NO: 1683781 - protein, 32 aa, Staphylococcus aureus
LLRARRTYAFTELFLFELRMQWLNRLEKSSDE

SEQ ID NO: 1683782 - protein, 27 aa, Staphylococcus aureus
LNCTLHSLYEIPYFVKYLADSYTNGKV

SEQ ID NO: 1683783 - protein, 20 aa, Staphylococcus aureus
LNHLYPEFHIWDAYSIYQLE

SEQ ID NO: 1683784 - protein, 27 aa, Staphylococcus aureus
LREEGIDCTFIAVKLPYGVQKDADEVE

SEQ ID NO: 1683785 - protein, 20 aa, Staphylococcus aureus
LTGITAYETFFDTFKISHNP

SEQ ID NO: 1683786 - protein, 20 aa, Staphylococcus aureus
MGVVPPIEGFLQGLRDITTE

SEQ ID NO: 1683787 - protein, 30 aa, Staphylococcus aureus
MHAVENFIMSRYQMYWQIYFHPVSRGGEVL

SEQ ID NO: 1683788 - protein, 20 aa, Staphylococcus aureus
MKLRIGFSDIFFNVDQLTSS

SEQ ID NO: 1683789 - protein, 18 aa, Staphylococcus aureus
MVAQILYKSKKPVVLAVN

SEQ ID NO: 1683790 - protein, 18 aa, Staphylococcus aureus
NEQYQISKQFWAYLVKTG

SEQ ID NO: 1683791 - protein, 26 aa, Staphylococcus aureus
NLIPYARKLEVLYEDAFIIIVTKPNN

SEQ ID NO: 1683792 - protein, 25 aa, Staphylococcus aureus
NSNGPMIRALAEKLGLEVGIYKTQK

SEQ ID NO: 1683793 - protein, 19 aa, Staphylococcus aureus
PEFHIWDAYSIYQLEESRL

SEQ ID NO: 1683794 - protein, 18 aa, Staphylococcus aureus
PVKIIPLEVVVRNIASGS

SEQ ID NO: 1683795 - protein, 17 aa, Staphylococcus aureus
QESFTHIELPEHAFLSC

SEQ ID NO: 1683796 - protein, 27 aa, Staphylococcus aureus
QIQGFFDIPIDHLMGVPILAKHFKDDP

SEQ ID NO: 1683797 - protein, 20 aa, Staphylococcus aureus
QMIKWTKLYIDQFLSSWTMP

SEQ ID NO: 1683798 - protein, 28 aa, Staphylococcus aureus
QYNVNNLLNMPFGACHFAVAAKPETTNY

SEQ ID NO: 1683799 - protein, 22 aa, Staphylococcus aureus
QYTDMPFLIMLDEDENGYKAGR

SEQ ID NO: 1683800 - protein, 19 aa, Staphylococcus aureus
RFPLVLGGDHSIAVGSVSA

SEQ ID NO: 1683801 - protein, 18 aa, Staphylococcus aureus
RGTAILITGGFKPSNKVI

SEQ ID NO: 1683802 - protein, 17 aa, Staphylococcus aureus
RIHTPSQMGIRKPEFSS

SEQ ID NO: 1683803 - protein, 25 aa, Staphylococcus aureus
RPVKMNSLLKLYFDRNILTPQKLLN

SEQ ID NO: 1683804 - protein, 21 aa, Staphylococcus aureus
RQGQLFLLDVFEGNIFKINPE

SEQ ID NO: 1683805 - protein, 43 aa, Staphylococcus aureus
RQKVSMIFQHFNLLWSRTVLKNIMFPLEIAGVPRRRAKQKALE

SEQ ID NO: 1683806 - protein, 17 aa, Staphylococcus aureus
RVAIMRAFMNNPKIILA

SEQ ID NO: 1683807 - protein, 27 aa, Staphylococcus aureus
SAMEILRRYCFDKAFIGMNGLDIELGL

SEQ ID NO: 1683808 - protein, 17 aa, Staphylococcus aureus
SFDIYKGETLGLVGESG

SEQ ID NO: 1683809 - protein, 17 aa, Staphylococcus aureus
SGISTYFKTYSPTTKII

SEQ ID NO: 1683810 - protein, 19 aa, Staphylococcus aureus
SHHCGDLIPETIPIGKPLS

SEQ ID NO: 1683811 - protein, 26 aa, Staphylococcus aureus
SLTERMEEEMFLGLRLNEGVSSSRFK

SEQ ID NO: 1683812 - protein, 17 aa, Staphylococcus aureus
SVLDQVSIDKMMIALDG

SEQ ID NO: 1683813 - protein, 21 aa, Staphylococcus aureus
TDQLLRYYSMYPTAATKVAYT

SEQ ID NO: 1683814 - protein, 17 aa, Staphylococcus aureus
TDRRPFNDVLLHGLVRA

SEQ ID NO: 1683815 - protein, 18 aa, Staphylococcus aureus
TEEKLNVPLIGFTGAPFT

SEQ ID NO: 1683816 - protein, 20 aa, Staphylococcus aureus
TGRIFISLAVKFSKARLIDN

SEQ ID NO: 1683817 - protein, 29 aa, Staphylococcus aureus
TGTPIHPMSPLAKIFWMKHEWQDVFQRTA

SEQ ID NO: 1683818 - protein, 19 aa, Staphylococcus aureus
TILLVLEKGEDIVECITTF

SEQ ID NO: 1683819 - protein, 27 aa, Staphylococcus aureus
TISVDNAIWKVIDFQHVKPGKGSAFVR

SEQ ID NO: 1683820 - protein, 20 aa, Staphylococcus aureus
TNKQRNYLELFYLEDYSLSE

SEQ ID NO: 1683821 - protein, 27 aa, Staphylococcus aureus
TTFIERYAQALIPPLIAFIQNYGIALE

SEQ ID NO: 1683822 - protein, 19 aa, Staphylococcus aureus
TVIKPNISELYQLLNQPLD

SEQ ID NO: 1683823 - protein, 35 aa, Staphylococcus aureus
TYGNAETFYPMPFLSPQTMWYYKSAFNTDQMKLID

SEQ ID NO: 1683824 - protein, 17 aa, Staphylococcus aureus
VCEDMSKCICLYNAPDE

SEQ ID NO: 1683825 - protein, 25 aa, Staphylococcus aureus
VDGFKALRFLRPRTAGRHYIIITLW

SEQ ID NO: 1683826 - protein, 25 aa, Staphylococcus aureus
VEKAQINRLKLFKQHGISSKCVYVK

SEQ ID NO: 1683827 - protein, 25 aa, Staphylococcus aureus
VSYYEIITLLNKRPLRQVDYGNKIQ

SEQ ID NO: 1683828 - protein, 30 aa, Staphylococcus aureus
WRHLSKIWYTDRQLLINNLISQAIPVIKYP

SEQ ID NO: 1683829 - protein, 18 aa, Staphylococcus aureus
YFNQILVHTGQNYDYTLN

SEQ ID NO: 1683830 - protein, 19 aa, Staphylococcus aureus
YFVLEFEQQIIGYLGLWIV

SEQ ID NO: 1683831 - protein, 18 aa, Staphylococcus aureus
YKQLLRNGVDFMTMGNHT

SEQ ID NO: 1683832 - protein, 18 aa, Staphylococcus aureus
YLELFYLEDYSLSEIADT

SEQ ID NO: 1683833 - protein, 17 aa, Staphylococcus aureus
YTIAKHYADDYLRRSGL

SEQ ID NO: 1683834 - protein, 25 aa, Staphylococcus aureus
AHEIYAKNAFINKVPLISKFVESIE

SEQ ID NO: 1683835 - protein, 18 aa, Staphylococcus aureus
AIAMIQFKLEIPIIKRRP

SEQ ID NO: 1683836 - protein, 17 aa, Staphylococcus aureus
AIYEFQYAYGLPDYGII

SEQ ID NO: 1683837 - protein, 20 aa, Staphylococcus aureus
ALPFSVLYNLPSKGSDVLVW

SEQ ID NO: 1683838 - protein, 25 aa, Staphylococcus aureus
APGFGDRRKAMLEDLAILTGAQVIT

SEQ ID NO: 1683839 - protein, 22 aa, Staphylococcus aureus
CGMGGPLIAKILKDGQDKLSQH

SEQ ID NO: 1683840 - protein, 18 aa, Staphylococcus aureus
DEKEKYSHDLYILKEFTT

SEQ ID NO: 1683841 - protein, 34 aa, Staphylococcus aureus
DGGINEAFLRRCPNLKWIAWFATGVNTLPLDYIA

SEQ ID NO: 1683842 - protein, 26 aa, Staphylococcus aureus
DGWYSLHLFYAVDWASLRIVPKDERD

SEQ ID NO: 1683843 - protein, 19 aa, Staphylococcus aureus
DIEIREYFWSIIENLKEDN

SEQ ID NO: 1683844 - protein, 29 aa, Staphylococcus aureus
DKHYPHLRFGFIHVPYIPEQVIGKPDTPS

SEQ ID NO: 1683845 - protein, 29 aa, Staphylococcus aureus
DLLTEKGALLKLDFITHSYPHDWRTKKPV

SEQ ID NO: 1683846 - protein, 25 aa, Staphylococcus aureus
DRRTKMYNVFEYFKQISNNKHFKSN

SEQ ID NO: 1683847 - protein, 35 aa, Staphylococcus aureus
DVEKVLAMTAPLGIFSHQLQRFIHLVWDVRDVIND

SEQ ID NO: 1683848 - protein, 18 aa, Staphylococcus aureus
DVVRRYFEYQGYNVEYVS

SEQ ID NO: 1683849 - protein, 38 aa, Staphylococcus aureus
EEIMPQYNRAVIFHTTSFREDWRTLLDYCNAKIVNTED

SEQ ID NO: 1683850 - protein, 20 aa, Staphylococcus aureus
EHEVVFKKYFEGEGLSILGY

SEQ ID NO: 1683851 - protein, 33 aa, Staphylococcus aureus
EKLRRHMSFLMRKGSLYLPYNGNLLIHGCIPVD

SEQ ID NO: 1683852 - protein, 23 aa, Staphylococcus aureus
ELGFTLMLAIARRIVEAEKYVEA

SEQ ID NO: 1683853 - protein, 17 aa, Staphylococcus aureus
ELREGNFMKIVSLAPEV

SEQ ID NO: 1683854 - protein, 18 aa, Staphylococcus aureus
ENQLPWHLPNDLKHVKKL

SEQ ID NO: 1683855 - protein, 17 aa, Staphylococcus aureus
EPKIKLYVSLKCPDFDD

SEQ ID NO: 1683856 - protein, 24 aa, Staphylococcus aureus
EPVAFLLQSTLGYKVLYVTDTKYL

SEQ ID NO: 1683857 - protein, 22 aa, Staphylococcus aureus
EQGFTILRSYEPEMYGEKLDLA

SEQ ID NO: 1683858 - protein, 36 aa, Staphylococcus aureus
EVVECAIPMIQGILGKIPFFGICLGHQLFALSQGAS

SEQ ID NO: 1683859 - protein, 17 aa, Staphylococcus aureus
FEHIEVSQLIVVKKDGT

SEQ ID NO: 1683860 - protein, 21 aa, Staphylococcus aureus
FKSNKLLYKHISERLKNTIEI

SEQ ID NO: 1683861 - protein, 26 aa, Staphylococcus aureus
FPDQLKVIEIINLYQSFYENPLPLEE

SEQ ID NO: 1683862 - protein, 18 aa, Staphylococcus aureus
GKAFARRLQGFNTNILYH

SEQ ID NO: 1683863 - protein, 18 aa, Staphylococcus aureus
GQPVLLGTVAVETSEYIS

SEQ ID NO: 1683864 - protein, 17 aa, Staphylococcus aureus
HARLIYVSTISVGTYFD

SEQ ID NO: 1683865 - protein, 17 aa, Staphylococcus aureus
HTTALMLFVQRCKDMQD

SEQ ID NO: 1683866 - protein, 22 aa, Staphylococcus aureus
IDPQFYIFHNNYKKFTILTDTG

SEQ ID NO: 1683867 - protein, 29 aa, Staphylococcus aureus
IETYSKALLGLVIPLVTKYGIALEAHLQN

SEQ ID NO: 1683868 - protein, 23 aa, Staphylococcus aureus
IGEQKFGLRLPGEFNRQQMTEAV

SEQ ID NO: 1683869 - protein, 17 aa, Staphylococcus aureus
ILAIPVGNAGNITAYWK

SEQ ID NO: 1683870 - protein, 19 aa, Staphylococcus aureus
ILEIHLPREIPSVNLIPYA

SEQ ID NO: 1683871 - protein, 21 aa, Staphylococcus aureus
IMFQKTMFPDQLKVIEIINLY

SEQ ID NO: 1683872 - protein, 19 aa, Staphylococcus aureus
IPHKERIIPYLDYVDEQAI

SEQ ID NO: 1683873 - protein, 30 aa, Staphylococcus aureus
ITINRMFWRARRRESIFIQYIVKHHPRFKD

SEQ ID NO: 1683874 - protein, 18 aa, Staphylococcus aureus
KHIQNMIGYIPKSDLQVV

SEQ ID NO: 1683875 - protein, 21 aa, Staphylococcus aureus
KIILGNTYHLWLQPGNDIIKH

SEQ ID NO: 1683876 - protein, 17 aa, Staphylococcus aureus
KLTLRPVAEDLSKKLDK

SEQ ID NO: 1683877 - protein, 25 aa, Staphylococcus aureus
KNLRDRVILELLYATGIRVSELVNI

SEQ ID NO: 1683878 - protein, 18 aa, Staphylococcus aureus
KSIIPKKLAHEINADLIM

SEQ ID NO: 1683879 - protein, 17 aa, Staphylococcus aureus
KSSILQQKALNDVAPFF

SEQ ID NO: 1683880 - protein, 21 aa, Staphylococcus aureus
KTKNYAKDVDILFILGGDGTV

SEQ ID NO: 1683881 - protein, 25 aa, Staphylococcus aureus
KYSHDLYILKEFTTTKVKMLTENIN

SEQ ID NO: 1683882 - protein, 25 aa, Staphylococcus aureus
LAKQLAIDLFGNKDALIRLDMSEYS

SEQ ID NO: 1683883 - protein, 24 aa, Staphylococcus aureus
LCSKRNYWYKKPNFSRIAQIASYV

SEQ ID NO: 1683884 - protein, 18 aa, Staphylococcus aureus
LERNVFLKGYTTTPQKCL

SEQ ID NO: 1683885 - protein, 24 aa, Staphylococcus aureus
LGHMPLLMDFIQQHSIDPSVIFSK

SEQ ID NO: 1683886 - protein, 21 aa, Staphylococcus aureus
LIDTTKFIPLGLEMNANHIHS

SEQ ID NO: 1683887 - protein, 20 aa, Staphylococcus aureus
LIRRSVCEFIKGLSLIDTSI

SEQ ID NO: 1683888 - protein, 18 aa, Staphylococcus aureus
LNLPPTLFKNEKARKSIL

SEQ ID NO: 1683889 - protein, 24 aa, Staphylococcus aureus
LRGGIIDIFPLIGEPIRIELFDTE

SEQ ID NO: 1683890 - protein, 19 aa, Staphylococcus aureus
LSINQLERLLKAIRDTFTI

SEQ ID NO: 1683891 - protein, 21 aa, Staphylococcus aureus
LSLKELLILAYFYYKNEHSIS

SEQ ID NO: 1683892 - protein, 26 aa, Staphylococcus aureus
LSSIPFNANWLNQQYAEIIQAILFDV

SEQ ID NO: 1683893 - protein, 19 aa, Staphylococcus aureus
LTGRELLIANQLPVIVHEA

SEQ ID NO: 1683894 - protein, 18 aa, Staphylococcus aureus
LTMGFIDDLLYPDDQVRA

SEQ ID NO: 1683895 - protein, 18 aa, Staphylococcus aureus
LTTIFNKFNHMSLSHYPI

SEQ ID NO: 1683896 - protein, 22 aa, Staphylococcus aureus
LYPAMEDFFLDIIIGKGDEARS

SEQ ID NO: 1683897 - protein, 24 aa, Staphylococcus aureus
MNNVKFIKPVYPGNTLYVIAEITN

SEQ ID NO: 1683898 - protein, 20 aa, Staphylococcus aureus
NDYFVRIQQWCQKFNIALTI

SEQ ID NO: 1683899 - protein, 22 aa, Staphylococcus aureus
NEGDTFTFDKVLFVGGDSVKVG

SEQ ID NO: 1683900 - protein, 17 aa, Staphylococcus aureus
NFSIIKHGDISTPQGFT

SEQ ID NO: 1683901 - protein, 25 aa, Staphylococcus aureus
NHEFNYGLPYLKDTLRRLNYPVLCA

SEQ ID NO: 1683902 - protein, 26 aa, Staphylococcus aureus
NIPGELIMKILAFDGNLEKIDKASKI

SEQ ID NO: 1683903 - protein, 17 aa, Staphylococcus aureus
NLVGHTHRFREAAASVH

SEQ ID NO: 1683904 - protein, 21 aa, Staphylococcus aureus
NMLNTILEAITAFLKNEFPQS

SEQ ID NO: 1683905 - protein, 26 aa, Staphylococcus aureus
NPDLSYAANFLYMLRGELPTDIEVEA

SEQ ID NO: 1683906 - protein, 20 aa, Staphylococcus aureus
NTSLAIFREATQWLDAYFKG

SEQ ID NO: 1683907 - protein, 18 aa, Staphylococcus aureus
NVVLVKLAEEIMPQYNRA

SEQ ID NO: 1683908 - protein, 26 aa, Staphylococcus aureus
PNLKTRDLVLLRYMYSYKEINMLDSY

SEQ ID NO: 1683909 - protein, 24 aa, Staphylococcus aureus
PRMNERAFVLIPLNDIAANVVEPR

SEQ ID NO: 1683910 - protein, 22 aa, Staphylococcus aureus
PSIPLKIMFPQLKVTIVDSLNK

SEQ ID NO: 1683911 - protein, 25 aa, Staphylococcus aureus
PWRQHDVKLVFFLAISHKDKAFTKQ

SEQ ID NO: 1683912 - protein, 17 aa, Staphylococcus aureus
PWTSCEFDFTRDGKLNV

SEQ ID NO: 1683913 - protein, 19 aa, Staphylococcus aureus
QDKIDFQIGTLSKAIGVVG

SEQ ID NO: 1683914 - protein, 17 aa, Staphylococcus aureus
QKFLDLFDKHELDSAVI

SEQ ID NO: 1683915 - protein, 19 aa, Staphylococcus aureus
REEFNKRLNLIHQKLNDNI

SEQ ID NO: 1683916 - protein, 28 aa, Staphylococcus aureus
RFKGIIASGMHTLSISFKLWVEEGKYGE

SEQ ID NO: 1683917 - protein, 36 aa, Staphylococcus aureus
RPELRNMKIFPRPIDNILPIWRAVGGPPASAIKAGK

SEQ ID NO: 1683918 - protein, 20 aa, Staphylococcus aureus
RTVLHFHPALAPYKAAILPL

SEQ ID NO: 1683919 - protein, 25 aa, Staphylococcus aureus
SDDYRYFPEPDIVPLYIDDAWKERV

SEQ ID NO: 1683920 - protein, 17 aa, Staphylococcus aureus
SDWFAELGFTFFNYHYT

SEQ ID NO: 1683921 - protein, 22 aa, Staphylococcus aureus
SKEQLDPVYKEIIRLIYREEIP

SEQ ID NO: 1683922 - protein, 28 aa, Staphylococcus aureus
SSGRSPSQLGFRYYVNRLLEQTSHQKTN

SEQ ID NO: 1683923 - protein, 26 aa, Staphylococcus aureus
TIENRPMMYIALSYDHRIIDGKEAVG

SEQ ID NO: 1683924 - protein, 19 aa, Staphylococcus aureus
TLRLYEMFMGPLDAAIAWS

SEQ ID NO: 1683925 - protein, 27 aa, Staphylococcus aureus
TNERMPIKSLNLLASQVLEIIKIVARQ

SEQ ID NO: 1683926 - protein, 18 aa, Staphylococcus aureus
TNMFWRQNISQMWVETEF

SEQ ID NO: 1683927 - protein, 18 aa, Staphylococcus aureus
TWFGGHVAVLPGVTIGEG

SEQ ID NO: 1683928 - protein, 31 aa, Staphylococcus aureus
VDQIHTGRYYIQRFLARAFGFEVDDIKAMSE

SEQ ID NO: 1683929 - protein, 19 aa, Staphylococcus aureus
VIVRELTSGIYFGEPRHFN

SEQ ID NO: 1683930 - protein, 25 aa, Staphylococcus aureus
VPRTDWDWMIYPQGLYDQIMRVVKD

SEQ ID NO: 1683931 - protein, 30 aa, Staphylococcus aureus
VTPHITLNQIFPYLKYQIIAMTTDSLKNIY

SEQ ID NO: 1683932 - protein, 20 aa, Staphylococcus aureus
YDKYDLLEYLFNQLTKDYFA

SEQ ID NO: 1683933 - protein, 18 aa, Staphylococcus aureus
ACFTGFELFVKPAVKHMC

SEQ ID NO: 1683934 - protein, 17 aa, Staphylococcus aureus
ADLGIKNAGLRLKFLKS

SEQ ID NO: 1683935 - protein, 24 aa, Staphylococcus aureus
AQEDYYRLILLSRHQNDIPMWLRE

SEQ ID NO: 1683936 - protein, 20 aa, Staphylococcus aureus
ASYPSTVLMTATLAQVAGVE

SEQ ID NO: 1683937 - protein, 26 aa, Staphylococcus aureus
DEIAGFILEPLIQGATGLFVHPKGFL

SEQ ID NO: 1683938 - protein, 27 aa, Staphylococcus aureus
DIINTLSKHFKVTAPIFIDNAESVTEL

SEQ ID NO: 1683939 - protein, 17 aa, Staphylococcus aureus
DMRIGELLAIKRVNINY

SEQ ID NO: 1683940 - protein, 22 aa, Staphylococcus aureus
DREQLLKEVWHYEFYGDLRTVD

SEQ ID NO: 1683941 - protein, 29 aa, Staphylococcus aureus
DSKNMKVIYMPHWLEFYSIAIHSDVTSNK

SEQ ID NO: 1683942 - protein, 28 aa, Staphylococcus aureus
DVKKGEYLFVLTAWYDQQRTLDSAFRIA

SEQ ID NO: 1683943 - protein, 17 aa, Staphylococcus aureus
DVNEGDTFTFDKVLFVG

SEQ ID NO: 1683944 - protein, 21 aa, Staphylococcus aureus
DYEIRNEIAQIKVIFKTVLKS

SEQ ID NO: 1683945 - protein, 22 aa, Staphylococcus aureus
EFEVRRFFIKLIDQRLNHDITK

SEQ ID NO: 1683946 - protein, 18 aa, Staphylococcus aureus
EFHFAKRRSTEALYEQQQ

SEQ ID NO: 1683947 - protein, 24 aa, Staphylococcus aureus
EIHSNLPKCLFPLTVRTRQSGDTF

SEQ ID NO: 1683948 - protein, 25 aa, Staphylococcus aureus
EIVCDYLFCKAFGKLASNIEKYTNQ

SEQ ID NO: 1683949 - protein, 19 aa, Staphylococcus aureus
EKLLPGCQFHKMGWAMGVV

SEQ ID NO: 1683950 - protein, 17 aa, Staphylococcus aureus
EKVGLDQSFLYRYPHEL

SEQ ID NO: 1683951 - protein, 27 aa, Staphylococcus aureus
ELIEYIENVYIMLNKPKGYISATEDHH

SEQ ID NO: 1683952 - protein, 26 aa, Staphylococcus aureus
EVVPWQYPPKREFIYGEWLRGEFENG

SEQ ID NO: 1683953 - protein, 20 aa, Staphylococcus aureus
FHEYLIHLTGVFETGYFLDM

SEQ ID NO: 1683954 - protein, 17 aa, Staphylococcus aureus
FISLKEGYFGKPLKYQS

SEQ ID NO: 1683955 - protein, 25 aa, Staphylococcus aureus
FITSNIPFRIRKPLPNMIFHQVEVN

SEQ ID NO: 1683956 - protein, 21 aa, Staphylococcus aureus
GDPIILLHGLDGNLAGFEDLQ

SEQ ID NO: 1683957 - protein, 17 aa, Staphylococcus aureus
GLELFHPERMASRILGM

SEQ ID NO: 1683958 - protein, 17 aa, Staphylococcus aureus
GLPIHEWLMLKQFSKYK

SEQ ID NO: 1683959 - protein, 17 aa, Staphylococcus aureus
GMFGALQDAAIYALNHY

SEQ ID NO: 1683960 - protein, 28 aa, Staphylococcus aureus
GNTKLKLNGYFIASIISPLNLNKLNNLY

SEQ ID NO: 1683961 - protein, 24 aa, Staphylococcus aureus
GQQRLLDFVLSLIGQPQLILLDEP

SEQ ID NO: 1683962 - protein, 27 aa, Staphylococcus aureus
GRTTGHLMSMLMTLKGLPLAYNKDMQE

SEQ ID NO: 1683963 - protein, 24 aa, Staphylococcus aureus
GVTFDEKYLYWYTGDSNPNNRNYL

SEQ ID NO: 1683964 - protein, 17 aa, Staphylococcus aureus
GYLLYRPTENTTFEQRA

SEQ ID NO: 1683965 - protein, 22 aa, Staphylococcus aureus
GYYDRFLANYQTKTISLLYDFQ

SEQ ID NO: 1683966 - protein, 26 aa, Staphylococcus aureus
HTKRDKLILMLMYEGGLRIGEVLSLR

SEQ ID NO: 1683967 - protein, 25 aa, Staphylococcus aureus
IDITKRIRYLLYQQNLIQASSQLDA

SEQ ID NO: 1683968 - protein, 24 aa, Staphylococcus aureus
IENIQPFLYHFYDMSVGICHNGNL

SEQ ID NO: 1683969 - protein, 18 aa, Staphylococcus aureus
IIINKDRTPYDSDATLVI

SEQ ID NO: 1683970 - protein, 22 aa, Staphylococcus aureus
IKAYCYHLKLLYEFMEQRGVIL

SEQ ID NO: 1683971 - protein, 42 aa, Staphylococcus aureus
ILVHPWQYDHTIGKYFEAWIAKKILIPTPFTILSKATLSFRT

SEQ ID NO: 1683972 - protein, 30 aa, Staphylococcus aureus
INIGQRRLFEWLRQNGFLIKRKGVDYNMPT

SEQ ID NO: 1683973 - protein, 17 aa, Staphylococcus aureus
KAKLTLRPVAEDLSKKL

SEQ ID NO: 1683974 - protein, 22 aa, Staphylococcus aureus
KDIGMIFQHFNLLNSATVFKNV

SEQ ID NO: 1683975 - protein, 31 aa, Staphylococcus aureus
KEAREALNGYFRENIFTSYINGNDLPYEHNN

SEQ ID NO: 1683976 - protein, 27 aa, Staphylococcus aureus
KKIAETLNLLYQLTNKKQRVKVVKEVV

SEQ ID NO: 1683977 - protein, 22 aa, Staphylococcus aureus
KMGLQIRHYTVQSLKLLKTHFN

SEQ ID NO: 1683978 - protein, 17 aa, Staphylococcus aureus
KTDVLTASYLKSAYLVD

SEQ ID NO: 1683979 - protein, 30 aa, Staphylococcus aureus
KTTTATALQWLLFDKGLDGSTKSFNPVPLN

SEQ ID NO: 1683980 - protein, 24 aa, Staphylococcus aureus
KYLKKYFCLTLDNYLVLAYLDVFK

SEQ ID NO: 1683981 - protein, 26 aa, Staphylococcus aureus
LDEKRLNYVGFYRLHHKYTKKVMMAK

SEQ ID NO: 1683982 - protein, 22 aa, Staphylococcus aureus
LEKDAYIVRLVFAGSTTTEPIV

SEQ ID NO: 1683983 - protein, 26 aa, Staphylococcus aureus
LIHYYSVETIFDLALLTLLKGDLSID

SEQ ID NO: 1683984 - protein, 17 aa, Staphylococcus aureus
LIQKLMLIMPEGPALTL

SEQ ID NO: 1683985 - protein, 17 aa, Staphylococcus aureus
LLEIISNKYNFNYQIEH

SEQ ID NO: 1683986 - protein, 20 aa, Staphylococcus aureus
LNPDFFMYQAYAAQVNREIA

SEQ ID NO: 1683987 - protein, 18 aa, Staphylococcus aureus
LPREWRDAGWFLEVKPPQ

SEQ ID NO: 1683988 - protein, 20 aa, Staphylococcus aureus
MLAECVIFLNESFNISENEN

SEQ ID NO: 1683989 - protein, 22 aa, Staphylococcus aureus
MYQAYSRIFERVGINARPVVAD

SEQ ID NO: 1683990 - protein, 24 aa, Staphylococcus aureus
NEENYELIPTVFAEFEIDGKITTF

SEQ ID NO: 1683991 - protein, 17 aa, Staphylococcus aureus
NFGLMPQGLEVFRVLYH

SEQ ID NO: 1683992 - protein, 24 aa, Staphylococcus aureus
NFNEKFDFIVSRTTFHHLDDIASV

SEQ ID NO: 1683993 - protein, 29 aa, Staphylococcus aureus
NGYRYIDDELWIYSFILNGNNENTLVRFK

SEQ ID NO: 1683994 - protein, 18 aa, Staphylococcus aureus
NLCKINNIPYKVDIYPYY

SEQ ID NO: 1683995 - protein, 25 aa, Staphylococcus aureus
NLPENFSQVFRPKAFKYSNGEIVFN

SEQ ID NO: 1683996 - protein, 19 aa, Staphylococcus aureus
NNGGVVLRWLRDELLASEV

SEQ ID NO: 1683997 - protein, 27 aa, Staphylococcus aureus
NNIPMGRGMIKWAPFATLPEQFETIQQ

SEQ ID NO: 1683998 - protein, 19 aa, Staphylococcus aureus
NQELLCIYIDFDSGLRHSN

SEQ ID NO: 1683999 - protein, 22 aa, Staphylococcus aureus
NSVFPHILRGVNILGIDSVFTA

SEQ ID NO: 1684000 - protein, 32 aa, Staphylococcus aureus
NVPYVTKFSMKWFLAMPRAKAWMINTRTPDWL

SEQ ID NO: 1684001 - protein, 26 aa, Staphylococcus aureus
NYMSRLMNPVRFLDYLDVSKLNGGEV

SEQ ID NO: 1684002 - protein, 17 aa, Staphylococcus aureus
PCLITIFGATGDLSHRK

SEQ ID NO: 1684003 - protein, 25 aa, Staphylococcus aureus
PGSLNPKFLNVSSLIQYIQSAYHEP

SEQ ID NO: 1684004 - protein, 20 aa, Staphylococcus aureus
QDDGYRIGYGGGYYDRFLAN

SEQ ID NO: 1684005 - protein, 20 aa, Staphylococcus aureus
QQVPLAVRKAIPQLTKVIKK

SEQ ID NO: 1684006 - protein, 20 aa, Staphylococcus aureus
QVVVHINGGKFNGIIPISQL

SEQ ID NO: 1684007 - protein, 22 aa, Staphylococcus aureus
RDAGWFLEVKPPQTGGDVIQIL

SEQ ID NO: 1684008 - protein, 18 aa, Staphylococcus aureus
RDILAAHYIAKSAIRTKN

SEQ ID NO: 1684009 - protein, 17 aa, Staphylococcus aureus
RLVKPIGIKVTRLAQGL

SEQ ID NO: 1684010 - protein, 22 aa, Staphylococcus aureus
RNGKIVRLYFNGKSSFVTCYLQ

SEQ ID NO: 1684011 - protein, 27 aa, Staphylococcus aureus
RQLNDKSLPLIVTTIQKMAKAIQGNAH

SEQ ID NO: 1684012 - protein, 25 aa, Staphylococcus aureus
RVENEFNFKILDHRLTFHGVCETCQ

SEQ ID NO: 1684013 - protein, 23 aa, Staphylococcus aureus
RVYIASVLMLEPKLIIADEPVAS

SEQ ID NO: 1684014 - protein, 19 aa, Staphylococcus aureus
SGTIQWWDKTYSDSGMNGI

SEQ ID NO: 1684015 - protein, 35 aa, Staphylococcus aureus
SIMAELEALYPPSYSSYIDFLYTCRQKIKVLDITY

SEQ ID NO: 1684016 - protein, 24 aa, Staphylococcus aureus
SLSNTELLAILINTGRKGFSSIDI

SEQ ID NO: 1684017 - protein, 20 aa, Staphylococcus aureus
SNIAALFWQNGHLEPELQDE

SEQ ID NO: 1684018 - protein, 24 aa, Staphylococcus aureus
SSEFKLQMVRLYKNGKLKNEIIRK

SEQ ID NO: 1684019 - protein, 21 aa, Staphylococcus aureus
SSIVGVYLFGSAVNGGLRINS

SEQ ID NO: 1684020 - protein, 23 aa, Staphylococcus aureus
STKKLPDFILSLGAKFNHQAKEG

SEQ ID NO: 1684021 - protein, 19 aa, Staphylococcus aureus
TFELDFPYELTPDQAKSID

SEQ ID NO: 1684022 - protein, 18 aa, Staphylococcus aureus
THQLKQLDIVYYFGNVTV

SEQ ID NO: 1684023 - protein, 25 aa, Staphylococcus aureus
TIVSPLPEKSSFTAKFQVLPKVVNP

SEQ ID NO: 1684024 - protein, 23 aa, Staphylococcus aureus
TKCTFLSEYLYPVKFREKTRIGR

SEQ ID NO: 1684025 - protein, 32 aa, Staphylococcus aureus
TLLNEDKVEWIILAGYMRLIGPDLLASFEGKI

SEQ ID NO: 1684026 - protein, 19 aa, Staphylococcus aureus
TLMTSFFVDKNPLTPKEQI

SEQ ID NO: 1684027 - protein, 36 aa, Staphylococcus aureus
TPPTYVYKLGAIQEFLPHCFKFGIKNAIRIYNHNTS

SEQ ID NO: 1684028 - protein, 32 aa, Staphylococcus aureus
TYVTQLICYDLRFPELLRYPARSGAKIAFYVA

SEQ ID NO: 1684029 - protein, 23 aa, Staphylococcus aureus
VDNKVCYQVFYDEKGYPYISRNI

SEQ ID NO: 1684030 - protein, 18 aa, Staphylococcus aureus
VFHAAALKQVPSCEFFPV

SEQ ID NO: 1684031 - protein, 17 aa, Staphylococcus aureus
VIYHGNYATWFEVARLD

SEQ ID NO: 1684032 - protein, 19 aa, Staphylococcus aureus
VKRDAVIKVGQLFENIREC

SEQ ID NO: 1684033 - protein, 24 aa, Staphylococcus aureus
VLEQFDNAVILFMGAGDIQKLQNA

SEQ ID NO: 1684034 - protein, 24 aa, Staphylococcus aureus
VMTSLNAYFKPEILNRMDDIVLFK

SEQ ID NO: 1684035 - protein, 18 aa, Staphylococcus aureus
VPDIYILGKALGGGLYPV

SEQ ID NO: 1684036 - protein, 23 aa, Staphylococcus aureus
YSSLPIEASLLDIPTIFYVYDEG

SEQ ID NO: 1684037 - protein, 20 aa, Staphylococcus aureus
AEEIAFDRKNWVFPIQTHEN

SEQ ID NO: 1684038 - protein, 43 aa, Staphylococcus aureus
ALEKEDYILPGYRDVPQIIWHGLPLTEAFLFSRGHFKGNQFPE

SEQ ID NO: 1684039 - protein, 21 aa, Staphylococcus aureus
ANEYKGELIFLHKVKDGAVDD

SEQ ID NO: 1684040 - protein, 17 aa, Staphylococcus aureus
ATWFEVARLDYISKLGF

SEQ ID NO: 1684041 - protein, 19 aa, Staphylococcus aureus
AVQLHLEGFLNKYPSEISG

SEQ ID NO: 1684042 - protein, 21 aa, Staphylococcus aureus
CDSLPLVVFTGQVATPGIGKD

SEQ ID NO: 1684043 - protein, 21 aa, Staphylococcus aureus
CINGYRWITYIANSGQRRYIA

SEQ ID NO: 1684044 - protein, 26 aa, Staphylococcus aureus
CYELNTFFKAYLQQKGFNPELMSATI

SEQ ID NO: 1684045 - protein, 20 aa, Staphylococcus aureus
DALQDIVNLLLDDVQVTLDK

SEQ ID NO: 1684046 - protein, 23 aa, Staphylococcus aureus
DCEYTYAMPIAILIRHTMSFDNA

SEQ ID NO: 1684047 - protein, 19 aa, Staphylococcus aureus
DEPILYSLNYMKNSLVQFK

SEQ ID NO: 1684048 - protein, 21 aa, Staphylococcus aureus
DFVQPLKPYLRQDPENGHIAD

SEQ ID NO: 1684049 - protein, 21 aa, Staphylococcus aureus
EDVLALWNKVNPSFALKSMFG

SEQ ID NO: 1684050 - protein, 25 aa, Staphylococcus aureus
EGHSYSHYLLIEQAINALKDAGYAF

SEQ ID NO: 1684051 - protein, 26 aa, Staphylococcus aureus
EHKLMYQATQLLLDYIHHTQKRDLSH

SEQ ID NO: 1684052 - protein, 22 aa, Staphylococcus aureus
EIAQYFTDKIIGLSISDLDEYA

SEQ ID NO: 1684053 - protein, 20 aa, Staphylococcus aureus
EIPYKQYCKHEFVLSGVRQK

SEQ ID NO: 1684054 - protein, 17 aa, Staphylococcus aureus
ELIFLHKVKDGAVDDSY

SEQ ID NO: 1684055 - protein, 31 aa, Staphylococcus aureus
ELTESIRLKSKKGTLLWLMDETKTPMGARRL

SEQ ID NO: 1684056 - protein, 17 aa, Staphylococcus aureus
FKPLHIFSDLSSKMFTW

SEQ ID NO: 1684057 - protein, 17 aa, Staphylococcus aureus
FMDAYRELKMIVPTPHM

SEQ ID NO: 1684058 - protein, 20 aa, Staphylococcus aureus
FVQPLKPYLRQDPENGHIAD

SEQ ID NO: 1684059 - protein, 25 aa, Staphylococcus aureus
GDITAPYYRDLAFVTYMGISAYDTF

SEQ ID NO: 1684060 - protein, 26 aa, Staphylococcus aureus
GLKVEGLYPYHIYTYIINELMGKPIE

SEQ ID NO: 1684061 - protein, 17 aa, Staphylococcus aureus
GQRFGEMEVWALEAYGA

SEQ ID NO: 1684062 - protein, 25 aa, Staphylococcus aureus
GRSSRIGYAYFLHPANKVLTETAED

SEQ ID NO: 1684063 - protein, 31 aa, Staphylococcus aureus
GRVYKNTEKWWNGLKSWWSNFREDQKKKSDK

SEQ ID NO: 1684064 - protein, 30 aa, Staphylococcus aureus
HGNELPISAGFFFINPFEVVYYAGGTSNAF

SEQ ID NO: 1684065 - protein, 19 aa, Staphylococcus aureus
HIGGFPVSGLFLRCTNQEV

SEQ ID NO: 1684066 - protein, 17 aa, Staphylococcus aureus
IASSLKAPIYVLSNIAG

SEQ ID NO: 1684067 - protein, 24 aa, Staphylococcus aureus
IDTPIKIILLNIDPAQITTILDEL

SEQ ID NO: 1684068 - protein, 19 aa, Staphylococcus aureus
IEGKTYIDLLSSASSQNVG

SEQ ID NO: 1684069 - protein, 17 aa, Staphylococcus aureus
IIINFSKYELEKLFKRV

SEQ ID NO: 1684070 - protein, 17 aa, Staphylococcus aureus
INPFGTFIAKGVIYPHP

SEQ ID NO: 1684071 - protein, 23 aa, Staphylococcus aureus
IQTDILKFSFPKHINYKIYGNIP

SEQ ID NO: 1684072 - protein, 23 aa, Staphylococcus aureus
ISDGTLYYTCEKFKLLVLQGNVL

SEQ ID NO: 1684073 - protein, 23 aa, Staphylococcus aureus
KAISILEQALFQHQLHFKTEVQS

SEQ ID NO: 1684074 - protein, 24 aa, Staphylococcus aureus
KDGDFFLKYYQWKMKKEHIVPISK

SEQ ID NO: 1684075 - protein, 17 aa, Staphylococcus aureus
KDYGIRKYGFHGTSHKF

SEQ ID NO: 1684076 - protein, 19 aa, Staphylococcus aureus
KEHIYLNEKYKFGIVLKEV

SEQ ID NO: 1684077 - protein, 25 aa, Staphylococcus aureus
KGTNLLTGIIHCPQCGAPMAASNTT

SEQ ID NO: 1684078 - protein, 18 aa, Staphylococcus aureus
KHDLKILINLNASGGFEL

SEQ ID NO: 1684079 - protein, 18 aa, Staphylococcus aureus
KHKVIFDTKNVVKSSFED

SEQ ID NO: 1684080 - protein, 19 aa, Staphylococcus aureus
KHVLEMIFLGEDPKNRIDI

SEQ ID NO: 1684081 - protein, 17 aa, Staphylococcus aureus
KILIYSEDYPKIPRAKP

SEQ ID NO: 1684082 - protein, 22 aa, Staphylococcus aureus
KKENPIPMCGVPYHSADSYIDT

SEQ ID NO: 1684083 - protein, 17 aa, Staphylococcus aureus
KKVILFAPTFRGNGHGT

SEQ ID NO: 1684084 - protein, 25 aa, Staphylococcus aureus
KNVDTPLYLFPTKSYIKKEPYGTVL

SEQ ID NO: 1684085 - protein, 19 aa, Staphylococcus aureus
KNVMVALREPALGPTFGIK

SEQ ID NO: 1684086 - protein, 25 aa, Staphylococcus aureus
KSIHYIATVVSVYRKVIDAYAADPD

SEQ ID NO: 1684087 - protein, 23 aa, Staphylococcus aureus
KYKEALEIIATKFGLTVNEDLQL

SEQ ID NO: 1684088 - protein, 17 aa, Staphylococcus aureus
LEGNVVLIFQYGEEIMP

SEQ ID NO: 1684089 - protein, 17 aa, Staphylococcus aureus
LIPHRGIVRLVHQNHYV

SEQ ID NO: 1684090 - protein, 18 aa, Staphylococcus aureus
LLTRTIITHILKDDLGPE

SEQ ID NO: 1684091 - protein, 31 aa, Staphylococcus aureus
LMVEMDIKMLKKVPPLYFHPKPSVDSVLIVL

SEQ ID NO: 1684092 - protein, 19 aa, Staphylococcus aureus
LNALAVIAISYLEKLDVTN

SEQ ID NO: 1684093 - protein, 35 aa, Staphylococcus aureus
LQHFEGTILFVSHDRYFINQLANKVFDLTIDGGKM

SEQ ID NO: 1684094 - protein, 17 aa, Staphylococcus aureus
LTYPDGFNILKKLNKVL

SEQ ID NO: 1684095 - protein, 24 aa, Staphylococcus aureus
NAAKQRALTLSSELNKYITSNEFN

SEQ ID NO: 1684096 - protein, 23 aa, Staphylococcus aureus
NFKGFRNTYFKQLVKRYCKLRLN

SEQ ID NO: 1684097 - protein, 17 aa, Staphylococcus aureus
NGDLPAFLSPEPGLQSG

SEQ ID NO: 1684098 - protein, 24 aa, Staphylococcus aureus
NKDIAWWSIVQSYPLLMRQEKSND

SEQ ID NO: 1684099 - protein, 26 aa, Staphylococcus aureus
NKLDTKYMQIFINKLSDIYSQNQVTR

SEQ ID NO: 1684100 - protein, 25 aa, Staphylococcus aureus
NSIVQVLIMPFLYANTYYSIDQLID

SEQ ID NO: 1684101 - protein, 18 aa, Staphylococcus aureus
NYHSLDIQWGNHDVLWVG

SEQ ID NO: 1684102 - protein, 24 aa, Staphylococcus aureus
PALRNRWVRFERVKNLWLRTELKY

SEQ ID NO: 1684103 - protein, 19 aa, Staphylococcus aureus
PARIAAMKGGLPETVPAFT

SEQ ID NO: 1684104 - protein, 21 aa, Staphylococcus aureus
PKLDNLFEKDLYSTYLSYLPS

SEQ ID NO: 1684105 - protein, 17 aa, Staphylococcus aureus
PSKILIYSEDYPKIPRA

SEQ ID NO: 1684106 - protein, 22 aa, Staphylococcus aureus
QASEFLKFRGLVDQYKEIELNK

SEQ ID NO: 1684107 - protein, 25 aa, Staphylococcus aureus
QLCTTYKMVLDFYIELSSNTVKGRY

SEQ ID NO: 1684108 - protein, 25 aa, Staphylococcus aureus
QPMSVTFEFQLNHRIYKVHRQGPYI

SEQ ID NO: 1684109 - protein, 19 aa, Staphylococcus aureus
QQIALFPHMTIKENIAQVP

SEQ ID NO: 1684110 - protein, 39 aa, Staphylococcus aureus
QQKGIVFLMIRFKTLDEVYLLPYSKFEVFWKRYKDNIKK

SEQ ID NO: 1684111 - protein, 29 aa, Staphylococcus aureus
QSVVPLKVLQDAYGLKRVAYTTYQAVSGS

SEQ ID NO: 1684112 - protein, 17 aa, Staphylococcus aureus
QYAKLKSIFGDRDMYFI

SEQ ID NO: 1684113 - protein, 19 aa, Staphylococcus aureus
RESFLDYAMSVIVARALPD

SEQ ID NO: 1684114 - protein, 18 aa, Staphylococcus aureus
RGYQKGRFSFNVKGGRCE

SEQ ID NO: 1684115 - protein, 24 aa, Staphylococcus aureus
RKGYQIYRPLLAVSKKEIKQFQER

SEQ ID NO: 1684116 - protein, 29 aa, Staphylococcus aureus
RTTHNSFVFDLLICENFIIYHGEKYTIKQ

SEQ ID NO: 1684117 - protein, 32 aa, Staphylococcus aureus
RVKNLWLRTELKYFYFYHLNNGIWNAKTVWIR

SEQ ID NO: 1684118 - protein, 26 aa, Staphylococcus aureus
SELKTLTFHALLDEWLEYHIKTSGSK

SEQ ID NO: 1684119 - protein, 20 aa, Staphylococcus aureus
SELNNIFINLSIQHASLLSE

SEQ ID NO: 1684120 - protein, 23 aa, Staphylococcus aureus
SGSAAIYTARKGLRTGIVADRIG

SEQ ID NO: 1684121 - protein, 18 aa, Staphylococcus aureus
SIPYVIDPVMLAKSGDSL

SEQ ID NO: 1684122 - protein, 28 aa, Staphylococcus aureus
SKIAYIMSFLKVHYPNYFYANILSNVIG

SEQ ID NO: 1684123 - protein, 18 aa, Staphylococcus aureus
SKSFSYAFDLLPEDQRKA

SEQ ID NO: 1684124 - protein, 23 aa, Staphylococcus aureus
SSFDVAPFLYLNINDEKYDMKIA

SEQ ID NO: 1684125 - protein, 25 aa, Staphylococcus aureus
SSNERWLRRVINSLVYDYGYPIGCS

SEQ ID NO: 1684126 - protein, 21 aa, Staphylococcus aureus
SVMPGFDFYFVPTVLNSTDVA

SEQ ID NO: 1684127 - protein, 26 aa, Staphylococcus aureus
SYGVHALTKILAAAVPLLDDFDIELT

SEQ ID NO: 1684128 - protein, 20 aa, Staphylococcus aureus
TADRIGVWIGSGIGGMETFE

SEQ ID NO: 1684129 - protein, 27 aa, Staphylococcus aureus
TDPTTIALLPIGYADGYLRIMQGSFVN

SEQ ID NO: 1684130 - protein, 23 aa, Staphylococcus aureus
TEITSIFYPKMFKAHPELLNMFN

SEQ ID NO: 1684131 - protein, 18 aa, Staphylococcus aureus
TFTVYRTTHNSFVFDLLI

SEQ ID NO: 1684132 - protein, 23 aa, Staphylococcus aureus
VAIYGLNFLIQNDLARLKSHYNI

SEQ ID NO: 1684133 - protein, 17 aa, Staphylococcus aureus
VDLLYKFKQSRLDRTLP

SEQ ID NO: 1684134 - protein, 23 aa, Staphylococcus aureus
VEQLVNFGRFPYSKGRLTKEDHD

SEQ ID NO: 1684135 - protein, 27 aa, Staphylococcus aureus
VNPQPYIEKVKYVGALFIGHYSPEVIG

SEQ ID NO: 1684136 - protein, 25 aa, Staphylococcus aureus
VVGKALLKYQQRDDIFIGTKVGNRL

SEQ ID NO: 1684137 - protein, 18 aa, Staphylococcus aureus
VYVALLKGTFSLDSIEFK

SEQ ID NO: 1684138 - protein, 19 aa, Staphylococcus aureus
WMFENGIPLDFTPKYTHTS

SEQ ID NO: 1684139 - protein, 23 aa, Staphylococcus aureus
YDITSLYTFKQPVSPHLAFKMTD

SEQ ID NO: 1684140 - protein, 17 aa, Staphylococcus aureus
YEKQLDIFLNPFDEEVI

SEQ ID NO: 1684141 - protein, 21 aa, Staphylococcus aureus
YIKNMMYVLADNRHISLIADV

SEQ ID NO: 1684142 - protein, 17 aa, Staphylococcus aureus
YLFPRKDGSPLKQETFR

SEQ ID NO: 1684143 - protein, 19 aa, Staphylococcus aureus
YLNEKYKFGIVLKEVTPLE

SEQ ID NO: 1684144 - protein, 24 aa, Staphylococcus aureus
YMKMDFYAKRNLELTESIRLKSKK

SEQ ID NO: 1684145 - protein, 26 aa, Staphylococcus aureus
YRDNATIYMRYADYVKIISVLSNGTT

SEQ ID NO: 1684146 - protein, 29 aa, Staphylococcus aureus
YSKDFLKYRFNLTFLDLSILYVISSRKNE

SEQ ID NO: 1684147 - protein, 19 aa, Staphylococcus aureus
YTPLIIKPSVIKGINYQME

SEQ ID NO: 1684148 - protein, 25 aa, Staphylococcus aureus
YVPCKEAVLPIFDQIFTRIGAADDL

SEQ ID NO: 1684149 - protein, 24 aa, Staphylococcus aureus
YYAGLSFRTLVPKYPAMSPHIKLS

SEQ ID NO: 1684150 - protein, 19 aa, Staphylococcus aureus
ADRIGVWIGSGIGGMETFE

SEQ ID NO: 1684151 - protein, 27 aa, Staphylococcus aureus
AGRHYIIITLWENRQAFYHWQNSAEYK

SEQ ID NO: 1684152 - protein, 17 aa, Staphylococcus aureus
AIMRAFMNNPKIILADE

SEQ ID NO: 1684153 - protein, 18 aa, Staphylococcus aureus
AIMRAFMNNPKIILADEP

SEQ ID NO: 1684154 - protein, 20 aa, Staphylococcus aureus
ATWFALMNHLVDVSVKYVTA

SEQ ID NO: 1684155 - protein, 20 aa, Staphylococcus aureus
AVCTRACRFCAVKTGLPNEL

SEQ ID NO: 1684156 - protein, 19 aa, Staphylococcus aureus
AYSLLKKKLVDKVKSWFED

SEQ ID NO: 1684157 - protein, 22 aa, Staphylococcus aureus
CLRYHQTFYTMTGKPFDSSDIV

SEQ ID NO: 1684158 - protein, 20 aa, Staphylococcus aureus
DELVATEYPVLLATSRKRFT

SEQ ID NO: 1684159 - protein, 19 aa, Staphylococcus aureus
DFYNRMAFDFGTLGNHEFN

SEQ ID NO: 1684160 - protein, 23 aa, Staphylococcus aureus
DGTKKRIRYYSCSNFRNKGSKVC

SEQ ID NO: 1684161 - protein, 20 aa, Staphylococcus aureus
DIPFAARHFHYFASVIETEE

SEQ ID NO: 1684162 - protein, 27 aa, Staphylococcus aureus
DMHQPNIIPYHKGFYRAFSKLHTTTFK

SEQ ID NO: 1684163 - protein, 17 aa, Staphylococcus aureus
DMVLGNYYLTLERKDAV

SEQ ID NO: 1684164 - protein, 23 aa, Staphylococcus aureus
DVPVYVYKLFPEGPITMTLIREM

SEQ ID NO: 1684165 - protein, 17 aa, Staphylococcus aureus
EASEFFIKALKKEFESF

SEQ ID NO: 1684166 - protein, 21 aa, Staphylococcus aureus
EATWFALMNHLVDVSVKYVTA

SEQ ID NO: 1684167 - protein, 25 aa, Staphylococcus aureus
EESQGQPILLFYNFKHDKERILQRF

SEQ ID NO: 1684168 - protein, 25 aa, Staphylococcus aureus
ENMNAWLKPYRRALHLEEPVVKITE

SEQ ID NO: 1684169 - protein, 33 aa, Staphylococcus aureus
ENVLKICGLYAFRNWPIAALSYGQKKRVTIASV

SEQ ID NO: 1684170 - protein, 21 aa, Staphylococcus aureus
ERLKGIFAWGFRFNSDEPEEG

SEQ ID NO: 1684171 - protein, 23 aa, Staphylococcus aureus
ETKTFFEYFLRIVNKTHDYAILE

SEQ ID NO: 1684172 - protein, 27 aa, Staphylococcus aureus
FQYAYGLPDYGIIGMQLPLTIVIIGET

SEQ ID NO: 1684173 - protein, 24 aa, Staphylococcus aureus
GAIKYAVKFYNYPNEYLLTNVKIP

SEQ ID NO: 1684174 - protein, 25 aa, Staphylococcus aureus
GANEWNWYMHLSKQLARQGQRIKAG

SEQ ID NO: 1684175 - protein, 20 aa, Staphylococcus aureus
GDIIGYVEAMKVLNEVTTDV

SEQ ID NO: 1684176 - protein, 24 aa, Staphylococcus aureus
GLLLKKHGQKLYDAGLRRINVSLD

SEQ ID NO: 1684177 - protein, 26 aa, Staphylococcus aureus
GRHYIIITLWENRQAFYHWQNSAEYK

SEQ ID NO: 1684178 - protein, 26 aa, Staphylococcus aureus
HGDGEHALLFVSKIREILMKEGIDIQ

SEQ ID NO: 1684179 - protein, 19 aa, Staphylococcus aureus
IHVANFSFNIVDSGIESAV

SEQ ID NO: 1684180 - protein, 19 aa, Staphylococcus aureus
IIKNYDSFLPQKLDIVVFP

SEQ ID NO: 1684181 - protein, 19 aa, Staphylococcus aureus
IREGGIRGIVISLLSLDHI

SEQ ID NO: 1684182 - protein, 21 aa, Staphylococcus aureus
ITIAYKVFKTAYDRVEWFRNG

SEQ ID NO: 1684183 - protein, 20 aa, Staphylococcus aureus
KDAFIINNKFINCEGGIRYL

SEQ ID NO: 1684184 - protein, 25 aa, Staphylococcus aureus
KDIYDWLQPLLKRKYPNISFKYTYI

SEQ ID NO: 1684185 - protein, 23 aa, Staphylococcus aureus
KECGLILGIDLLDHIIIGDNRFT

SEQ ID NO: 1684186 - protein, 22 aa, Staphylococcus aureus
KEWPFDMVVIDELSTFKSPKSQ

SEQ ID NO: 1684187 - protein, 26 aa, Staphylococcus aureus
KGDKLAQLVIVPIWTPELKQVEEFES

SEQ ID NO: 1684188 - protein, 25 aa, Staphylococcus aureus
KHRCLYLHIDPYLPYQYLNHDGEIT

SEQ ID NO: 1684189 - protein, 26 aa, Staphylococcus aureus
KLVNDNLNYFKLKKFIVALESKTAII

SEQ ID NO: 1684190 - protein, 27 aa, Staphylococcus aureus
KNEELNRFYLQHTLLPIVKQYEEEFNR

SEQ ID NO: 1684191 - protein, 21 aa, Staphylococcus aureus
KNLPDYVQIWPGHGAGSPCGK

SEQ ID NO: 1684192 - protein, 23 aa, Staphylococcus aureus
KTGNVYYRPGYVQTGRAFFKLKV

SEQ ID NO: 1684193 - protein, 22 aa, Staphylococcus aureus
LGETIKFFGGKIIGGAVRKLGE

SEQ ID NO: 1684194 - protein, 24 aa, Staphylococcus aureus
LKNLGMLTEPGLYYLYTDHTVQID

SEQ ID NO: 1684195 - protein, 17 aa, Staphylococcus aureus
LNFECGRFIVAHIGYYV

SEQ ID NO: 1684196 - protein, 32 aa, Staphylococcus aureus
LNLQQGGHIIVWFGLTWSLELYQQANARLYRQ

SEQ ID NO: 1684197 - protein, 20 aa, Staphylococcus aureus
LQHDGHELIFASARPIRDLL

SEQ ID NO: 1684198 - protein, 26 aa, Staphylococcus aureus
LRKIEADVPIYYYGFKDSDDIYAQNI

SEQ ID NO: 1684199 - protein, 31 aa, Staphylococcus aureus
LSSVIQPLYDIGAVGMRLLTKYMNDEKIEEP

SEQ ID NO: 1684200 - protein, 18 aa, Staphylococcus aureus
LTDHRIGMMLAVASLLSS

SEQ ID NO: 1684201 - protein, 25 aa, Staphylococcus aureus
LTSDDIDLFIPHQANIRIMESARER

SEQ ID NO: 1684202 - protein, 18 aa, Staphylococcus aureus
LYEKQLDIFLNPFDEEVI

SEQ ID NO: 1684203 - protein, 26 aa, Staphylococcus aureus
MHQPNIIPYHKGFYRAFSKLHTTTFK

SEQ ID NO: 1684204 - protein, 17 aa, Staphylococcus aureus
MMALQHVAQHKNIAFQS

SEQ ID NO: 1684205 - protein, 28 aa, Staphylococcus aureus
MMHVTISYPLPDNQLLTQLFTELEEGAV

SEQ ID NO: 1684206 - protein, 19 aa, Staphylococcus aureus
NIWRVVPRAWSHVFLSLID

SEQ ID NO: 1684207 - protein, 24 aa, Staphylococcus aureus
NKGYRLYFDSPTNQQFFILSNEKI

SEQ ID NO: 1684208 - protein, 28 aa, Staphylococcus aureus
NLGYQRASMYDIYPPYDGIPDEAFLIKE

SEQ ID NO: 1684209 - protein, 23 aa, Staphylococcus aureus
NTKWLCDQYKKEWPFDMVVIDEL

SEQ ID NO: 1684210 - protein, 25 aa, Staphylococcus aureus
NTRDNYFIHAIDRIYINTSKGLFPE

SEQ ID NO: 1684211 - protein, 32 aa, Staphylococcus aureus
NVLKNSAKLAILPFKLLKNGLGLAAKSLFAVS

SEQ ID NO: 1684212 - protein, 22 aa, Staphylococcus aureus
PDSIFVQHLLITMPQSFGRATM

SEQ ID NO: 1684213 - protein, 25 aa, Staphylococcus aureus
PEAEKLYLTLHLLSTSVQWTDLQES

SEQ ID NO: 1684214 - protein, 17 aa, Staphylococcus aureus
PFCVRICTYCDFNKYFI

SEQ ID NO: 1684215 - protein, 17 aa, Staphylococcus aureus
PIYNSFGMTETCSQFLT

SEQ ID NO: 1684216 - protein, 18 aa, Staphylococcus aureus
PIYNSFGMTETCSQFLTA

SEQ ID NO: 1684217 - protein, 18 aa, Staphylococcus aureus
PNDLYTWSSGIKSPIYCD

SEQ ID NO: 1684218 - protein, 17 aa, Staphylococcus aureus
PNEYLLTNVKIPKRRKT

SEQ ID NO: 1684219 - protein, 23 aa, Staphylococcus aureus
PSAIFGTMKPKKLENGRIPVSKP

SEQ ID NO: 1684220 - protein, 26 aa, Staphylococcus aureus
PSKSYIKEAVKGSLKRLGIDHIDLYQ

SEQ ID NO: 1684221 - protein, 17 aa, Staphylococcus aureus
QIDQIIDEAKAYNFKSV

SEQ ID NO: 1684222 - protein, 17 aa, Staphylococcus aureus
QVIGSMIVIYRESKENK

SEQ ID NO: 1684223 - protein, 25 aa, Staphylococcus aureus
REISPRLRLVIPLKRNVNADEYEAI

SEQ ID NO: 1684224 - protein, 20 aa, Staphylococcus aureus
RESFLDYAMSVIVARALPDV

SEQ ID NO: 1684225 - protein, 20 aa, Staphylococcus aureus
RFTIKKGSQGGIYKLILDGK

SEQ ID NO: 1684226 - protein, 17 aa, Staphylococcus aureus
RMKWYTVIQSIGLVQWY

SEQ ID NO: 1684227 - protein, 19 aa, Staphylococcus aureus
RPEAIKMAPLVKALEQEKM

SEQ ID NO: 1684228 - protein, 20 aa, Staphylococcus aureus
RTHRIFMIGQRGILEILHSR

SEQ ID NO: 1684229 - protein, 26 aa, Staphylococcus aureus
RVKPLPMRPDKLKNLGMLTEPGLYYL

SEQ ID NO: 1684230 - protein, 17 aa, Staphylococcus aureus
SIDISRFLELSNMILLL

SEQ ID NO: 1684231 - protein, 25 aa, Staphylococcus aureus
SILSKSIIKLLPEKISKLSNGEVIF

SEQ ID NO: 1684232 - protein, 17 aa, Staphylococcus aureus
SNNKMLQRIYGTAFFDK

SEQ ID NO: 1684233 - protein, 24 aa, Staphylococcus aureus
TAVPVMKVFKYFYSNRGPVIDYEN

SEQ ID NO: 1684234 - protein, 24 aa, Staphylococcus aureus
TDIMNYLFEIIDPYSVNQQGNDIG

SEQ ID NO: 1684235 - protein, 20 aa, Staphylococcus aureus
TFELDFPYELTPDQAKSIDE

SEQ ID NO: 1684236 - protein, 25 aa, Staphylococcus aureus
TGKNALLSDSLLRDIKVLSSNAKGD

SEQ ID NO: 1684237 - protein, 19 aa, Staphylococcus aureus
TMGVSTPITLGLGAALKTS

SEQ ID NO: 1684238 - protein, 25 aa, Staphylococcus aureus
TNSKAMKSLGLQTLFLGSTTGKTSK

SEQ ID NO: 1684239 - protein, 30 aa, Staphylococcus aureus
TVSHDRYFLNKVAQSYWFIHDGQMEKIIGT

SEQ ID NO: 1684240 - protein, 18 aa, Staphylococcus aureus
VDLVNWVENALQSGLAAK

SEQ ID NO: 1684241 - protein, 29 aa, Staphylococcus aureus
VFHELQPDEFYFLPSFMSPLKKHHDFIDV

SEQ ID NO: 1684242 - protein, 23 aa, Staphylococcus aureus
VNMIALVNGRPKLINLKEALVHY

SEQ ID NO: 1684243 - protein, 17 aa, Staphylococcus aureus
YCYRNYKNYLKNAIIHE

SEQ ID NO: 1684244 - protein, 27 aa, Staphylococcus aureus
YENQELVHFFFNELSKYVKKHRCLYLH

SEQ ID NO: 1684245 - protein, 17 aa, Staphylococcus aureus
YHMLNGVTIIDPDSTYI

SEQ ID NO: 1684246 - protein, 31 aa, Staphylococcus aureus
YNVSEKVFYDLWTDLYRLFKKLRNAFKEEDL

SEQ ID NO: 1684247 - protein, 30 aa, Staphylococcus aureus
AARATIVMALYQMFHVLPSFSVAYGATASG

SEQ ID NO: 1684248 - protein, 21 aa, Staphylococcus aureus
AKDPEKWLKSLKGSGVRSGSG

SEQ ID NO: 1684249 - protein, 44 aa, Staphylococcus aureus
ALEKEDYILPGYRDVPQIIWHGLPLTEAFLFSRGHFKGNQFPEG

SEQ ID NO: 1684250 - protein, 20 aa, Staphylococcus aureus
ANEYKGELIFLHKVKDGAVD

SEQ ID NO: 1684251 - protein, 28 aa, Staphylococcus aureus
ATDPTTIALLPIGYADGYLRIMQGSFVN

SEQ ID NO: 1684252 - protein, 19 aa, Staphylococcus aureus
DAFIINNKFINCEGGIRYL

SEQ ID NO: 1684253 - protein, 24 aa, Staphylococcus aureus
DERVRGLFQFYGAGTGRWAGRGVQ

SEQ ID NO: 1684254 - protein, 20 aa, Staphylococcus aureus
DSLPLVVFTGQVATPGIGKD

SEQ ID NO: 1684255 - protein, 19 aa, Staphylococcus aureus
DTLIPPFISVPGLGENVAK

SEQ ID NO: 1684256 - protein, 17 aa, Staphylococcus aureus
DTNPSLIISFYPGYAVH

SEQ ID NO: 1684257 - protein, 23 aa, Staphylococcus aureus
DVHTVYKMMTLFNNQSYIDDKGD

SEQ ID NO: 1684258 - protein, 20 aa, Staphylococcus aureus
DVIIFSGGVLEIIDLKYGKG

SEQ ID NO: 1684259 - protein, 17 aa, Staphylococcus aureus
EAVVRAIYNCKTPIISA

SEQ ID NO: 1684260 - protein, 18 aa, Staphylococcus aureus
EEVILQWKAQGIKPDVVM

SEQ ID NO: 1684261 - protein, 22 aa, Staphylococcus aureus
ELRQRISYLMQQSDLFGETIED

SEQ ID NO: 1684262 - protein, 17 aa, Staphylococcus aureus
ETIMSQFNLIDNRPESL

SEQ ID NO: 1684263 - protein, 19 aa, Staphylococcus aureus
FHEYLIHLTGVFETGYFLD

SEQ ID NO: 1684264 - protein, 24 aa, Staphylococcus aureus
FNEYGTKWYTYYDDDYNNFIMISY

SEQ ID NO: 1684265 - protein, 22 aa, Staphylococcus aureus
FNYGLPYLKDTLRRLNYPVLCA

SEQ ID NO: 1684266 - protein, 17 aa, Staphylococcus aureus
FNYMPYFEHLDMNQINV

SEQ ID NO: 1684267 - protein, 23 aa, Staphylococcus aureus
FPRQCIFIGTTNKVDFLRDETGG

SEQ ID NO: 1684268 - protein, 18 aa, Staphylococcus aureus
FTDKYGVRWMLHGQDYTA

SEQ ID NO: 1684269 - protein, 23 aa, Staphylococcus aureus
GDKQEMVIPLTRRKRAIQLTEQV

SEQ ID NO: 1684270 - protein, 24 aa, Staphylococcus aureus
GKEPQFYFIDPYANYSEFKDVDDL

SEQ ID NO: 1684271 - protein, 32 aa, Staphylococcus aureus
GLGFKAFWEEETGFHYDLFDKIDPKLSKVIQD

SEQ ID NO: 1684272 - protein, 20 aa, Staphylococcus aureus
GQFPRDFNIASSDDLLVCAH

SEQ ID NO: 1684273 - protein, 23 aa, Staphylococcus aureus
GVYGLIIPDLPYELSQRLKQQFS

SEQ ID NO: 1684274 - protein, 17 aa, Staphylococcus aureus
GYIGLPTSIMFAKHGVD

SEQ ID NO: 1684275 - protein, 23 aa, Staphylococcus aureus
HEVEKLYVFTKAASSLTGDNATI

SEQ ID NO: 1684276 - protein, 24 aa, Staphylococcus aureus
HTNPLWRVYRLVKFSKVFKNVIII

SEQ ID NO: 1684277 - protein, 47 aa, Staphylococcus aureus
IDELIDEDVFKLITNPQAFNLLDWKKRRSLLFEIAKPINDEDVIKTN

SEQ ID NO: 1684278 - protein, 24 aa, Staphylococcus aureus
IEHPYPLNVFTLNIATYIFRHREE

SEQ ID NO: 1684279 - protein, 19 aa, Staphylococcus aureus
IHRIKYDMLQPNPLRQEVM

SEQ ID NO: 1684280 - protein, 25 aa, Staphylococcus aureus
INKGYRLYFDSPTNQQFFILSNEKI

SEQ ID NO: 1684281 - protein, 20 aa, Staphylococcus aureus
IREGGIRGIVISLLSLDHIE

SEQ ID NO: 1684282 - protein, 21 aa, Staphylococcus aureus
ITMTLIREMRLMWKEMMAILQ

SEQ ID NO: 1684283 - protein, 18 aa, Staphylococcus aureus
IYQDESTPIWIYTENPNL

SEQ ID NO: 1684284 - protein, 23 aa, Staphylococcus aureus
KAIDYLREKGIAKAAKKADRIAA

SEQ ID NO: 1684285 - protein, 24 aa, Staphylococcus aureus
KAIDYLREKGIAKAAKKADRIAAE

SEQ ID NO: 1684286 - protein, 23 aa, Staphylococcus aureus
KEQLKMFVYDYDTNLIKNVMVAA

SEQ ID NO: 1684287 - protein, 28 aa, Staphylococcus aureus
KKCEQMYDHFLYLKHKMNYSEDAMIRMT

SEQ ID NO: 1684288 - protein, 25 aa, Staphylococcus aureus
KSAQMIIIDNYYLLLGGYNKTSNQH

SEQ ID NO: 1684289 - protein, 29 aa, Staphylococcus aureus
KSQRFKSIKKKLPLINRFIGLTGTPSPNS

SEQ ID NO: 1684290 - protein, 19 aa, Staphylococcus aureus
LEGLEFMGVYWDPKKNENL

SEQ ID NO: 1684291 - protein, 18 aa, Staphylococcus aureus
LEYPLFCTAIKYIIARDY

SEQ ID NO: 1684292 - protein, 17 aa, Staphylococcus aureus
LLESIYTLALAKSHRTS

SEQ ID NO: 1684293 - protein, 23 aa, Staphylococcus aureus
LQHKTIGIFGFGRIGQLVAERLA

SEQ ID NO: 1684294 - protein, 18 aa, Staphylococcus aureus
LTESIRLKSKKGTLLWLM

SEQ ID NO: 1684295 - protein, 17 aa, Staphylococcus aureus
MDYFAAGINYCIVGTKG

SEQ ID NO: 1684296 - protein, 21 aa, Staphylococcus aureus
MKMDFYAKRNLELTESIRLKS

SEQ ID NO: 1684297 - protein, 24 aa, Staphylococcus aureus
MTDILSMFYDFAYCLYSTHKHREI

SEQ ID NO: 1684298 - protein, 22 aa, Staphylococcus aureus
NDVTQLLRLLHDKYPHAFIHMV

SEQ ID NO: 1684299 - protein, 27 aa, Staphylococcus aureus
NFSTQLLDRFLVIAHSYQLNARVLVTK

SEQ ID NO: 1684300 - protein, 18 aa, Staphylococcus aureus
NHEFNYGLPYLKDTLRRL

SEQ ID NO: 1684301 - protein, 25 aa, Staphylococcus aureus
NSGDIFIINHRDLYRFQLQQDGIIC

SEQ ID NO: 1684302 - protein, 23 aa, Staphylococcus aureus
NSPTIVIHYDIRHLSTEFAQIIA

SEQ ID NO: 1684303 - protein, 25 aa, Staphylococcus aureus
NVVTRPLMEEWLFNTVAFVGGPSEI

SEQ ID NO: 1684304 - protein, 21 aa, Staphylococcus aureus
NYYKYRKFGILPETEYEINKV

SEQ ID NO: 1684305 - protein, 32 aa, Staphylococcus aureus
QLSSVIQPLYDIGAVGMRLLTKYMNDEKIEEP

SEQ ID NO: 1684306 - protein, 28 aa, Staphylococcus aureus
QSVVPLKVLQDAYGLKRVAYTTYQAVSG

SEQ ID NO: 1684307 - protein, 25 aa, Staphylococcus aureus
RAARLQPLLIYITTAGYQLDGPLVD

SEQ ID NO: 1684308 - protein, 20 aa, Staphylococcus aureus
RDFIRKYITPNIAKYLRHAG

SEQ ID NO: 1684309 - protein, 19 aa, Staphylococcus aureus
RDYYFFRSSEDGPPTNWHS

SEQ ID NO: 1684310 - protein, 20 aa, Staphylococcus aureus
RHLRYLENGGKWVFDEELAH

SEQ ID NO: 1684311 - protein, 26 aa, Staphylococcus aureus
RTTGHLMSMLMTLKGLPLAYNKDMQE

SEQ ID NO: 1684312 - protein, 29 aa, Staphylococcus aureus
RVMEPGCKFDYMLTLYGPQGVGKSALLKK

SEQ ID NO: 1684313 - protein, 23 aa, Staphylococcus aureus
SAIEARVIAWYAKEQWRLDVFNT

SEQ ID NO: 1684314 - protein, 18 aa, Staphylococcus aureus
SGFLALIEAGPDKINSYS

SEQ ID NO: 1684315 - protein, 18 aa, Staphylococcus aureus
SIFGDRDMYFISENGAVI

SEQ ID NO: 1684316 - protein, 19 aa, Staphylococcus aureus
SIFGDRDMYFISENGAVIY

SEQ ID NO: 1684317 - protein, 17 aa, Staphylococcus aureus
SKDFPLLTKIVDARESL

SEQ ID NO: 1684318 - protein, 26 aa, Staphylococcus aureus
SKDIYDWLQPLLKRKYPNISFKYTYI

SEQ ID NO: 1684319 - protein, 27 aa, Staphylococcus aureus
SKIAYIMSFLKVHYPNYFYANILSNVI

SEQ ID NO: 1684320 - protein, 22 aa, Staphylococcus aureus
SLQDLWAQVYLIDRGERLESSF

SEQ ID NO: 1684321 - protein, 25 aa, Staphylococcus aureus
SSIPFNANWLNQQYAEIIQAILFDV

SEQ ID NO: 1684322 - protein, 23 aa, Staphylococcus aureus
SSSIEEPFFMSLNEMFAMKEYKQ

SEQ ID NO: 1684323 - protein, 22 aa, Staphylococcus aureus
STGKWFGKAWQSVKSTTGSIYN

SEQ ID NO: 1684324 - protein, 19 aa, Staphylococcus aureus
SYMVMFEFKGHRIVAFKGG

SEQ ID NO: 1684325 - protein, 24 aa, Staphylococcus aureus
TDVPVYVYKLFPEGPITMTLIREM

SEQ ID NO: 1684326 - protein, 19 aa, Staphylococcus aureus
TLANVYLALDNELELLPVI

SEQ ID NO: 1684327 - protein, 18 aa, Staphylococcus aureus
TVNNKLIFSIPGSTGAVK

SEQ ID NO: 1684328 - protein, 23 aa, Staphylococcus aureus
TYQPHRLMYWPSTSNDAEFFFTY

SEQ ID NO: 1684329 - protein, 23 aa, Staphylococcus aureus
VDGNKFIDYLQAYGPIITGHAHP

SEQ ID NO: 1684330 - protein, 19 aa, Staphylococcus aureus
VEHRTLIYVPACFHKPQLM

SEQ ID NO: 1684331 - protein, 27 aa, Staphylococcus aureus
VHGDGEHALLFVSKIREILMKEGIDIQ

SEQ ID NO: 1684332 - protein, 19 aa, Staphylococcus aureus
VIQLLMHMIHYVPRTYHSN

SEQ ID NO: 1684333 - protein, 19 aa, Staphylococcus aureus
VLTMGFIDDLLYPDDQVRA

SEQ ID NO: 1684334 - protein, 24 aa, Staphylococcus aureus
VPCKEAVLPIFDQIFTRIGAADDL

SEQ ID NO: 1684335 - protein, 31 aa, Staphylococcus aureus
VPYVTKFSMKWFLAMPRAKAWMINTRTPDWL

SEQ ID NO: 1684336 - protein, 17 aa, Staphylococcus aureus
VVGKFVEFFGPGVQHLP

SEQ ID NO: 1684337 - protein, 17 aa, Staphylococcus aureus
VVRRYFEYQGYNVEYVS

SEQ ID NO: 1684338 - protein, 17 aa, Staphylococcus aureus
WLRIDYNFENDLIEGLI

SEQ ID NO: 1684339 - protein, 17 aa, Staphylococcus aureus
YHSLDIQWGNHDVLWVG

SEQ ID NO: 1684340 - protein, 17 aa, Staphylococcus aureus
YLNLGVNNKFIISSWLG

SEQ ID NO: 1684341 - protein, 17 aa, Staphylococcus aureus
YQLIVSKIQEAFKDRIL

SEQ ID NO: 1684342 - protein, 17 aa, Staphylococcus aureus
YTDILTPGYSKTGEAFK

SEQ ID NO: 1684343 - protein, 18 aa, Staphylococcus aureus
AGNDWFFDKMSNLGFEHT

SEQ ID NO: 1684344 - protein, 17 aa, Staphylococcus aureus
AIARRRKALEKEQALKE

SEQ ID NO: 1684345 - protein, 20 aa, Staphylococcus aureus
AIESGEIFKYFPIPEQPSDS

SEQ ID NO: 1684346 - protein, 17 aa, Staphylococcus aureus
CGKFMIKVKTKNGQMLV

SEQ ID NO: 1684347 - protein, 27 aa, Staphylococcus aureus
DKHLPDMDVIISAPFYPAYMTRERIEK

SEQ ID NO: 1684348 - protein, 20 aa, Staphylococcus aureus
DWFFDKMSNLGFEHTGFHKG

SEQ ID NO: 1684349 - protein, 25 aa, Staphylococcus aureus
EIAGFILEPLIQGATGLFVHPKGFL

SEQ ID NO: 1684350 - protein, 25 aa, Staphylococcus aureus
EIHSNLPKCLFPLTVRTRQSGDTFK

SEQ ID NO: 1684351 - protein, 17 aa, Staphylococcus aureus
ELILPRSTDKPLKGKEL

SEQ ID NO: 1684352 - protein, 20 aa, Staphylococcus aureus
ENPIPMCGVPYHSADSYIDT

SEQ ID NO: 1684353 - protein, 24 aa, Staphylococcus aureus
EQPGYKLMFNTLRAMYQQHPIRVD

SEQ ID NO: 1684354 - protein, 17 aa, Staphylococcus aureus
ESHFVGIGLRTPTDSGL

SEQ ID NO: 1684355 - protein, 21 aa, Staphylococcus aureus
ESNIAALFWQNGHLEPELQDE

SEQ ID NO: 1684356 - protein, 18 aa, Staphylococcus aureus
GAVRKLGEFKNYLGSIGK

SEQ ID NO: 1684357 - protein, 18 aa, Staphylococcus aureus
GDFFKKMDILISKQKMKI

SEQ ID NO: 1684358 - protein, 17 aa, Staphylococcus aureus
GNSKYLFTYFVKHNPMT

SEQ ID NO: 1684359 - protein, 33 aa, Staphylococcus aureus
GTYVTQLICYDLRFPELLRYPARSGAKIAFYVA

SEQ ID NO: 1684360 - protein, 18 aa, Staphylococcus aureus
GVIYHGNYATWFEVARLD

SEQ ID NO: 1684361 - protein, 29 aa, Staphylococcus aureus
HAVENFIMSRYQMYWQIYFHPVSRGGEVL

SEQ ID NO: 1684362 - protein, 40 aa, Staphylococcus aureus
HISLVPQTLNWLMQQGLHEPYNLQKILLGGAKLSATMIET

SEQ ID NO: 1684363 - protein, 25 aa, Staphylococcus aureus
HKLMYQATQLLLDYIHHTQKRDLSH

SEQ ID NO: 1684364 - protein, 19 aa, Staphylococcus aureus
IDHNDDLFKHVKDILRKQG

SEQ ID NO: 1684365 - protein, 29 aa, Staphylococcus aureus
IDILDIRFGSLWTNIPLAFLKSLEIVHGN

SEQ ID NO: 1684366 - protein, 17 aa, Staphylococcus aureus
IEIYSFFDPFSSDCFKL

SEQ ID NO: 1684367 - protein, 23 aa, Staphylococcus aureus
INTAFFVKLFNTALAERDYYFNI

SEQ ID NO: 1684368 - protein, 26 aa, Staphylococcus aureus
IQGFFDIPIDHLMGVPILAKHFKDDP

SEQ ID NO: 1684369 - protein, 28 aa, Staphylococcus aureus
ISSFVYKRRLPFHAKRFNDWLESMPNNV

SEQ ID NO: 1684370 - protein, 18 aa, Staphylococcus aureus
IWRVVPRAWSHVFLSLID

SEQ ID NO: 1684371 - protein, 34 aa, Staphylococcus aureus
KGKPFSISSITYILANPFYIGKIQFAKYKDWSEK

SEQ ID NO: 1684372 - protein, 20 aa, Staphylococcus aureus
KLDNLFEKDLYSTYLSYLPS

SEQ ID NO: 1684373 - protein, 23 aa, Staphylococcus aureus
KPAKKFLYLVIEKLMSRITDSII

SEQ ID NO: 1684374 - protein, 21 aa, Staphylococcus aureus
KQVVVHINGGKFNGIIPISQL

SEQ ID NO: 1684375 - protein, 17 aa, Staphylococcus aureus
KVGFKRLYVGVFNPEAT

SEQ ID NO: 1684376 - protein, 20 aa, Staphylococcus aureus
KYELDYIIDDDWNYAAQLDA

SEQ ID NO: 1684377 - protein, 19 aa, Staphylococcus aureus
LEEYVNVRGVPLRLVDTAG

SEQ ID NO: 1684378 - protein, 20 aa, Staphylococcus aureus
LREAIQIRQLAPDATIFLMN

SEQ ID NO: 1684379 - protein, 18 aa, Staphylococcus aureus
LSTLTGRRILILGDVLEL

SEQ ID NO: 1684380 - protein, 17 aa, Staphylococcus aureus
MCEFQIESMYHMSASTT

SEQ ID NO: 1684381 - protein, 18 aa, Staphylococcus aureus
MMHVTISYPLPDNQLLTQ

SEQ ID NO: 1684382 - protein, 17 aa, Staphylococcus aureus
MMQTFYEHALKGEVTKF

SEQ ID NO: 1684383 - protein, 24 aa, Staphylococcus aureus
MPPEEWICTMVNSMRIGLPASLDK

SEQ ID NO: 1684384 - protein, 23 aa, Staphylococcus aureus
NERSYDVFQYLKHEMNYSEDAQR

SEQ ID NO: 1684385 - protein, 21 aa, Staphylococcus aureus
NGKIVRLYFNGKSSFVTCYLQ

SEQ ID NO: 1684386 - protein, 26 aa, Staphylococcus aureus
NIHVNGFDFKLFILKGHMGISIQVKD

SEQ ID NO: 1684387 - protein, 25 aa, Staphylococcus aureus
NIPGELIMKILAFDGNLEKIDKASK

SEQ ID NO: 1684388 - protein, 18 aa, Staphylococcus aureus
NKLVLYVPTYREDKADNR

SEQ ID NO: 1684389 - protein, 20 aa, Staphylococcus aureus
NLFEHWFRSVFNRRHPYYVI

SEQ ID NO: 1684390 - protein, 22 aa, Staphylococcus aureus
NLIDTTKFIPLGLEMNANHIHS

SEQ ID NO: 1684391 - protein, 25 aa, Staphylococcus aureus
NNCRLDNETFIYLITGPNMSGKSTY

SEQ ID NO: 1684392 - protein, 21 aa, Staphylococcus aureus
NSVFPHILRGVNILGIDSVFT

SEQ ID NO: 1684393 - protein, 18 aa, Staphylococcus aureus
PCLITIFGATGDLSHRKL

SEQ ID NO: 1684394 - protein, 24 aa, Staphylococcus aureus
PPENPVNDMLWYDTSNPDVAVLRR

SEQ ID NO: 1684395 - protein, 22 aa, Staphylococcus aureus
QGSKLMGYYQNELYDYASQLDS

SEQ ID NO: 1684396 - protein, 33 aa, Staphylococcus aureus
QYLKIKSEYQDCLLFFRLGDFYEMFYEDAKEAS

SEQ ID NO: 1684397 - protein, 17 aa, Staphylococcus aureus
QYQLIQPVIGISSAGVV

SEQ ID NO: 1684398 - protein, 19 aa, Staphylococcus aureus
RERQLLLSVDNIECILVKG

SEQ ID NO: 1684399 - protein, 22 aa, Staphylococcus aureus
RQNHQLLLSIHPNFSRLQLTTK

SEQ ID NO: 1684400 - protein, 24 aa, Staphylococcus aureus
RVENEFNFKILDHRLTFHGVCETC

SEQ ID NO: 1684401 - protein, 22 aa, Staphylococcus aureus
SGSAAIYTARKGLRTGIVADRI

SEQ ID NO: 1684402 - protein, 17 aa, Staphylococcus aureus
SIRKLDEIVLLEGFMDV

SEQ ID NO: 1684403 - protein, 27 aa, Staphylococcus aureus
SIRLKSKKGTLLWLMDETKTPMGARRL

SEQ ID NO: 1684404 - protein, 23 aa, Staphylococcus aureus
SKIDILIVVNMFLTGFDSKVLNT

SEQ ID NO: 1684405 - protein, 22 aa, Staphylococcus aureus
SRLEILDLLSCGELCACDLLAH

SEQ ID NO: 1684406 - protein, 24 aa, Staphylococcus aureus
TEITSIFYPKMFKAHPELLNMFNQ

SEQ ID NO: 1684407 - protein, 27 aa, Staphylococcus aureus
THYMGIPIEESFLKLADRPLDEAALAK

SEQ ID NO: 1684408 - protein, 19 aa, Staphylococcus aureus
TIVVWRLDRLGRNMEDLIT

SEQ ID NO: 1684409 - protein, 17 aa, Staphylococcus aureus
TVRFTIKKGSQGGIYKL

SEQ ID NO: 1684410 - protein, 19 aa, Staphylococcus aureus
VCTRACRFCAVKTGLPNEL

SEQ ID NO: 1684411 - protein, 26 aa, Staphylococcus aureus
VNPQPYIEKVKYVGALFIGHYSPEVI

SEQ ID NO: 1684412 - protein, 17 aa, Staphylococcus aureus
VPDIYILGKALGGGLYP

SEQ ID NO: 1684413 - protein, 32 aa, Staphylococcus aureus
VTTLHTSLIEMIDYFKALFPNGGLYIHLDQAT

SEQ ID NO: 1684414 - protein, 17 aa, Staphylococcus aureus
WVRDQMPIVLDKQQRII

SEQ ID NO: 1684415 - protein, 26 aa, Staphylococcus aureus
YEQNDLLLIRYPLKDKVLNVHIGVIN

SEQ ID NO: 1684416 - protein, 24 aa, Staphylococcus aureus
YHTDEMMIIFVTNGKKWPQKNAVV

SEQ ID NO: 1684417 - protein, 21 aa, Staphylococcus aureus
YQAYSRIFERVGINARPVVAD

SEQ ID NO: 1684418 - protein, 18 aa, Staphylococcus aureus
YVCEDMSKCICLYNAPDE

SEQ ID NO: 1684419 - protein, 18 aa, Staphylococcus aureus
ADYLADKGVVPFLKVDKG

SEQ ID NO: 1684420 - protein, 19 aa, Staphylococcus aureus
AEDIFEVVWAKIEAAYQSQ

SEQ ID NO: 1684421 - protein, 32 aa, Staphylococcus aureus
AKNTSTIIPMCHPLPLTGIDVHFSWDETNAPL

SEQ ID NO: 1684422 - protein, 21 aa, Staphylococcus aureus
ARTVLHFHPALAPYKAAILPL

SEQ ID NO: 1684423 - protein, 23 aa, Staphylococcus aureus
CGMGGPLIAKILKDGQDKLSQHP

SEQ ID NO: 1684424 - protein, 17 aa, Staphylococcus aureus
CTKNAMLPIVLEKNARE

SEQ ID NO: 1684425 - protein, 17 aa, Staphylococcus aureus
DAQLLYGFSSEEEKDMF

SEQ ID NO: 1684426 - protein, 17 aa, Staphylococcus aureus
DGAYCINGYRWITYIAN

SEQ ID NO: 1684427 - protein, 26 aa, Staphylococcus aureus
DGWYSLHLFYAVDWASLRLVPKDERD

SEQ ID NO: 1684428 - protein, 21 aa, Staphylococcus aureus
DISRFLELSNMILLLDDMLDV

SEQ ID NO: 1684429 - protein, 20 aa, Staphylococcus aureus
DLIDYSLYIKKGLVEPFIVF

SEQ ID NO: 1684430 - protein, 27 aa, Staphylococcus aureus
DTIENRPMMYIALSYDHRIIDGKEAVG

SEQ ID NO: 1684431 - protein, 18 aa, Staphylococcus aureus
DTYLTKFPGIGKKTARQI

SEQ ID NO: 1684432 - protein, 26 aa, Staphylococcus aureus
DVPRTDWDWMIYPQGLYDQIMRVVKD

SEQ ID NO: 1684433 - protein, 21 aa, Staphylococcus aureus
DYAIRLLEDKVLYNKLQKNML

SEQ ID NO: 1684434 - protein, 24 aa, Staphylococcus aureus
EAQPIIELAARIYIEILDEVRQAN

SEQ ID NO: 1684435 - protein, 19 aa, Staphylococcus aureus
EEFFEMYSWAQIGIHEKPI

SEQ ID NO: 1684436 - protein, 31 aa, Staphylococcus aureus
EETGVTFAGIPLGHEFNSLVLAILQVSGRAP

SEQ ID NO: 1684437 - protein, 21 aa, Staphylococcus aureus
EFIKRLACLPSHIYRLKGFMT

SEQ ID NO: 1684438 - protein, 33 aa, Staphylococcus aureus
EKERMIPYFIQQQYWFLFYHDENYFAVKYSDDG

SEQ ID NO: 1684439 - protein, 23 aa, Staphylococcus aureus
FDREQLLKEVWHYEFYGDLRTVD

SEQ ID NO: 1684440 - protein, 17 aa, Staphylococcus aureus
FLFVLKDGKIQQFGTPT

SEQ ID NO: 1684441 - protein, 18 aa, Staphylococcus aureus
FSVLDQVSIDKMMIALDG

SEQ ID NO: 1684442 - protein, 23 aa, Staphylococcus aureus
FVAKQYLTIFKLSNAQNYKPILV

SEQ ID NO: 1684443 - protein, 18 aa, Staphylococcus aureus
GDPIILLHGLDGNLAGFE

SEQ ID NO: 1684444 - protein, 31 aa, Staphylococcus aureus
HGNELPISAGFFFINPFEVVYYAGGTSNAFR

SEQ ID NO: 1684445 - protein, 22 aa, Staphylococcus aureus
HHLTPNLWHQFNEGFYPLPRKD

SEQ ID NO: 1684446 - protein, 19 aa, Staphylococcus aureus
HHVLDYLLKPVDHAQLEVI

SEQ ID NO: 1684447 - protein, 25 aa, Staphylococcus aureus
HIDAYLKVAYQFSLPFGKDYADAHE

SEQ ID NO: 1684448 - protein, 22 aa, Staphylococcus aureus
HKGKMAFRVYPKWCNQLNKTAG

SEQ ID NO: 1684449 - protein, 17 aa, Staphylococcus aureus
HKMLGPTGIGVLFGKRE

SEQ ID NO: 1684450 - protein, 18 aa, Staphylococcus aureus
IANQHYLIHASNFDEACH

SEQ ID NO: 1684451 - protein, 30 aa, Staphylococcus aureus; identical to SEQ ID NO: 1651979

SEQ ID NO: 1684452 - protein, 19 aa, Staphylococcus aureus
IGEQKFGLRLPGEFNRQQM

SEQ ID NO: 1684453 - protein, 18 aa, Staphylococcus aureus
IILLHGLDGNLAGFEDLQ

SEQ ID NO: 1684454 - protein, 24 aa, Staphylococcus aureus
INPIPIKALTSYLGFGNYELRLPL

SEQ ID NO: 1684455 - protein, 23 aa, Staphylococcus aureus
ITDKNLIKPIPTLSTGTLAGKGV

SEQ ID NO: 1684456 - protein, 29 aa, Staphylococcus aureus
ITINRMFWRARRRESIFIQYIVKHHPRFK

SEQ ID NO: 1684457 - protein, 24 aa, Staphylococcus aureus
ITSNIPFRIRKPLPNMIFHQVEVN

SEQ ID NO: 1684458 - protein, 19 aa, Staphylococcus aureus
IVPWQQLAKRKNATLKFIP

SEQ ID NO: 1684459 - protein, 17 aa, Staphylococcus aureus
IYNYIKQVVQTKGYPPS

SEQ ID NO: 1684460 - protein, 22 aa, Staphylococcus aureus
IYTIAAMAPCPYIYAELAKRSQ

SEQ ID NO: 1684461 - protein, 19 aa, Staphylococcus aureus
KAKLTLRPVAEDLSKKLDK

SEQ ID NO: 1684462 - protein, 22 aa, Staphylococcus aureus
KIILGNTYHLWLQPGNDIIKHA

SEQ ID NO: 1684463 - protein, 19 aa, Staphylococcus aureus
KLYPFVFNTLFEAIDKLAI

SEQ ID NO: 1684464 - protein, 18 aa, Staphylococcus aureus
KMNQDLLAKCYLSCLKLA

SEQ ID NO: 1684465 - protein, 24 aa, Staphylococcus aureus
KNKLVEWSLYLKDQRINPIIYMET

SEQ ID NO: 1684466 - protein, 17 aa, Staphylococcus aureus
KRYLFEAVYGAGIIRMY

SEQ ID NO: 1684467 - protein, 17 aa, Staphylococcus aureus
KSIIPKKLAHEINADLI

SEQ ID NO: 1684468 - protein, 25 aa, Staphylococcus aureus
KSLRDRVILELLYATGIRVSELVNI

SEQ ID NO: 1684469 - protein, 17 aa, Staphylococcus aureus
KVNDLEYPLFFMVTKNL

SEQ ID NO: 1684470 - protein, 22 aa, Staphylococcus aureus
LEKYTLMTMHGLFNQLKLGIIS

SEQ ID NO: 1684471 - protein, 17 aa, Staphylococcus aureus
LFGDSMNVALLTGSVKG

SEQ ID NO: 1684472 - protein, 18 aa, Staphylococcus aureus
LKNSFRPEFLNRVDDIIV

SEQ ID NO: 1684473 - protein, 18 aa, Staphylococcus aureus
LLTYPDGFNILKKLNKVL

SEQ ID NO: 1684474 - protein, 20 aa, Staphylococcus aureus
LMHHMRSGLTLLDSVKIVST

SEQ ID NO: 1684475 - protein, 27 aa, Staphylococcus aureus
LNDSIHFYRDILLGKLLLTGKKTAYFE

SEQ ID NO: 1684476 - protein, 24 aa, Staphylococcus aureus
LNHLYPEFHIWDAYSIYQLEESRL

SEQ ID NO: 1684477 - protein, 21 aa, Staphylococcus aureus
LREAIQIRQLAPDATIFLMNA

SEQ ID NO: 1684478 - protein, 20 aa, Staphylococcus aureus
LTRYDSGVLSSLYICFSIKS

SEQ ID NO: 1684479 - protein, 24 aa, Staphylococcus aureus
LVEKLISMLGWDPQSPVPINDHGD

SEQ ID NO: 1684480 - protein, 17 aa, Staphylococcus aureus
MFDYSACKYPIGVVEDE

SEQ ID NO: 1684481 - protein, 21 aa, Staphylococcus aureus
MQGITYDAGILYWYTGDSNTA

SEQ ID NO: 1684482 - protein, 19 aa, Staphylococcus aureus
MTNMFWRQNISQMWVETEF

SEQ ID NO: 1684483 - protein, 25 aa, Staphylococcus aureus
NGLLLKKHGQKLYDAGLRRINVSLD

SEQ ID NO: 1684484 - protein, 24 aa, Staphylococcus aureus
NIAVKCIFFNQPYLKKKIELNQTI

SEQ ID NO: 1684485 - protein, 36 aa, Staphylococcus aureus
NIYSGYDQLLAFFNNRYWRSQFNPRGGWSPSGPRRY

SEQ ID NO: 1684486 - protein, 26 aa, Staphylococcus aureus
NKKNELIYQFNPKAQIYGFIVGSGLR

SEQ ID NO: 1684487 - protein, 20 aa, Staphylococcus aureus
NQELLCIYIDFDSGLRHSNM

SEQ ID NO: 1684488 - protein, 18 aa, Staphylococcus aureus
NVMVALREPALGPTFGIK

SEQ ID NO: 1684489 - protein, 26 aa, Staphylococcus aureus
NVSVNDFFTILIKYPSLEEQQKIGKF

SEQ ID NO: 1684490 - protein, 17 aa, Staphylococcus aureus
PFDVYPQDAIMPLPLEE

SEQ ID NO: 1684491 - protein, 20 aa, Staphylococcus aureus
PGHGLLLKDFMTYNVDDWWE

SEQ ID NO: 1684492 - protein, 25 aa, Staphylococcus aureus
PIDRQLFYQFIMKLPESVLRLKGYV

SEQ ID NO: 1684493 - protein, 20 aa, Staphylococcus aureus
QDKIDFQIGTLSKAIGVVGG

SEQ ID NO: 1684494 - protein, 25 aa, Staphylococcus aureus
QEHGLDMIVIDYLQLIQGSGSRASD

SEQ ID NO: 1684495 - protein, 18 aa, Staphylococcus aureus
QEYAPILYQIWKKKHKKA

SEQ ID NO: 1684496 - protein, 17 aa, Staphylococcus aureus
QGDILSENISIPASLGG

SEQ ID NO: 1684497 - protein, 24 aa, Staphylococcus aureus
QQRQLVCEILSQQQLRYFFSHNHS

SEQ ID NO: 1684498 - protein, 18 aa, Staphylococcus aureus
QRVAIMRAFMNNPKIILA

SEQ ID NO: 1684499 - protein, 20 aa, Staphylococcus aureus
RLMDSLINYLDVIEYTTLSE

SEQ ID NO: 1684500 - protein, 19 aa, Staphylococcus aureus
RPIIINFSKYELEKLFKRV

SEQ ID NO: 1684501 - protein, 27 aa, Staphylococcus aureus
RTVLKNIMFPLEIAGVPRRRAKQKALE

SEQ ID NO: 1684502 - protein, 23 aa, Staphylococcus aureus
SDLKKIKHSYLKKSFLEIVETLK

SEQ ID NO: 1684503 - protein, 19 aa, Staphylococcus aureus
SFRPEFLNRVDDIIVFHKL

SEQ ID NO: 1684504 - protein, 27 aa, Staphylococcus aureus
SGRSPSQLGFRYYVNRLLEQTSHQKTN

SEQ ID NO: 1684505 - protein, 24 aa, Staphylococcus aureus
SKIDILIVVNMFLTGFDSKVLNTL

SEQ ID NO: 1684506 - protein, 17 aa, Staphylococcus aureus
TFDAVIANPPYSAKWTA

SEQ ID NO: 1684507 - protein, 21 aa, Staphylococcus aureus
TGKWYFSIRYKDVYGNNKRKM

SEQ ID NO: 1684508 - protein, 17 aa, Staphylococcus aureus
TIYKPLLGEDCRRTMDI

SEQ ID NO: 1684509 - protein, 22 aa, Staphylococcus aureus
TMYHSPIRLLVVIQAPDYVVAR

SEQ ID NO: 1684510 - protein, 23 aa, Staphylococcus aureus
TTAKPLKTLMLLHGLSSDETTYM

SEQ ID NO: 1684511 - protein, 18 aa, Staphylococcus aureus
TVIDWYIGEYNPKPAWMQ

SEQ ID NO: 1684512 - protein, 19 aa, Staphylococcus aureus
TYCGIGTIGLYMAPHAKHV

SEQ ID NO: 1684513 - protein, 17 aa, Staphylococcus aureus
VDRFRVAYGHYIEDFPR

SEQ ID NO: 1684514 - protein, 25 aa, Staphylococcus aureus
VQDYNEWLIKQPGYTTNFLNIDDGL

SEQ ID NO: 1684515 - protein, 25 aa, Staphylococcus aureus
VTISYPLPDNQLLTQLFTELEEGAV

SEQ ID NO: 1684516 - protein, 19 aa, Staphylococcus aureus
YAVGLFFSKERILGSEHEV

SEQ ID NO: 1684517 - protein, 29 aa, Staphylococcus aureus
YIKKGLVEPFIVFYNQENIFYISNAVIDI

SEQ ID NO: 1684518 - protein, 22 aa, Staphylococcus aureus
YILKYVFANGIAREIIYALLEE

SEQ ID NO: 1684519 - protein, 25 aa, Staphylococcus aureus
YSNGYPLGAIKRLTRYDSGVLSSLY

SEQ ID NO: 1684520 - protein, 17 aa, Staphylococcus aureus
YVMTYKELATFLKVLSD

SEQ ID NO: 1684521 - protein, 18 aa, Staphylococcus aureus
AFKNDKIDFIWSHTLKSI

SEQ ID NO: 1684522 - protein, 21 aa, Staphylococcus aureus
AFLTAIADKMKALNGYFVIDE

SEQ ID NO: 1684523 - protein, 29 aa, Staphylococcus aureus
AIDFSNPNLLFPLLDEEFHLPLVVATTGE

SEQ ID NO: 1684524 - protein, 17 aa, Staphylococcus aureus
ANQHYLIHASNFDEACH

SEQ ID NO: 1684525 - protein, 17 aa, Staphylococcus aureus
ATKPTRIKLKWTPQIMH

SEQ ID NO: 1684526 - protein, 25 aa, Staphylococcus aureus
DDYNNFIMISYMKDKVNALYTNQNI

SEQ ID NO: 1684527 - protein, 22 aa, Staphylococcus aureus
DLMKIANDVRWLASGPRAGLAE

SEQ ID NO: 1684528 - protein, 20 aa, Staphylococcus aureus
DLSNRLIQMRKRRGEIDFDI

SEQ ID NO: 1684529 - protein, 18 aa, Staphylococcus aureus
DSNNKMLQRIYGTAFFDK

SEQ ID NO: 1684530 - protein, 21 aa, Staphylococcus aureus
DVPTFAICHGPQILIDTDDLK

SEQ ID NO: 1684531 - protein, 23 aa, Staphylococcus aureus
EAPMFKKILKKHQLLDDAFRATQ

SEQ ID NO: 1684532 - protein, 19 aa, Staphylococcus aureus
EFFILFMNIMYSKDFLKYR

SEQ ID NO: 1684533 - protein, 17 aa, Staphylococcus aureus
EGIIRAYGISSIRPNVI

SEQ ID NO: 1684534 - protein, 20 aa, Staphylococcus aureus
EIAHPFKQQLAPAGMGGIKF

SEQ ID NO: 1684535 - protein, 17 aa, Staphylococcus aureus
EILECILIEAPDLKNAA

SEQ ID NO: 1684536 - protein, 23 aa, Staphylococcus aureus
EKYGLFLDMGLGKTVSTLTAFSE

SEQ ID NO: 1684537 - protein, 21 aa, Staphylococcus aureus
EPFNQLGGYPYFDQIDPRTND

SEQ ID NO: 1684538 - protein, 21 aa, Staphylococcus aureus
ERHMWYIVRDVLDNIFDQLVL

SEQ ID NO: 1684539 - protein, 29 aa, Staphylococcus aureus
EYTKYKIYGTWYPFYKKNDGNLTKQFVEE

SEQ ID NO: 1684540 - protein, 17 aa, Staphylococcus aureus
FFEADEHWGTEFAKLYY

SEQ ID NO: 1684541 - protein, 20 aa, Staphylococcus aureus
FLTGRELLIANQLPVIVHEA

SEQ ID NO: 1684542 - protein, 17 aa, Staphylococcus aureus
FTFIGDGPTLNDCQQQV

SEQ ID NO: 1684543 - protein, 19 aa, Staphylococcus aureus
FTRFIRAKATLTSAGATVV

SEQ ID NO: 1684544 - protein, 17 aa, Staphylococcus aureus
FVIGPGNRFPHAASLAV

SEQ ID NO: 1684545 - protein, 17 aa, Staphylococcus aureus
GAYLIEALQGYSHRIYC

SEQ ID NO: 1684546 - protein, 32 aa, Staphylococcus aureus
GHAAPPEEILKSSPFVWFKDALDGYDYLVEQG

SEQ ID NO: 1684547 - protein, 24 aa, Staphylococcus aureus
GKKTAYFELAGLWIALNEEKDIPR

SEQ ID NO: 1684548 - protein, 18 aa, Staphylococcus aureus
GKKVILFAPTFRGNGHGT

SEQ ID NO: 1684549 - protein, 23 aa, Staphylococcus aureus
GKSTLLSAICRLIRFDNGEVKID

SEQ ID NO: 1684550 - protein, 17 aa, Staphylococcus aureus
GKYTADYLADKGVVPFL

SEQ ID NO: 1684551 - protein, 27 aa, Staphylococcus aureus
GLKVEGLYPYHIYTYIINELMGKPIEK

SEQ ID NO: 1684552 - protein, 19 aa, Staphylococcus aureus
GQFPRDFNIASSDDLLVCA

SEQ ID NO: 1684553 - protein, 17 aa, Staphylococcus aureus
GQPVLLGTVAVETSEYI

SEQ ID NO: 1684554 - protein, 19 aa, Staphylococcus aureus
GVVGKFVEFFGPGVQHLPL

SEQ ID NO: 1684555 - protein, 21 aa, Staphylococcus aureus
HQPSKLFLLNPDVVEMLIENQ

SEQ ID NO: 1684556 - protein, 17 aa, Staphylococcus aureus
HSLWHQYNNSIFYYYMV

SEQ ID NO: 1684557 - protein, 18 aa, Staphylococcus aureus
ICINPKYILFDEAISSLD

SEQ ID NO: 1684558 - protein, 19 aa, Staphylococcus aureus
IDEKLQWKWVKGIIEAYQE

SEQ ID NO: 1684559 - protein, 22 aa, Staphylococcus aureus
IEKSRLKALYLSVIDRIDIKKD

SEQ ID NO: 1684560 - protein, 21 aa, Staphylococcus aureus
IENQKYMFDYSACKYPIGVVE

SEQ ID NO: 1684561 - protein, 20 aa, Staphylococcus aureus
IEPRDSVFFVHELMGYNTEL

SEQ ID NO: 1684562 - protein, 19 aa, Staphylococcus aureus
IIVQTVPKSKLDFLANAPH

SEQ ID NO: 1684563 - protein, 21 aa, Staphylococcus aureus
INHGINLLDTAYIYGPERSEE

SEQ ID NO: 1684564 - protein, 28 aa, Staphylococcus aureus
IQVWKKPSSFVIKPLPKNKYPDSIEEST

SEQ ID NO: 1684565 - protein, 26 aa, Staphylococcus aureus
KAPGFGDRRKAMLEDLAILTGAQVIT

SEQ ID NO: 1684566 - protein, 33 aa, Staphylococcus aureus
KGEIEGIAYDRLWIHLIPVIKEQQLRIKKLEES

SEQ ID NO: 1684567 - protein, 17 aa, Staphylococcus aureus
KQLLRNGVDFMTMGNHT

SEQ ID NO: 1684568 - protein, 22 aa, Staphylococcus aureus
KQSEELINIIKLAIDQNIPYTV

SEQ ID NO: 1684569 - protein, 20 aa, Staphylococcus aureus
KRLSGQTVLFLGTGAIATRT

SEQ ID NO: 1684570 - protein, 24 aa, Staphylococcus aureus
KSAQMIIIDNYYLLLGGYNKTSNQ

SEQ ID NO: 1684571 - protein, 25 aa, Staphylococcus aureus
KTTTTERILYYTGRIHKIGETHEGA

SEQ ID NO: 1684572 - protein, 17 aa, Staphylococcus aureus
KYKQSLLQNGYYQDKLN

SEQ ID NO: 1684573 - protein, 19 aa, Staphylococcus aureus
KYTIAKFYKLYIERSNNGE

SEQ ID NO: 1684574 - protein, 23 aa, Staphylococcus aureus
LCKDTHRTIIRLSPPLVIDKEEI

SEQ ID NO: 1684575 - protein, 27 aa, Staphylococcus aureus
LDTALSIRMYYALFLNKPIITTDDTFT

SEQ ID NO: 1684576 - protein, 29 aa, Staphylococcus aureus
LEHSKAILNLPIRTWFDKAESEILARELR

SEQ ID NO: 1684577 - protein, 21 aa, Staphylococcus aureus
LEKDAYIVRLVFAGSTTTEPI

SEQ ID NO: 1684578 - protein, 19 aa, Staphylococcus aureus
LERISELCNVQISIFSVGP

SEQ ID NO: 1684579 - protein, 23 aa, Staphylococcus aureus
LGHMPLLMDFIQQHSIDPSVIFS

SEQ ID NO: 1684580 - protein, 28 aa, Staphylococcus aureus
LLTEKGALLKLDFITHSYPHDWRTKKPV

SEQ ID NO: 1684581 - protein, 19 aa, Staphylococcus aureus
LTEEKLNVPLIGFTGAPFT

SEQ ID NO: 1684582 - protein, 24 aa, Staphylococcus aureus
MAKRLLDFGVHPPTIYFPLNVEEG

SEQ ID NO: 1684583 - protein, 21 aa, Staphylococcus aureus
MGLQIRHYTVQSLKLLKTHFN

SEQ ID NO: 1684584 - protein, 17 aa, Staphylococcus aureus
MLSRLRPNGQFIDSSLI

SEQ ID NO: 1684585 - protein, 22 aa, Staphylococcus aureus
NKLSEYQLLTQFNPAFINKKIK

SEQ ID NO: 1684586 - protein, 27 aa, Staphylococcus aureus
NKSKHNLLQCLIFVNDMYLLSNPKSQN

SEQ ID NO: 1684587 - protein, 18 aa, Staphylococcus aureus
NTFDAVIANPPYSAKWTA

SEQ ID NO: 1684588 - protein, 21 aa, Staphylococcus aureus
PGVFGAAWLNDALHTEMIVDG

SEQ ID NO: 1684589 - protein, 25 aa, Staphylococcus aureus
PYPDNFDFTTLDKSFRENYGTLGLA

SEQ ID NO: 1684590 - protein, 25 aa, Staphylococcus aureus
QAQAILDMRLRRLTGLERDKIEAEY

SEQ ID NO: 1684591 - protein, 21 aa, Staphylococcus aureus
QFVSFLNFYYKKYNDEELRVA

SEQ ID NO: 1684592 - protein, 24 aa, Staphylococcus aureus
QKRSEKLLHGMWQFPMFESEHARR

SEQ ID NO: 1684593 - protein, 24 aa, Staphylococcus aureus
RDVATKAWFNTYLNIYAATTVNHL

SEQ ID NO: 1684594 - protein, 18 aa, Staphylococcus aureus
RELREGNFMKIVSLAPEV

SEQ ID NO: 1684595 - protein, 17 aa, Staphylococcus aureus
RFKGLKEWHFGLFEGES

SEQ ID NO: 1684596 - protein, 19 aa, Staphylococcus aureus
RGTAILITGGFKPSNKVIN

SEQ ID NO: 1684597 - protein, 21 aa, Staphylococcus aureus
RISLSIKDTLPTPFENIKGQF

SEQ ID NO: 1684598 - protein, 17 aa, Staphylococcus aureus
RLYEMFMGPLDAAIAWS

SEQ ID NO: 1684599 - protein, 26 aa, Staphylococcus aureus
SDDYRYFPEPDIVPLYIDDAWKERVR

SEQ ID NO: 1684600 - protein, 18 aa, Staphylococcus aureus
SELQLLDTKKMLVIAPKQ

SEQ ID NO: 1684601 - protein, 27 aa, Staphylococcus aureus
SKIFRLMNTPLLLFYKKEYLTGYYFEN

SEQ ID NO: 1684602 - protein, 24 aa, Staphylococcus aureus
SNTYSYNLISLMIEYLRFANCTQE

SEQ ID NO: 1684603 - protein, 23 aa, Staphylococcus aureus
SSEGFLKFLPKSEKYRIIYSYNM

SEQ ID NO: 1684604 - protein, 34 aa, Staphylococcus aureus
STYHFNDSPLFKFKLFQFADAAYILLDFHVSIFD

SEQ ID NO: 1684605 - protein, 26 aa, Staphylococcus aureus
TFIERYSQALIPPLIAFIQNYGIALE

SEQ ID NO: 1684606 - protein, 26 aa, Staphylococcus aureus
TISVDNAIWKVIDFQHVKPGKGSAFV

SEQ ID NO: 1684607 - protein, 18 aa, Staphylococcus aureus
TKQNLQHTLLPLADVVTP

SEQ ID NO: 1684608 - protein, 17 aa, Staphylococcus aureus
TLRLYEMFMGPLDAAIA

SEQ ID NO: 1684609 - protein, 18 aa, Staphylococcus aureus
TVIKPNISELYQLLNQPL

SEQ ID NO: 1684610 - protein, 34 aa, Staphylococcus aureus
TYGNAETFYPMPFLSPQTMWYYKSAFNTDQMKLI

SEQ ID NO: 1684611 - protein, 20 aa, Staphylococcus aureus
TYKKFLIQLKGRKFAHRTKS

SEQ ID NO: 1684612 - protein, 26 aa, Staphylococcus aureus
VADDNYKWLQILPEKKRYSITVMFDN

SEQ ID NO: 1684613 - protein, 17 aa, Staphylococcus aureus
VHIGVVFKITVSTNDVE

SEQ ID NO: 1684614 - protein, 31 aa, Staphylococcus aureus
VIRPVYLNQSTIPTFYIVNVGGGYLDGDRYR

SEQ ID NO: 1684615 - protein, 18 aa, Staphylococcus aureus
VSVATFTLAVNRTFTNAQ

SEQ ID NO: 1684616 - protein, 17 aa, Staphylococcus aureus
YFNQILVHTGQNYDYTL

SEQ ID NO: 1684617 - protein, 21 aa, Staphylococcus aureus
YLRSLAHNIDPIFQIGKGGIN

SEQ ID NO: 1684618 - protein, 21 aa, Staphylococcus aureus
YPAMEDFFLDIIIGKGDEARS

SEQ ID NO: 1684619 - protein, 18 aa, Staphylococcus aureus
YTIAKHYADDYLRRSGLN

SEQ ID NO: 1684620 - protein, 22 aa, Staphylococcus aureus
YYNIEPLVHITCRDRNLIGLQS

SEQ ID NO: 1684621 - protein, 23 aa, Staphylococcus aureus
AKKIAETLNLLYQLTGNQNGVKV

SEQ ID NO: 1684622 - protein, 17 aa, Staphylococcus aureus
AKRNLELTESIRLKSKK

SEQ ID NO: 1684623 - protein, 20 aa, Staphylococcus aureus
ALPGKYFIFKDLQIEEYQSK

SEQ ID NO: 1684624 - protein, 20 aa, Staphylococcus aureus
ALSINQLERLLKAIRDTFTI

SEQ ID NO: 1684625 - protein, 18 aa, Staphylococcus aureus
DDIPSTLPVFEKVTSGQL

SEQ ID NO: 1684626 - protein, 17 aa, Staphylococcus aureus
DGAAMMLVMSEDKAKEL

SEQ ID NO: 1684627 - protein, 24 aa, Staphylococcus aureus
DKDDPRFNNPTKPIGPFYTKEEVE

SEQ ID NO: 1684628 - protein, 18 aa, Staphylococcus aureus
DMVLGNYYLTLERKDAVN

SEQ ID NO: 1684629 - protein, 23 aa, Staphylococcus aureus
DNADYHVQVFKIGTGGLGGEIHL

SEQ ID NO: 1684630 - protein, 24 aa, Staphylococcus aureus
DNRHISLIADVFKAFQSLYNGHYN

SEQ ID NO: 1684631 - protein, 24 aa, Staphylococcus aureus
DVNEGDTFTFDKVLFVGGDSVKVG

SEQ ID NO: 1684632 - protein, 23 aa, Staphylococcus aureus
DYIRASINLFPFNTNGNKGIAVG

SEQ ID NO: 1684633 - protein, 29 aa, Staphylococcus aureus
EAQSQFNLPMRYIWGIYEPQSDDQNMNET

SEQ ID NO: 1684634 - protein, 17 aa, Staphylococcus aureus
EEYVNVRGVPLRLVDTA

SEQ ID NO: 1684635 - protein, 31 aa, Staphylococcus aureus
EKTLNLIDILNPYLCIIFCNSRDNANDLARS

SEQ ID NO: 1684636 - protein, 24 aa, Staphylococcus aureus
EMLTEREMEILLLIAKGYSNQEIA

SEQ ID NO: 1684637 - protein, 17 aa, Staphylococcus aureus
ENFVKYIKENAGPSWKY

SEQ ID NO: 1684638 - protein, 26 aa, Staphylococcus aureus
ERLADSEVLVCTVIGFPLGASTTATK

SEQ ID NO: 1684639 - protein, 23 aa, Staphylococcus aureus
ERLKGIFAWGFRFNSDEPEEGLP

SEQ ID NO: 1684640 - protein, 17 aa, Staphylococcus aureus
ERRFFNMAMTLEQWEFG

SEQ ID NO: 1684641 - protein, 21 aa, Staphylococcus aureus
ETGKEDFYFIKLNQFNDDTVT

SEQ ID NO: 1684642 - protein, 17 aa, Staphylococcus aureus
EVVFDFFDQLKSNTKGY

SEQ ID NO: 1684643 - protein, 17 aa, Staphylococcus aureus
FFGAYDLALYKNNTFIG

SEQ ID NO: 1684644 - protein, 17 aa, Staphylococcus aureus
FPAYHRPTSPDYTVGTE

SEQ ID NO: 1684645 - protein, 22 aa, Staphylococcus aureus
FQDDGYRIGYGGGYYDRFLANY

SEQ ID NO: 1684646 - protein, 21 aa, Staphylococcus aureus
FTNDFKIDGLNRATATYKFAG

SEQ ID NO: 1684647 - protein, 31 aa, Staphylococcus aureus
GEIEGIAYDRLWVHLIPIIKNQQSKIEKLEE

SEQ ID NO: 1684648 - protein, 26 aa, Staphylococcus aureus
GFKDQEVIWLYQYFSDISIAPTTYTL

SEQ ID NO: 1684649 - protein, 29 aa, Staphylococcus aureus
GGHQWKDWKPLLSDILLYFLRKNTDDQHY

SEQ ID NO: 1684650 - protein, 23 aa, Staphylococcus aureus
GGYYDRFLANYQTKTISLLYDFQ

SEQ ID NO: 1684651 - protein, 17 aa, Staphylococcus aureus
GKSTLFNAITKAGALAA

SEQ ID NO: 1684652 - protein, 26 aa, Staphylococcus aureus
GLLIGEALMRCDNLSEFLPQLKMQKV

SEQ ID NO: 1684653 - protein, 23 aa, Staphylococcus aureus
GNPQPRMFRLLEDDALINRMGFN

SEQ ID NO: 1684654 - protein, 27 aa, Staphylococcus aureus
GRKSYQYDWFYHSKAWKKLREIALDRD

SEQ ID NO: 1684655 - protein, 24 aa, Staphylococcus aureus
GTENLAQIVGMAKALQLAEKNRDD

SEQ ID NO: 1684656 - protein, 22 aa, Staphylococcus aureus
GYGQFINDLYLNLISDLANING

SEQ ID NO: 1684657 - protein, 17 aa, Staphylococcus aureus
HKANEVGYLLYRPTENT

SEQ ID NO: 1684658 - protein, 18 aa, Staphylococcus aureus
HLLQTVWGYDYFGDVRTV

SEQ ID NO: 1684659 - protein, 19 aa, Staphylococcus aureus
HQQIELIKRLVSYVPKIEL

SEQ ID NO: 1684660 - protein, 26 aa, Staphylococcus aureus
HYSNLRQYINISPYPATAKLLEGVTI

SEQ ID NO: 1684661 - protein, 17 aa, Staphylococcus aureus
ICNLISPTSGELYFKGK

SEQ ID NO: 1684662 - protein, 20 aa, Staphylococcus aureus
IFTDKYGVRWMLHGQDYTAI

SEQ ID NO: 1684663 - protein, 21 aa, Staphylococcus aureus
IGINPNWLTKPILGEIFKEIV

SEQ ID NO: 1684664 - protein, 20 aa, Staphylococcus aureus
IKDRLLFHPRFEKELRAQGI

SEQ ID NO: 1684665 - protein, 21 aa, Staphylococcus aureus
IKKYNSHIKRFIFASSAAVYG

SEQ ID NO: 1684666 - protein, 21 aa, Staphylococcus aureus
IKVLVETLPDFKFHIAAITEM

SEQ ID NO: 1684667 - protein, 17 aa, Staphylococcus aureus
INRLRMEILNPTKELDT

SEQ ID NO: 1684668 - protein, 23 aa, Staphylococcus aureus
IPTARDLKLPEHHSYIISYNGSK

SEQ ID NO: 1684669 - protein, 18 aa, Staphylococcus aureus
ITLLVEMNVSLKAIMKRV

SEQ ID NO: 1684670 - protein, 31 aa, Staphylococcus aureus
IWRHLSKIWYTDRQLLINNLISQAIPVIKYP

SEQ ID NO: 1684671 - protein, 29 aa, Staphylococcus aureus
KDHSSIEIELPFADQFWGGKMGIFTDKYG

SEQ ID NO: 1684672 - protein, 28 aa, Staphylococcus aureus
KEIDHLIDYFILPLRQIEQVSIACSKII

SEQ ID NO: 1684673 - protein, 25 aa, Staphylococcus aureus
KKSDDILINLYIETYEFYCRLRDEL

SEQ ID NO: 1684674 - protein, 20 aa, Staphylococcus aureus
KLLYRHMGPQNWWPADNDIE

SEQ ID NO: 1684675 - protein, 23 aa, Staphylococcus aureus
KPYIDYQDVLNWIIKMNEHYVVE

SEQ ID NO: 1684676 - protein, 23 aa, Staphylococcus aureus
KSTLINILGFIDREYHGEYLFEG

SEQ ID NO: 1684677 - protein, 17 aa, Staphylococcus aureus
KTAYDRVEWFRNGINGL

SEQ ID NO: 1684678 - protein, 17 aa, Staphylococcus aureus
KVPEYVKTSLAPGSKVV

SEQ ID NO: 1684679 - protein, 23 aa, Staphylococcus aureus
KYDKIEIVGLMTMAPLTDDEAYI

SEQ ID NO: 1684680 - protein, 20 aa, Staphylococcus aureus
KYLLQNGKWGYFNREFFDLL

SEQ ID NO: 1684681 - protein, 18 aa, Staphylococcus aureus
LADYLFNNPGELLKYNVI

SEQ ID NO: 1684682 - protein, 35 aa, Staphylococcus aureus
LEKMIAPFYRKWDHQVFEFYLEKFDLPINKSIKTF

SEQ ID NO: 1684683 - protein, 25 aa, Staphylococcus aureus
LENKMLKRWNSSYVDRGFIFTTKKG

SEQ ID NO: 1684684 - protein, 19 aa, Staphylococcus aureus
LEREAILKGYNFISVLGWP

SEQ ID NO: 1684685 - protein, 18 aa, Staphylococcus aureus
LHTALVNGGVFVYVPKNV

SEQ ID NO: 1684686 - protein, 19 aa, Staphylococcus aureus
LIDALDNKEILACGLDVLA

SEQ ID NO: 1684687 - protein, 18 aa, Staphylococcus aureus
LIQGILKIYDLTLTTKSN

SEQ ID NO: 1684688 - protein, 33 aa, Staphylococcus aureus
LLRARRTYAFTELFLFELRMQWLNRLEKSSDEA

SEQ ID NO: 1684689 - protein, 17 aa, Staphylococcus aureus
LMIQRFGTTYVLTTKKE

SEQ ID NO: 1684690 - protein, 27 aa, Staphylococcus aureus
LREEGIDCTFIAVKLPYGVQKDADEVD

SEQ ID NO: 1684691 - protein, 21 aa, Staphylococcus aureus
LRLLEIIKKYNSHIKRFIFAS

SEQ ID NO: 1684692 - protein, 20 aa, Staphylococcus aureus
LTNCQILIQNKYLTGEVLDD

SEQ ID NO: 1684693 - protein, 22 aa, Staphylococcus aureus
MGTYDVIVGINLLREGIDIPEV

SEQ ID NO: 1684694 - protein, 24 aa, Staphylococcus aureus
MIHPNMATMLAFITTDASIESNTL

SEQ ID NO: 1684695 - protein, 26 aa, Staphylococcus aureus
MKEYKQKYLILRIFNVSGKEPQFYFI

SEQ ID NO: 1684696 - protein, 17 aa, Staphylococcus aureus
MKIAGDFNAYNALAAYT

SEQ ID NO: 1684697 - protein, 22 aa, Staphylococcus aureus
NEYFNWLKQNYIFKELDSSTEI

SEQ ID NO: 1684698 - protein, 18 aa, Staphylococcus aureus
NFGLMPQGLEVFRVLYHK

SEQ ID NO: 1684699 - protein, 17 aa, Staphylococcus aureus
NFKDFRHSFSQKAPEGE

SEQ ID NO: 1684700 - protein, 19 aa, Staphylococcus aureus
NGLCLKWVAPGTRGVPDRI

SEQ ID NO: 1684701 - protein, 25 aa, Staphylococcus aureus
NILQAKRIILLAFGEKKRAAITHLL

SEQ ID NO: 1684702 - protein, 17 aa, Staphylococcus aureus
NLSYLFIAHDLSVVKHI

SEQ ID NO: 1684703 - protein, 18 aa, Staphylococcus aureus
NMLKRRDGNRYIHIQSTD

SEQ ID NO: 1684704 - protein, 23 aa, Staphylococcus aureus
NNKFIISSWLGTMGCGLPGAMAS

SEQ ID NO: 1684705 - protein, 35 aa, Staphylococcus aureus
PELRNMKIFPRPIDNTLPIWRAVGGPPASAIKAGK

SEQ ID NO: 1684706 - protein, 23 aa, Staphylococcus aureus
QKQIVFSPEILSWIEQRSLNIHR

SEQ ID NO: 1684707 - protein, 18 aa, Staphylococcus aureus
QRVAIARAIINNPKFIIA

SEQ ID NO: 1684708 - protein, 20 aa, Staphylococcus aureus
QRVLLALINKGMVREEAYDK

SEQ ID NO: 1684709 - protein, 21 aa, Staphylococcus aureus
QTIINYLRRINRKTALLIQLS

SEQ ID NO: 1684710 - protein, 17 aa, Staphylococcus aureus
RAQDYIRLLGHVKLDEI

SEQ ID NO: 1684711 - protein, 20 aa, Staphylococcus aureus
RASKKFTIVPSWETYAKEAD

SEQ ID NO: 1684712 - protein, 26 aa, Staphylococcus aureus
RGIIDKFRLPYLLGKADYIFVDDFHP

SEQ ID NO: 1684713 - protein, 18 aa, Staphylococcus aureus
RIFISLAVKFSKARLIDN

SEQ ID NO: 1684714 - protein, 18 aa, Staphylococcus aureus
RIHTPSQMGIRKPEFSSA

SEQ ID NO: 1684715 - protein, 17 aa, Staphylococcus aureus
RLLPKAKRLDIVSYEEM

SEQ ID NO: 1684716 - protein, 19 aa, Staphylococcus aureus
RLLPKAKRLDIVSYEEMME

SEQ ID NO: 1684717 - protein, 26 aa, Staphylococcus aureus
RLTSPNPFHLIYSILSKHQSASIPDD

SEQ ID NO: 1684718 - protein, 26 aa, Staphylococcus aureus
RLVDTKTLFLEYRKKLQDVYTDVEDV

SEQ ID NO: 1684719 - protein, 17 aa, Staphylococcus aureus
RQLLQIINEPLAAPSAN

SEQ ID NO: 1684720 - protein, 26 aa, Staphylococcus aureus
RSNNKYVTSFLLMPTVIVVNSDLQGD

SEQ ID NO: 1684721 - protein, 21 aa, Staphylococcus aureus
SDIVYIPYKTPILEEAERKGN

SEQ ID NO: 1684722 - protein, 30 aa, Staphylococcus aureus
SHSKEILKLPIRTWFDKYESEIMAKELESG

SEQ ID NO: 1684723 - protein, 18 aa, Staphylococcus aureus
SIALQLVRRFPDIERRVQ

SEQ ID NO: 1684724 - protein, 19 aa, Staphylococcus aureus
SILKFLEEPPDNTIAILLS

SEQ ID NO: 1684725 - protein, 23 aa, Staphylococcus aureus
SKEKIIIFTSHLPNTILELSENI

SEQ ID NO: 1684726 - protein, 17 aa, Staphylococcus aureus
SKHNLIQGILKIYDLTL

SEQ ID NO: 1684727 - protein, 31 aa, Staphylococcus aureus
SKQAPVYLYPNTDKVPGLNRFAFTLSNADNA

SEQ ID NO: 1684728 - protein, 17 aa, Staphylococcus aureus
SLAIFKEATQWLDAYFK

SEQ ID NO: 1684729 - protein, 26 aa, Staphylococcus aureus
SLNADQLVMLKLTIPTEANLYKDLAE

SEQ ID NO: 1684730 - protein, 25 aa, Staphylococcus aureus
SLRGGIIDIFPLIGEPIRIELFDTE

SEQ ID NO: 1684731 - protein, 24 aa, Staphylococcus aureus
SMFYTFKLMKNNVMPSLLLPELSG

SEQ ID NO: 1684732 - protein, 27 aa, Staphylococcus aureus
SNWQVNPMLRLLKTDVLTASYLKSAYL

SEQ ID NO: 1684733 - protein, 19 aa, Staphylococcus aureus
SPAELPFLSFDHDKILSSD

SEQ ID NO: 1684734 - protein, 24 aa, Staphylococcus aureus
SRMKMQGYMPVKRIEKPVFQEQKD

SEQ ID NO: 1684735 - protein, 38 aa, Staphylococcus aureus
TDDERLVRDFLHDAFFFINIAEIILFIEKQYGIDEKLQ

SEQ ID NO: 1684736 - protein, 38 aa, Staphylococcus aureus
TDDERLVRDFLHDAFFFINIAEIILFIEKQYGIDEQRQ

SEQ ID NO: 1684737 - protein, 17 aa, Staphylococcus aureus
TFSKLIERLTGETYNNI

SEQ ID NO: 1684738 - protein, 26 aa, Staphylococcus aureus
TGDTLDHLWRVTSLNQAIALGIDDRK

SEQ ID NO: 1684739 - protein, 17 aa, Staphylococcus aureus
TGRIFISLAVKFSKARL

SEQ ID NO: 1684740 - protein, 23 aa, Staphylococcus aureus
TGRPIYHAIVWQSRQTQSICSEL

SEQ ID NO: 1684741 - protein, 19 aa, Staphylococcus aureus
THIELPEHAYLSCYPNASL

SEQ ID NO: 1684742 - protein, 20 aa, Staphylococcus aureus
TILVTTLQLLGAQVGWHIPN

SEQ ID NO: 1684743 - protein, 18 aa, Staphylococcus aureus
TLANVYLALDNELELLPV

SEQ ID NO: 1684744 - protein, 37 aa, Staphylococcus aureus
TQDTQNALDFPLPKAFRDAGWFFDVLPGHYNGALRQV

SEQ ID NO: 1684745 - protein, 24 aa, Staphylococcus aureus
TTAIFPKLVFSIKKGTNFSPQDPN

SEQ ID NO: 1684746 - protein, 26 aa, Staphylococcus aureus
VAKRLDKIVAILLDTKGPEIRTHNMK

SEQ ID NO: 1684747 - protein, 26 aa, Staphylococcus aureus
VCNHVLYHLGYLQDKHYPHLRFGFIH

SEQ ID NO: 1684748 - protein, 23 aa, Staphylococcus aureus
VIEGFGLTALPNAIQLSKANVVD

SEQ ID NO: 1684749 - protein, 27 aa, Staphylococcus aureus
VKVAGTWHYICLFIDLFNREIVGYSAG

SEQ ID NO: 1684750 - protein, 26 aa, Staphylococcus aureus
VMKEGLKTLLMNWFNTEKINIDVEAS

SEQ ID NO: 1684751 - protein, 26 aa, Staphylococcus aureus
VTLVDRMPFHGLKPEFYALAAGTKSD

SEQ ID NO: 1684752 - protein, 17 aa, Staphylococcus aureus
VYNYIHIGNARPAINYD

SEQ ID NO: 1684753 - protein, 24 aa, Staphylococcus aureus
WGYAKSILNTWLNANLKSIEQVRA

SEQ ID NO: 1684754 - protein, 19 aa, Staphylococcus aureus
WVRSFKLRGAYNAISVLSD

SEQ ID NO: 1684755 - protein, 17 aa, Staphylococcus aureus
YIEKLLLEPNGLIRMYL

SEQ ID NO: 1684756 - protein, 18 aa, Staphylococcus aureus
YNRRYLSGFTGTSGALII

SEQ ID NO: 1684757 - protein, 17 aa, Staphylococcus aureus
YPYYASGGFIHYCEYPK

SEQ ID NO: 1684758 - protein, 21 aa, Staphylococcus aureus
YQYMGDSMFIGRPVHIMALTI

SEQ ID NO: 1684759 - protein, 18 aa, Staphylococcus aureus
YVAVWFRQERRDGTFRTV

SEQ ID NO: 1684760 - protein, 21 aa, Staphylococcus aureus
AFLTAIADKMKAINGYFVIDE

SEQ ID NO: 1684761 - protein, 23 aa, Staphylococcus aureus
AKDNLYLICSLYNRKIDQITIEK

SEQ ID NO: 1684762 - protein, 18 aa, Staphylococcus aureus
ALDLLGLATLSLLDTFSC

SEQ ID NO: 1684763 - protein, 21 aa, Staphylococcus aureus
APQCAGIIHTDFERGFIRAEV

SEQ ID NO: 1684764 - protein, 24 aa, Staphylococcus aureus
AQHPQYVVRPFIDKIKHFQETANR

SEQ ID NO: 1684765 - protein, 32 aa, Staphylococcus aureus
AVQTSKPMIRKGPNIKLPSVSLLEEPQVIEPD

SEQ ID NO: 1684766 - protein, 23 aa, Staphylococcus aureus
AWRRYFHQFPELSDKEFKTTQKI

SEQ ID NO: 1684767 - protein, 17 aa, Staphylococcus aureus
CINPKYILFDEAISSLD

SEQ ID NO: 1684768 - protein, 27 aa, Staphylococcus aureus
DAYHTDYFKPYNPAFRKSSMPDGLHPN

SEQ ID NO: 1684769 - protein, 20 aa, Staphylococcus aureus
DFHHFVKSLKTKRYTYTHIQ

SEQ ID NO: 1684770 - protein, 26 aa, Staphylococcus aureus
DGPGLRYILFTQGCLLRCLYCHNPDT

SEQ ID NO: 1684771 - protein, 26 aa, Staphylococcus aureus
DHGIVFNASLPLYKDAIHQKGSMRSN

SEQ ID NO: 1684772 - protein, 19 aa, Staphylococcus aureus
DIAMVFQNYALYPHMTVFE

SEQ ID NO: 1684773 - protein, 25 aa, Staphylococcus aureus
DKDHFNFFSLFTFSEPIEQVVTHFL

SEQ ID NO: 1684774 - protein, 24 aa, Staphylococcus aureus
DKEKLADWHIGLPEIVQLQYDFEQ

SEQ ID NO: 1684775 - protein, 18 aa, Staphylococcus aureus
DKWVYEMLGMDSTCPKDV

SEQ ID NO: 1684776 - protein, 18 aa, Staphylococcus aureus
DLGDIFHSVLKYISERIN

SEQ ID NO: 1684777 - protein, 26 aa, Staphylococcus aureus
DPMAKIIRQKLKKLGIRKGIPVVFSD

SEQ ID NO: 1684778 - protein, 22 aa, Staphylococcus aureus
EATAYIFIKMVQQMKELGVLNH

SEQ ID NO: 1684779 - protein, 20 aa, Staphylococcus aureus
EDLWELYRGLANVRPALPVS

SEQ ID NO: 1684780 - protein, 24 aa, Staphylococcus aureus
EEDLDPTFMWHLAFAYGQEERDKE

SEQ ID NO: 1684781 - protein, 21 aa, Staphylococcus aureus
EFDLLALRKSVIRWCELLLTN

SEQ ID NO: 1684782 - protein, 25 aa, Staphylococcus aureus
EGSKIYLSAIYDLGAKRIVSYELGP

SEQ ID NO: 1684783 - protein, 25 aa, Staphylococcus aureus
EHNKHKIWLGVWEHNPRAQAFYKRH

SEQ ID NO: 1684784 - protein, 21 aa, Staphylococcus aureus
EIQNRIIPRILKRTNLIGQSQ

SEQ ID NO: 1684785 - protein, 31 aa, Staphylococcus aureus
EKLRRHMSFLMRKGSLYLPCNGNLLIHGCIP

SEQ ID NO: 1684786 - protein, 17 aa, Staphylococcus aureus
EKVFGKPVVFTDAAVKP

SEQ ID NO: 1684787 - protein, 25 aa, Staphylococcus aureus
EQEKKLWLHIKLDTGMGRLGIKDTN

SEQ ID NO: 1684788 - protein, 28 aa, Staphylococcus aureus
EQHIDLIDMVVVNLYPFQQTVANPDVTM

SEQ ID NO: 1684789 - protein, 22 aa, Staphylococcus aureus
ETDGYIMFGSDENYKYGAGLRF

SEQ ID NO: 1684790 - protein, 17 aa, Staphylococcus aureus
EVVESFRNSGNKPSWMI

SEQ ID NO: 1684791 - protein, 27 aa, Staphylococcus aureus
FADIKTYIFYHLFDTYIIDYSMASATG

SEQ ID NO: 1684792 - protein, 19 aa, Staphylococcus aureus
FDNLKWLGLDWDESVDKDN

SEQ ID NO: 1684793 - protein, 18 aa, Staphylococcus aureus
FEAIFTELRNRDITFIAA

SEQ ID NO: 1684794 - protein, 25 aa, Staphylococcus aureus
FEDQEVIWLYQYFSDISIAPTTYTL

SEQ ID NO: 1684795 - protein, 22 aa, Staphylococcus aureus
FKERFDLNCYLTLLDVLDSHNI

SEQ ID NO: 1684796 - protein, 22 aa, Staphylococcus aureus
FKQDILAVKVLAQLFSKIKPDV

SEQ ID NO: 1684797 - protein, 24 aa, Staphylococcus aureus
FKQDILAVKVLAQLFSKIKPDVIH

SEQ ID NO: 1684798 - protein, 19 aa, Staphylococcus aureus
FNILLNHPLIDEEVANSLI

SEQ ID NO: 1684799 - protein, 17 aa, Staphylococcus aureus
FPVVGQAVSASISYYFM

SEQ ID NO: 1684800 - protein, 20 aa, Staphylococcus aureus
FTILRSYQPEMYGEKLDLAL

SEQ ID NO: 1684801 - protein, 32 aa, Staphylococcus aureus
GEVQGVAQLLFKKVPKLPYTLCYISRGFVVDY

SEQ ID NO: 1684802 - protein, 17 aa, Staphylococcus aureus
GQRYIIERILHTNDEKH

SEQ ID NO: 1684803 - protein, 25 aa, Staphylococcus aureus
GQTPQSFNIKLLQDSYRALSSAQKE

SEQ ID NO: 1684804 - protein, 23 aa, Staphylococcus aureus
GQYRGIATWRYDQERQRLIGTIE

SEQ ID NO: 1684805 - protein, 20 aa, Staphylococcus aureus
GRELLLDYQFVEKIKDGRED

SEQ ID NO: 1684806 - protein, 19 aa, Staphylococcus aureus
GTFSPLLLDTLYHLNETTY

SEQ ID NO: 1684807 - protein, 20 aa, Staphylococcus aureus
GVYATDPRLLPKAKRLDIVS

SEQ ID NO: 1684808 - protein, 23 aa, Staphylococcus aureus
GYPIVLIHTVLDNYSVFNKLAAQ

SEQ ID NO: 1684809 - protein, 17 aa, Staphylococcus aureus
GYSQHFPSVFALIGSHS

SEQ ID NO: 1684810 - protein, 19 aa, Staphylococcus aureus
HARENHLKIIASCSFAKHM

SEQ ID NO: 1684811 - protein, 33 aa, Staphylococcus aureus
HDINHYIQYLIQLGYPLDMITDLDFETLYQYML

SEQ ID NO: 1684812 - protein, 21 aa, Staphylococcus aureus
HDKKFILMTAHRRENIGKPME

SEQ ID NO: 1684813 - protein, 21 aa, Staphylococcus aureus
HGQTLFNFKGLIQGFGDSPLT

SEQ ID NO: 1684814 - protein, 17 aa, Staphylococcus aureus
HSIQNEVLHLRRIKIAD

SEQ ID NO: 1684815 - protein, 21 aa, Staphylococcus aureus
IDPQFYIFHNNYKKFTILTDT

SEQ ID NO: 1684816 - protein, 17 aa, Staphylococcus aureus
IDTIRKVAKRLDKIVAI

SEQ ID NO: 1684817 - protein, 18 aa, Staphylococcus aureus
IEENKYVFVLKHSETCPI

SEQ ID NO: 1684818 - protein, 19 aa, Staphylococcus aureus
IENIIFKLADQGVAIMWIT

SEQ ID NO: 1684819 - protein, 19 aa, Staphylococcus aureus
IETIMSQFNLIDNRPESLL

SEQ ID NO: 1684820 - protein, 17 aa, Staphylococcus aureus
IFERSREGRYAYSLPIS

SEQ ID NO: 1684821 - protein, 23 aa, Staphylococcus aureus
IHPNMATMLAFITTDASIESNTL

SEQ ID NO: 1684822 - protein, 17 aa, Staphylococcus aureus
IKCNYVLMTYYNIICHY

SEQ ID NO: 1684823 - protein, 30 aa, Staphylococcus aureus
IKDGTMILKPAFRDYLLKLVEAHDIEHQYY

SEQ ID NO: 1684824 - protein, 22 aa, Staphylococcus aureus
ILRRHISYLMQQSDLFGETIED

SEQ ID NO: 1684825 - protein, 18 aa, Staphylococcus aureus
IPFAARHFHYFASVIETE

SEQ ID NO: 1684826 - protein, 33 aa, Staphylococcus aureus
IQLIKYCSSKYTRSKLRRALPEQYVFIVEELLY

SEQ ID NO: 1684827 - protein, 24 aa, Staphylococcus aureus
IQQQGLDLQTYFQISGQDESQLRE

SEQ ID NO: 1684828 - protein, 30 aa, Staphylococcus aureus
IREADVILYDRLVNPLILQYANLTTEIIDV

SEQ ID NO: 1684829 - protein, 39 aa, Staphylococcus aureus
IRGKGVMVVAPLEILDPFKGILKFQLPNDVIKRDGSYQA

SEQ ID NO: 1684830 - protein, 22 aa, Staphylococcus aureus
ITLTKQNQWLDSLKFLVKCIEE

SEQ ID NO: 1684831 - protein, 27 aa, Staphylococcus aureus
KEIDHLIDYFILPLRQIEQVSIARSKI

SEQ ID NO: 1684832 - protein, 17 aa, Staphylococcus aureus
KHKVIFDTKNVVKSSFE

SEQ ID NO: 1684833 - protein, 21 aa, Staphylococcus aureus
KHSKPFLKQFPTSGEHVLMGP

SEQ ID NO: 1684834 - protein, 20 aa, Staphylococcus aureus
KKYNSHIKRFIFASSAAVYG

SEQ ID NO: 1684835 - protein, 22 aa, Staphylococcus aureus
KLQTYLTPHFISFEIVYEAMDL

SEQ ID NO: 1684836 - protein, 26 aa, Staphylococcus aureus
KNKYDKVYIVPLDKLTKQELLELCES

SEQ ID NO: 1684837 - protein, 17 aa, Staphylococcus aureus
KSIVFPTVPRGTGRVRN

SEQ ID NO: 1684838 - protein, 17 aa, Staphylococcus aureus
KSSILQQKAINDVAPFF

SEQ ID NO: 1684839 - protein, 28 aa, Staphylococcus aureus
KTIYEISKRTVLFLIQKDITVYNKTIDC

SEQ ID NO: 1684840 - protein, 25 aa, Staphylococcus aureus
KVMQDSFKLLVTYRTKLQGGYGQFI

SEQ ID NO: 1684841 - protein, 25 aa, Staphylococcus aureus
LAKQLAIDLFGNKEALIRLDMSEYS

SEQ ID NO: 1684842 - protein, 24 aa, Staphylococcus aureus
LASPNNILGISYLKAIAKHAKNIN

SEQ ID NO: 1684843 - protein, 26 aa, Staphylococcus aureus
LDEKRLNYVGFYRLHHKYNKKVMMAK

SEQ ID NO: 1684844 - protein, 18 aa, Staphylococcus aureus
LDHSLNLKNGFYLNEFLK

SEQ ID NO: 1684845 - protein, 26 aa, Staphylococcus aureus
LDYYAGLSFRTLVPKYPAMSPHIKLS

SEQ ID NO: 1684846 - protein, 33 aa, Staphylococcus aureus
LFESTYFDHQILRRLVAFMYETPSTIIDYFQKD

SEQ ID NO: 1684847 - protein, 17 aa, Staphylococcus aureus
LIEFCRLAQLPKNENIQ

SEQ ID NO: 1684848 - protein, 17 aa, Staphylococcus aureus
LIESLFIQFHSQCLKQN

SEQ ID NO: 1684849 - protein, 19 aa, Staphylococcus aureus
LIEVQALVTPTTFNNPRRM

SEQ ID NO: 1684850 - protein, 18 aa, Staphylococcus aureus
LINDVVIPQLPLADINQY

SEQ ID NO: 1684851 - protein, 24 aa, Staphylococcus aureus
LKGKKAIIYFYPRDNTPTCTTEAC

SEQ ID NO: 1684852 - protein, 25 aa, Staphylococcus aureus
LLTEGMVLAIEPFISSNASFVTEGK

SEQ ID NO: 1684853 - protein, 17 aa, Staphylococcus aureus
LLVKTLFIDEIKRQLTY

SEQ ID NO: 1684854 - protein, 29 aa, Staphylococcus aureus
LNPAKNQCYFIPYGNKMQLQRSYHGNVMM

SEQ ID NO: 1684855 - protein, 26 aa, Staphylococcus aureus
LQNQICFKTIYRWINSNMINFELISC

SEQ ID NO: 1684856 - protein, 26 aa, Staphylococcus aureus
LRSLVTTEFIWSVPGHFDIYGPQILI

SEQ ID NO: 1684857 - protein, 17 aa, Staphylococcus aureus
LSMVTYADKLKSLIKKE

SEQ ID NO: 1684858 - protein, 17 aa, Staphylococcus aureus
MQFFGARANLAKTLLYA

SEQ ID NO: 1684859 - protein, 26 aa, Staphylococcus aureus
NRDINSYFLIITYRIDKESKQLAAIK

SEQ ID NO: 1684860 - protein, 18 aa, Staphylococcus aureus
NRPSIEALNYYATRFMLT

SEQ ID NO: 1684861 - protein, 19 aa, Staphylococcus aureus
PDNFILGFRATPEETRGSD

SEQ ID NO: 1684862 - protein, 18 aa, Staphylococcus aureus
PDREGEAIAWHLSKILEL

SEQ ID NO: 1684863 - protein, 20 aa, Staphylococcus aureus
PEGFINFCHKRLLFVDTKPN

SEQ ID NO: 1684864 - protein, 23 aa, Staphylococcus aureus
PGNGKFLYSPFSIFDNESIIDFF

SEQ ID NO: 1684865 - protein, 20 aa, Staphylococcus aureus
PIEWQLQVDLWLKNGKSKLV

SEQ ID NO: 1684866 - protein, 23 aa, Staphylococcus aureus
QDGIICYIQFQMKYLADKFDDAH

SEQ ID NO: 1684867 - protein, 23 aa, Staphylococcus aureus
QDGIICYIQFQMKYLADKFDDVH

SEQ ID NO: 1684868 - protein, 17 aa, Staphylococcus aureus
QFVCVISMSGPDMETKV

SEQ ID NO: 1684869 - protein, 18 aa, Staphylococcus aureus
QIAEKRFIARKAASLIED

SEQ ID NO: 1684870 - protein, 17 aa, Staphylococcus aureus
QKALNDVAPFFNVSPEQ

SEQ ID NO: 1684871 - protein, 28 aa, Staphylococcus aureus
QLSLYHSLPLLKYPSFELFLENITEFNA

SEQ ID NO: 1684872 - protein, 38 aa, Staphylococcus aureus
QQKGIVFLMIRFKTLDEVYLLPYSKFEIFWKRYKDNIK

SEQ ID NO: 1684873 - protein, 20 aa, Staphylococcus aureus
QRFLIYGYARGTGEWINMIN

SEQ ID NO: 1684874 - protein, 26 aa, Staphylococcus aureus
QRSTNFSIVWILPISSIDNMPIKDMV

SEQ ID NO: 1684875 - protein, 34 aa, Staphylococcus aureus
QSNSGIIDRYFFKSLYYRHNSIMYEFATEAPGFT

SEQ ID NO: 1684876 - protein, 19 aa, Staphylococcus aureus
QTKWFPVVGQAVSASISYY

SEQ ID NO: 1684877 - protein, 24 aa, Staphylococcus aureus
QVDKFIHYTPAYMYHEPLVRLAKK

SEQ ID NO: 1684878 - protein, 20 aa, Staphylococcus aureus
RAGTLLRYYTGLLEHSKVQP

SEQ ID NO: 1684879 - protein, 27 aa, Staphylococcus aureus
REIGYSIVPLKLYLKHGHCKVLLGVAR

SEQ ID NO: 1684880 - protein, 24 aa, Staphylococcus aureus
RENYEALLIYYKNSIENPIVDGAC

SEQ ID NO: 1684881 - protein, 17 aa, Staphylococcus aureus
RIELFKPDYIFVGMGFP

SEQ ID NO: 1684882 - protein, 18 aa, Staphylococcus aureus
SAFYQELFDFYYDLFKSD

SEQ ID NO: 1684883 - protein, 26 aa, Staphylococcus aureus
SEIPKDFILLPIHPYQINVLRQHPQY

SEQ ID NO: 1684884 - protein, 28 aa, Staphylococcus aureus
SSAMEILRRYCFDKAFIGMNGLDIELGL

SEQ ID NO: 1684885 - protein, 25 aa, Staphylococcus aureus
SSYDTFLVANIINKALFNQKIRKDI

SEQ ID NO: 1684886 - protein, 17 aa, Staphylococcus aureus
TDDYPGWWREIIDGGYI

SEQ ID NO: 1684887 - protein, 24 aa, Staphylococcus aureus
TEGAIYEGFLEYARNFKKYEGKNQ

SEQ ID NO: 1684888 - protein, 30 aa, Staphylococcus aureus
TGTPIHPMSPLVKIFWMKHEWQDVFQRTAK

SEQ ID NO: 1684889 - protein, 26 aa, Staphylococcus aureus
TIEHPYPLNVFTLNIATYIFRHREET

SEQ ID NO: 1684890 - protein, 21 aa, Staphylococcus aureus
TILVTTLQLLGAQVGWHIPNR

SEQ ID NO: 1684891 - protein, 18 aa, Staphylococcus aureus
TIRIAPRKVRLVLDLIRG

SEQ ID NO: 1684892 - protein, 20 aa, Staphylococcus aureus
TRYYLMRELPFGSDGVFTPE

SEQ ID NO: 1684893 - protein, 19 aa, Staphylococcus aureus
TSDPFKILSKRELEILPLI

SEQ ID NO: 1684894 - protein, 23 aa, Staphylococcus aureus
TTHTPVWFMRQAGRSQPEYRKLK

SEQ ID NO: 1684895 - protein, 19 aa, Staphylococcus aureus
TWFGGHVAVLPGVTIGEGS

SEQ ID NO: 1684896 - protein, 17 aa, Staphylococcus aureus
TWRKVIDGFFSSFKQDV

SEQ ID NO: 1684897 - protein, 25 aa, Staphylococcus aureus
TYIVRSLINTMYPHQPCYEGAMCVC

SEQ ID NO: 1684898 - protein, 18 aa, Staphylococcus aureus
VDALLFETYYDLEELTNV

SEQ ID NO: 1684899 - protein, 18 aa, Staphylococcus aureus
VDRLLVVTFTNLSAREMK

SEQ ID NO: 1684900 - protein, 29 aa, Staphylococcus aureus
VFHELQPDEFYFLPSFMSPLKKHNNFIDV

SEQ ID NO: 1684901 - protein, 18 aa, Staphylococcus aureus
VGYIDIYDDCEFIVAIRS

SEQ ID NO: 1684902 - protein, 18 aa, Staphylococcus aureus
VHNIVFNGPLRIMAENRL

SEQ ID NO: 1684903 - protein, 17 aa, Staphylococcus aureus
VIPSNYLGRKMKILKDH

SEQ ID NO: 1684904 - protein, 23 aa, Staphylococcus aureus
VKHYQKLIESLAYKYSKGQSHHE

SEQ ID NO: 1684905 - protein, 17 aa, Staphylococcus aureus
VKIIPLEVVVRNIASGS

SEQ ID NO: 1684906 - protein, 26 aa, Staphylococcus aureus
VLEKFKSLIFISGTLKFNHSFDAFKQ

SEQ ID NO: 1684907 - protein, 17 aa, Staphylococcus aureus
VNLLLKLQREKGITFLF

SEQ ID NO: 1684908 - protein, 25 aa, Staphylococcus aureus
VTNDDFTHWRKIMGAAPISDEEREN

SEQ ID NO: 1684909 - protein, 30 aa, Staphylococcus aureus
VTPHITLNQIFPYLKYQIIAMTTESLKNIY

SEQ ID NO: 1684910 - protein, 33 aa, Staphylococcus aureus
VVDQIHTGRYYIQRFLARAFGFEVDDIKAMSEV

SEQ ID NO: 1684911 - protein, 19 aa, Staphylococcus aureus
YDKYDLLEYLFNQLTKDYF

SEQ ID NO: 1684912 - protein, 25 aa, Staphylococcus aureus
YELNTFFKAYLQQKGFNPELMSATI

SEQ ID NO: 1684913 - protein, 23 aa, Staphylococcus aureus
YNELDEPILYSLNYMKNSLVQFK

SEQ ID NO: 1684914 - protein, 26 aa, Staphylococcus aureus
YTHIQRLLMNVLLNIKPTDVTRNIHA

SEQ ID NO: 1684915 - protein, 26 aa, Staphylococcus aureus
AADLLGQPLYKYLGGFNGKQLPVPMM

SEQ ID NO: 1684916 - protein, 18 aa, Staphylococcus aureus
AEDIFEVVWAKIEAAYQS

SEQ ID NO: 1684917 - protein, 24 aa, Staphylococcus aureus
AEDKDTIYVAKNKSPLLLGVGEGF

SEQ ID NO: 1684918 - protein, 24 aa, Staphylococcus aureus
AGKSTLLSAICRLIRFDEGEVKID

SEQ ID NO: 1684919 - protein, 23 aa, Staphylococcus aureus
AGNVLRFQPPLVITYEQLDTALN

SEQ ID NO: 1684920 - protein, 19 aa, Staphylococcus aureus
ALEKALLNIFKNREKLLNS

SEQ ID NO: 1684921 - protein, 20 aa, Staphylococcus aureus
ALGFGYRTGFLGMLHMEIIQ

SEQ ID NO: 1684922 - protein, 20 aa, Staphylococcus aureus
ARAIKYRTRIVTLEGDIVNP

SEQ ID NO: 1684923 - protein, 18 aa, Staphylococcus aureus
ARENHLKIIASCSFAKHM

SEQ ID NO: 1684924 - protein, 17 aa, Staphylococcus aureus
ASDYAIRLLEDKVLYNK

SEQ ID NO: 1684925 - protein, 17 aa, Staphylococcus aureus
ASPHEGLILLKITHYNE

SEQ ID NO: 1684926 - protein, 25 aa, Staphylococcus aureus
ATGNLEAYMTPRLQPWDFAGGLVIL

SEQ ID NO: 1684927 - protein, 20 aa, Staphylococcus aureus
CIENGIMGIPSFLVYKNGEL

SEQ ID NO: 1684928 - protein, 22 aa, Staphylococcus aureus
DAYGINLRPLLTLAEKYYDADN

SEQ ID NO: 1684929 - protein, 18 aa, Staphylococcus aureus
DETNAPLYTLNIQTTVST

SEQ ID NO: 1684930 - protein, 18 aa, Staphylococcus aureus
DFNDMLNALPKQLTKRKI

SEQ ID NO: 1684931 - protein, 18 aa, Staphylococcus aureus
DGKKYLLQNGKWGYFNRE

SEQ ID NO: 1684932 - protein, 21 aa, Staphylococcus aureus
DIFIINHRDLYRFQLQQDGII

SEQ ID NO: 1684933 - protein, 24 aa, Staphylococcus aureus
DITAKPLKTLMLLHGLSSDETTYM

SEQ ID NO: 1684934 - protein, 20 aa, Staphylococcus aureus
DKHTFFKEIIRVQSVLGGIN

SEQ ID NO: 1684935 - protein, 25 aa, Staphylococcus aureus
DKHYPHLRFGFIHVPYIPEQVVGKP

SEQ ID NO: 1684936 - protein, 23 aa, Staphylococcus aureus
DNAKELLLKGLEKLEYRGYDSAG

SEQ ID NO: 1684937 - protein, 24 aa, Staphylococcus aureus
DQRKAVWAIYAVCRKIDDSIDVYG

SEQ ID NO: 1684938 - protein, 28 aa, Staphylococcus aureus
DSTKHQFVMIARFAYPKLPQNLIAAIEI

SEQ ID NO: 1684939 - protein, 23 aa, Staphylococcus aureus
EATAQDLLKWTNGKALIGTGIPY

SEQ ID NO: 1684940 - protein, 27 aa, Staphylococcus aureus
EDDHAITHLLDVALTLDYYNVTTAENA

SEQ ID NO: 1684941 - protein, 29 aa, Staphylococcus aureus
EDNIAYQYATIRNILYAKGYTTEMLINYE

SEQ ID NO: 1684942 - protein, 29 aa, Staphylococcus aureus
EGIGSEKWPIFLERSLVDGIFTIKDQDAF

SEQ ID NO: 1684943 - protein, 24 aa, Staphylococcus aureus
EGQSLYIRPFVFATEGALGVGASH

SEQ ID NO: 1684944 - protein, 21 aa, Staphylococcus aureus
EGTRPLLIEVQALVTPTTFNN

SEQ ID NO: 1684945 - protein, 20 aa, Staphylococcus aureus
EHPNVVRIVVLSGGYSREKA

SEQ ID NO: 1684946 - protein, 25 aa, Staphylococcus aureus
EIGHFRADFDQRFKCNCGRSGCIET

SEQ ID NO: 1684947 - protein, 19 aa, Staphylococcus aureus
EIYNYIKQVVQMKGYPPSV

SEQ ID NO: 1684948 - protein, 23 aa, Staphylococcus aureus
ELKHQFTHLTWKIKVYAVSGTIN

SEQ ID NO: 1684949 - protein, 27 aa, Staphylococcus aureus
ELQPENMYQILRKLPPREYSISSSFMA

SEQ ID NO: 1684950 - protein, 25 aa, Staphylococcus aureus
ELSQNMPVFFSANMSYGVHALTKIL

SEQ ID NO: 1684951 - protein, 19 aa, Staphylococcus aureus
EPFNQLGGYPYFDQIDPRT

SEQ ID NO: 1684952 - protein, 28 aa, Staphylococcus aureus
EQKHLDAIIILSDYNRRYLSGFTGTSGA

SEQ ID NO: 1684953 - protein, 22 aa, Staphylococcus aureus
ERPTTLDYIPYIFDSFMELHGD

SEQ ID NO: 1684954 - protein, 27 aa, Staphylococcus aureus
ETLNRKNIPFDELVLFSSARSAGKEVE

SEQ ID NO: 1684955 - protein, 18 aa, Staphylococcus aureus
EWQLQVDLWLKNGKSKLV

SEQ ID NO: 1684956 - protein, 27 aa, Staphylococcus aureus
FASARPIRDLLPVLPSVFHQHTLIGAN

SEQ ID NO: 1684957 - protein, 18 aa, Staphylococcus aureus
FLSLIPNVTCNYIKTKLE

SEQ ID NO: 1684958 - protein, 21 aa, Staphylococcus aureus
FRVGYHCAQGHFGVTPDLTCL

SEQ ID NO: 1684959 - protein, 25 aa, Staphylococcus aureus
FTNDFKIDGLNRATATYKFAGGKGI

SEQ ID NO: 1684960 - protein, 30 aa, Staphylococcus aureus
GDLIILQGTDDDWLHGYWAGVPIGTDKTDT

SEQ ID NO: 1684961 - protein, 20 aa, Staphylococcus aureus
GEQFFKDNFGLKVKATNVVG

SEQ ID NO: 1684962 - protein, 28 aa, Staphylococcus aureus
GILPGAISFAPFSLVLRFGYDGIDVIDL

SEQ ID NO: 1684963 - protein, 21 aa, Staphylococcus aureus
GITVIQILKLLEHVDLPSMGP

SEQ ID NO: 1684964 - protein, 17 aa, Staphylococcus aureus
GLNFDRQGQLFLLDVFE

SEQ ID NO: 1684965 - protein, 23 aa, Staphylococcus aureus
GYPIVLIHTVLDNYSVFNKLAAE

SEQ ID NO: 1684966 - protein, 25 aa, Staphylococcus aureus
HCENMSEILGIDLYVKYEGANPTGS

SEQ ID NO: 1684967 - protein, 34 aa, Staphylococcus aureus
HIELAAPVSHIWYFKGIPSRMGLLLDMSPRALEE

SEQ ID NO: 1684968 - protein, 18 aa, Staphylococcus aureus
HQCGDLIPETIPIGKPLS

SEQ ID NO: 1684969 - protein, 17 aa, Staphylococcus aureus
IAQIQVMYDPGLILIGG

SEQ ID NO: 1684970 - protein, 23 aa, Staphylococcus aureus
IAVKCIFFNQPYLKKKIELNQTI

SEQ ID NO: 1684971 - protein, 33 aa, Staphylococcus aureus
IDACYQLNVLQLIRLCRYFVDVLRQSDNGRIIV

SEQ ID NO: 1684972 - protein, 20 aa, Staphylococcus aureus
IDQYLTNGKSRAIPIFVFLN

SEQ ID NO: 1684973 - protein, 25 aa, Staphylococcus aureus
IEYVENVYIMLNKPKGYISATEDHH

SEQ ID NO: 1684974 - protein, 19 aa, Staphylococcus aureus
IFQEYNLLHTLTVKENIML

SEQ ID NO: 1684975 - protein, 24 aa, Staphylococcus aureus
IIQKYELDYIIDDDWNYAAQLDAE

SEQ ID NO: 1684976 - protein, 30 aa, Staphylococcus aureus
IISNMEVIPTYKYLLHLDTQRLNKLEREFE

SEQ ID NO: 1684977 - protein, 25 aa, Staphylococcus aureus
IKAKIFRYQYRDVNLTWICKAPKYT

SEQ ID NO: 1684978 - protein, 26 aa, Staphylococcus aureus
IMPNMTKGQALKRLLDKWGMSSSELM

SEQ ID NO: 1684979 - protein, 28 aa, Staphylococcus aureus
INLMLRSEAPFKKALLYAPLYPVEVTST

SEQ ID NO: 1684980 - protein, 27 aa, Staphylococcus aureus
INMPSMLNKYFNKLSVFRKLFGNLTYS

SEQ ID NO: 1684981 - protein, 17 aa, Staphylococcus aureus
IQYLNFYHTELSNALFA

SEQ ID NO: 1684982 - protein, 22 aa, Staphylococcus aureus
IWDGLLEYNVMPCGLGARDTLR

SEQ ID NO: 1684983 - protein, 18 aa, Staphylococcus aureus
KEVYVDNLSLKDGGRNNH

SEQ ID NO: 1684984 - protein, 25 aa, Staphylococcus aureus
KILNQPYYHVMVDYFGGTAFEIYAQ

SEQ ID NO: 1684985 - protein, 23 aa, Staphylococcus aureus
KIQTIGVILPSLTNPFFSALMQS

SEQ ID NO: 1684986 - protein, 25 aa, Staphylococcus aureus
KKDKKLLDWQLLIKNVYLDTEEDDN

SEQ ID NO: 1684987 - protein, 18 aa, Staphylococcus aureus
KLYPFVFNTLFEAIDKLA

SEQ ID NO: 1684988 - protein, 17 aa, Staphylococcus aureus
KQICNLISPTSGELYFK

SEQ ID NO: 1684989 - protein, 19 aa, Staphylococcus aureus
KTFSKLIERLTGETYNNIE

SEQ ID NO: 1684990 - protein, 22 aa, Staphylococcus aureus
KVAAVWKLDLKGHKPALEGTEE

SEQ ID NO: 1684991 - protein, 25 aa, Staphylococcus aureus
KVKQTNSYDLAFDELEKEKDFLQVI

SEQ ID NO: 1684992 - protein, 17 aa, Staphylococcus aureus
KYLDLLSQHFDTPEKLA

SEQ ID NO: 1684993 - protein, 24 aa, Staphylococcus aureus
LADLLPEHRIIINKQPLSIESAIT

SEQ ID NO: 1684994 - protein, 21 aa, Staphylococcus aureus
LEFNTLYQVLRTLQTNMKQNA

SEQ ID NO: 1684995 - protein, 20 aa, Staphylococcus aureus
LKTLFPEDVLSIAKGLTDGE

SEQ ID NO: 1684996 - protein, 18 aa, Staphylococcus aureus
LLEALILVGAFDAFGKTR

SEQ ID NO: 1684997 - protein, 25 aa, Staphylococcus aureus
LLEPNGLIRMYLKDAHYTYSSRRFL

SEQ ID NO: 1684998 - protein, 18 aa, Staphylococcus aureus
LLNIFKNREKLLNSITKP

SEQ ID NO: 1684999 - protein, 17 aa, Staphylococcus aureus
LLTRTIITHILKDDLGP

SEQ ID NO: 1685000 - protein, 20 aa, Staphylococcus aureus
LMHQLKQLDIVYYFGNVTVE

SEQ ID NO: 1685001 - protein, 29 aa, Staphylococcus aureus
LNAGGKRIRPVLLLLTLDSLNTEYELGMK

SEQ ID NO: 1685002 - protein, 18 aa, Staphylococcus aureus
LQGLLTFQDLPVNSYIIW

SEQ ID NO: 1685003 - protein, 19 aa, Staphylococcus aureus
LSRYFTAMLARKGDYPGDV

SEQ ID NO: 1685004 - protein, 30 aa, Staphylococcus aureus
LTSHYKQIDYEFLYLLSMDKLFGNKRNRLT

SEQ ID NO: 1685005 - protein, 17 aa, Staphylococcus aureus
MCASLWSKFDLFKKYAN

SEQ ID NO: 1685006 - protein, 17 aa, Staphylococcus aureus
MGDIMGDVTSRRGRVDG

SEQ ID NO: 1685007 - protein, 17 aa, Staphylococcus aureus
MISYFNGVAQLRQHIKK

SEQ ID NO: 1685008 - protein, 17 aa, Staphylococcus aureus
MPILLVSGYDDPLGDYG

SEQ ID NO: 1685009 - protein, 24 aa, Staphylococcus aureus
NDPVLYFEHKKAYRFLKEEVPEEY

SEQ ID NO: 1685010 - protein, 20 aa, Staphylococcus aureus
NIVKDITFDKALPVAIREAR

SEQ ID NO: 1685011 - protein, 22 aa, Staphylococcus aureus
NKYTALQYIFDADVKYIAFGND

SEQ ID NO: 1685012 - protein, 19 aa, Staphylococcus aureus
NLLHTLTVKENIMLPLTVQ

SEQ ID NO: 1685013 - protein, 18 aa, Staphylococcus aureus
NSGDIFIINHRDLYRFQL

SEQ ID NO: 1685014 - protein, 24 aa, Staphylococcus aureus
NTERRIQRLYQALKPLGDSKPDWK

SEQ ID NO: 1685015 - protein, 17 aa, Staphylococcus aureus
NTGHAYLAYAGKFAGKA

SEQ ID NO: 1685016 - protein, 18 aa, Staphylococcus aureus
NYLFEIIDPYSVNRQGND

SEQ ID NO: 1685017 - protein, 25 aa, Staphylococcus aureus
PDLSYAANFLYMLRGELPTDIEVEA

SEQ ID NO: 1685018 - protein, 24 aa, Staphylococcus aureus
PGNGKFLYSPFSIFDNESIIDFFE

SEQ ID NO: 1685019 - protein, 17 aa, Staphylococcus aureus
PIEWQLQVDLWLKNGKS

SEQ ID NO: 1685020 - protein, 17 aa, Staphylococcus aureus
PKLPQNLIAAIEILKLH

SEQ ID NO: 1685021 - protein, 19 aa, Staphylococcus aureus
PNDLYTWSSGIKSPIYCDN

SEQ ID NO: 1685022 - protein, 24 aa, Staphylococcus aureus
PNVICTYDLLFRSGLDLKVDFVIR

SEQ ID NO: 1685023 - protein, 25 aa, Staphylococcus aureus
PQSKRQVMRLLKSLQTDENKTIILI

SEQ ID NO: 1685024 - protein, 17 aa, Staphylococcus aureus
PVNNGGVVLRWLRDELL

SEQ ID NO: 1685025 - protein, 25 aa, Staphylococcus aureus
PYSHFKVGAYLKTKDGRTFYGTNVE

SEQ ID NO: 1685026 - protein, 23 aa, Staphylococcus aureus
QANNALMYPGLGLGLIASKAKKV

SEQ ID NO: 1685027 - protein, 29 aa, Staphylococcus aureus
QAQTQLFVYGLFIYNQWRGMGTLNSVDVI

SEQ ID NO: 1685028 - protein, 23 aa, Staphylococcus aureus
QDVPEQFSIMRYHSLISNPDNFP

SEQ ID NO: 1685029 - protein, 32 aa, Staphylococcus aureus
QFKCHIDTIIKKQVPVCCFTFGIPNESIIKRL

SEQ ID NO: 1685030 - protein, 20 aa, Staphylococcus aureus
QGLGILLKEQGHDLADYIFA

SEQ ID NO: 1685031 - protein, 18 aa, Staphylococcus aureus
QLPLYAEQVRWMHDKYWV

SEQ ID NO: 1685032 - protein, 25 aa, Staphylococcus aureus
QQKYDNAFLLRTFSKAYGLAGLRVG

SEQ ID NO: 1685033 - protein, 25 aa, Staphylococcus aureus
QREKGITFLFIAHDLSMVKYISDRI

SEQ ID NO: 1685034 - protein, 32 aa, Staphylococcus aureus
QTDFEKRLFLMAIFNRNRTLFYKLTSEHLVEF

SEQ ID NO: 1685035 - protein, 18 aa, Staphylococcus aureus
QYTDMPFIIMLDEDENGY

SEQ ID NO: 1685036 - protein, 30 aa, Staphylococcus aureus
RDYEHALTNYYLYFLVDSNIEIGIKSIIIK

SEQ ID NO: 1685037 - protein, 19 aa, Staphylococcus aureus
RHKNCVFLVDTFHTLKSGV

SEQ ID NO: 1685038 - protein, 26 aa, Staphylococcus aureus
RLGALGYLDWSYFNKGFHSNNGLSDQ

SEQ ID NO: 1685039 - protein, 22 aa, Staphylococcus aureus
RLQGLYAYNIPFDNKARIEKYG

SEQ ID NO: 1685040 - protein, 17 aa, Staphylococcus aureus
RMGLLLDMSPRALEEVI

SEQ ID NO: 1685041 - protein, 17 aa, Staphylococcus aureus
RNNFMPSVLTAIKIARI

SEQ ID NO: 1685042 - protein, 23 aa, Staphylococcus aureus
RNNIMKDAALTRRFNEVLVNEPS

SEQ ID NO: 1685043 - protein, 20 aa, Staphylococcus aureus
RQHIKPVLFVINNDGYTVER

SEQ ID NO: 1685044 - protein, 20 aa, Staphylococcus aureus
RQRIAIARQLMYTPDILLLD

SEQ ID NO: 1685045 - protein, 25 aa, Staphylococcus aureus
RSDRDYLFFKLAIHSGMKITELLTI

SEQ ID NO: 1685046 - protein, 18 aa, Staphylococcus aureus
SDEEIAELLYKLPDIKKW

SEQ ID NO: 1685047 - protein, 21 aa, Staphylococcus aureus
SDILRDMVIISLQGILTPAEY

SEQ ID NO: 1685048 - protein, 17 aa, Staphylococcus aureus
SEFPRIVTLKDLNKIEV

SEQ ID NO: 1685049 - protein, 19 aa, Staphylococcus aureus
SFDFEMLRQMLGKHFISQD

SEQ ID NO: 1685050 - protein, 18 aa, Staphylococcus aureus
SIDIKPRMLGQQAGAAIL

SEQ ID NO: 1685051 - protein, 25 aa, Staphylococcus aureus
SLELSFGFKFLREIDNRLGLKVEQA

SEQ ID NO: 1685052 - protein, 26 aa, Staphylococcus aureus
SNEEIYNLMIYQLGALQGFCRIHQVK

SEQ ID NO: 1685053 - protein, 24 aa, Staphylococcus aureus
SPNLYPGIECKLLAFLEEKKVDAT

SEQ ID NO: 1685054 - protein, 28 aa, Staphylococcus aureus
SQFPARIKCATLAWKALEKGTVAKEGKA

SEQ ID NO: 1685055 - protein, 24 aa, Staphylococcus aureus
SSLSLETIFHCYHQMMSCCNDVIE

SEQ ID NO: 1685056 - protein, 24 aa, Staphylococcus aureus
SVAEHAVMDLLILLRNYEEGHRQS

SEQ ID NO: 1685057 - protein, 27 aa, Staphylococcus aureus
SYGVHALTKILAAAVPLLDDFDIELTE

SEQ ID NO: 1685058 - protein, 19 aa, Staphylococcus aureus
TDIMNYLFEIIDPYSVNRQ

SEQ ID NO: 1685059 - protein, 20 aa, Staphylococcus aureus
TGAGFIVALTGAIMTMPGLP

SEQ ID NO: 1685060 - protein, 25 aa, Staphylococcus aureus
TGVYGLIIPDLPFELSQRLKQQFSH

SEQ ID NO: 1685061 - protein, 24 aa, Staphylococcus aureus
TKGRYSIVIFDIYGTLTLDNDVLS

SEQ ID NO: 1685062 - protein, 21 aa, Staphylococcus aureus
TNGLLREFFPKKTDLAKVNQE

SEQ ID NO: 1685063 - protein, 20 aa, Staphylococcus aureus
TVQLHLEGFLNKYPSEISGG

SEQ ID NO: 1685064 - protein, 17 aa, Staphylococcus aureus
TVRKALDLLALDGMIQK

SEQ ID NO: 1685065 - protein, 23 aa, Staphylococcus aureus
VAIYGLNFLIQNDLARLKAHYKI

SEQ ID NO: 1685066 - protein, 17 aa, Staphylococcus aureus
VASCAHMMIWEGIELIP

SEQ ID NO: 1685067 - protein, 18 aa, Staphylococcus aureus
VDERIPEINWVEGVKEAL

SEQ ID NO: 1685068 - protein, 18 aa, Staphylococcus aureus
VEGLIHFVSRQAMNIDGL

SEQ ID NO: 1685069 - protein, 18 aa, Staphylococcus aureus
VELLADLELPLAKILSEM

SEQ ID NO: 1685070 - protein, 23 aa, Staphylococcus aureus
VEQLVNFGRFPYSKGRLTKEDHE

SEQ ID NO: 1685071 - protein, 27 aa, Staphylococcus aureus
VGRLPEEYLMLHKKFIKPINKNFIVKG

SEQ ID NO: 1685072 - protein, 24 aa, Staphylococcus aureus
VNNKFIISSWLGTMGCGLPGAMAS

SEQ ID NO: 1685073 - protein, 17 aa, Staphylococcus aureus
VTFNEYGTKWYTYYDDD

SEQ ID NO: 1685074 - protein, 27 aa, Staphylococcus aureus
WNRSHHQLIFFGRYHCLARKPKCDICP

SEQ ID NO: 1685075 - protein, 25 aa, Staphylococcus aureus
YCINGYRWITYIANSGQRRYIATGE

SEQ ID NO: 1685076 - protein, 17 aa, Staphylococcus aureus
YFIYPYQEVMKDSNVKL

SEQ ID NO: 1685077 - protein, 22 aa, Staphylococcus aureus
YKEALEIIATKFGLTVNEDLQL

SEQ ID NO: 1685078 - protein, 25 aa, Staphylococcus aureus
YRENIIEYLSYFQTSSPSYLIMASL

SEQ ID NO: 1685079 - protein, 25 aa, Staphylococcus aureus
YTNTLVNGLMYQIKDLSGINGEIRP

SEQ ID NO: 1685080 - protein, 22 aa, Staphylococcus aureus
AILKDFLMNHDEGMWKLSSDAL

SEQ ID NO: 1685081 - protein, 17 aa, Staphylococcus aureus
AKKYHVPLVKVTGSQRV

SEQ ID NO: 1685082 - protein, 21 aa, Staphylococcus aureus
AKRQQIYYEVFPFEGNRVSLK

SEQ ID NO: 1685083 - protein, 28 aa, Staphylococcus aureus
ARSYQDMLKIWGHLFQYIKSEHIEDTYL

SEQ ID NO: 1685084 - protein, 20 aa, Staphylococcus aureus
ATMPTYLNALAGRGVHVITV

SEQ ID NO: 1685085 - protein, 26 aa, Staphylococcus aureus
AVNFEKEYWDKVFTYFLDEYKKGRTP

SEQ ID NO: 1685086 - protein, 21 aa, Staphylococcus aureus
AYTAQIAVLSILSQIVAKEHG

SEQ ID NO: 1685087 - protein, 18 aa, Staphylococcus aureus
CIEAGKYVYRTFVQGEMI

SEQ ID NO: 1685088 - protein, 18 aa, Staphylococcus aureus
CVDATYRTFYQHVLVYEI

SEQ ID NO: 1685089 - protein, 19 aa, Staphylococcus aureus
DAARYFLTMRSPDSHFDFD

SEQ ID NO: 1685090 - protein, 25 aa, Staphylococcus aureus
DAYYGLFYEDVYTQSLFTALSNLNS

SEQ ID NO: 1685091 - protein, 19 aa, Staphylococcus aureus
DEILYNTELGYYRGSNHLG

SEQ ID NO: 1685092 - protein, 23 aa, Staphylococcus aureus
DETKAYIEEKLSLKWSPRQIASQ

SEQ ID NO: 1685093 - protein, 19 aa, Staphylococcus aureus
DFNDMLNALPKQLTKRKIL

SEQ ID NO: 1685094 - protein, 17 aa, Staphylococcus aureus
DGWYVSALTRNKNNRKL

SEQ ID NO: 1685095 - protein, 17 aa, Staphylococcus aureus
DILAAHYIAKSAIRTKN

SEQ ID NO: 1685096 - protein, 25 aa, Staphylococcus aureus
DITENPFIALLFLTSNSQVFNNATL

SEQ ID NO: 1685097 - protein, 26 aa, Staphylococcus aureus
DITRQIEYLKAKKKFPSNLEYVDSYT

SEQ ID NO: 1685098 - protein, 20 aa, Staphylococcus aureus
DMFKALLHETFKAYGVLFID

SEQ ID NO: 1685099 - protein, 18 aa, Staphylococcus aureus
DMGYGIVFLGSLRNDVAR

SEQ ID NO: 1685100 - protein, 25 aa, Staphylococcus aureus
DQLQLFYQCLHGNDLFINKYWLQRT

SEQ ID NO: 1685101 - protein, 20 aa, Staphylococcus aureus
DRIILFRKAGEKVDATKMLF

SEQ ID NO: 1685102 - protein, 18 aa, Staphylococcus aureus
EALKESLRKIKGGFTFAI

SEQ ID NO: 1685103 - protein, 18 aa, Staphylococcus aureus
EDKKLRALKPGEALVQTE

SEQ ID NO: 1685104 - protein, 25 aa, Staphylococcus aureus
EDTELNLFSFVRQLSDIPLGGIIYT

SEQ ID NO: 1685105 - protein, 23 aa, Staphylococcus aureus
EEFYTFIGQFYSLNQHILPKEVH

SEQ ID NO: 1685106 - protein, 28 aa, Staphylococcus aureus
EELTTIGLDLPFPIKINQMLGHQTSFLT

SEQ ID NO: 1685107 - protein, 21 aa, Staphylococcus aureus
EEQIILPHTTQFYISNNEEIG

SEQ ID NO: 1685108 - protein, 28 aa, Staphylococcus aureus
EIAGKNYIDIAWLARKKGYQVTLKDDSL

SEQ ID NO: 1685109 - protein, 23 aa, Staphylococcus aureus
EIESLLFNLLDSPVKYTKHIGGT

SEQ ID NO: 1685110 - protein, 17 aa, Staphylococcus aureus
EIRLDINFALYGNGSNT

SEQ ID NO: 1685111 - protein, 26 aa, Staphylococcus aureus
EIYELWRQTLIQVGINRPTYKRFLIQ

SEQ ID NO: 1685112 - protein, 18 aa, Staphylococcus aureus
EKGVSFQYLIDTLQLDIN

SEQ ID NO: 1685113 - protein, 23 aa, Staphylococcus aureus
EKQLSIVKPLPNGSFQILTEIDL

SEQ ID NO: 1685114 - protein, 22 aa, Staphylococcus aureus
EQLLHHMRSGLTLLDSVKIVST

SEQ ID NO: 1685115 - protein, 19 aa, Staphylococcus aureus
ETDEYYLHLFDVSQADLNW

SEQ ID NO: 1685116 - protein, 26 aa, Staphylococcus aureus
EYDNPVTEIYFIEPDLHFTIIDFNQE

SEQ ID NO: 1685117 - protein, 18 aa, Staphylococcus aureus
EYPHFYVDRHNIWAPRRA

SEQ ID NO: 1685118 - protein, 21 aa, Staphylococcus aureus
FEVRRFFIKLIDQRLNHDITK

SEQ ID NO: 1685119 - protein, 17 aa, Staphylococcus aureus
FIDCKVPQWVRDQMPIV

SEQ ID NO: 1685120 - protein, 17 aa, Staphylococcus aureus
FIDCKVQQWVRDQMPIV

SEQ ID NO: 1685121 - protein, 20 aa, Staphylococcus aureus
FNEIIIATPAQWISHTQDIL

SEQ ID NO: 1685122 - protein, 24 aa, Staphylococcus aureus
FNKSEAYILLFSKLFRNQEKTMKW

SEQ ID NO: 1685123 - protein, 18 aa, Staphylococcus aureus
FPAYHRPTSPDYTVGTEP

SEQ ID NO: 1685124 - protein, 17 aa, Staphylococcus aureus
FPHMTIKENIAQVPQMK

SEQ ID NO: 1685125 - protein, 20 aa, Staphylococcus aureus
FQQCVWNELRQIPYGTLTTY

SEQ ID NO: 1685126 - protein, 17 aa, Staphylococcus aureus
GASFLVLSPEHALVDSI

SEQ ID NO: 1685127 - protein, 24 aa, Staphylococcus aureus
GASGPLYGFSFVKMSAVAKDDMDN

SEQ ID NO: 1685128 - protein, 25 aa, Staphylococcus aureus
GEFHHPIFAVSPILKCLILKGLVKK

SEQ ID NO: 1685129 - protein, 33 aa, Staphylococcus aureus
GEIQGVAQLLFKKVPKLPYTLCYISRGFVVDYS

SEQ ID NO: 1685130 - protein, 24 aa, Staphylococcus aureus
GGFKSYRLLRPVKGTTYKIYFGFA

SEQ ID NO: 1685131 - protein, 32 aa, Staphylococcus aureus
GHAAPPEEILQSSPFVWFKDALDGYDYLVEQG

SEQ ID NO: 1685132 - protein, 23 aa, Staphylococcus aureus
GHEVYIYHPYMNDGVLPLAEETD

SEQ ID NO: 1685133 - protein, 37 aa, Staphylococcus aureus
GHIELAAPVSHIWYFKGIPSRMGLLLDMSPRALEEVI

SEQ ID NO: 1685134 - protein, 17 aa, Staphylococcus aureus
GIFGSPIKWNFTKFIID

SEQ ID NO: 1685135 - protein, 35 aa, Staphylococcus aureus
GKGEKIEFLNKPPSAWVILAKPNLGISSPDIFKLI

SEQ ID NO: 1685136 - protein, 32 aa, Staphylococcus aureus
GKGKSFLAKLLWIYTSFFKGQMLYWDPKSEFA

SEQ ID NO: 1685137 - protein, 24 aa, Staphylococcus aureus
GNDLFINKYWLQRTTATGIAENLF

SEQ ID NO: 1685138 - protein, 27 aa, Staphylococcus aureus
GNGFAMPMLLAISHVHQLLIKADLRMS

SEQ ID NO: 1685139 - protein, 17 aa, Staphylococcus aureus
GQIYQWVHKYQAHGKNG

SEQ ID NO: 1685140 - protein, 17 aa, Staphylococcus aureus
GVAHIIFIGYYADQHNN

SEQ ID NO: 1685141 - protein, 25 aa, Staphylococcus aureus
GVLARKYQLPIYANEKTWQAIEKKD

SEQ ID NO: 1685142 - protein, 20 aa, Staphylococcus aureus
GVVPVIRALREKAMAIQAET

SEQ ID NO: 1685143 - protein, 25 aa, Staphylococcus aureus
HAHNEWVSMLGVVPVIRALREKAMA

SEQ ID NO: 1685144 - protein, 21 aa, Staphylococcus aureus
HKRLEKLFIKYLGVEDTEVNR

SEQ ID NO: 1685145 - protein, 32 aa, Staphylococcus aureus; identical to SEQ ID NO: 1589953

SEQ ID NO: 1685146 - protein, 24 aa, Staphylococcus aureus
IDDETYLHYTFPSVDVALLRGTYA

SEQ ID NO: 1685147 - protein, 30 aa, Staphylococcus aureus
IDLKAHGLTPRLHLFMEDGSIFKNEPLIID

SEQ ID NO: 1685148 - protein, 20 aa, Staphylococcus aureus
IDVLLYMFQEYEKGVSFQYL

SEQ ID NO: 1685149 - protein, 20 aa, Staphylococcus aureus
IEIYSFFDPFSSDCFKLSAI

SEQ ID NO: 1685150 - protein, 18 aa, Staphylococcus aureus
IEMNQGISFLPIYITTDS

SEQ ID NO: 1685151 - protein, 25 aa, Staphylococcus aureus
IENIQPFLYHFYDMSVGICHNGNLI

SEQ ID NO: 1685152 - protein, 25 aa, Staphylococcus aureus
IETLPDDMIWFNLSDRDQYTFPVPM

SEQ ID NO: 1685153 - protein, 22 aa, Staphylococcus aureus
IKGFEMLPQMKAVDLRIEYDGN

SEQ ID NO: 1685154 - protein, 18 aa, Staphylococcus aureus
IKYYPLVIDHGYGATLVD

SEQ ID NO: 1685155 - protein, 24 aa, Staphylococcus aureus
IQLKHSISEIPNIKALLNSMNQNT

SEQ ID NO: 1685156 - protein, 25 aa, Staphylococcus aureus
ISQTTLMSLFSFFQDPELEVKKIEE

SEQ ID NO: 1685157 - protein, 17 aa, Staphylococcus aureus
IYHFIVEGNRRLEKPKG

SEQ ID NO: 1685158 - protein, 19 aa, Staphylococcus aureus
KATNPEQLFAAGYASCFNG

SEQ ID NO: 1685159 - protein, 24 aa, Staphylococcus aureus
KDEVMQYFLSNRKIYPNIFPEFKV

SEQ ID NO: 1685160 - protein, 19 aa, Staphylococcus aureus
KEGRFVTLPEYPEFAWFEG

SEQ ID NO: 1685161 - protein, 26 aa, Staphylococcus aureus
KEIREKLVVPLPLKFGDYLSASSMRS

SEQ ID NO: 1685162 - protein, 20 aa, Staphylococcus aureus
KEVPPLMCASLWSKFDLFKK

SEQ ID NO: 1685163 - protein, 29 aa, Staphylococcus aureus
KFADIKTYIFYHLFDRYIIDYSMASATGM

SEQ ID NO: 1685164 - protein, 35 aa, Staphylococcus aureus
KGSKRQLVLQPWQHFIIGSLFGWVHKETKLRRFKE

SEQ ID NO: 1685165 - protein, 19 aa, Staphylococcus aureus
KICHTAMFTFKRVSISANK

SEQ ID NO: 1685166 - protein, 18 aa, Staphylococcus aureus
KILLPSSELARPLLSAAL

SEQ ID NO: 1685167 - protein, 21 aa, Staphylococcus aureus
KINKIPLVRLKLNFSYDYKEK

SEQ ID NO: 1685168 - protein, 22 aa, Staphylococcus aureus
KITTPTYLYHDFDFATEVIDTL

SEQ ID NO: 1685169 - protein, 20 aa, Staphylococcus aureus
KIYTNLKPWDRVQIARLQER

SEQ ID NO: 1685170 - protein, 23 aa, Staphylococcus aureus
KLQTYLTPHFISFEIVYEAMDLI

SEQ ID NO: 1685171 - protein, 17 aa, Staphylococcus aureus
KLTTYDKSKRKSLDVDH

SEQ ID NO: 1685172 - protein, 29 aa, Staphylococcus aureus
KQFAEQLYNGLWFSPLTDSLKLFIDSTQQ

SEQ ID NO: 1685173 - protein, 34 aa, Staphylococcus aureus
KQYYQAMYLSNLTSYLFSFVTIPDNIILSLINNL

SEQ ID NO: 1685174 - protein, 20 aa, Staphylococcus aureus
KRMRYFLESIKGYQDFHFEM

SEQ ID NO: 1685175 - protein, 19 aa, Staphylococcus aureus
KRNEQMIYIVNDKLTKKEL

SEQ ID NO: 1685176 - protein, 25 aa, Staphylococcus aureus
KSLSNTELLAILINTGRKGFSSIDI

SEQ ID NO: 1685177 - protein, 23 aa, Staphylococcus aureus
KTIRTLITRLYKKEIIKRYKSEN

SEQ ID NO: 1685178 - protein, 25 aa, Staphylococcus aureus
KTVKSLRKQLLYLKDKFKNIEQSLK

SEQ ID NO: 1685179 - protein, 32 aa, Staphylococcus aureus
KVIRPVYLNQSTIPTFYIVNVGGGYLDGDRYR

SEQ ID NO: 1685180 - protein, 25 aa, Staphylococcus aureus
KVMQDSFKLLVTYRTKLQGGYGQFT

SEQ ID NO: 1685181 - protein, 19 aa, Staphylococcus aureus
KVYDMIFIDAAKAQSKKFF

SEQ ID NO: 1685182 - protein, 18 aa, Staphylococcus aureus
KYTIAKFYKLYIERSNNG

SEQ ID NO: 1685183 - protein, 25 aa, Staphylococcus aureus
LDYIDLVLIHQPYNDVYGSWRALEE

SEQ ID NO: 1685184 - protein, 32 aa, Staphylococcus aureus
LEEKERLLPGGYLFLSDLVGNPSLLNKVGKLI

SEQ ID NO: 1685185 - protein, 19 aa, Staphylococcus aureus
LFDAVLMTIKYIMRESKVN

SEQ ID NO: 1685186 - protein, 27 aa, Staphylococcus aureus
LGMSNDIKHIVVYNPAPLAIKDVSGLY

SEQ ID NO: 1685187 - protein, 26 aa, Staphylococcus aureus
LGYQRASMYDIYPPYDGIPDEAFLIK

SEQ ID NO: 1685188 - protein, 18 aa, Staphylococcus aureus
LIMCGKQDFLYQDNLDFI

SEQ ID NO: 1685189 - protein, 18 aa, Staphylococcus aureus
LLKHQGLVITDNVLYHGF

SEQ ID NO: 1685190 - protein, 19 aa, Staphylococcus aureus
LLLTKTGEVWAYYRVRSES

SEQ ID NO: 1685191 - protein, 26 aa, Staphylococcus aureus
LLSEDKALLYWATINRNCVICGKPHA

SEQ ID NO: 1685192 - protein, 18 aa, Staphylococcus aureus
LLVLNAIHIPLHAGKIEE

SEQ ID NO: 1685193 - protein, 17 aa, Staphylococcus aureus
LPDKLKNKIYYEPKTTS

SEQ ID NO: 1685194 - protein, 27 aa, Staphylococcus aureus
LPKSDQSLILPLSPYAIDKYYGERTTL

SEQ ID NO: 1685195 - protein, 18 aa, Staphylococcus aureus
LQYTFILSSFLKSINTIE

SEQ ID NO: 1685196 - protein, 24 aa, Staphylococcus aureus
LVNGGTLAIYMGVKRLGKIIAQIQ

SEQ ID NO: 1685197 - protein, 25 aa, Staphylococcus aureus
LYKDREKMYYFAYEIKDGKAEINRE

SEQ ID NO: 1685198 - protein, 19 aa, Staphylococcus aureus
MEPIYLDNVAVIGKVIGLY

SEQ ID NO: 1685199 - protein, 19 aa, Staphylococcus aureus
MGVVPPIEGFLQGLRDITT

SEQ ID NO: 1685200 - protein, 21 aa, Staphylococcus aureus
MKLRIGFSDIFFNVDKLTSSE

SEQ ID NO: 1685201 - protein, 19 aa, Staphylococcus aureus
MSTEGIIVLVIYHGHSEGQ

SEQ ID NO: 1685202 - protein, 19 aa, Staphylococcus aureus
MYPHLDGVLSLDLTTVLIL

SEQ ID NO: 1685203 - protein, 18 aa, Staphylococcus aureus
NASFPAYHRPTSPDYTVG

SEQ ID NO: 1685204 - protein, 19 aa, Staphylococcus aureus
NAVNQIVGYLLSGDPAYIP

SEQ ID NO: 1685205 - protein, 18 aa, Staphylococcus aureus
NDGYLNRNFVFTNHKGNP

SEQ ID NO: 1685206 - protein, 21 aa, Staphylococcus aureus
NGHFQFQETVLYILKSNTYSY

SEQ ID NO: 1685207 - protein, 28 aa, Staphylococcus aureus
NHKDTVYNVPFLWRLSSGLNVAQLQQAV

SEQ ID NO: 1685208 - protein, 18 aa, Staphylococcus aureus
NHKKQFYVTLKLNNEIIK

SEQ ID NO: 1685209 - protein, 18 aa, Staphylococcus aureus
NILKLVFSDGTNPALNIQ

SEQ ID NO: 1685210 - protein, 24 aa, Staphylococcus aureus
NLHVDVVKLYFKKAKAWSEKHQFP

SEQ ID NO: 1685211 - protein, 21 aa, Staphylococcus aureus
NMVQGLVIPSNYLGRKMKILK

SEQ ID NO: 1685212 - protein, 26 aa, Staphylococcus aureus
NNIPMGRGMIKWAPFATLPEQFETIQ

SEQ ID NO: 1685213 - protein, 19 aa, Staphylococcus aureus
NSATFPAYHRPTSPDYTVG

SEQ ID NO: 1685214 - protein, 22 aa, Staphylococcus aureus
NSFKAILRCDPDVILIGEIRDK

SEQ ID NO: 1685215 - protein, 18 aa, Staphylococcus aureus
NVLIAKLQAIYRRVYEFT

SEQ ID NO: 1685216 - protein, 26 aa, Staphylococcus aureus
PEAEKLYLTLHLLSTSVQWTDLQESD

SEQ ID NO: 1685217 - protein, 17 aa, Staphylococcus aureus
PEQLFAAGYASCFNGAF

SEQ ID NO: 1685218 - protein, 17 aa, Staphylococcus aureus
PFCVKITFEIDKNDNWL

SEQ ID NO: 1685219 - protein, 23 aa, Staphylococcus aureus
PKPWDIAAQFLFAELLNLKMTTL

SEQ ID NO: 1685220 - protein, 23 aa, Staphylococcus aureus
PLDVVDFHNFAKKSYFILTDSGG

SEQ ID NO: 1685221 - protein, 22 aa, Staphylococcus aureus
PMGCQTGFYVSFINHDNYDDVL

SEQ ID NO: 1685222 - protein, 27 aa, Staphylococcus aureus
PPQLAFAIGNAIKYLSRAPLKNGHEDL

SEQ ID NO: 1685223 - protein, 24 aa, Staphylococcus aureus
PRMNERAFVLIPLNDIAANVIEPR

SEQ ID NO: 1685224 - protein, 23 aa, Staphylococcus aureus
PSIPLKIMFPQLKVTIVDSLNKR

SEQ ID NO: 1685225 - protein, 21 aa, Staphylococcus aureus
PTIVIHYDIRHLSTEFAQIIA

SEQ ID NO: 1685226 - protein, 19 aa, Staphylococcus aureus
PYQHYIKQLIKQKPFQLSA

SEQ ID NO: 1685227 - protein, 19 aa, Staphylococcus aureus
QEISGWRYMLDRCEIMLSE

SEQ ID NO: 1685228 - protein, 38 aa, Staphylococcus aureus
QIKDLPMVMVMLYASLGSVLLREFGLQPFIVEISGSTS

SEQ ID NO: 1685229 - protein, 30 aa, Staphylococcus aureus
QKMHSGIHKRFYLFVALMTEFQALNGMRIG

SEQ ID NO: 1685230 - protein, 19 aa, Staphylococcus aureus
QNYYMYKKFGVIPEMEYEM

SEQ ID NO: 1685231 - protein, 26 aa, Staphylococcus aureus
QVFYYEIITLLNKRPLRQVDYGNKIQ

SEQ ID NO: 1685232 - protein, 17 aa, Staphylococcus aureus
QVRLDCAEIIRQQGRNE

SEQ ID NO: 1685233 - protein, 18 aa, Staphylococcus aureus
RDMLGKYHKLFTDKHDIN

SEQ ID NO: 1685234 - protein, 34 aa, Staphylococcus aureus
REKERMIPYFIQQQYWFLFYHDENYFAVKYSDDG

SEQ ID NO: 1685235 - protein, 18 aa, Staphylococcus aureus
RFFTGIEIHPGAKIGKRL

SEQ ID NO: 1685236 - protein, 17 aa, Staphylococcus aureus
RFKGLKEWHFGIFEGES

SEQ ID NO: 1685237 - protein, 24 aa, Staphylococcus aureus
RKAEQYKRLEFNLSIALDDVESTA

SEQ ID NO: 1685238 - protein, 26 aa, Staphylococcus aureus
RKIKGGFTFAILTKDALYGAVDPNAI

SEQ ID NO: 1685239 - protein, 21 aa, Staphylococcus aureus
RMPIEVVYGFAQLKRAAALAN

SEQ ID NO: 1685240 - protein, 17 aa, Staphylococcus aureus
RNQILFKTIVPARIDKI

SEQ ID NO: 1685241 - protein, 22 aa, Staphylococcus aureus
RSYHGNVMMLKRDAGAQDVVAQ

SEQ ID NO: 1685242 - protein, 19 aa, Staphylococcus aureus
RTGIFDLFGYDLKDYDELF

SEQ ID NO: 1685243 - protein, 24 aa, Staphylococcus aureus
RVICKHMIALLFTASPEAANKHII

SEQ ID NO: 1685244 - protein, 25 aa, Staphylococcus aureus
SEHLVEFMPIIYDPVIAQSIEQYNE

SEQ ID NO: 1685245 - protein, 23 aa, Staphylococcus aureus
SEIYLSFLDTKSWCKNKFQVTNQ

SEQ ID NO: 1685246 - protein, 27 aa, Staphylococcus aureus
SEKNGITLMLLIGKFLEKFGSRRDVQT

SEQ ID NO: 1685247 - protein, 18 aa, Staphylococcus aureus
SFLPQKLDIVVFPSKYGG

SEQ ID NO: 1685248 - protein, 27 aa, Staphylococcus aureus
SGVDHFKIVPLLIFSAMHYLKDIPNIV

SEQ ID NO: 1685249 - protein, 19 aa, Staphylococcus aureus
SHDAIDPQFYIFHNNYKKF

SEQ ID NO: 1685250 - protein, 25 aa, Staphylococcus aureus
SILSKSIIKLLPEKISKLSSGEVIF

SEQ ID NO: 1685251 - protein, 26 aa, Staphylococcus aureus
SLTERMEEEMFLGLRLNEGVSSRRFK

SEQ ID NO: 1685252 - protein, 23 aa, Staphylococcus aureus
SMAEWDVMNIIWGKKSVSANEIV

SEQ ID NO: 1685253 - protein, 25 aa, Staphylococcus aureus
SNDPVLYFEHKKAYRFLKEEVPEEY

SEQ ID NO: 1685254 - protein, 26 aa, Staphylococcus aureus
SNIYAIGDIVPGLPLAHKASYEAKVA

SEQ ID NO: 1685255 - protein, 20 aa, Staphylococcus aureus
SQLYQDFFKAKAKQLPQITV

SEQ ID NO: 1685256 - protein, 31 aa, Staphylococcus aureus
SRLKKSLKQSLSLDFLVLRESYPEADPQPGD

SEQ ID NO: 1685257 - protein, 22 aa, Staphylococcus aureus
SSKHYLIPEMHLKPILSYMKAH

SEQ ID NO: 1685258 - protein, 27 aa, Staphylococcus aureus
STSNDAEFFFTYEDLPLLDPDKILNEY

SEQ ID NO: 1685259 - protein, 20 aa, Staphylococcus aureus
SVFVPKITTPTYLYHDFDFA

SEQ ID NO: 1685260 - protein, 19 aa, Staphylococcus aureus
TFQLYQNLKRQNPSPYMYY

SEQ ID NO: 1685261 - protein, 40 aa, Staphylococcus aureus
TGALMSAGLFIVGRIKGVARPALVVTLPTIDGKGFVFLDV

SEQ ID NO: 1685262 - protein, 18 aa, Staphylococcus aureus
TLYLTSHYKQIDYEFLYL

SEQ ID NO: 1685263 - protein, 19 aa, Staphylococcus aureus
TMILSANGPFIGGSRIPLT

SEQ ID NO: 1685264 - protein, 26 aa, Staphylococcus aureus
TRNEVVLWKLVAHRLMTWKKEYANNA

SEQ ID NO: 1685265 - protein, 17 aa, Staphylococcus aureus
TRQLAAIYLASGIDPDK

SEQ ID NO: 1685266 - protein, 33 aa, Staphylococcus aureus
TSLSAIINLIKLYNVKVVVLKPFRLGGIDKVQT

SEQ ID NO: 1685267 - protein, 23 aa, Staphylococcus aureus
TTRNAFFIGRTIDYNVSLEGALK

SEQ ID NO: 1685268 - protein, 18 aa, Staphylococcus aureus
TVYALDHSLNLKNGFYLN

SEQ ID NO: 1685269 - protein, 17 aa, Staphylococcus aureus
VCRSTVYNWLKYYRKDN

SEQ ID NO: 1685270 - protein, 34 aa, Staphylococcus aureus
VGSTLYLNESLDQFILLIFYGTFPGGDFTEFGSP

SEQ ID NO: 1685271 - protein, 20 aa, Staphylococcus aureus
VHELLTPLVSVVTLQLISYY

SEQ ID NO: 1685272 - protein, 19 aa, Staphylococcus aureus
VKMYVQMSGDFGTIAYSWN

SEQ ID NO: 1685273 - protein, 17 aa, Staphylococcus aureus
VKTLLPLYKEVFESLID

SEQ ID NO: 1685274 - protein, 25 aa, Staphylococcus aureus
VMNKGYWTGNLSRNIRYKKTGDLQY

SEQ ID NO: 1685275 - protein, 17 aa, Staphylococcus aureus
VNLPGVRVSLPGITEKD

SEQ ID NO: 1685276 - protein, 22 aa, Staphylococcus aureus
VNMIALVNGRPKLINLKEALVH

SEQ ID NO: 1685277 - protein, 28 aa, Staphylococcus aureus
VSVKGKAPNTLYIEKRNLMKQKLEMLGE

SEQ ID NO: 1685278 - protein, 24 aa, Staphylococcus aureus
VTNDDFTHWRKIMGAAPISEEERE

SEQ ID NO: 1685279 - protein, 25 aa, Staphylococcus aureus
VYIEAPFEHLYRIPKYTYEIIEVKK

SEQ ID NO: 1685280 - protein, 24 aa, Staphylococcus aureus
WKDNSIIGFVMRPLINYDAIKNET

SEQ ID NO: 1685281 - protein, 17 aa, Staphylococcus aureus
WLGYSACTILNSGYDAN

SEQ ID NO: 1685282 - protein, 17 aa, Staphylococcus aureus
YARCEKLFVIGSYEPGS

SEQ ID NO: 1685283 - protein, 26 aa, Staphylococcus aureus
YARVKSEWIVKLPDTLTLEESMIYGT

SEQ ID NO: 1685284 - protein, 19 aa, Staphylococcus aureus
YEEKLYQAYRYTEKMKTRI

SEQ ID NO: 1685285 - protein, 31 aa, Staphylococcus aureus
YFVLEFEQQIIGYLGLWIVIDQAQITTVAID

SEQ ID NO: 1685286 - protein, 20 aa, Staphylococcus aureus
YLPIYAIQNHLCECGIAGEV

SEQ ID NO: 1685287 - protein, 19 aa, Staphylococcus aureus
YPHAFIHMVGFSRGGLQGL

SEQ ID NO: 1685288 - protein, 30 aa, Staphylococcus aureus
YPVLLKEIYQFPLLLFYKGNIKLINNMHHL

SEQ ID NO: 1685289 - protein, 19 aa, Staphylococcus aureus
YQELFDFYYDLFKSDDDTY

SEQ ID NO: 1685290 - protein, 24 aa, Staphylococcus aureus
YSSLPIEASLLDIPTIFYVYDEGT

SEQ ID NO: 1685291 - protein, 19 aa, Staphylococcus aureus
YSYHLGMMFQIKDDLLDCY

SEQ ID NO: 1685292 - protein, 27 aa, Staphylococcus aureus
YVFKPKSLFVLYDILSNNSVYLHFFKN

SEQ ID NO: 1685293 - protein, 18 aa, Staphylococcus aureus
AAHPNTIIFLTADAFGVI

SEQ ID NO: 1685294 - protein, 23 aa, Staphylococcus aureus
AAPFSFFNIVNNHPPMVAIAVQR

SEQ ID NO: 1685295 - protein, 29 aa, Staphylococcus aureus
AARQGLDIIRKKGFYSQIGIFKDAEIPFD

SEQ ID NO: 1685296 - protein, 28 aa, Staphylococcus aureus
AARQGLDILRKKGFYSQIGIFKDAEITF

SEQ ID NO: 1685297 - protein, 20 aa, Staphylococcus aureus
AELIASFSRALASDLRAGQS

SEQ ID NO: 1685298 - protein, 24 aa, Staphylococcus aureus
AGELLCQYYFTRFGVDTRSVRFPG

SEQ ID NO: 1685299 - protein, 26 aa, Staphylococcus aureus
AGVHKLPFVCVIINNKYAISVPDSLQ

SEQ ID NO: 1685300 - protein, 32 aa, Staphylococcus aureus
AIDFSNPNLLFPLLDEAFHLPLVVATTGEKEK

SEQ ID NO: 1685301 - protein, 25 aa, Staphylococcus aureus
AIMAALHFDVPCLFAKKAKPSTLTD

SEQ ID NO: 1685302 - protein, 23 aa, Staphylococcus aureus
AIYTIAAMAPCPYIYAELAKRSQ

SEQ ID NO: 1685303 - protein, 26 aa, Staphylococcus aureus
AKGKVLARHIVPYPPGIPIIFKGETI

SEQ ID NO: 1685304 - protein, 27 aa, Staphylococcus aureus
AKGKVLARHIVPYPPGIPIIFKGETIT

SEQ ID NO: 1685305 - protein, 22 aa, Staphylococcus aureus
AKHEHFVFVIPVSETLDMKKAA

SEQ ID NO: 1685306 - protein, 26 aa, Staphylococcus aureus
AKNYAHRLLMDLGFSRDVMSQSPFQM

SEQ ID NO: 1685307 - protein, 25 aa, Staphylococcus aureus
ALVKALQAWDIDHLYGIPGDSIDAV

SEQ ID NO: 1685308 - protein, 22 aa, Staphylococcus aureus
ANKNIIGKLGKLLKLGGKALKP

SEQ ID NO: 1685309 - protein, 28 aa, Staphylococcus aureus
AQFSGGMKRRLSLAITLLAEPELIILDE

SEQ ID NO: 1685310 - protein, 27 aa, Staphylococcus aureus
ARQYQKLIVVPLFLYDGRLVNKVKQQM

SEQ ID NO: 1685311 - protein, 34 aa, Staphylococcus aureus
ASFSWYEYSPLRIKYPYIRGKLWDLWTEALEENY

SEQ ID NO: 1685312 - protein, 23 aa, Staphylococcus aureus
ATKKLPDFILSLGAKFNHQAKEG

SEQ ID NO: 1685313 - protein, 24 aa, Staphylococcus aureus
CNSEYFFTLSYFLKPGKATINFRE

SEQ ID NO: 1685314 - protein, 22 aa, Staphylococcus aureus
CSKRKYWYKKPNFSRIAQIASY

SEQ ID NO: 1685315 - protein, 18 aa, Staphylococcus aureus
CVDATYRTFYQHILVYEV

SEQ ID NO: 1685316 - protein, 20 aa, Staphylococcus aureus
DAIVVGNTYGRIRAMVNDLG

SEQ ID NO: 1685317 - protein, 24 aa, Staphylococcus aureus
DALFILGETLYNFGLMPQGLEVFR

SEQ ID NO: 1685318 - protein, 26 aa, Staphylococcus aureus
DANTEQYYFHLFSKKQPDLNWGNPEV

SEQ ID NO: 1685319 - protein, 19 aa, Staphylococcus aureus
DAVNVSFPGFLPKLKLLEN

SEQ ID NO: 1685320 - protein, 24 aa, Staphylococcus aureus
DDVVFRLKALAQFTMRTAKVQQQV

SEQ ID NO: 1685321 - protein, 22 aa, Staphylococcus aureus
DEFQAFYDELKPLADLYNAKKL

SEQ ID NO: 1685322 - protein, 23 aa, Staphylococcus aureus
DIEPYFHKVVLLSGALRLDTLKS

SEQ ID NO: 1685323 - protein, 22 aa, Staphylococcus aureus
DIIAAQLLYTIKKYGPDRIAGF

SEQ ID NO: 1685324 - protein, 24 aa, Staphylococcus aureus
DILVTYPMKTLFIDYINLARDYYQ

SEQ ID NO: 1685325 - protein, 17 aa, Staphylococcus aureus
DKIIDFLSTDDPSLVRA

SEQ ID NO: 1685326 - protein, 26 aa, Staphylococcus aureus
DKKKDRYKFVLTPFANQKASYFISDE

SEQ ID NO: 1685327 - protein, 19 aa, Staphylococcus aureus
DLPKLAQMKPKDTIQFKWI

SEQ ID NO: 1685328 - protein, 23 aa, Staphylococcus aureus
DQEKPFVTSGIRLGTPAATTRGF

SEQ ID NO: 1685329 - protein, 26 aa, Staphylococcus aureus
DRDDKFYYNRLKYYKDRVLVPLAYIN

SEQ ID NO: 1685330 - protein, 26 aa, Staphylococcus aureus
DSYLPIKHPFEQALYQTYLIDDMTSI

SEQ ID NO: 1685331 - protein, 19 aa, Staphylococcus aureus
DTYLTKFPGIGKKTARQIV

SEQ ID NO: 1685332 - protein, 19 aa, Staphylococcus aureus
DYLLQFKIDHKALLQCIEA

SEQ ID NO: 1685333 - protein, 27 aa, Staphylococcus aureus
DYTNQSLVAFFFKALTSYLKKQNCLYV

SEQ ID NO: 1685334 - protein, 29 aa, Staphylococcus aureus
EAKASIKPFIRRTPLIKSMYLSQNITKGN

SEQ ID NO: 1685335 - protein, 21 aa, Staphylococcus aureus
EAPDNFILGFRATPEETRGSD

SEQ ID NO: 1685336 - protein, 19 aa, Staphylococcus aureus
EECDRMIEAANKNCKLLTV

SEQ ID NO: 1685337 - protein, 26 aa, Staphylococcus aureus
EELAKLEKVLSALQPIAKIIKTTNSE

SEQ ID NO: 1685338 - protein, 17 aa, Staphylococcus aureus
EEQIILPHTTQFYISNN

SEQ ID NO: 1685339 - protein, 19 aa, Staphylococcus aureus
EFDFILIEGAGGIAVPIYE

SEQ ID NO: 1685340 - protein, 19 aa, Staphylococcus aureus
EFQAFYDELKPLSDLYNAK

SEQ ID NO: 1685341 - protein, 19 aa, Staphylococcus aureus
EGLNFDRQGQLFLLDVFEG

SEQ ID NO: 1685342 - protein, 20 aa, Staphylococcus aureus
EIKHAVWQLVLQHAKEDALF

SEQ ID NO: 1685343 - protein, 18 aa, Staphylococcus aureus
EIKVLVLTSYVDDEHVIS

SEQ ID NO: 1685344 - protein, 18 aa, Staphylococcus aureus
EIRPFLMKDLFNDKKLRD

SEQ ID NO: 1685345 - protein, 25 aa, Staphylococcus aureus
EISIAQRLLIQTFFSTFSNRRTDHY

SEQ ID NO: 1685346 - protein, 26 aa, Staphylococcus aureus
EIYELWRQTLIQVGINRPTYKKFLIQ

SEQ ID NO: 1685347 - protein, 29 aa, Staphylococcus aureus
EKELAESVLPFHPLFIKPNKDELEVMFNT

SEQ ID NO: 1685348 - protein, 25 aa, Staphylococcus aureus
EKFNRPIFTFIDTKGAYPGKAAEER

SEQ ID NO: 1685349 - protein, 18 aa, Staphylococcus aureus
ELAEQLVAFIPHSLLTLH

SEQ ID NO: 1685350 - protein, 27 aa, Staphylococcus aureus
EMQEKYPLFINHLKTFKYVTLNYEDST

SEQ ID NO: 1685351 - protein, 27 aa, Staphylococcus aureus
ENGFGYDPIFYVPKLDRTMAQLSKEQK

SEQ ID NO: 1685352 - protein, 17 aa, Staphylococcus aureus
ENGLLTITLPKIKPSND

SEQ ID NO: 1685353 - protein, 25 aa, Staphylococcus aureus
ENMNAWLKPYRRALHLEEPVVKIIE

SEQ ID NO: 1685354 - protein, 29 aa, Staphylococcus aureus
EQILTSSDLILYVSYFNHSFTDNDKAFIE

SEQ ID NO: 1685355 - protein, 25 aa, Staphylococcus aureus
EQMLKIQIEFLIAYATAQTELSMRE

SEQ ID NO: 1685356 - protein, 31 aa, Staphylococcus aureus
ERFKETFHAIQGHFTAVFKQLFGGGDAELQL

SEQ ID NO: 1685357 - protein, 17 aa, Staphylococcus aureus
ERGFEIPSFNYVLKTEN

SEQ ID NO: 1685358 - protein, 18 aa, Staphylococcus aureus
ERKWYVIDAEGQTLGRLS

SEQ ID NO: 1685359 - protein, 18 aa, Staphylococcus aureus
ERQLLLSVDNIECILVKG

SEQ ID NO: 1685360 - protein, 24 aa, Staphylococcus aureus
ESEIYLSFLDKKSWCKNKFQVTNQ

SEQ ID NO: 1685361 - protein, 28 aa, Staphylococcus aureus
ESHFQRTFDEKTYLSWLAQVGFKHVETF

SEQ ID NO: 1685362 - protein, 17 aa, Staphylococcus aureus
ESTFITLQLIKNEIPQK

SEQ ID NO: 1685363 - protein, 17 aa, Staphylococcus aureus
ETVDIVMLLRIQHERHG

SEQ ID NO: 1685364 - protein, 32 aa, Staphylococcus aureus
EVPPLMCASLWPKFDLFKKYANSELILTKSAI

SEQ ID NO: 1685365 - protein, 19 aa, Staphylococcus aureus
EYDFYNLNGEYGHEVLKMY

SEQ ID NO: 1685366 - protein, 18 aa, Staphylococcus aureus
EYRKYYEPLIHKNDKEFK

SEQ ID NO: 1685367 - protein, 25 aa, Staphylococcus aureus
FEDNTLFDGFIYSAGLGYFKSISDH

SEQ ID NO: 1685368 - protein, 17 aa, Staphylococcus aureus
FELFHYLSKHMGQVMTR

SEQ ID NO: 1685369 - protein, 17 aa, Staphylococcus aureus
FICRFNVAILDDGYYLP

SEQ ID NO: 1685370 - protein, 23 aa, Staphylococcus aureus
FIGQPLWGSIGYTLPATLGSQLA

SEQ ID NO: 1685371 - protein, 17 aa, Staphylococcus aureus
FIHMVGFSRGGLQGLLT

SEQ ID NO: 1685372 - protein, 18 aa, Staphylococcus aureus
FIPGVFEENVRRVKALES

SEQ ID NO: 1685373 - protein, 17 aa, Staphylococcus aureus
FLEIPFDVYPQDAIMPL

SEQ ID NO: 1685374 - protein, 19 aa, Staphylococcus aureus
FQKLICNLISPTSGTLYFK

SEQ ID NO: 1685375 - protein, 19 aa, Staphylococcus aureus
FRHKYRNIKLNWICKAPKY

SEQ ID NO: 1685376 - protein, 23 aa, Staphylococcus aureus
FSNYYEFLVRYKKIDALLTENES

SEQ ID NO: 1685377 - protein, 21 aa, Staphylococcus aureus
FTKANPFTRFIRAKATLTSAG

SEQ ID NO: 1685378 - protein, 24 aa, Staphylococcus aureus
FTVERYFNIVFQGTGMLFEVEGKV

SEQ ID NO: 1685379 - protein, 30 aa, Staphylococcus aureus
FVAATAPFTPFYRALDWIVTDPLDSIKEEI

SEQ ID NO: 1685380 - protein, 20 aa, Staphylococcus aureus
GAAYIEPYGKLFEYGFNIDH

SEQ ID NO: 1685381 - protein, 17 aa, Staphylococcus aureus
GAQLLIDFLSNNKLMRI

SEQ ID NO: 1685382 - protein, 26 aa, Staphylococcus aureus
GAQLVTRLFYMFDKESMIASMGIGGG

SEQ ID NO: 1685383 - protein, 24 aa, Staphylococcus aureus
GDYNNFIMVSYIKDKVNALYTNQN

SEQ ID NO: 1685384 - protein, 28 aa, Staphylococcus aureus
GEFDYILNQPLYQLIEQVKPRLTKAKIK

SEQ ID NO: 1685385 - protein, 26 aa, Staphylococcus aureus
GEGQSLYIRPFVFATEGVLGVGASHQ

SEQ ID NO: 1685386 - protein, 25 aa, Staphylococcus aureus
GENYIDITWLARKKGYQVTLKDDGL

SEQ ID NO: 1685387 - protein, 24 aa, Staphylococcus aureus
GHAMSGILMSRTQAIILAELNKVK

SEQ ID NO: 1685388 - protein, 24 aa, Staphylococcus aureus
GHCNYWKSSFLFRSSLSTSEMIEK

SEQ ID NO: 1685389 - protein, 24 aa, Staphylococcus aureus
GKAHAIRRRAVPTWGVFLNEEAQG

SEQ ID NO: 1685390 - protein, 23 aa, Staphylococcus aureus
GKVIVIGIQLYKDREKMYYFAYE

SEQ ID NO: 1685391 - protein, 22 aa, Staphylococcus aureus
GLHEPYDLQKILLGGAKLSASM

SEQ ID NO: 1685392 - protein, 19 aa, Staphylococcus aureus
GLIIQRFGTTYVLTTKKEA

SEQ ID NO: 1685393 - protein, 33 aa, Staphylococcus aureus
GMGAQCWDLPNYLLDKYWGFRTWGNADAMAQKS

SEQ ID NO: 1685394 - protein, 26 aa, Staphylococcus aureus
GMSNGIPNIVVYNPAPISITSLNPNS

SEQ ID NO: 1685395 - protein, 24 aa, Staphylococcus aureus
GNTVCYMWLRFNIDQQFDDTAINQ

SEQ ID NO: 1685396 - protein, 18 aa, Staphylococcus aureus
GSERFKELVDLFNKRYDI

SEQ ID NO: 1685397 - protein, 24 aa, Staphylococcus aureus
GSLNPKFLNVSSLIQYIQAAYHEP

SEQ ID NO: 1685398 - protein, 24 aa, Staphylococcus aureus
GTGKTFLAVVYAAKQLRKGAVKRI

SEQ ID NO: 1685399 - protein, 19 aa, Staphylococcus aureus
HERRFFNMAMTLEQWEFGG

SEQ ID NO: 1685400 - protein, 23 aa, Staphylococcus aureus
HFHSLFINPITRKLHTFNLEKKQ

SEQ ID NO: 1685401 - protein, 30 aa, Staphylococcus aureus
HISLVPQTLNWLMQQGLHEPYDLQKILLGG

SEQ ID NO: 1685402 - protein, 26 aa, Staphylococcus aureus
HKEDALDFTLWKKAKPGEISWNSPFG

SEQ ID NO: 1685403 - protein, 24 aa, Staphylococcus aureus
HKRVTLLIGDLSFYHDMNGLLMSK

SEQ ID NO: 1685404 - protein, 19 aa, Staphylococcus aureus
HLKKMYHAMAHKFGDNWKK

SEQ ID NO: 1685405 - protein, 28 aa, Staphylococcus aureus
HRHNLKRPLILLNWNTLTGDTFITNGEY

SEQ ID NO: 1685406 - protein, 23 aa, Staphylococcus aureus
HRITALHTALVNGGVFVYVPKNV

SEQ ID NO: 1685407 - protein, 17 aa, Staphylococcus aureus
HYIDLKKSIKNLCLMKK

SEQ ID NO: 1685408 - protein, 17 aa, Staphylococcus aureus
IAELILPRSTDKPLKGK

SEQ ID NO: 1685409 - protein, 21 aa, Staphylococcus aureus
IAIDVAFTSLLTRALDTTHYI

SEQ ID NO: 1685410 - protein, 17 aa, Staphylococcus aureus
ICNLISPTSGTLYFKGK

SEQ ID NO: 1685411 - protein, 24 aa, Staphylococcus aureus
IDDYVLFPVHPWQYQHILPNVFAT

SEQ ID NO: 1685412 - protein, 25 aa, Staphylococcus aureus
IDGLIYHILIAIQRLNENFSFDIPI

SEQ ID NO: 1685413 - protein, 24 aa, Staphylococcus aureus
IEKKLSRYPQLYSRIGFAHEFDNL

SEQ ID NO: 1685414 - protein, 25 aa, Staphylococcus aureus
IENDLFTMYDYFQKAINYKKTKQVN

SEQ ID NO: 1685415 - protein, 20 aa, Staphylococcus aureus
IEQLLDEGLEWVLIQGQMGI

SEQ ID NO: 1685416 - protein, 25 aa, Staphylococcus aureus
IFEQDFDLLFVKWIPREQNKEANQH

SEQ ID NO: 1685417 - protein, 43 aa, Staphylococcus aureus
IGATESYPIMKYMQPVRKMIGKPTILNLVGPLINPYHLTYQMV

SEQ ID NO: 1685418 - protein, 25 aa, Staphylococcus aureus
IIKGKKVILFAPTFRGSGHGTAHYP

SEQ ID NO: 1685419 - protein, 18 aa, Staphylococcus aureus
IIVQTVPKSKLDFLANAP

SEQ ID NO: 1685420 - protein, 26 aa, Staphylococcus aureus
IKKAIAYYRFRPYAMKILKENHYDFV

SEQ ID NO: 1685421 - protein, 20 aa, Staphylococcus aureus
IKRLACLPTHIYRLKGFMTF

SEQ ID NO: 1685422 - protein, 25 aa, Staphylococcus aureus
IKVTAWMPLMRNRGLLDNPVIVKIA

SEQ ID NO: 1685423 - protein, 22 aa, Staphylococcus aureus
ILALFCRIFKYKFGMVNKVVIK

SEQ ID NO: 1685424 - protein, 25 aa, Staphylococcus aureus
ILKNISWQIAKGDKWILYGLNGAGK

SEQ ID NO: 1685425 - protein, 24 aa, Staphylococcus aureus
ILSTNHLLYLTQRFYDATFSKEEL

SEQ ID NO: 1685426 - protein, 26 aa, Staphylococcus aureus
IPIIEDDIFRDIFFSDPTPAIKTYDK

SEQ ID NO: 1685427 - protein, 17 aa, Staphylococcus aureus
IPSRLKALHWHEDMFQI

SEQ ID NO: 1685428 - protein, 24 aa, Staphylococcus aureus
IPTARDLKLPEHHSYIISYNGSKT

SEQ ID NO: 1685429 - protein, 25 aa, Staphylococcus aureus
IPVCGFAWIHWSVANVSITGDSISI

SEQ ID NO: 1685430 - protein, 28 aa, Staphylococcus aureus
IREADVILYDRLVNPLILQYSKSTTEII

SEQ ID NO: 1685431 - protein, 22 aa, Staphylococcus aureus
IVDVIKYLINTIPKIRKNLRHA

SEQ ID NO: 1685432 - protein, 17 aa, Staphylococcus aureus
IVRLVHRNHYVPLNEET

SEQ ID NO: 1685433 - protein, 20 aa, Staphylococcus aureus
KAHYPEIKVLVLTSYVDDEH

SEQ ID NO: 1685434 - protein, 23 aa, Staphylococcus aureus
KAISILEQALFQHQLHFKTEVHS

SEQ ID NO: 1685435 - protein, 24 aa, Staphylococcus aureus
KALFEKWFHPKDASTKVFRFNAVS

SEQ ID NO: 1685436 - protein, 23 aa, Staphylococcus aureus
KAQINRLKLFKQHGISSKCVYVK

SEQ ID NO: 1685437 - protein, 23 aa, Staphylococcus aureus
KDDPRFDNPTKPIGPFYTKEEVE

SEQ ID NO: 1685438 - protein, 23 aa, Staphylococcus aureus
KDGRLFVCYLGDFKSTGGIFAAT

SEQ ID NO: 1685439 - protein, 24 aa, Staphylococcus aureus
KEAQIDLFKQFKTIADKKKSVSDR

SEQ ID NO: 1685440 - protein, 24 aa, Staphylococcus aureus
KEAVDLFGCIIYPNDTEIGFYSPE

SEQ ID NO: 1685441 - protein, 24 aa, Staphylococcus aureus
KELFEKWFHPKGASTKVFRFNAVS

SEQ ID NO: 1685442 - protein, 22 aa, Staphylococcus aureus
KELILKTVIDLVDKRVPVIAGT

SEQ ID NO: 1685443 - protein, 27 aa, Staphylococcus aureus
KELRKAMLYAIDREKWIKAFFNGYASE

SEQ ID NO: 1685444 - protein, 24 aa, Staphylococcus aureus
KETKFNGRRWYLDDYELNTLIDNE

SEQ ID NO: 1685445 - protein, 34 aa, Staphylococcus aureus
KEYKDEFLAAPTEIKFLLYFAKMTKKDKNKLYHF

SEQ ID NO: 1685446 - protein, 21 aa, Staphylococcus aureus
KFHISHLGGALPFFMTRIKDN

SEQ ID NO: 1685447 - protein, 23 aa, Staphylococcus aureus
KGDILKIGAITKGARGYLTFGHT

SEQ ID NO: 1685448 - protein, 19 aa, Staphylococcus aureus
KGWMCIQVFFIRQGNMIKR

SEQ ID NO: 1685449 - protein, 26 aa, Staphylococcus aureus
KHNINEIYLIAHAFLESGYGTSNFAN

SEQ ID NO: 1685450 - protein, 19 aa, Staphylococcus aureus
KHQILQHSLTIRQYEMQKQ

SEQ ID NO: 1685451 - protein, 20 aa, Staphylococcus aureus
KHRQYWLSQFKDEVPILSLP

SEQ ID NO: 1685452 - protein, 17 aa, Staphylococcus aureus
KIALTIALSHDVKLLIL

SEQ ID NO: 1685453 - protein, 30 aa, Staphylococcus aureus
KIKDILTEYNIRILDLPLATGLVAEVGQGL

SEQ ID NO: 1685454 - protein, 22 aa, Staphylococcus aureus
KIRKYPIGIGPYKVKKIVPGEA

SEQ ID NO: 1685455 - protein, 17 aa, Staphylococcus aureus
KIVRWRAAMFIFDEGNA

SEQ ID NO: 1685456 - protein, 26 aa, Staphylococcus aureus
KKDMDWIKKNYDLYSKLIAGAIHGKP

SEQ ID NO: 1685457 - protein, 20 aa, Staphylococcus aureus
KKRIDVPEYRRPASDRKISI

SEQ ID NO: 1685458 - protein, 18 aa, Staphylococcus aureus
KLGYDQVLWLDGVEQKYI

SEQ ID NO: 1685459 - protein, 17 aa, Staphylococcus aureus
KLNQDLLAKCYLSCLKL

SEQ ID NO: 1685460 - protein, 33 aa, Staphylococcus aureus
KNLIGAFYRPTAVIYDLDFLKTLPFEQILSGYA

SEQ ID NO: 1685461 - protein, 19 aa, Staphylococcus aureus
KPVIIYFYGGSFENGHGTA

SEQ ID NO: 1685462 - protein, 26 aa, Staphylococcus aureus
KQDKLKLYKFFIIIAKYIKRNEQFFK

SEQ ID NO: 1685463 - protein, 20 aa, Staphylococcus aureus
KQLNAFIHQSNFKPGDKLPN

SEQ ID NO: 1685464 - protein, 34 aa, Staphylococcus aureus
KQYYQAMYLSNLTSYLFSFVKIPDNIILSLINNL

SEQ ID NO: 1685465 - protein, 20 aa, Staphylococcus aureus
KRIENFKFFGQYANLKELKN

SEQ ID NO: 1685466 - protein, 24 aa, Staphylococcus aureus
KSCESQLLSMLPIEVEQIPERFSY

SEQ ID NO: 1685467 - protein, 27 aa, Staphylococcus aureus
KSELGSRMRLRIMPELMYEYDQSIEYG

SEQ ID NO: 1685468 - protein, 22 aa, Staphylococcus aureus
KSQNSFPKNLSYLKSYTDPKTG

SEQ ID NO: 1685469 - protein, 30 aa, Staphylococcus aureus
KTQYFVSMMGYSPGFPYLTGLNKKLYINHT

SEQ ID NO: 1685470 - protein, 22 aa, Staphylococcus aureus
KVAAVWKLDLKGHKPALEDTEE

SEQ ID NO: 1685471 - protein, 20 aa, Staphylococcus aureus
KVDDSIWRSMLEHVNWNMID

SEQ ID NO: 1685472 - protein, 23 aa, Staphylococcus aureus
KVLLRLREGKITERHARAVLSLS

SEQ ID NO: 1685473 - protein, 28 aa, Staphylococcus aureus
KYNGIYGYRRIYIYIRLKLGKQVNRKRI

SEQ ID NO: 1685474 - protein, 40 aa, Staphylococcus aureus
LADDYQALAILPLWHHDDTYLFDLLLRKIEDMILPKKSVS

SEQ ID NO: 1685475 - protein, 28 aa, Staphylococcus aureus
LDIKVIMPMFDDALPYYKQFITEVTTFL

SEQ ID NO: 1685476 - protein, 28 aa, Staphylococcus aureus
LEKHNIYYGQWLILRDIAKHQPTTLIEI

SEQ ID NO: 1685477 - protein, 23 aa, Staphylococcus aureus
LEKYTLMTMHGLFNQLKLGIISI

SEQ ID NO: 1685478 - protein, 19 aa, Staphylococcus aureus
LENLAIPRAAFKDIVKMMD

SEQ ID NO: 1685479 - protein, 20 aa, Staphylococcus aureus
LFPVNEGILQFWISSEDQMY

SEQ ID NO: 1685480 - protein, 30 aa, Staphylococcus aureus
LGKLLKLGGKALKPLGFITAITDNIGKKSW

SEQ ID NO: 1685481 - protein, 19 aa, Staphylococcus aureus
LIDAFHRAGVDKIFGVPGD

SEQ ID NO: 1685482 - protein, 25 aa, Staphylococcus aureus
LIHYYSVETIFDLALLTLLKGDLSI

SEQ ID NO: 1685483 - protein, 18 aa, Staphylococcus aureus
LISSFNVVLVKLAEEIMP

SEQ ID NO: 1685484 - protein, 25 aa, Staphylococcus aureus
LKHTERPMIFPLSNPTKLAEATAQD

SEQ ID NO: 1685485 - protein, 21 aa, Staphylococcus aureus
LKVDAPIVEGSFIAAVKLSIG

SEQ ID NO: 1685486 - protein, 19 aa, Staphylococcus aureus
LNIHPSLLPKYKGIDAIGQ

SEQ ID NO: 1685487 - protein, 26 aa, Staphylococcus aureus
LNQSKIGGMPFLKSFKDIPLDENNVP

SEQ ID NO: 1685488 - protein, 20 aa, Staphylococcus aureus
LNVDVQLRLLKYQEDTAKLL

SEQ ID NO: 1685489 - protein, 18 aa, Staphylococcus aureus
LPNDRKFHPLEKLGRYLM

SEQ ID NO: 1685490 - protein, 17 aa, Staphylococcus aureus
LPYLIELGAIEVSINFR

SEQ ID NO: 1685491 - protein, 28 aa, Staphylococcus aureus
LSQSKIGGMPFLKSFKDIPLDENNVPMV

SEQ ID NO: 1685492 - protein, 25 aa, Staphylococcus aureus
LSSAQKRMYLLWKSNHKDTVYNIPF

SEQ ID NO: 1685493 - protein, 25 aa, Staphylococcus aureus
LSSFLFMRLNFYLIDLFRQQKRLND

SEQ ID NO: 1685494 - protein, 17 aa, Staphylococcus aureus
LTKPILGEIFKEIVNDS

SEQ ID NO: 1685495 - protein, 26 aa, Staphylococcus aureus
LVSAASSCYIISLAATLERAKFTDIS

SEQ ID NO: 1685496 - protein, 26 aa, Staphylococcus aureus
MIESKEILPYLYKGLRDKSPAVRRTA

SEQ ID NO: 1685497 - protein, 26 aa, Staphylococcus aureus
MPSVLNKYFNKLSVFRKLFGNLTYSN

SEQ ID NO: 1685498 - protein, 17 aa, Staphylococcus aureus
MQKPFYTNVLIAKLQAI

SEQ ID NO: 1685499 - protein, 19 aa, Staphylococcus aureus
MREVSNVPILFLSSRDNPM

SEQ ID NO: 1685500 - protein, 22 aa, Staphylococcus aureus
MSHDLQLPIGILPGGTFNDFTK

SEQ ID NO: 1685501 - protein, 18 aa, Staphylococcus aureus
MTGIFLDQKEVRKKLRGQ

SEQ ID NO: 1685502 - protein, 18 aa, Staphylococcus aureus
NDIFKFEKELKRLGINAT

SEQ ID NO: 1685503 - protein, 26 aa, Staphylococcus aureus
NDTLKLQRMGVLPKFHGGTKKKDWLD

SEQ ID NO: 1685504 - protein, 43 aa, Staphylococcus aureus
NFKNKEGYNLTFFAFFVKAVADALKAYPLLNSSWQGNEIVLHK

SEQ ID NO: 1685505 - protein, 28 aa, Staphylococcus aureus
NFNGKKEWKLFYLYKELIQTFEILYDDT

SEQ ID NO: 1685506 - protein, 28 aa, Staphylococcus aureus
NFSTQLLDRFLVIAHSYQLNARILVTKK

SEQ ID NO: 1685507 - protein, 25 aa, Staphylococcus aureus
NKKNELIYQFNPKAQIYGFIVGSGL

SEQ ID NO: 1685508 - protein, 25 aa, Staphylococcus aureus
NKKRYYKSFSRGTVVYVKLGSNIGS

SEQ ID NO: 1685509 - protein, 28 aa, Staphylococcus aureus
NKMRRIYRRKLTYILKRLKPYKEQLDIQ

SEQ ID NO: 1685510 - protein, 24 aa, Staphylococcus aureus
NKTIPWLYVERGFEIPSFNYVLKT

SEQ ID NO: 1685511 - protein, 25 aa, Staphylococcus aureus
NKTNYLIDLMHRHNLKRPLILLNWN

SEQ ID NO: 1685512 - protein, 26 aa, Staphylococcus aureus
NLIDILNPYLCIVFCNSRDNANDLAR

SEQ ID NO: 1685513 - protein, 20 aa, Staphylococcus aureus
NLNVIKIPANILFGGKDEPS

SEQ ID NO: 1685514 - protein, 24 aa, Staphylococcus aureus
NLPAKYIIHTVGPQIRRLPVSKLN

SEQ ID NO: 1685515 - protein, 27 aa, Staphylococcus aureus
NLVTFKEYVNMFEDYQSALSNYENIIE

SEQ ID NO: 1685516 - protein, 22 aa, Staphylococcus aureus
NNGFIAFVRVNFYDGKDALQPN

SEQ ID NO: 1685517 - protein, 21 aa, Staphylococcus aureus
NNYPFPNTFKVLAVSGFKLKQ

SEQ ID NO: 1685518 - protein, 20 aa, Staphylococcus aureus
NPDDEMPWIQSERQLILVLM

SEQ ID NO: 1685519 - protein, 27 aa, Staphylococcus aureus
NPYHLTYQMVGIFDPTKLKLVAKTIKD

SEQ ID NO: 1685520 - protein, 20 aa, Staphylococcus aureus
NTRLVLEKGLTLIGSSRSGS

SEQ ID NO: 1685521 - protein, 25 aa, Staphylococcus aureus
NYLTGFITGPLLSKKYLSDVPIKDL

SEQ ID NO: 1685522 - protein, 18 aa, Staphylococcus aureus
PFSNTIHWQFGHVLTIFE

SEQ ID NO: 1685523 - protein, 18 aa, Staphylococcus aureus
PNCGFYTATHPLNFHHRN

SEQ ID NO: 1685524 - protein, 18 aa, Staphylococcus aureus
PNIKFHISHLGGALPFFM

SEQ ID NO: 1685525 - protein, 18 aa, Staphylococcus aureus
PQMPVAFQSSKPLIEKVS

SEQ ID NO: 1685526 - protein, 25 aa, Staphylococcus aureus
PSKSYIKEAVKGSLKRLGIDHIDLY

SEQ ID NO: 1685527 - protein, 32 aa, Staphylococcus aureus
PSSPSYALFKGRDLVYFMPREFIEGRDINDIA

SEQ ID NO: 1685528 - protein, 18 aa, Staphylococcus aureus
QGDILSENISIPASLGGV

SEQ ID NO: 1685529 - protein, 33 aa, Staphylococcus aureus
QGIAKMFDLMLPQKNIRMPLSKMNMFGLGNMMM

SEQ ID NO: 1685530 - protein, 23 aa, Staphylococcus aureus
QGKPLVCVGILKGSAMFMSDLIK

SEQ ID NO: 1685531 - protein, 27 aa, Staphylococcus aureus
QHNNPFHMSPYFGYASRLLSTSGIDYT

SEQ ID NO: 1685532 - protein, 17 aa, Staphylococcus aureus
QIDQIIDEAKAYHFKSV

SEQ ID NO: 1685533 - protein, 20 aa, Staphylococcus aureus
QIIDEAKAYHFKSVCVNPTH

SEQ ID NO: 1685534 - protein, 17 aa, Staphylococcus aureus
QIIFIDTPGIHKPKHKL

SEQ ID NO: 1685535 - protein, 19 aa, Staphylococcus aureus
QIILPHTTQFYISNNEEIG

SEQ ID NO: 1685536 - protein, 18 aa, Staphylococcus aureus
QIKCQYVLMTYYNIICHY

SEQ ID NO: 1685537 - protein, 19 aa, Staphylococcus aureus
QIVGYLLSGDPAYIPRQNE

SEQ ID NO: 1685538 - protein, 21 aa, Staphylococcus aureus
QLLIDFLSNNKLMRIPQVVDF

SEQ ID NO: 1685539 - protein, 18 aa, Staphylococcus aureus
QMIYIVNDKLTKKELVEI

SEQ ID NO: 1685540 - protein, 19 aa, Staphylococcus aureus
QNRSLLRKIVDPETKERIY

SEQ ID NO: 1685541 - protein, 21 aa, Staphylococcus aureus
QPIIELAARIYIEILDEVRQA

SEQ ID NO: 1685542 - protein, 22 aa, Staphylococcus aureus
QQFDIITIFCDSLNYLQDETAV

SEQ ID NO: 1685543 - protein, 25 aa, Staphylococcus aureus
QSERQLILVLMAQNKPIYGACFGAQ

SEQ ID NO: 1685544 - protein, 18 aa, Staphylococcus aureus
QWFQHDPKLYGAFKEKYE

SEQ ID NO: 1685545 - protein, 29 aa, Staphylococcus aureus
QYCVDHLITFIPYFPLASGILAGKYDENT

SEQ ID NO: 1685546 - protein, 18 aa, Staphylococcus aureus
QYHLIQPVIGISSAGVVD

SEQ ID NO: 1685547 - protein, 24 aa, Staphylococcus aureus
RELIFREFYYVLMTQYPETSYQAF

SEQ ID NO: 1685548 - protein, 17 aa, Staphylococcus aureus
RFKEALIFMGRKNGKTT

SEQ ID NO: 1685549 - protein, 25 aa, Staphylococcus aureus
RLVQQYPDRFLAYGAVSLPYVDQAI

SEQ ID NO: 1685550 - protein, 17 aa, Staphylococcus aureus
RPALFDPAPLYGDREFD

SEQ ID NO: 1685551 - protein, 20 aa, Staphylococcus aureus
RQGQLFLLDVFEGNIFKVNP

SEQ ID NO: 1685552 - protein, 18 aa, Staphylococcus aureus
RRAKLLETILKNTRSIDA

SEQ ID NO: 1685553 - protein, 29 aa, Staphylococcus aureus
RSFKENGDWYKLEKLWEKAIKSGKSIENI

SEQ ID NO: 1685554 - protein, 27 aa, Staphylococcus aureus
RSYQDMLKIWGHLFQYIKSEHIEDTYL

SEQ ID NO: 1685555 - protein, 20 aa, Staphylococcus aureus
RVGPIKLHIVPFTELQKQVN

SEQ ID NO: 1685556 - protein, 17 aa, Staphylococcus aureus
RVMIARALMGQPQVLIL

SEQ ID NO: 1685557 - protein, 24 aa, Staphylococcus aureus
SDKDGLPFIEKWIKQYGSEAWTKQ

SEQ ID NO: 1685558 - protein, 28 aa, Staphylococcus aureus
SDTAVMIAWLVKIPHSIMPILGTSQLKR

SEQ ID NO: 1685559 - protein, 26 aa, Staphylococcus aureus
SEAEAQSHRLLLKAGLIKQSTSGIYS

SEQ ID NO: 1685560 - protein, 21 aa, Staphylococcus aureus
SELNNIFINLSIQHASLLSEA

SEQ ID NO: 1685561 - protein, 21 aa, Staphylococcus aureus
SERIVNHIKYYLNLITEKPSD

SEQ ID NO: 1685562 - protein, 23 aa, Staphylococcus aureus
SGIHPEWLYCAKANLVLEPAYTG

SEQ ID NO: 1685563 - protein, 26 aa, Staphylococcus aureus
SHYMGIPIEESFLKLADRPLDEATLA

SEQ ID NO: 1685564 - protein, 25 aa, Staphylococcus aureus
SIISRYAFITYMDQISKYINMTIPK

SEQ ID NO: 1685565 - protein, 18 aa, Staphylococcus aureus
SINELDKLNWAPADIPAV

SEQ ID NO: 1685566 - protein, 28 aa, Staphylococcus aureus
SNHKDTVYNIPFLWRLSSELNVAQLRQA

SEQ ID NO: 1685567 - protein, 28 aa, Staphylococcus aureus
SNKIFECIHAGLPVILSPVKEHIYLNEK

SEQ ID NO: 1685568 - protein, 26 aa, Staphylococcus aureus
SNMDIEMREYFWSIIAKLKEENRTIL

SEQ ID NO: 1685569 - protein, 17 aa, Staphylococcus aureus
SPQIIIGAQYIQTAGVA

SEQ ID NO: 1685570 - protein, 22 aa, Staphylococcus aureus
SRLEILDLLSCGELCACDLLEH

SEQ ID NO: 1685571 - protein, 23 aa, Staphylococcus aureus
SSRLEILDLLSCGELCACDLLEH

SEQ ID NO: 1685572 - protein, 27 aa, Staphylococcus aureus
SVTNNLQLVMAIAALKLKLSPSEVWNA

SEQ ID NO: 1685573 - protein, 23 aa, Staphylococcus aureus
SYRNEYFYKNTMLNKLLLGLHSV

SEQ ID NO: 1685574 - protein, 24 aa, Staphylococcus aureus
TAREIPIDKLMIDRIYVNVTGSFT

SEQ ID NO: 1685575 - protein, 25 aa, Staphylococcus aureus
TDKKRPLLFDLNLVSHLTYGNFDDD

SEQ ID NO: 1685576 - protein, 23 aa, Staphylococcus aureus
TDTFALNKPAQGLFAKFGFHKVG

SEQ ID NO: 1685577 - protein, 26 aa, Staphylococcus aureus
TEHHIRILDLPLMTGLVAEVGQGLSC

SEQ ID NO: 1685578 - protein, 26 aa, Staphylococcus aureus
TEISEKLVVLLPLKFGDYLSSSSMRS

SEQ ID NO: 1685579 - protein, 19 aa, Staphylococcus aureus
TILLVLEKGEDIVECITNF

SEQ ID NO: 1685580 - protein, 26 aa, Staphylococcus aureus
TKKEFIDFPVLFDDEGNFRKKQVIDY

SEQ ID NO: 1685581 - protein, 24 aa, Staphylococcus aureus
TLAQEVYQEWYLGSKLYEEVEKKI

SEQ ID NO: 1685582 - protein, 21 aa, Staphylococcus aureus
TLIPHRGIVRLVHRNHYVPLN

SEQ ID NO: 1685583 - protein, 32 aa, Staphylococcus aureus
TLLNKDKVEWIILAGYMRLIGPDLLASFEGKI

SEQ ID NO: 1685584 - protein, 17 aa, Staphylococcus aureus
TPKDLTFILANDIHSLG

SEQ ID NO: 1685585 - protein, 18 aa, Staphylococcus aureus
TRLVLEKGLTLIGSSRSG

SEQ ID NO: 1685586 - protein, 19 aa, Staphylococcus aureus
TRRDFIPGVFEENVRRVKA

SEQ ID NO: 1685587 - protein, 24 aa, Staphylococcus aureus
TSDDIDLFIPHQANIRIMESARER

SEQ ID NO: 1685588 - protein, 33 aa, Staphylococcus aureus
TTIFKAMIAIKTGNPIIFAFHPSAQESSKRAAE

SEQ ID NO: 1685589 - protein, 23 aa, Staphylococcus aureus
VDIKEVFLKLPIIGTEVYDESNE

SEQ ID NO: 1685590 - protein, 29 aa, Staphylococcus aureus
VEDLIRLIAADLVEFDWLDGFDIECRNEE

SEQ ID NO: 1685591 - protein, 23 aa, Staphylococcus aureus
VENVEMIAFCDVDISKAACAAEA

SEQ ID NO: 1685592 - protein, 18 aa, Staphylococcus aureus
VEWALYIAKNKIAIDVPG

SEQ ID NO: 1685593 - protein, 20 aa, Staphylococcus aureus
VGIINIYFEILEDKIKIVIS

SEQ ID NO: 1685594 - protein, 17 aa, Staphylococcus aureus
VGLFFSKERILGSEHEA

SEQ ID NO: 1685595 - protein, 24 aa, Staphylococcus aureus
VKDGYADLKILYSPASDQNYRYAN

SEQ ID NO: 1685596 - protein, 24 aa, Staphylococcus aureus
VKGGLQFTYISLDDYRIIKSSLYG

SEQ ID NO: 1685597 - protein, 20 aa, Staphylococcus aureus
VKPAKKFLYLVIEKLMSCIT

SEQ ID NO: 1685598 - protein, 17 aa, Staphylococcus aureus
VKVLAQLFSKIKPDVIH

SEQ ID NO: 1685599 - protein, 24 aa, Staphylococcus aureus
VNRKRIYRLMKELNLKAVIRQKRK

SEQ ID NO: 1685600 - protein, 17 aa, Staphylococcus aureus
VPEYRRPASDRKISIRG

SEQ ID NO: 1685601 - protein, 17 aa, Staphylococcus aureus
VRFQYRTGEITYGNEMQ

SEQ ID NO: 1685602 - protein, 26 aa, Staphylococcus aureus
VSHATKLLWLGIPDDAIIGALHIKTI

SEQ ID NO: 1685603 - protein, 17 aa, Staphylococcus aureus
VTGYMKQYHLIQPVIGI

SEQ ID NO: 1685604 - protein, 18 aa, Staphylococcus aureus
WHRLKYYVVVNHLGHLVS

SEQ ID NO: 1685605 - protein, 17 aa, Staphylococcus aureus
WQLVLQHAKEDALFATN

SEQ ID NO: 1685606 - protein, 18 aa, Staphylococcus aureus
WVRSFKLRGAYNAISVLS

SEQ ID NO: 1685607 - protein, 33 aa, Staphylococcus aureus
YAAVPPLTHFITNSTYFLWDVLTTAYIGNKDLV

SEQ ID NO: 1685608 - protein, 17 aa, Staphylococcus aureus
YEPLIHKNDKEFKEGMQ

SEQ ID NO: 1685609 - protein, 23 aa, Staphylococcus aureus
YEVLNRQFWYDTANFHEPSLINS

SEQ ID NO: 1685610 - protein, 29 aa, Staphylococcus aureus
YFENKVAGWLWAWKAVPFKLLGINTSLPF

SEQ ID NO: 1685611 - protein, 22 aa, Staphylococcus aureus
YHDKKFILMTAHRRENLGQPME

SEQ ID NO: 1685612 - protein, 21 aa, Staphylococcus aureus
YIDLWEYYAAIAEKDFRDVMD

SEQ ID NO: 1685613 - protein, 25 aa, Staphylococcus aureus
YNLPAKYIIHTVGPQIRRLPVSKMN

SEQ ID NO: 1685614 - protein, 26 aa, Staphylococcus aureus
YQSAFYQELFYFYYDLFKSDDDIYTK

SEQ ID NO: 1685615 - protein, 17 aa, Staphylococcus aureus
YYAAIAEKDFRDVMDQI

SEQ ID NO: 1685616 - protein, 37 aa, Staphylococcus aureus
AADIAPIFGLNKRQGRQLLAYLGAPKQLYEKTPTADL

SEQ ID NO: 1685617 - protein, 23 aa, Staphylococcus aureus
ADIVIGDFPVGYYPIDERSRDFK

SEQ ID NO: 1685618 - protein, 18 aa, Staphylococcus aureus
AEAIRYLERIGFDAIHKY

SEQ ID NO: 1685619 - protein, 23 aa, Staphylococcus aureus
AEKSIEMIVAMIGVLKAGGAYVP

SEQ ID NO: 1685620 - protein, 25 aa, Staphylococcus aureus
AEQLHSIFLEVIIAPKFTDEALNIL

SEQ ID NO: 1685621 - protein, 17 aa, Staphylococcus aureus
AFKNVFKGFVDKVKDKT

SEQ ID NO: 1685622 - protein, 19 aa, Staphylococcus aureus
AFTCLQMVKLVAEEDLQLD

SEQ ID NO: 1685623 - protein, 26 aa, Staphylococcus aureus
AFYTHGHLYQVNRTRYLLAEQARELG

SEQ ID NO: 1685624 - protein, 25 aa, Staphylococcus aureus
AGLQPYLDDLGFNLVGYGCTTCIGN

SEQ ID NO: 1685625 - protein, 26 aa, Staphylococcus aureus
AHNEPSWMTELRKKALKLTETLEMPK

SEQ ID NO: 1685626 - protein, 18 aa, Staphylococcus aureus
AIESGEIFKYFPIPEQSS

SEQ ID NO: 1685627 - protein, 43 aa, Staphylococcus aureus
AILVHPWQYDHTIGKYFEAWIAKKILIPTPFTILSKATLSFRT

SEQ ID NO: 1685628 - protein, 25 aa, Staphylococcus aureus
AKHNHTFYRVNIPKISVLNPVGSGD

SEQ ID NO: 1685629 - protein, 30 aa, Staphylococcus aureus
AKLRYHQVGQGPVLIFIPGANGTGNIFLPL

SEQ ID NO: 1685630 - protein, 19 aa, Staphylococcus aureus
ALQDIVNLLLDDVQVTLDK

SEQ ID NO: 1685631 - protein, 25 aa, Staphylococcus aureus
ANQYYLTLHLNYQLKKEYIKYATGT

SEQ ID NO: 1685632 - protein, 24 aa, Staphylococcus aureus
AQMVNHLYRLPVMYIEYSGIYGDV

SEQ ID NO: 1685633 - protein, 17 aa, Staphylococcus aureus
AQVVLRWNVQHGVVIIP

SEQ ID NO: 1685634 - protein, 34 aa, Staphylococcus aureus
ARGTHTKEVLFPDKSLKLSYKVNVANIDTPKNID

SEQ ID NO: 1685635 - protein, 24 aa, Staphylococcus aureus
ASTIRDRLFLYTQIITALDEYREE

SEQ ID NO: 1685636 - protein, 35 aa, Staphylococcus aureus
ATGHIVNLYFPFVEVEMMLTLLDMAQIYVSSGSAC

SEQ ID NO: 1685637 - protein, 18 aa, Staphylococcus aureus
AVLLAIGRKPNTALALEN

SEQ ID NO: 1685638 - protein, 28 aa, Staphylococcus aureus
AVMIGIIYQFIVANILFNSNHDIQHYIN

SEQ ID NO: 1685639 - protein, 26 aa, Staphylococcus aureus
AVMTNLNAYFKPEILNRMDDIVLFKP

SEQ ID NO: 1685640 - protein, 26 aa, Staphylococcus aureus
AYKMPKKMRRLALRSALSFKVQENGL

SEQ ID NO: 1685641 - protein, 20 aa, Staphylococcus aureus
AYVEGHLLALPGWAGILYYR

SEQ ID NO: 1685642 - protein, 17 aa, Staphylococcus aureus
CLPLIKKGGQFVALKSS

SEQ ID NO: 1685643 - protein, 25 aa, Staphylococcus aureus
CQEIKAKDYAKDVDILFILGGDGTV

SEQ ID NO: 1685644 - protein, 21 aa, Staphylococcus aureus
DAYLKVAYQFSLPFGRDYADA

SEQ ID NO: 1685645 - protein, 27 aa, Staphylococcus aureus
DEQPLKLFHPVYTYKMKFIKSFEAIDL

SEQ ID NO: 1685646 - protein, 30 aa, Staphylococcus aureus
DETKYHYFTKLLNLLKYEQVTYLIDANPSI

SEQ ID NO: 1685647 - protein, 23 aa, Staphylococcus aureus
DFNTVRYVYNRNLPKSLIEELKA

SEQ ID NO: 1685648 - protein, 24 aa, Staphylococcus aureus
DGLIYHILIAIQRLNENFSFDIPI

SEQ ID NO: 1685649 - protein, 25 aa, Staphylococcus aureus
DGQYRGIATWRYDQKRQRLIGTIEV

SEQ ID NO: 1685650 - protein, 24 aa, Staphylococcus aureus
DGTMDEILIFDIEPSYDAIITLKD

SEQ ID NO: 1685651 - protein, 24 aa, Staphylococcus aureus
DIAKYDVITLASSKYMVFEAQGAV

SEQ ID NO: 1685652 - protein, 24 aa, Staphylococcus aureus
DKANQHFYIMDKQGLLFDDMDDLT

SEQ ID NO: 1685653 - protein, 35 aa, Staphylococcus aureus
DKAWAHSKSIWRGTSKWFSNAYKSAKGWLTDMANK

SEQ ID NO: 1685654 - protein, 18 aa, Staphylococcus aureus
DLGHFRGAIRPDITRFRD

SEQ ID NO: 1685655 - protein, 17 aa, Staphylococcus aureus
DLLLKIREQQNLTIILI

SEQ ID NO: 1685656 - protein, 29 aa, Staphylococcus aureus
DLVGNNTPVFFFRDPKLFVSLNRAVKRDP

SEQ ID NO: 1685657 - protein, 18 aa, Staphylococcus aureus
DMKGGLMALVIALIELKE

SEQ ID NO: 1685658 - protein, 19 aa, Staphylococcus aureus
DPQDIAEAVLYALTQPKHV

SEQ ID NO: 1685659 - protein, 25 aa, Staphylococcus aureus
DQDASTHLPYIYLSAGVSAELFQET

SEQ ID NO: 1685660 - protein, 20 aa, Staphylococcus aureus
DQLLRYYSMYPTAATKVAYT

SEQ ID NO: 1685661 - protein, 20 aa, Staphylococcus aureus
DRAWDFIYNNGVSVAYLSFA

SEQ ID NO: 1685662 - protein, 25 aa, Staphylococcus aureus
DSTDRVLLFAPFYNDQVALDIQKLI

SEQ ID NO: 1685663 - protein, 24 aa, Staphylococcus aureus
DVAPYNYQLLQFVLEKIESGTSAQ

SEQ ID NO: 1685664 - protein, 25 aa, Staphylococcus aureus
DYKTYLKVPLLIKKAEKAECVSRFR

SEQ ID NO: 1685665 - protein, 17 aa, Staphylococcus aureus
DYYFFKASEDGPPTNWH

SEQ ID NO: 1685666 - protein, 23 aa, Staphylococcus aureus
EADIKIMMREVRLALFEADVNFK

SEQ ID NO: 1685667 - protein, 24 aa, Staphylococcus aureus
EAQTLFFGGLARIDYVSGGKRPLI

SEQ ID NO: 1685668 - protein, 29 aa, Staphylococcus aureus
ECNYPVISEKLEWIPNLYVAGCFADLELG

SEQ ID NO: 1685669 - protein, 21 aa, Staphylococcus aureus
EDCRRTMDIFRLLGVDIKEDE

SEQ ID NO: 1685670 - protein, 28 aa, Staphylococcus aureus
EDLIRLIAADLVEFDWLDGFDIECRNEE

SEQ ID NO: 1685671 - protein, 17 aa, Staphylococcus aureus
EDYYEVIEWAAKQPWSN

SEQ ID NO: 1685672 - protein, 25 aa, Staphylococcus aureus
EEDLDPTFIWHLAFAYGQEERDKEA

SEQ ID NO: 1685673 - protein, 18 aa, Staphylococcus aureus
EELKLLNKNLRVLNTELS

SEQ ID NO: 1685674 - protein, 28 aa, Staphylococcus aureus
EELTRIGLDLPFPIKINQMLGHQTSFLT

SEQ ID NO: 1685675 - protein, 49 aa, Staphylococcus aureus
EENAPVIWRGPMLGKMLTNFFTEVRWGDIEYLILDLPPGTGDVALDVHT

SEQ ID NO: 1685676 - protein, 23 aa, Staphylococcus aureus
EEYTYFFNGVKHILKAKNKELKG

SEQ ID NO: 1685677 - protein, 27 aa, Staphylococcus aureus
EFDYVLNQPLYQLIEQVKPRLTKAKIK

SEQ ID NO: 1685678 - protein, 24 aa, Staphylococcus aureus
EGQRYYLPIRTWNGSAPPNQILGD

SEQ ID NO: 1685679 - protein, 24 aa, Staphylococcus aureus
EIKNWEFPFVIKPGDDLPTAGGYG

SEQ ID NO: 1685680 - protein, 18 aa, Staphylococcus aureus
EILGVYLEPHRDALIQLH

SEQ ID NO: 1685681 - protein, 18 aa, Staphylococcus aureus
EIMTPWIPTDTNIGGEFV

SEQ ID NO: 1685682 - protein, 24 aa, Staphylococcus aureus
EIQNRIIPRILKRTNLIGQSQTGT

SEQ ID NO: 1685683 - protein, 30 aa, Staphylococcus aureus
EKDLYSTYLSYLPSTDFSYPLLMNVDDRGS

SEQ ID NO: 1685684 - protein, 17 aa, Staphylococcus aureus
ELFITTKVWIENVNYED

SEQ ID NO: 1685685 - protein, 20 aa, Staphylococcus aureus
ELQGRFPIRVELDSLAVEDF

SEQ ID NO: 1685686 - protein, 22 aa, Staphylococcus aureus
ELRQWFQHDPKLFGAFKEKYEK

SEQ ID NO: 1685687 - protein, 24 aa, Staphylococcus aureus
ELSKNMPVFFSANMSYGVHALTKI

SEQ ID NO: 1685688 - protein, 19 aa, Staphylococcus aureus
EMIALLIKYHSQYITIHDI

SEQ ID NO: 1685689 - protein, 27 aa, Staphylococcus aureus
EMKVKNGDLFLLLAKENWHEGVLGIVA

SEQ ID NO: 1685690 - protein, 24 aa, Staphylococcus aureus
ENKKVGLWSFDFNIDWHAGGDKRK

SEQ ID NO: 1685691 - protein, 18 aa, Staphylococcus aureus
ENNRFPLVLGGDHSIAIG

SEQ ID NO: 1685692 - protein, 17 aa, Staphylococcus aureus
ENQLPWHLPNDLKHVKK

SEQ ID NO: 1685693 - protein, 21 aa, Staphylococcus aureus
EQARELGCVFAFYGHTHVAKY

SEQ ID NO: 1685694 - protein, 17 aa, Staphylococcus aureus
EQLNWPDSWLYSTKFML

SEQ ID NO: 1685695 - protein, 18 aa, Staphylococcus aureus
EQLQPFLNKYLSHPEYVA

SEQ ID NO: 1685696 - protein, 17 aa, Staphylococcus aureus
EQNNIINFYKEKTIKDV

SEQ ID NO: 1685697 - protein, 24 aa, Staphylococcus aureus
EQQEKIELFKKLEFKQLLSDIDQS

SEQ ID NO: 1685698 - protein, 20 aa, Staphylococcus aureus
ERDLVAAQLYLLEHNHLPFS

SEQ ID NO: 1685699 - protein, 23 aa, Staphylococcus aureus
ERIKEIVPIWKKEIWEDGSKWQG

SEQ ID NO: 1685700 - protein, 22 aa, Staphylococcus aureus
ERRVQTHDFTWQAEIMSKPVKN

SEQ ID NO: 1685701 - protein, 21 aa, Staphylococcus aureus
ESFDFEMLRQMLGKHFISQDI

SEQ ID NO: 1685702 - protein, 20 aa, Staphylococcus aureus
ETFINVYRHLADSGVFIFDV

SEQ ID NO: 1685703 - protein, 18 aa, Staphylococcus aureus
ETPLKQLQIFVDTSSIEI

SEQ ID NO: 1685704 - protein, 17 aa, Staphylococcus aureus
EVAFHGGIPDTGFYRFW

SEQ ID NO: 1685705 - protein, 25 aa, Staphylococcus aureus
EVAYDKLIFATGSKAFVIPVPGSTL

SEQ ID NO: 1685706 - protein, 25 aa, Staphylococcus aureus
FDTDLNIPMSQWQYAMNRTLPDDIY

SEQ ID NO: 1685707 - protein, 18 aa, Staphylococcus aureus
FEDCCTIFTPKNPVTEPN

SEQ ID NO: 1685708 - protein, 17 aa, Staphylococcus aureus
FFTGIEIHPGAKIGKRL

SEQ ID NO: 1685709 - protein, 31 aa, Staphylococcus aureus
FHGGIPDTGFYRFWIQGIFARWTDNPNIEDM

SEQ ID NO: 1685710 - protein, 27 aa, Staphylococcus aureus
FIMIDEDKCLVVIPLNKAISESTLNTI

SEQ ID NO: 1685711 - protein, 17 aa, Staphylococcus aureus
FITLQLIKNEIPQKYPN

SEQ ID NO: 1685712 - protein, 29 aa, Staphylococcus aureus
FKEKRTFSKFEAWIYLLMEANHSKAKVPI

SEQ ID NO: 1685713 - protein, 18 aa, Staphylococcus aureus
FLKNQKNIIWLDCNIDII

SEQ ID NO: 1685714 - protein, 20 aa, Staphylococcus aureus
FPESEIIFITLHLLGSKMTE

SEQ ID NO: 1685715 - protein, 18 aa, Staphylococcus aureus
FPLVLGGDHSIAIGSVSA

SEQ ID NO: 1685716 - protein, 19 aa, Staphylococcus aureus
FQQCVWNELRQVPYGTLTT

SEQ ID NO: 1685717 - protein, 24 aa, Staphylococcus aureus
FRNDGRYIEIIGISIGGGTIKIKG

SEQ ID NO: 1685718 - protein, 17 aa, Staphylococcus aureus
FSNTIHWQFGHVLTIFE

SEQ ID NO: 1685719 - protein, 21 aa, Staphylococcus aureus
FVDEDILINKITLSYAQQVFD

SEQ ID NO: 1685720 - protein, 18 aa, Staphylococcus aureus
FWNGIQEWTERHGYIVDV

SEQ ID NO: 1685721 - protein, 17 aa, Staphylococcus aureus
FYEQFKDKGITKILTIE

SEQ ID NO: 1685722 - protein, 23 aa, Staphylococcus aureus
GAVKLALEKLIKPELNHLIHELT

SEQ ID NO: 1685723 - protein, 21 aa, Staphylococcus aureus
GAVLLLIMEKDMAYELGFDHG

SEQ ID NO: 1685724 - protein, 18 aa, Staphylococcus aureus
GDANVFVFPSLEAGNIGY

SEQ ID NO: 1685725 - protein, 17 aa, Staphylococcus aureus
GDNPLMRWFTNNVAVKI

SEQ ID NO: 1685726 - protein, 17 aa, Staphylococcus aureus
GDVLVLDNILDKAELQQ

SEQ ID NO: 1685727 - protein, 18 aa, Staphylococcus aureus
GFCIQRHITVRDKVLIFS

SEQ ID NO: 1685728 - protein, 19 aa, Staphylococcus aureus
GFGVIAKTLAASERKYREI

SEQ ID NO: 1685729 - protein, 23 aa, Staphylococcus aureus
GGITVIQILKLLEHVDLQSMGPR

SEQ ID NO: 1685730 - protein, 25 aa, Staphylococcus aureus
GIDTVVFIPSIIHPSFKRIPEVENL

SEQ ID NO: 1685731 - protein, 25 aa, Staphylococcus aureus
GIQQYDALMIYYVKSLIGLEQYFEA

SEQ ID NO: 1685732 - protein, 22 aa, Staphylococcus aureus
GKKTAYFKLAGLWIALNEEKDI

SEQ ID NO: 1685733 - protein, 18 aa, Staphylococcus aureus
GKTLLMLSGGIDSPVAGM

SEQ ID NO: 1685734 - protein, 22 aa, Staphylococcus aureus
GKYTADYLADKGVVPFLKVDKG

SEQ ID NO: 1685735 - protein, 26 aa, Staphylococcus aureus
GLGFKAFWEEETGFHYDLFDKVDPKL

SEQ ID NO: 1685736 - protein, 22 aa, Staphylococcus aureus
GLKYLDLYLVHWPGTNEAVMVD

SEQ ID NO: 1685737 - protein, 20 aa, Staphylococcus aureus
GLSPEYLLSRDYLEDDPEGF

SEQ ID NO: 1685738 - protein, 23 aa, Staphylococcus aureus
GNQDNWTYPPFQLTEKAGKLYGR

SEQ ID NO: 1685739 - protein, 21 aa, Staphylococcus aureus
GNREFVTWLDNIASIVSRVSV

SEQ ID NO: 1685740 - protein, 22 aa, Staphylococcus aureus
GNTVCYMWLRFNMDQQFDGTAI

SEQ ID NO: 1685741 - protein, 18 aa, Staphylococcus aureus
GQTLLPEVLSLYNAQFPN

SEQ ID NO: 1685742 - protein, 25 aa, Staphylococcus aureus
GQTYDWTILKNIKDIPYLIAGGINT

SEQ ID NO: 1685743 - protein, 22 aa, Staphylococcus aureus
GRATFLPLNVIQSRAVATDIKS

SEQ ID NO: 1685744 - protein, 26 aa, Staphylococcus aureus
GSWTVQMFMLFQFPHVAFENIPVADI

SEQ ID NO: 1685745 - protein, 24 aa, Staphylococcus aureus
GTEKKFTFWADKPGAYWVGEGQKI

SEQ ID NO: 1685746 - protein, 24 aa, Staphylococcus aureus
GTGKTFLAVVYAAKQLRKGTVKRI

SEQ ID NO: 1685747 - protein, 24 aa, Staphylococcus aureus
GTSIFPTPIVGMVGLIENVDYLND

SEQ ID NO: 1685748 - protein, 18 aa, Staphylococcus aureus
GTYGFLHQIKINNPTHQL

SEQ ID NO: 1685749 - protein, 24 aa, Staphylococcus aureus
GVDFRLIEPSAFYHTLQHFTGSKE

SEQ ID NO: 1685750 - protein, 37 aa, Staphylococcus aureus
GVRNAFDFPGFVPAYIRPLFCEGKGPFRFAALSGDPK

SEQ ID NO: 1685751 - protein, 26 aa, Staphylococcus aureus
GVSKQTIFNNIKRLNIETIKQENTSF

SEQ ID NO: 1685752 - protein, 17 aa, Staphylococcus aureus
GYIDIYDDCEFIVAIRS

SEQ ID NO: 1685753 - protein, 30 aa, Staphylococcus aureus
HDVTIEPSPIWMQVRLIKAGIRPINNVVDI

SEQ ID NO: 1685754 - protein, 23 aa, Staphylococcus aureus
HFSKLNVPFIYRVHEQPKSDRLR

SEQ ID NO: 1685755 - protein, 24 aa, Staphylococcus aureus
HKDGRLFICYLGDFKSTGGIFAAT

SEQ ID NO: 1685756 - protein, 24 aa, Staphylococcus aureus
HLYKLKIELKLRKSIFIKSLKKHL

SEQ ID NO: 1685757 - protein, 21 aa, Staphylococcus aureus
HSENELGALSTYLVSLDQHRE

SEQ ID NO: 1685758 - protein, 18 aa, Staphylococcus aureus
HSNAILPIRLDGATKEFF

SEQ ID NO: 1685759 - protein, 18 aa, Staphylococcus aureus
HTFGIIEANIRRSKDSII

SEQ ID NO: 1685760 - protein, 20 aa, Staphylococcus aureus
HTNAISLFDLIISTEADAYE

SEQ ID NO: 1685761 - protein, 17 aa, Staphylococcus aureus
HVQTVGKGGLLITLAKL

SEQ ID NO: 1685762 - protein, 25 aa, Staphylococcus aureus
HWGEFIPFFLERMDEALFAEHLNHS

SEQ ID NO: 1685763 - protein, 26 aa, Staphylococcus aureus
HYSNLRQYINISPYPATAKLLEGVSI

SEQ ID NO: 1685764 - protein, 17 aa, Staphylococcus aureus
IAALSYGQKKRVTIASV

SEQ ID NO: 1685765 - protein, 18 aa, Staphylococcus aureus
IATCWFNFRGFDHNPGII

SEQ ID NO: 1685766 - protein, 34 aa, Staphylococcus aureus
IDACYQLNVLQLIRLCRYFVDVLRQSANGRIIVI

SEQ ID NO: 1685767 - protein, 26 aa, Staphylococcus aureus
IDGITSIFHVMNFLAVDKAPKADWEV

SEQ ID NO: 1685768 - protein, 25 aa, Staphylococcus aureus
IDGLVTKLQAALIDNQAAISELDAK

SEQ ID NO: 1685769 - protein, 23 aa, Staphylococcus aureus
IDQIWAEAKYYYEQGEELFLNPE

SEQ ID NO: 1685770 - protein, 24 aa, Staphylococcus aureus
IDQNIPYTILRDNIYTHPTMAESF

SEQ ID NO: 1685771 - protein, 18 aa, Staphylococcus aureus
IEMNQGISFLPIYITKNS

SEQ ID NO: 1685772 - protein, 18 aa, Staphylococcus aureus
IERIKRAIANDEKILVYG

SEQ ID NO: 1685773 - protein, 24 aa, Staphylococcus aureus
IERLPDDMIWFDLSDRDQYTFPVP

SEQ ID NO: 1685774 - protein, 18 aa, Staphylococcus aureus
IEVVYGFAQLKRAAALAN

SEQ ID NO: 1685775 - protein, 18 aa, Staphylococcus aureus
IGLAEAIRYLERIGFDAI

SEQ ID NO: 1685776 - protein, 17 aa, Staphylococcus aureus
IHLLRQDGKIREISNQS

SEQ ID NO: 1685777 - protein, 21 aa, Staphylococcus aureus
IHRIKYDMLQPNPLRQEVMRR

SEQ ID NO: 1685778 - protein, 33 aa, Staphylococcus aureus
IKCLLHSRFIFLSPEFLLQPSNFKLISMIDFGM

SEQ ID NO: 1685779 - protein, 25 aa, Staphylococcus aureus
IKVTAWMPLMRNRGLLDDPVIVKIA

SEQ ID NO: 1685780 - protein, 27 aa, Staphylococcus aureus
ILKGYNFISVLGWPNYYANLGYQRASM

SEQ ID NO: 1685781 - protein, 29 aa, Staphylococcus aureus
ILSGTGMYSLWKGLPTVKVLQLITKIYGA

SEQ ID NO: 1685782 - protein, 24 aa, Staphylococcus aureus
ILSIASYLIGVKRIKALDIDEMAV

SEQ ID NO: 1685783 - protein, 19 aa, Staphylococcus aureus
IMEDFYIEKLITGGATSTA

SEQ ID NO: 1685784 - protein, 33 aa, Staphylococcus aureus
INNNAPYRFVDIKTLVYPGFATDLQQPITPLLF

SEQ ID NO: 1685785 - protein, 18 aa, Staphylococcus aureus
INPNWLTKPVLGEIFKDV

SEQ ID NO: 1685786 - protein, 21 aa, Staphylococcus aureus
IPTDLVVMAVGIRPYTEVAKE

SEQ ID NO: 1685787 - protein, 21 aa, Staphylococcus aureus
IQPGVRVIVPFGPRTIQGYVM

SEQ ID NO: 1685788 - protein, 18 aa, Staphylococcus aureus
IQYLIQLCGKSNIPIGII

SEQ ID NO: 1685789 - protein, 20 aa, Staphylococcus aureus
IREQQNLTIILITHEMHVIR

SEQ ID NO: 1685790 - protein, 17 aa, Staphylococcus aureus
ISTSDWKGERRTKSDSK

SEQ ID NO: 1685791 - protein, 38 aa, Staphylococcus aureus
ISVVDNTFMTLYYQNPLDLGIDIVLHSATKYLGGHSDV

SEQ ID NO: 1685792 - protein, 24 aa, Staphylococcus aureus
ITNRLSKIFGIKSISPVLKVEKSI

SEQ ID NO: 1685793 - protein, 30 aa, Staphylococcus aureus
KAAGKDVTIFFTFWGLNALKKAQSTRVKKK

SEQ ID NO: 1685794 - protein, 28 aa, Staphylococcus aureus
KATARNEITTILNNKLQAIQATPDATDE

SEQ ID NO: 1685795 - protein, 21 aa, Staphylococcus aureus
KDGEHLDLLSKIAITFSEEGN

SEQ ID NO: 1685796 - protein, 17 aa, Staphylococcus aureus
KDGLSPEYLLSRDYLED

SEQ ID NO: 1685797 - protein, 19 aa, Staphylococcus aureus
KDPKKYVELSQASMAKHVE

SEQ ID NO: 1685798 - protein, 26 aa, Staphylococcus aureus
KDRIIKPLAYLYNKDLERTGLLNTAA

SEQ ID NO: 1685799 - protein, 23 aa, Staphylococcus aureus
KDTKYLAWSLIDYDAIPVCGFAW

SEQ ID NO: 1685800 - protein, 24 aa, Staphylococcus aureus
KEIAQYFTDKIIGFSISDLDEYAK

SEQ ID NO: 1685801 - protein, 26 aa, Staphylococcus aureus
KEISEKLVVLLPLKFGDYLSSSSMRS

SEQ ID NO: 1685802 - protein, 17 aa, Staphylococcus aureus
KEMEEIGLSTGLPLVLH

SEQ ID NO: 1685803 - protein, 29 aa, Staphylococcus aureus
KETFHAIQGHFTAMFKQLFGGGDAELQLT

SEQ ID NO: 1685804 - protein, 23 aa, Staphylococcus aureus
KGDMITLDFGAYFNGYCSDITRT

SEQ ID NO: 1685805 - protein, 25 aa, Staphylococcus aureus
KGKVLARHIVPYPPGIPIIFKGETI

SEQ ID NO: 1685806 - protein, 25 aa, Staphylococcus aureus
KGTNFDVLPLIYQLPNESVKYYEYP

SEQ ID NO: 1685807 - protein, 18 aa, Staphylococcus aureus
KISFIDKTRVLFNDINKY

SEQ ID NO: 1685808 - protein, 24 aa, Staphylococcus aureus
KIVQPHAIALNYVYYDIYTQMIEM

SEQ ID NO: 1685809 - protein, 21 aa, Staphylococcus aureus
KKVIRLKYWNKDKKLKIEQIG

SEQ ID NO: 1685810 - protein, 23 aa, Staphylococcus aureus
KKVRNILKNLAKIDYLIFNKKEA

SEQ ID NO: 1685811 - protein, 17 aa, Staphylococcus aureus
KLAGLWIALNEEKDIPR

SEQ ID NO: 1685812 - protein, 21 aa, Staphylococcus aureus
KLETLQLQYVSSGLQSAVVVI

SEQ ID NO: 1685813 - protein, 19 aa, Staphylococcus aureus
KLILHLVTSKLTNIEENPQ

SEQ ID NO: 1685814 - protein, 19 aa, Staphylococcus aureus
KLLYRHMGPQNWWPADNDI

SEQ ID NO: 1685815 - protein, 31 aa, Staphylococcus aureus
KLQLINFDNFLTSHFYYYYDFEYDCLILPND

SEQ ID NO: 1685816 - protein, 39 aa, Staphylococcus aureus
KLVDGFTHLPGWVRKASVGLALFGAAIGPAVLAGGLLIR

SEQ ID NO: 1685817 - protein, 24 aa, Staphylococcus aureus
KMESRSMVLYINRNTRTTKGNFIV

SEQ ID NO: 1685818 - protein, 35 aa, Staphylococcus aureus
KNLIGAFYRPTAVIYDLDFLKTLPFEQILSGYAEV

SEQ ID NO: 1685819 - protein, 22 aa, Staphylococcus aureus
KNNVALKFQTLNEIIETINNSS

SEQ ID NO: 1685820 - protein, 24 aa, Staphylococcus aureus
KPNSRYMIFYNDGLTLYTKTNIHS

SEQ ID NO: 1685821 - protein, 21 aa, Staphylococcus aureus
KQAFTNVYGKTLHYDIIPMAD

SEQ ID NO: 1685822 - protein, 25 aa, Staphylococcus aureus
KQPMSVTFEFQLNNRIYKVHRQGPY

SEQ ID NO: 1685823 - protein, 19 aa, Staphylococcus aureus
KQPPLKAKLKLYEQMISNA

SEQ ID NO: 1685824 - protein, 22 aa, Staphylococcus aureus
KQSEELINIIKLAIDQNIPYTI

SEQ ID NO: 1685825 - protein, 35 aa, Staphylococcus aureus
KRKDIYVKWQKYMNDELPGLPMFQGKSITIVNDKV

SEQ ID NO: 1685826 - protein, 23 aa, Staphylococcus aureus
KSAPSLPILRRGQHYKLHFDFDA

SEQ ID NO: 1685827 - protein, 19 aa, Staphylococcus aureus
KSDEKILLDQMVSHFKNFE

SEQ ID NO: 1685828 - protein, 18 aa, Staphylococcus aureus
KSIFIKSLKKHLSKFGYW

SEQ ID NO: 1685829 - protein, 22 aa, Staphylococcus aureus
KTVIDYYHRFVERFPTVEVLSQ

SEQ ID NO: 1685830 - protein, 25 aa, Staphylococcus aureus
KVSKLPYSIRVLLESLLRQEDDFVI

SEQ ID NO: 1685831 - protein, 24 aa, Staphylococcus aureus
KVTTPILVKAPIAGRRILLKEVRD

SEQ ID NO: 1685832 - protein, 19 aa, Staphylococcus aureus
KYEISRFDVAPFLHLNIND

SEQ ID NO: 1685833 - protein, 20 aa, Staphylococcus aureus
KYKQLILDDKMLVVAVRDKS

SEQ ID NO: 1685834 - protein, 31 aa, Staphylococcus aureus
LAVEDFVRILTEPKLSLIKQYEALLQTEEVT

SEQ ID NO: 1685835 - protein, 17 aa, Staphylococcus aureus
LCGKSNIPIGIIPASIK

SEQ ID NO: 1685836 - protein, 34 aa, Staphylococcus aureus
LDEVLSLCLKFDKKLLIELKSPNLYPGIECKLLA

SEQ ID NO: 1685837 - protein, 25 aa, Staphylococcus aureus
LECIQQGHYLLDVPLSTYQQHHSSI

SEQ ID NO: 1685838 - protein, 24 aa, Staphylococcus aureus
LEESLDLYQRGMKLSAACDTTLKN

SEQ ID NO: 1685839 - protein, 19 aa, Staphylococcus aureus
LEGVLYNLYTVYLALIEVM

SEQ ID NO: 1685840 - protein, 17 aa, Staphylococcus aureus
LEKYKQLILDDKMLVVA

SEQ ID NO: 1685841 - protein, 30 aa, Staphylococcus aureus
LERALKIELDFYFPLLKSWSKKKKSEMVGQ

SEQ ID NO: 1685842 - protein, 25 aa, Staphylococcus aureus
LERVYIASVLMLKPKLIIADEPVAS

SEQ ID NO: 1685843 - protein, 21 aa, Staphylococcus aureus
LIDQYLTNGKSRAIPIFVFLN

SEQ ID NO: 1685844 - protein, 27 aa, Staphylococcus aureus
LINNNFKRYVFFTNSFRKEMITKSSMT

SEQ ID NO: 1685845 - protein, 17 aa, Staphylococcus aureus
LKHIKIIENMNTGMFTS

SEQ ID NO: 1685846 - protein, 22 aa, Staphylococcus aureus
LKLYDMIVERFLEALMSPHEYD

SEQ ID NO: 1685847 - protein, 23 aa, Staphylococcus aureus
LKNSFRPEFLNRVDDIIVFHKLT

SEQ ID NO: 1685848 - protein, 17 aa, Staphylococcus aureus
LKYVFANGIAREIIYDL

SEQ ID NO: 1685849 - protein, 19 aa, Staphylococcus aureus
LLALPGWAGILYYRSQQHH

SEQ ID NO: 1685850 - protein, 17 aa, Staphylococcus aureus
LLEFYNQFKEKYSELKK

SEQ ID NO: 1685851 - protein, 24 aa, Staphylococcus aureus
LLNQRYDWLIFSSKNAVKFFYKYL

SEQ ID NO: 1685852 - protein, 28 aa, Staphylococcus aureus
LNCTLHSLYEIPYFVKYLADTYTNGKII

SEQ ID NO: 1685853 - protein, 27 aa, Staphylococcus aureus
LNDSIHFYRDILLGKLLLTGKKTAYFK

SEQ ID NO: 1685854 - protein, 22 aa, Staphylococcus aureus
LNDYFVRIQQWCQKFNIVLTIK

SEQ ID NO: 1685855 - protein, 25 aa, Staphylococcus aureus
LRKIEADVPIYYYGFKESDDIYAQN

SEQ ID NO: 1685856 - protein, 33 aa, Staphylococcus aureus
LSADKYVLVTPMWNLSFPPVVKAYIDAISIAGK

SEQ ID NO: 1685857 - protein, 18 aa, Staphylococcus aureus
LSHRPLGKTLLTGATGFL

SEQ ID NO: 1685858 - protein, 28 aa, Staphylococcus aureus
LTAVLAVPLWYKNQVYGVLLFGQRDGRS

SEQ ID NO: 1685859 - protein, 18 aa, Staphylococcus aureus
LTSALQHIDYFVAGIGSG

SEQ ID NO: 1685860 - protein, 26 aa, Staphylococcus aureus
LVNDKLNYPVFVKPANLGSSIGISKC

SEQ ID NO: 1685861 - protein, 26 aa, Staphylococcus aureus
LVSDNLNYFKLKKFIVALESKTAIIE

SEQ ID NO: 1685862 - protein, 31 aa, Staphylococcus aureus
MFQKTMFPDQLKVIGIIKLYQSFYENPLTLD

SEQ ID NO: 1685863 - protein, 29 aa, Staphylococcus aureus
MGETYLEVQRIYFLKDFQGGGRGSQLIAL

SEQ ID NO: 1685864 - protein, 18 aa, Staphylococcus aureus
MIAEAFYKKFDEAGILNQ

SEQ ID NO: 1685865 - protein, 20 aa, Staphylococcus aureus
MIDVNIKGTLYTAKAALPTM

SEQ ID NO: 1685866 - protein, 18 aa, Staphylococcus aureus
MRIGELLAIKRENINYED

SEQ ID NO: 1685867 - protein, 18 aa, Staphylococcus aureus
MYHAMAHKFGDNWKKAQE

SEQ ID NO: 1685868 - protein, 24 aa, Staphylococcus aureus
NAGLKVLSAPSLDYGLIGFVSHDY

SEQ ID NO: 1685869 - protein, 23 aa, Staphylococcus aureus
NAQPEVTLTADPFSVAVEMNKDA

SEQ ID NO: 1685870 - protein, 17 aa, Staphylococcus aureus
NCQILIQNKYLTGEILD

SEQ ID NO: 1685871 - protein, 20 aa, Staphylococcus aureus
NDEVLEYFGLKVLVDKEDAP

SEQ ID NO: 1685872 - protein, 19 aa, Staphylococcus aureus
NDGAAMMLVMSEDKAKELN

SEQ ID NO: 1685873 - protein, 27 aa, Staphylococcus aureus
NDGIINDVFIPLKPLRQLEIISGEYND

SEQ ID NO: 1685874 - protein, 24 aa, Staphylococcus aureus
NEHVELIEVPIKPSDRLKARDMLG

SEQ ID NO: 1685875 - protein, 26 aa, Staphylococcus aureus
NEIQDLLIPLTFHFSKDEQLVIDQYK

SEQ ID NO: 1685876 - protein, 18 aa, Staphylococcus aureus
NENLKQKFETLLNTLKIN

SEQ ID NO: 1685877 - protein, 17 aa, Staphylococcus aureus
NEQYQISKQFWAYLVKT

SEQ ID NO: 1685878 - protein, 26 aa, Staphylococcus aureus
NESDVSHMLLPLIQTFHLQNDTHVIP

SEQ ID NO: 1685879 - protein, 24 aa, Staphylococcus aureus
NGEVTFINPLMPSGLPIHEWLMLK

SEQ ID NO: 1685880 - protein, 21 aa, Staphylococcus aureus
NGHFQFQETVLYILKSNMYSY

SEQ ID NO: 1685881 - protein, 26 aa, Staphylococcus aureus
NGTVGFLVLHIPYISSIDFGKFEKEL

SEQ ID NO: 1685882 - protein, 17 aa, Staphylococcus aureus
NHDFLILNMKGEAITER

SEQ ID NO: 1685883 - protein, 17 aa, Staphylococcus aureus
NIERKWYVIDAEGQTLG

SEQ ID NO: 1685884 - protein, 19 aa, Staphylococcus aureus
NIFYEEVFEFLYDQKIRGL

SEQ ID NO: 1685885 - protein, 19 aa, Staphylococcus aureus
NKDYGLYWVKSQGYDIVLE

SEQ ID NO: 1685886 - protein, 20 aa, Staphylococcus aureus
NKLFSILVRGPNKEADEKSA

SEQ ID NO: 1685887 - protein, 25 aa, Staphylococcus aureus
NLIPYARKLEVLYEDAFVIIVTKPN

SEQ ID NO: 1685888 - protein, 24 aa, Staphylococcus aureus
NLLKQDKSFLYWSTVNRNCVICGK

SEQ ID NO: 1685889 - protein, 31 aa, Staphylococcus aureus
NLMLRSEAPFKKALLYAPLYPIEVRSTKKLS

SEQ ID NO: 1685890 - protein, 20 aa, Staphylococcus aureus
NNIINFYKEKTIKDVIEDIQ

SEQ ID NO: 1685891 - protein, 22 aa, Staphylococcus aureus
NPEIRILCRQLLLDGCRVAQAE

SEQ ID NO: 1685892 - protein, 20 aa, Staphylococcus aureus
NRKQFDFRGLQCPGPIVNIS

SEQ ID NO: 1685893 - protein, 29 aa, Staphylococcus aureus
NSGFRNEYYYLTAIPYTLDEYKKYFQPLI

SEQ ID NO: 1685894 - protein, 41 aa, Staphylococcus aureus
NTGALMSVGLFIVGRIKGVARPALVVTLPTIDGKGFVFLDV

SEQ ID NO: 1685895 - protein, 31 aa, Staphylococcus aureus
NVFNRQELLWLQDKFPEHMKKQGFELKRGER

SEQ ID NO: 1685896 - protein, 17 aa, Staphylococcus aureus
NVGYKFDYWLDLAFYEL

SEQ ID NO: 1685897 - protein, 17 aa, Staphylococcus aureus
PAFLSPEPGLQSGAMIM

SEQ ID NO: 1685898 - protein, 25 aa, Staphylococcus aureus
PAKGLLQYIPQTFRHYAVRGHNNIY

SEQ ID NO: 1685899 - protein, 25 aa, Staphylococcus aureus
PDEAPGIGMRFIKINDIKLAVINLQ

SEQ ID NO: 1685900 - protein, 23 aa, Staphylococcus aureus
PELGNIIKYYLKCHWSPEQIVGR

SEQ ID NO: 1685901 - protein, 24 aa, Staphylococcus aureus
PGHGLLLKDFITYNVDDWWEEVEK

SEQ ID NO: 1685902 - protein, 21 aa, Staphylococcus aureus
PIVEDSIYSDLWFSPNQQISM

SEQ ID NO: 1685903 - protein, 24 aa, Staphylococcus aureus
PLDVIDFHNFAKQSYFILTDSGGI

SEQ ID NO: 1685904 - protein, 17 aa, Staphylococcus aureus
PLSAYRGFFGSKPYSKA

SEQ ID NO: 1685905 - protein, 25 aa, Staphylococcus aureus
PPNVKKEHWGFDDPAGKEWSEFQRV

SEQ ID NO: 1685906 - protein, 20 aa, Staphylococcus aureus
PPRLQNGTSWFYFATDQWKY

SEQ ID NO: 1685907 - protein, 21 aa, Staphylococcus aureus
PPYREFAWVQDKFGVSFQLAL

SEQ ID NO: 1685908 - protein, 23 aa, Staphylococcus aureus
PSAIFGTMKPKKLENGRIPVSKS

SEQ ID NO: 1685909 - protein, 21 aa, Staphylococcus aureus
PSGMLYVTISDVYSGSPTLTI

SEQ ID NO: 1685910 - protein, 23 aa, Staphylococcus aureus
PSGNIHGMPLRILTGEGPKELLE

SEQ ID NO: 1685911 - protein, 27 aa, Staphylococcus aureus
PSRNKLEPIMLIIVNDVYHPINERAQT

SEQ ID NO: 1685912 - protein, 20 aa, Staphylococcus aureus
PTLYLAADTVWFDGVEKTLK

SEQ ID NO: 1685913 - protein, 25 aa, Staphylococcus aureus
PTSPYIANIIFYNIDKRIFSYCQKN

SEQ ID NO: 1685914 - protein, 29 aa, Staphylococcus aureus
PVLLKEIYQFPLLLFYRGNIKLINNMHHL

SEQ ID NO: 1685915 - protein, 25 aa, Staphylococcus aureus
QAKQDIIQAVTTRKQQIKKSNASLQ

SEQ ID NO: 1685916 - protein, 30 aa, Staphylococcus aureus
QAQTQLFVYGLFIYNKWRGMGTLNSVDVIS

SEQ ID NO: 1685917 - protein, 24 aa, Staphylococcus aureus
QIEDKLIQLSQRKLIEQNNLNHYE

SEQ ID NO: 1685918 - protein, 18 aa, Staphylococcus aureus
QIIMFQQIQYLGGHKYVA

SEQ ID NO: 1685919 - protein, 25 aa, Staphylococcus aureus
QIVNFFEKPIIYGVLDATRFLERHQ

SEQ ID NO: 1685920 - protein, 25 aa, Staphylococcus aureus
QKRSEKLLHGMWQFPMFKSEHARRE

SEQ ID NO: 1685921 - protein, 35 aa, Staphylococcus aureus
QLETELFDYVNWYNNFRPHSSLQYLTPVAFKNIHM

SEQ ID NO: 1685922 - protein, 30 aa, Staphylococcus aureus
QLPQSEHFLPSQTNFIFVKTKRVNELYEAL

SEQ ID NO: 1685923 - protein, 25 aa, Staphylococcus aureus
QMTISPYKLYLLDKGDVLKFRETSY

SEQ ID NO: 1685924 - protein, 25 aa, Staphylococcus aureus
QQYILSVLYKDYLECVKLGSVKLTC

SEQ ID NO: 1685925 - protein, 29 aa, Staphylococcus aureus
QSGSIKVYKLFFIEVYKTVFQMTSMVSGT

SEQ ID NO: 1685926 - protein, 28 aa, Staphylococcus aureus
QSGVKQLKIVPLLLFSAMHYLKDIPNIV

SEQ ID NO: 1685927 - protein, 31 aa, Staphylococcus aureus
QSYHYYMDDMLFKQYPYFNRKNIHIPNGDAY

SEQ ID NO: 1685928 - protein, 18 aa, Staphylococcus aureus
QVFNYFTTPSFVTNIYET

SEQ ID NO: 1685929 - protein, 18 aa, Staphylococcus aureus
QVRKIFSEMGYKFELATA

SEQ ID NO: 1685930 - protein, 22 aa, Staphylococcus aureus
QWREFIINWVQDTMDGYTEIEC

SEQ ID NO: 1685931 - protein, 23 aa, Staphylococcus aureus
QWREFIINWVQDTMDGYTEIECI

SEQ ID NO: 1685932 - protein, 20 aa, Staphylococcus aureus
RAEIFLKQQFERLQNEQIFV

SEQ ID NO: 1685933 - protein, 20 aa, Staphylococcus aureus
RAYFFQYINKGPYPDEEEKM

SEQ ID NO: 1685934 - protein, 25 aa, Staphylococcus aureus
READFINVVVFKKQAENVKNYLSKG

SEQ ID NO: 1685935 - protein, 19 aa, Staphylococcus aureus
REIGYSIVPLKLYLKHGHC

SEQ ID NO: 1685936 - protein, 32 aa, Staphylococcus aureus
REVKFKQFIFDQFMVQVCFLGEAPWGYKKVSV

SEQ ID NO: 1685937 - protein, 21 aa, Staphylococcus aureus
RFDVAPFLHLNINDEKYDMKI

SEQ ID NO: 1685938 - protein, 23 aa, Staphylococcus aureus
RHKHALLIDYLLHNIDLSLQMNE

SEQ ID NO: 1685939 - protein, 27 aa, Staphylococcus aureus
RHLDDKASVAMILKLLKKLKEEQIILP

SEQ ID NO: 1685940 - protein, 26 aa, Staphylococcus aureus
RHLDDKASVAMILQLLKKLKEEQIIL

SEQ ID NO: 1685941 - protein, 19 aa, Staphylococcus aureus
RILKTVIDLVDKRVPVIAG

SEQ ID NO: 1685942 - protein, 47 aa, Staphylococcus aureus
RITTNKDGYKYYSFIDNVGLFSGSHLYVKNRDLAPKATNNKEYTINT

SEQ ID NO: 1685943 - protein, 22 aa, Staphylococcus aureus
RKTIVYKGWLRSDQIKKFYTDL

SEQ ID NO: 1685944 - protein, 17 aa, Staphylococcus aureus
RLLKYQEDTTKLLEDAE

SEQ ID NO: 1685945 - protein, 24 aa, Staphylococcus aureus
RNGYQIYRPLLAVSKKEIKQFQER

SEQ ID NO: 1685946 - protein, 23 aa, Staphylococcus aureus
RNMIGIKSDYFYKCLYVNDHFYN

SEQ ID NO: 1685947 - protein, 26 aa, Staphylococcus aureus
RNSNGPMIRALAEKLGLEVGIYKTQQ

SEQ ID NO: 1685948 - protein, 22 aa, Staphylococcus aureus
RPRKCLNWKFPYEVLCDELLHL

SEQ ID NO: 1685949 - protein, 17 aa, Staphylococcus aureus
RQSIIGINPNWLTKPVL

SEQ ID NO: 1685950 - protein, 17 aa, Staphylococcus aureus
RSIIAIAVGYPNKLKGA

SEQ ID NO: 1685951 - protein, 25 aa, Staphylococcus aureus
RTFDEKTYLSWLTQVGFKHVETFTD

SEQ ID NO: 1685952 - protein, 19 aa, Staphylococcus aureus
RTGVFDLFGYDLKDYDELF

SEQ ID NO: 1685953 - protein, 24 aa, Staphylococcus aureus
SDDILSLKTLPSSVGIIGGGVIGM

SEQ ID NO: 1685954 - protein, 25 aa, Staphylococcus aureus
SDNNLTFTSPYYHTMRKSFSGEQGW

SEQ ID NO: 1685955 - protein, 19 aa, Staphylococcus aureus
SDYNSMMETLYLQQNPNNA

SEQ ID NO: 1685956 - protein, 32 aa, Staphylococcus aureus
SEFLQSNYIDKFILYYAPKLIGGSGNYQFYQT

SEQ ID NO: 1685957 - protein, 21 aa, Staphylococcus aureus
SFITIYRPYLKLTEPILEKHN

SEQ ID NO: 1685958 - protein, 26 aa, Staphylococcus aureus
SFSQHLDIDFIFKARKPMGKAFDKAI

SEQ ID NO: 1685959 - protein, 26 aa, Staphylococcus aureus
SGGKRPLICFFSNDLNIHRTKTEKAN

SEQ ID NO: 1685960 - protein, 17 aa, Staphylococcus aureus
SHFQRTFDEKTYLSWLT

SEQ ID NO: 1685961 - protein, 27 aa, Staphylococcus aureus
SIGVNAGLYLLKFLASLNLDNNAKAFV

SEQ ID NO: 1685962 - protein, 24 aa, Staphylococcus aureus
SIQRLMGIIISENLIECVKTAEEN

SEQ ID NO: 1685963 - protein, 26 aa, Staphylococcus aureus
SKFSNYYEFLLRYKKIDALLTENESK

SEQ ID NO: 1685964 - protein, 25 aa, Staphylococcus aureus
SKLVQPIMQLFIDNAILNNVQNDAL

SEQ ID NO: 1685965 - protein, 25 aa, Staphylococcus aureus
SKMALLQMLSYLNNHQWLLKARDQR

SEQ ID NO: 1685966 - protein, 18 aa, Staphylococcus aureus
SMLAGWLGYSACTILNSG

SEQ ID NO: 1685967 - protein, 19 aa, Staphylococcus aureus
SMMETLYLQQNPNNAEHLA

SEQ ID NO: 1685968 - protein, 27 aa, Staphylococcus aureus
SNDEIYNLMIYQLGALQGFCRIHQLKI

SEQ ID NO: 1685969 - protein, 24 aa, Staphylococcus aureus
SNHDIQHYINYLTKLGYPLETITD

SEQ ID NO: 1685970 - protein, 17 aa, Staphylococcus aureus
SNRKPIHLLRQDGKIRE

SEQ ID NO: 1685971 - protein, 23 aa, Staphylococcus aureus
SQTPDLTMTYPVYINAMTGGSEW

SEQ ID NO: 1685972 - protein, 24 aa, Staphylococcus aureus
SSVSDFLTYLNGRFSNMVLGHNGD

SEQ ID NO: 1685973 - protein, 32 aa, Staphylococcus aureus
STIIDELQKCETFYFSVAFITESGLASLKAQL

SEQ ID NO: 1685974 - protein, 24 aa, Staphylococcus aureus
SVKRGDYLAILSTGAYHYSMASNY

SEQ ID NO: 1685975 - protein, 26 aa, Staphylococcus aureus
SVTNNLQLVMAIAALKLKLSPNEVWN

SEQ ID NO: 1685976 - protein, 21 aa, Staphylococcus aureus
SVVGKALFKYQQRDDIVIGTK

SEQ ID NO: 1685977 - protein, 21 aa, Staphylococcus aureus
SVYELYKQFDKLRDLFKEEGL

SEQ ID NO: 1685978 - protein, 32 aa, Staphylococcus aureus
SYTLDNIMRMLHPFMPFVTEKIWQSLPHEGET

SEQ ID NO: 1685979 - protein, 19 aa, Staphylococcus aureus
TFLDTPGHAAFTTMRARGA

SEQ ID NO: 1685980 - protein, 19 aa, Staphylococcus aureus
TINIPFNKTFINQIGWYLD

SEQ ID NO: 1685981 - protein, 25 aa, Staphylococcus aureus
TKARAYLPRILVEKLLIKIDDMLEG

SEQ ID NO: 1685982 - protein, 24 aa, Staphylococcus aureus
TKGNFRLIHRLFAQIDRIMDINGL

SEQ ID NO: 1685983 - protein, 17 aa, Staphylococcus aureus
TNGALAGSILKMNHGLR

SEQ ID NO: 1685984 - protein, 21 aa, Staphylococcus aureus
TPHMHLGVVPMRDGKLQGKNV

SEQ ID NO: 1685985 - protein, 17 aa, Staphylococcus aureus
TQVGCRIGCTFCASTLG

SEQ ID NO: 1685986 - protein, 24 aa, Staphylococcus aureus
TSHNQYHILFIDTAHQRIKFSSFD

SEQ ID NO: 1685987 - protein, 21 aa, Staphylococcus aureus
TSKPFVVITPVYDLPSDFMSD

SEQ ID NO: 1685988 - protein, 20 aa, Staphylococcus aureus
TTIPEAIRYIKPADFHVPGD

SEQ ID NO: 1685989 - protein, 27 aa, Staphylococcus aureus
TTNENIKALYFYQKNKYRITDVIFDAV

SEQ ID NO: 1685990 - protein, 26 aa, Staphylococcus aureus
TTSFPTPKIFDWLQQQGNIETNEMYN

SEQ ID NO: 1685991 - protein, 19 aa, Staphylococcus aureus
TTSKPFFLEFMAKDVSKGN

SEQ ID NO: 1685992 - protein, 18 aa, Staphylococcus aureus
TVNDKLIFSIPGSTGAVK

SEQ ID NO: 1685993 - protein, 24 aa, Staphylococcus aureus
TVRDKVLIFSGRISSEILIKAAKI

SEQ ID NO: 1685994 - protein, 18 aa, Staphylococcus aureus
TWHNIRAKIIPLSINYIK

SEQ ID NO: 1685995 - protein, 19 aa, Staphylococcus aureus
TYITYTRLLEQFTIEDIAA

SEQ ID NO: 1685996 - protein, 22 aa, Staphylococcus aureus
TYQTPMLKYKVPRAFVEISPEL

SEQ ID NO: 1685997 - protein, 17 aa, Staphylococcus aureus
VAFVPGAFEIPLVAKKL

SEQ ID NO: 1685998 - protein, 21 aa, Staphylococcus aureus
VALVLEAIPNDLAEEISKHLT

SEQ ID NO: 1685999 - protein, 23 aa, Staphylococcus aureus
VDGNKFIDYLQAYGPIIAGHAHP

SEQ ID NO: 1686000 - protein, 25 aa, Staphylococcus aureus
VDLLNDIALLDCNVIILSSYDDFEY

SEQ ID NO: 1686001 - protein, 23 aa, Staphylococcus aureus
VDNQDVILICPQGIEPKGDQFKN

SEQ ID NO: 1686002 - protein, 20 aa, Staphylococcus aureus
VEADAWQSWGPYLLSGKDVF

SEQ ID NO: 1686003 - protein, 30 aa, Staphylococcus aureus
VESDWPLTHGQFFSILPIYDSGGYLEKVYQ

SEQ ID NO: 1686004 - protein, 23 aa, Staphylococcus aureus
VGIALDYKIPYLDKSATELAKDG

SEQ ID NO: 1686005 - protein, 17 aa, Staphylococcus aureus
VHGLKYWYNYTSDDLIN

SEQ ID NO: 1686006 - protein, 33 aa, Staphylococcus aureus
VIGCQSYCGPGRRKTFAFVNNRPLAALTEEELI

SEQ ID NO: 1686007 - protein, 25 aa, Staphylococcus aureus
VIHLMSRVRRYPLPLVLEISNIESV

SEQ ID NO: 1686008 - protein, 17 aa, Staphylococcus aureus
VIKPENIVLIGMRDLDK

SEQ ID NO: 1686009 - protein, 19 aa, Staphylococcus aureus
VKEQYLYLTGRQHDMLIIG

SEQ ID NO: 1686010 - protein, 27 aa, Staphylococcus aureus
VMKEGLKTLLMNWFNIEKINIDVEAST

SEQ ID NO: 1686011 - protein, 25 aa, Staphylococcus aureus
VNQKQWIQFWKKAMKLDYDPNVKVQ

SEQ ID NO: 1686012 - protein, 23 aa, Staphylococcus aureus
VNTAFFVKLFNTALAERDYYFNI

SEQ ID NO: 1686013 - protein, 25 aa, Staphylococcus aureus
VNVKPDSELIINFTTMQTNSKQGAT

SEQ ID NO: 1686014 - protein, 20 aa, Staphylococcus aureus
VQEYAPILYQIWKKKHKKAY

SEQ ID NO: 1686015 - protein, 23 aa, Staphylococcus aureus
VSIESLIEFCRLAQLPKNKNIQT

SEQ ID NO: 1686016 - protein, 25 aa, Staphylococcus aureus
VTNNIQLVMAIAALKLKLSPNEVWN

SEQ ID NO: 1686017 - protein, 23 aa, Staphylococcus aureus
VVMEELRLLARAVFVLDVDNKVV

SEQ ID NO: 1686018 - protein, 27 aa, Staphylococcus aureus
VVVRLANFGAFVEIAPGVQGLVHISEI

SEQ ID NO: 1686019 - protein, 23 aa, Staphylococcus aureus
VYHLNARLKLQLLDDIKSVFNSQ

SEQ ID NO: 1686020 - protein, 23 aa, Staphylococcus aureus
WGFDPKYDLVSMTKLMLEAIEQK

SEQ ID NO: 1686021 - protein, 30 aa, Staphylococcus aureus
WIKGKRTVTIRWRGPFERFRIVHLIENGHV

SEQ ID NO: 1686022 - protein, 18 aa, Staphylococcus aureus
WLKDLLRQIEIAIVTGKV

SEQ ID NO: 1686023 - protein, 31 aa, Staphylococcus aureus
WPDSWLYSTKFMLPKWLYKIAKQRADNKQLQ

SEQ ID NO: 1686024 - protein, 18 aa, Staphylococcus aureus
YAHVMHTHLLINFVTKSE

SEQ ID NO: 1686025 - protein, 21 aa, Staphylococcus aureus
YATISFLNWFLDEQVEEEAMF

SEQ ID NO: 1686026 - protein, 19 aa, Staphylococcus aureus
YDKQYLGELSLVDRLKHHK

SEQ ID NO: 1686027 - protein, 18 aa, Staphylococcus aureus
YELGFDHGLLFKDGVTVG

SEQ ID NO: 1686028 - protein, 21 aa, Staphylococcus aureus
YFSKVFFQMDIPNNLLIAQNV

SEQ ID NO: 1686029 - protein, 19 aa, Staphylococcus aureus
YIEDDFVFHPVLFDVVESE

SEQ ID NO: 1686030 - protein, 18 aa, Staphylococcus aureus
YIQAAYHEPLREEFKNLT

SEQ ID NO: 1686031 - protein, 24 aa, Staphylococcus aureus
YNINERVIMLITKQQPIASDLRMM

SEQ ID NO: 1686032 - protein, 30 aa, Staphylococcus aureus
YNVSEKVFYDLWTDLYRLFKKLRNAFKEDL

SEQ ID NO: 1686033 - protein, 17 aa, Staphylococcus aureus
YPKAADIFRSVGIDFCC

SEQ ID NO: 1686034 - protein, 17 aa, Staphylococcus aureus
YPLFFMVTKNLSKKQEL

SEQ ID NO: 1686035 - protein, 18 aa, Staphylococcus aureus
YPYYTSGGFIHYCEYPKL

SEQ ID NO: 1686036 - protein, 26 aa, Staphylococcus aureus
YQSIQFAATLPDYIQIWPGHGAGSPC

SEQ ID NO: 1686037 - protein, 25 aa, Staphylococcus aureus
YSSSLPIYNLYFIKRNIEKLINADD

SEQ ID NO: 1686038 - protein, 21 aa, Staphylococcus aureus
YTFLNWDKIFSRIYKEQKVLV

SEQ ID NO: 1686039 - protein, 25 aa, Staphylococcus aureus
YTFTGPIDRQLFYQFIMKLSESVLR

SEQ ID NO: 1686040 - protein, 18 aa, Staphylococcus aureus
YTNGKIIMFGGGGYNIWR

SEQ ID NO: 1686041 - protein, 18 aa, Staphylococcus aureus
YVLNAEPSNLFETKIRHS

SEQ ID NO: 1686042 - protein, 18 aa, Staphylococcus aureus
AAKDLVSKAKEKAYQDIL

SEQ ID NO: 1686043 - protein, 17 aa, Staphylococcus aureus
AARATIVMALYQMFHVL

SEQ ID NO: 1686044 - protein, 29 aa, Staphylococcus aureus
AARQGLDILRKKGFYSQIGIFKDAEIPFD

SEQ ID NO: 1686045 - protein, 19 aa, Staphylococcus aureus
ACFTGFELFVKPAVKHMCG

SEQ ID NO: 1686046 - protein, 18 aa, Staphylococcus aureus
ADQKSAFNNVQVGDGAPT

SEQ ID NO: 1686047 - protein, 18 aa, Staphylococcus aureus
AFDRFKLNIFISLAELES

SEQ ID NO: 1686048 - protein, 19 aa, Staphylococcus aureus
AFEFIIEGETLIPPFISVP

SEQ ID NO: 1686049 - protein, 17 aa, Staphylococcus aureus
AHFTFIGDGPTLNDCQQ

SEQ ID NO: 1686050 - protein, 21 aa, Staphylococcus aureus
ALAGSILKMNHGLRNLISFTG

SEQ ID NO: 1686051 - protein, 17 aa, Staphylococcus aureus
ALMQYYRETGIYAERTA

SEQ ID NO: 1686052 - protein, 36 aa, Staphylococcus aureus
ALQHFEGTILFVSHDRYFINQLANKVFDLTIDGGKM

SEQ ID NO: 1686053 - protein, 19 aa, Staphylococcus aureus
AMKQAWLQISQDNKLMSCN

SEQ ID NO: 1686054 - protein, 23 aa, Staphylococcus aureus
AREFDYIKSLRRLTTKDIEVGGG

SEQ ID NO: 1686055 - protein, 26 aa, Staphylococcus aureus
ASIISRYAFITYMDQISKNINMTIPK

SEQ ID NO: 1686056 - protein, 21 aa, Staphylococcus aureus
ASYPSTVLMTATLAQVAGVEN

SEQ ID NO: 1686057 - protein, 19 aa, Staphylococcus aureus
ATMPTYLNALAGRGVHVIT

SEQ ID NO: 1686058 - protein, 19 aa, Staphylococcus aureus
AVQLVKFDDYWQGKPALDK

SEQ ID NO: 1686059 - protein, 19 aa, Staphylococcus aureus
AYLTMLFGGSLRRQDENFD

SEQ ID NO: 1686060 - protein, 18 aa, Staphylococcus aureus
CIDIKPRMLGQQAGSAIL

SEQ ID NO: 1686061 - protein, 25 aa, Staphylococcus aureus
DAKPEHLLQYAQLGDIYAQKIRGID

SEQ ID NO: 1686062 - protein, 17 aa, Staphylococcus aureus
DALRRFKRSVSKSGTIQ

SEQ ID NO: 1686063 - protein, 25 aa, Staphylococcus aureus
DATIDKTMRWLKISNINKLSQKQIA

SEQ ID NO: 1686064 - protein, 30 aa, Staphylococcus aureus
DDGIFKFNLNLMIDVGIISKYYPVFKGIDA

SEQ ID NO: 1686065 - protein, 25 aa, Staphylococcus aureus
DDLWMDLYDLFEELRNLFKEEGHEP

SEQ ID NO: 1686066 - protein, 20 aa, Staphylococcus aureus
DEEGNYYKGWNKKQLKDVLE

SEQ ID NO: 1686067 - protein, 17 aa, Staphylococcus aureus
DILVQFLKQHQLNYRSN

SEQ ID NO: 1686068 - protein, 29 aa, Staphylococcus aureus
DIYQAPFPSRWLYVVKHLQTLIQERKINQ

SEQ ID NO: 1686069 - protein, 26 aa, Staphylococcus aureus
DKAIETLGYPFIVKTRFGGYDGKGQV

SEQ ID NO: 1686070 - protein, 22 aa, Staphylococcus aureus
DKYRTWAWNYGRNPKYNFEREE

SEQ ID NO: 1686071 - protein, 23 aa, Staphylococcus aureus
DLDNINDYTIPTGKKESATTDLY

SEQ ID NO: 1686072 - protein, 32 aa, Staphylococcus aureus
DLFYGFQCYDYANMFFMIATGERLQGLYAYNI

SEQ ID NO: 1686073 - protein, 26 aa, Staphylococcus aureus
DLMPESGKKFYPTKYLLIYNDNKTVE

SEQ ID NO: 1686074 - protein, 19 aa, Staphylococcus aureus
DNEIAYLTMLFGGSLRRQD

SEQ ID NO: 1686075 - protein, 27 aa, Staphylococcus aureus
DNTLGKWEPFLNDLKAVSPILDNHLDD

SEQ ID NO: 1686076 - protein, 17 aa, Staphylococcus aureus
DNWKTRLRMLNHFPKPT

SEQ ID NO: 1686077 - protein, 25 aa, Staphylococcus aureus
DRDDKFYYNRLKYYKDRVLVPLAYI

SEQ ID NO: 1686078 - protein, 25 aa, Staphylococcus aureus
DSKMTGILCRIPNLISDDVPQGESD

SEQ ID NO: 1686079 - protein, 26 aa, Staphylococcus aureus
DYCRDRGFFVLTYHDGQIIYDSEHEY

SEQ ID NO: 1686080 - protein, 29 aa, Staphylococcus aureus
DYNVLAARLGWLPSYPQFNKNSLLFAEEA

SEQ ID NO: 1686081 - protein, 18 aa, Staphylococcus aureus
EAFLEEMIALLPEVKHYA

SEQ ID NO: 1686082 - protein, 23 aa, Staphylococcus aureus
EAIAFIHQRPKPLSLYLFSEDEN

SEQ ID NO: 1686083 - protein, 23 aa, Staphylococcus aureus
EDFEILIIAYSIDGGAISAIDMT

SEQ ID NO: 1686084 - protein, 25 aa, Staphylococcus aureus
EDTELNLFSFVKQLSDIPIGGIIYT

SEQ ID NO: 1686085 - protein, 27 aa, Staphylococcus aureus
EFDSLFKRIPVKSGDFYYVPAGTVHAI

SEQ ID NO: 1686086 - protein, 26 aa, Staphylococcus aureus
EFEQQIIGYLGLWIVIDQAQITTVAI

SEQ ID NO: 1686087 - protein, 21 aa, Staphylococcus aureus
EFKLKPSGWYKTIPPKKDGGT

SEQ ID NO: 1686088 - protein, 20 aa, Staphylococcus aureus
EFNTLYQVLRTLQTNMKQNA

SEQ ID NO: 1686089 - protein, 17 aa, Staphylococcus aureus
EILMQWQRGIYDGGGWN

SEQ ID NO: 1686090 - protein, 26 aa, Staphylococcus aureus
EIYPHHHPKFKISEKSLLISAEAVGT

SEQ ID NO: 1686091 - protein, 23 aa, Staphylococcus aureus
EKKLKIILSLIKEDELCVCDISL

SEQ ID NO: 1686092 - protein, 26 aa, Staphylococcus aureus
ELPISRLLQWGTDFVKPLARLAYNGE

SEQ ID NO: 1686093 - protein, 31 aa, Staphylococcus aureus
ENVLKICGLYAFRNWPIAALSYGQKKRVTIA

SEQ ID NO: 1686094 - protein, 17 aa, Staphylococcus aureus
ENYGTLGLAFIKQYESK

SEQ ID NO: 1686095 - protein, 27 aa, Staphylococcus aureus
EQDYRELFTLMFYTGLRIGEAMALVWT

SEQ ID NO: 1686096 - protein, 25 aa, Staphylococcus aureus
EQPGYKLMFNTLRAMYQRHPIRVDI

SEQ ID NO: 1686097 - protein, 25 aa, Staphylococcus aureus
ESISAVKHLLPDFALDALKERINEL

SEQ ID NO: 1686098 - protein, 22 aa, Staphylococcus aureus
ESNIGYFILPKNHITYRSRSDD

SEQ ID NO: 1686099 - protein, 23 aa, Staphylococcus aureus
ETGNVYYRPGYVQTGRAFFKLKV

SEQ ID NO: 1686100 - protein, 36 aa, Staphylococcus aureus
ETKDGYYLVYLFHPEGEGIYLSLNQGWSKISDMFPR

SEQ ID NO: 1686101 - protein, 17 aa, Staphylococcus aureus
ETTAYIKAFLDSLNIKY

SEQ ID NO: 1686102 - protein, 17 aa, Staphylococcus aureus
ETYYIVCAGGVRSAKVV

SEQ ID NO: 1686103 - protein, 17 aa, Staphylococcus aureus
FIHLVWDVRDVINDNIK

SEQ ID NO: 1686104 - protein, 20 aa, Staphylococcus aureus
FSKKWRPYLRHRDVYHYDLK

SEQ ID NO: 1686105 - protein, 18 aa, Staphylococcus aureus
FSNPSGMLYVTISDVYSG

SEQ ID NO: 1686106 - protein, 20 aa, Staphylococcus aureus
GATWLRTTDFKDDKDRVLIK

SEQ ID NO: 1686107 - protein, 26 aa, Staphylococcus aureus
GEQKRFFEESYKLFSERYGKQNIAYA

SEQ ID NO: 1686108 - protein, 26 aa, Staphylococcus aureus
GGITDTGFYRFWTQGIFARWTDNPNI

SEQ ID NO: 1686109 - protein, 29 aa, Staphylococcus aureus
GHAPDLIKSAAFPNILPSSTNPTLPYTHN

SEQ ID NO: 1686110 - protein, 21 aa, Staphylococcus aureus
GHTVAFMHIPMLMDRIKATYN

SEQ ID NO: 1686111 - protein, 19 aa, Staphylococcus aureus
GIEDVEKRLFLARKQLEFY

SEQ ID NO: 1686112 - protein, 24 aa, Staphylococcus aureus
GKNALLSDSLLRDIKVLSSNAKGD

SEQ ID NO: 1686113 - protein, 23 aa, Staphylococcus aureus
GNSKITSGLYWIAPETFANFDSR

SEQ ID NO: 1686114 - protein, 19 aa, Staphylococcus aureus
GQFIAKKLDHAGIKHAFYN

SEQ ID NO: 1686115 - protein, 19 aa, Staphylococcus aureus
GRLRKLNHPIPLKKYQHGF

SEQ ID NO: 1686116 - protein, 23 aa, Staphylococcus aureus
GSSKHYLIPEMHLKPILSYMKAH

SEQ ID NO: 1686117 - protein, 18 aa, Staphylococcus aureus
GTDDYPGWWREIIDGGYI

SEQ ID NO: 1686118 - protein, 17 aa, Staphylococcus aureus
GTLTGRRILILGDVLEL

SEQ ID NO: 1686119 - protein, 17 aa, Staphylococcus aureus
HKNCVFLVDTFHTLKSG

SEQ ID NO: 1686120 - protein, 32 aa, Staphylococcus aureus
HNDDLPYVELALGAGMAFLIRRFTKKDQQTEE

SEQ ID NO: 1686121 - protein, 17 aa, Staphylococcus aureus
HPMILITVLEEPLTLPS

SEQ ID NO: 1686122 - protein, 24 aa, Staphylococcus aureus
HTCKELLDLLRLHLSLFNKYEKDE

SEQ ID NO: 1686123 - protein, 32 aa, Staphylococcus aureus
HTIQNIIQKRFTLNILYPYIETIHITKDKNLI

SEQ ID NO: 1686124 - protein, 26 aa, Staphylococcus aureus
HVGKVLTYQVLLKSLYGYVNHTEMAA

SEQ ID NO: 1686125 - protein, 19 aa, Staphylococcus aureus
IADCKRFLECLNDKNVKTI

SEQ ID NO: 1686126 - protein, 20 aa, Staphylococcus aureus
IAIDVAFTSLLTRALDTTHY

SEQ ID NO: 1686127 - protein, 27 aa, Staphylococcus aureus
IDKKDILPLRIILGSVNLYGILSTNHL

SEQ ID NO: 1686128 - protein, 18 aa, Staphylococcus aureus
IDLDYADVLGLQSQGRDN

SEQ ID NO: 1686129 - protein, 17 aa, Staphylococcus aureus
IDYINDNIIYGSEIKRE

SEQ ID NO: 1686130 - protein, 24 aa, Staphylococcus aureus
IEKDIAFYQLMFRMGKDSNIHEKL

SEQ ID NO: 1686131 - protein, 20 aa, Staphylococcus aureus
IEKWNIIRPPFNVTRISEYA

SEQ ID NO: 1686132 - protein, 29 aa, Staphylococcus aureus
IELQPENMYQILRKLPPREYSISSSFMAT

SEQ ID NO: 1686133 - protein, 26 aa, Staphylococcus aureus
IEQANKLFLLFINTYGEIFELNNKEY

SEQ ID NO: 1686134 - protein, 20 aa, Staphylococcus aureus
IETLWTLFTAALNFANYPSE

SEQ ID NO: 1686135 - protein, 28 aa, Staphylococcus aureus
IIRLKKEYYYNFFGQYLLSRKGKRKIFL

SEQ ID NO: 1686136 - protein, 20 aa, Staphylococcus aureus
IKHYLLMLDEKMKNLDDYMH

SEQ ID NO: 1686137 - protein, 31 aa, Staphylococcus aureus
IKLHKEFTIPVKFTIKVVLTDPYKYSVTGNK

SEQ ID NO: 1686138 - protein, 29 aa, Staphylococcus aureus
IKNRTQVETWWRWYRNGESYRFSQHVGKQ

SEQ ID NO: 1686139 - protein, 17 aa, Staphylococcus aureus
ILRLLEMGISVQELIQA

SEQ ID NO: 1686140 - protein, 26 aa, Staphylococcus aureus
IMQEEIFGPILPILTYQSLDEAIAFI

SEQ ID NO: 1686141 - protein, 19 aa, Staphylococcus aureus
INHNDDLFKHVKDILRKQG

SEQ ID NO: 1686142 - protein, 17 aa, Staphylococcus aureus
IRYFSIPCKPTKVNGGR

SEQ ID NO: 1686143 - protein, 19 aa, Staphylococcus aureus
ITKLNGLCLKWVAPGTRGV

SEQ ID NO: 1686144 - protein, 27 aa, Staphylococcus aureus
IYNDNDLNWIYLVKNLRNAGVSIESLI

SEQ ID NO: 1686145 - protein, 24 aa, Staphylococcus aureus
KDEDMEDIFIPPTKINRALDGDTV

SEQ ID NO: 1686146 - protein, 19 aa, Staphylococcus aureus
KDIELDILKKYKALERKWY

SEQ ID NO: 1686147 - protein, 30 aa, Staphylococcus aureus
KEIARTDLGRYFDRFADKLDKTQTNTEVDE

SEQ ID NO: 1686148 - protein, 26 aa, Staphylococcus aureus
KESATTDLYAYADQKKNNILADTNAT

SEQ ID NO: 1686149 - protein, 18 aa, Staphylococcus aureus
KFGLRLPGEFNRQQMTEA

SEQ ID NO: 1686150 - protein, 22 aa, Staphylococcus aureus
KHIGGFPVSGLFLRCTNQEVID

SEQ ID NO: 1686151 - protein, 18 aa, Staphylococcus aureus
KHPMILITVLEEPLTLPS

SEQ ID NO: 1686152 - protein, 30 aa, Staphylococcus aureus
KIVEYIGEMLTFLKYFDAPQPFKIMASHYL

SEQ ID NO: 1686153 - protein, 28 aa, Staphylococcus aureus
KKHLNIKVIIVTTFKRPGYFEKAVANDV

SEQ ID NO: 1686154 - protein, 18 aa, Staphylococcus aureus
KKNFAIGKLLNINTRSEN

SEQ ID NO: 1686155 - protein, 18 aa, Staphylococcus aureus
KLCHSLNGKIFIVKDMIP

SEQ ID NO: 1686156 - protein, 20 aa, Staphylococcus aureus
KMMKSTVYLINASRGPIVHE

SEQ ID NO: 1686157 - protein, 26 aa, Staphylococcus aureus
KNLDDYMHYLITKKEQLSKLIDSLML

SEQ ID NO: 1686158 - protein, 17 aa, Staphylococcus aureus
KPSVFFLKDGKAREVIK

SEQ ID NO: 1686159 - protein, 30 aa, Staphylococcus aureus
KRMEGYNEARWILIDLADVVVHVFHKDERN

SEQ ID NO: 1686160 - protein, 23 aa, Staphylococcus aureus
KSTSLVFYQIKIDLDYADVLGLQ

SEQ ID NO: 1686161 - protein, 23 aa, Staphylococcus aureus
KTNIPFLINVMKNKKFTSGDYTT

SEQ ID NO: 1686162 - protein, 18 aa, Staphylococcus aureus
KVIAPFNGLISMIVPTKH

SEQ ID NO: 1686163 - protein, 17 aa, Staphylococcus aureus
LDNQDVILICPQGIEPK

SEQ ID NO: 1686164 - protein, 21 aa, Staphylococcus aureus
LDRIYPYRKCDKMPDKLCLYY

SEQ ID NO: 1686165 - protein, 18 aa, Staphylococcus aureus
LENFVKYIKENAGPSWKY

SEQ ID NO: 1686166 - protein, 18 aa, Staphylococcus aureus
LFDAVLMTIKYIMRESKV

SEQ ID NO: 1686167 - protein, 17 aa, Staphylococcus aureus
LFLLHQDGLITLPEHKY

SEQ ID NO: 1686168 - protein, 17 aa, Staphylococcus aureus
LFSERYGKQNIAYATVH

SEQ ID NO: 1686169 - protein, 23 aa, Staphylococcus aureus
LGKTECWYILDAAPGAEIIYGVH

SEQ ID NO: 1686170 - protein, 18 aa, Staphylococcus aureus
LIKMWQLSQIYKPSSNQS

SEQ ID NO: 1686171 - protein, 24 aa, Staphylococcus aureus
LKAQRINPVVKKNALEAIREVVNK

SEQ ID NO: 1686172 - protein, 24 aa, Staphylococcus aureus
LKDDYIEVKIIRNVFDKMLTDSQF

SEQ ID NO: 1686173 - protein, 30 aa, Staphylococcus aureus
LKNLPAEESYFLFYINRPSIIVGKNQNTIE

SEQ ID NO: 1686174 - protein, 17 aa, Staphylococcus aureus
LLMDLSMPPGESGLIAT

SEQ ID NO: 1686175 - protein, 18 aa, Staphylococcus aureus
LNALAVIAISYLEKLDVT

SEQ ID NO: 1686176 - protein, 18 aa, Staphylococcus aureus
LNFILVKMSKSLYVIGKD

SEQ ID NO: 1686177 - protein, 30 aa, Staphylococcus aureus
LNFKFMKHINDVGIPVVFIINQIDKHQDDE

SEQ ID NO: 1686178 - protein, 19 aa, Staphylococcus aureus
LNGKIFIVKDMIPGVNAPP

SEQ ID NO: 1686179 - protein, 28 aa, Staphylococcus aureus
LQNVDGFKALRFLRPRTAGRHYIIITLW

SEQ ID NO: 1686180 - protein, 20 aa, Staphylococcus aureus
LSILGYRNVPVNKDAIAKHV

SEQ ID NO: 1686181 - protein, 18 aa, Staphylococcus aureus
LVAGIKAALLDTTGIKLA

SEQ ID NO: 1686182 - protein, 20 aa, Staphylococcus aureus
LVQLLRRKRNVILQGPPGVG

SEQ ID NO: 1686183 - protein, 32 aa, Staphylococcus aureus
MDASEFRNYILGLIFYCFLSEKAEQEYADALS

SEQ ID NO: 1686184 - protein, 18 aa, Staphylococcus aureus
MISMFIPDNDFMASLVSD

SEQ ID NO: 1686185 - protein, 43 aa, Staphylococcus aureus
MPKAMIMKFDLALQRMLLGEPIQYIVGFASFYGRTFDVNSNCL

SEQ ID NO: 1686186 - protein, 17 aa, Staphylococcus aureus
MVVFGQTKAKFAKLGNS

SEQ ID NO: 1686187 - protein, 26 aa, Staphylococcus aureus
NAAISTTLLINKFKPDIIINTGSAGA

SEQ ID NO: 1686188 - protein, 28 aa, Staphylococcus aureus
NDKQLIYLTPIFPQRYTSNTWLYKKMPT

SEQ ID NO: 1686189 - protein, 18 aa, Staphylococcus aureus
NEAFAAQLLAVDRELKLP

SEQ ID NO: 1686190 - protein, 23 aa, Staphylococcus aureus
NEILQLPLLKIDLNFYPQFCKDM

SEQ ID NO: 1686191 - protein, 20 aa, Staphylococcus aureus
NELYRVIGVYSKHKGKDTYV

SEQ ID NO: 1686192 - protein, 21 aa, Staphylococcus aureus
NGHVLPIIAQFLLDNTNDVTS

SEQ ID NO: 1686193 - protein, 24 aa, Staphylococcus aureus
NHSPNELLMFLYDLEQRFNNFINR

SEQ ID NO: 1686194 - protein, 32 aa, Staphylococcus aureus
NIDTPKNIDFNEKLTYRTASDVVINNAQPEVT

SEQ ID NO: 1686195 - protein, 28 aa, Staphylococcus aureus
NITSMPHYDGFITNLPLIGQHTLKSYND

SEQ ID NO: 1686196 - protein, 24 aa, Staphylococcus aureus
NQGIYDFDILVVALGFVSETFGIE

SEQ ID NO: 1686197 - protein, 24 aa, Staphylococcus aureus
NQVLKQLMHAMNLKLVDFKIEFGK

SEQ ID NO: 1686198 - protein, 27 aa, Staphylococcus aureus
NRDINSYFLIITYRIDKESKQLAAIKQ

SEQ ID NO: 1686199 - protein, 17 aa, Staphylococcus aureus
NRFRPDSQFLYKSAQRG

SEQ ID NO: 1686200 - protein, 23 aa, Staphylococcus aureus
NVGRWFAYFVKHAPRVPFIIIGK

SEQ ID NO: 1686201 - protein, 18 aa, Staphylococcus aureus
NYHYLYPHQRYAIDLVIK

SEQ ID NO: 1686202 - protein, 19 aa, Staphylococcus aureus
PHETWVPSLAMRLILGQMS

SEQ ID NO: 1686203 - protein, 19 aa, Staphylococcus aureus
PIHDYQFLTFDVIGSPFGS

SEQ ID NO: 1686204 - protein, 18 aa, Staphylococcus aureus
PILYQIWKKKHKKAYYKW

SEQ ID NO: 1686205 - protein, 27 aa, Staphylococcus aureus
PLVSVVTLQLISYYAALHRDLDVDKPR

SEQ ID NO: 1686206 - protein, 21 aa, Staphylococcus aureus
PSAHQFLVRNFGTGGVGKWSL

SEQ ID NO: 1686207 - protein, 22 aa, Staphylococcus aureus
PVELRRNIGYVIQQIGLMTHMT

SEQ ID NO: 1686208 - protein, 20 aa, Staphylococcus aureus
QDVILICPQGIEPKGNQFKN

SEQ ID NO: 1686209 - protein, 26 aa, Staphylococcus aureus
QERKINQFFTLILSNHYIKYELKIDE

SEQ ID NO: 1686210 - protein, 23 aa, Staphylococcus aureus
QERPTTLDYIPYIFDSFMELHGD

SEQ ID NO: 1686211 - protein, 27 aa, Staphylococcus aureus
QHNNPFHMSPYFGYASRLLATSGIDYT

SEQ ID NO: 1686212 - protein, 19 aa, Staphylococcus aureus
QIQVMYDPGLILIGGGISE

SEQ ID NO: 1686213 - protein, 17 aa, Staphylococcus aureus
QLQRRYIFDDRGYLSAI

SEQ ID NO: 1686214 - protein, 18 aa, Staphylococcus aureus
QMQKPSVFFLKDGKAREV

SEQ ID NO: 1686215 - protein, 17 aa, Staphylococcus aureus
QNYYMYKKFGVIPEMEY

SEQ ID NO: 1686216 - protein, 19 aa, Staphylococcus aureus
QPMENIFKAVRRLIDEYTD

SEQ ID NO: 1686217 - protein, 19 aa, Staphylococcus aureus
QQIELVKRLVPYVPKVELH

SEQ ID NO: 1686218 - protein, 21 aa, Staphylococcus aureus
QQVPLAVRKAIPQLTKVIKKT

SEQ ID NO: 1686219 - protein, 27 aa, Staphylococcus aureus
QTVGKGGLLITLAKLSAHYGLGLKSLI

SEQ ID NO: 1686220 - protein, 25 aa, Staphylococcus aureus
QTYKMLISICYLIFQGVIQTESKGQ

SEQ ID NO: 1686221 - protein, 29 aa, Staphylococcus aureus
RATIVMALYQMFHVLLSFSVAYGATASGL

SEQ ID NO: 1686222 - protein, 17 aa, Staphylococcus aureus
RFFNHYFNKGDIYQAPF

SEQ ID NO: 1686223 - protein, 35 aa, Staphylococcus aureus
RIGLLKIDFLGLRNLSIIHQILIQVKKDLGINIDI

SEQ ID NO: 1686224 - protein, 21 aa, Staphylococcus aureus
RIINEPTAAALAYGLDKTDKD

SEQ ID NO: 1686225 - protein, 20 aa, Staphylococcus aureus
RIKRYIAKYTINPAITHGIS

SEQ ID NO: 1686226 - protein, 17 aa, Staphylococcus aureus
RILHFVSGDGGKLKIHY

SEQ ID NO: 1686227 - protein, 22 aa, Staphylococcus aureus
RKEYPNALLHWEDFGRGHAKNI

SEQ ID NO: 1686228 - protein, 24 aa, Staphylococcus aureus
RKMMGEYIVYYDGVVIGGLYDNRL

SEQ ID NO: 1686229 - protein, 25 aa, Staphylococcus aureus
RLVDTQALFLEYRKKLQDVYTDVED

SEQ ID NO: 1686230 - protein, 17 aa, Staphylococcus aureus
RNYLLKHKNLYEFNSSP

SEQ ID NO: 1686231 - protein, 17 aa, Staphylococcus aureus
RPIIINFSKYELEKLFK

SEQ ID NO: 1686232 - protein, 17 aa, Staphylococcus aureus
RPYLRHRDVYHYDLKSF

SEQ ID NO: 1686233 - protein, 25 aa, Staphylococcus aureus
RQKERQLLVDLFKDEGLTEEDVLNK

SEQ ID NO: 1686234 - protein, 27 aa, Staphylococcus aureus
RSAYHILDMVFWFGNLQILAAHQYPTT

SEQ ID NO: 1686235 - protein, 23 aa, Staphylococcus aureus
RTEQARIRLYIPLNERISADDYR

SEQ ID NO: 1686236 - protein, 28 aa, Staphylococcus aureus
RVASILAHTLFDYPSHQLVTFGVTGTNG

SEQ ID NO: 1686237 - protein, 19 aa, Staphylococcus aureus
RVGPIKLHIVPFTELQKQV

SEQ ID NO: 1686238 - protein, 17 aa, Staphylococcus aureus
RVILVTHVVTHPDFIVP

SEQ ID NO: 1686239 - protein, 18 aa, Staphylococcus aureus
SASDYAIRLLEDKALYNK

SEQ ID NO: 1686240 - protein, 18 aa, Staphylococcus aureus
SFKSFSKPKWSKLINKLS

SEQ ID NO: 1686241 - protein, 33 aa, Staphylococcus aureus
SIEPGKLADIVLWDPIFFGVKPELVVKGGLINS

SEQ ID NO: 1686242 - protein, 21 aa, Staphylococcus aureus
SIKLILEVLNIPKSTYYRWKN

SEQ ID NO: 1686243 - protein, 35 aa, Staphylococcus aureus
SIMAELEALYPPSYSSYIDFLYTCRQKIKLLDITY

SEQ ID NO: 1686244 - protein, 30 aa, Staphylococcus aureus
SLNAGGKRIRPVLLLLTLDSLNTEYELGVK

SEQ ID NO: 1686245 - protein, 21 aa, Staphylococcus aureus
SPYDFQGLGVEGLKILKQIKD

SEQ ID NO: 1686246 - protein, 24 aa, Staphylococcus aureus
SRNHWYQWLEHNLTLEGYDVTLFN

SEQ ID NO: 1686247 - protein, 29 aa, Staphylococcus aureus
SSEQKFYYKLILWQYLKDKHGLTCAYSTF

SEQ ID NO: 1686248 - protein, 17 aa, Staphylococcus aureus
SVFFLKDGKAREVIKRQ

SEQ ID NO: 1686249 - protein, 26 aa, Staphylococcus aureus
SVLDACLTPILAPFTTITHMIGVIDA

SEQ ID NO: 1686250 - protein, 19 aa, Staphylococcus aureus
TAKFQVLPKAVNPTFINNK

SEQ ID NO: 1686251 - protein, 17 aa, Staphylococcus aureus
TAYRREKYVPFGGPAGG

SEQ ID NO: 1686252 - protein, 17 aa, Staphylococcus aureus
TDDYPGWWREIIDGGYV

SEQ ID NO: 1686253 - protein, 22 aa, Staphylococcus aureus
TDYIDLYYIHFPDDNTPKDQAV

SEQ ID NO: 1686254 - protein, 18 aa, Staphylococcus aureus
TEEKEAFTNALEDILSKA

SEQ ID NO: 1686255 - protein, 17 aa, Staphylococcus aureus
TFAESNIGYFILPKNHI

SEQ ID NO: 1686256 - protein, 20 aa, Staphylococcus aureus
TFIMPKFLKSFFNEHPFIDV

SEQ ID NO: 1686257 - protein, 20 aa, Staphylococcus aureus
TFLPSLTVQVAMAGAMLIGL

SEQ ID NO: 1686258 - protein, 24 aa, Staphylococcus aureus
TFSEYKKDALAKIADAYNAKVNEA

SEQ ID NO: 1686259 - protein, 23 aa, Staphylococcus aureus
TGIRMIKHYATLTTTAHILNQSL

SEQ ID NO: 1686260 - protein, 17 aa, Staphylococcus aureus
TGKSTSLVFYQIKIDLD

SEQ ID NO: 1686261 - protein, 17 aa, Staphylococcus aureus
TGMSHNDDLPYVELALG

SEQ ID NO: 1686262 - protein, 26 aa, Staphylococcus aureus
TIVSPLPEKSSFTAKFQVLPKAVNPT

SEQ ID NO: 1686263 - protein, 18 aa, Staphylococcus aureus
TIYGGLIAGFYNDVSKET

SEQ ID NO: 1686264 - protein, 28 aa, Staphylococcus aureus
TKADLPFFHAKGGIYVWLETPPGYDSEQ

SEQ ID NO: 1686265 - protein, 19 aa, Staphylococcus aureus
TNKQRNYLELFYLEDYSLS

SEQ ID NO: 1686266 - protein, 20 aa, Staphylococcus aureus
TSFFGAYDLALYKSNTFIGQ

SEQ ID NO: 1686267 - protein, 29 aa, Staphylococcus aureus
TSHYKKIDYEFLYLLSMDKLFGNKRNRLT

SEQ ID NO: 1686268 - protein, 22 aa, Staphylococcus aureus
TSVPIVPELLKSLNFNQFNLVE

SEQ ID NO: 1686269 - protein, 28 aa, Staphylococcus aureus
TTLHNSLIEMIDYFKALFPNGGLYVHLD

SEQ ID NO: 1686270 - protein, 21 aa, Staphylococcus aureus
TVIDYYHRFVERFPTVEVLSQ

SEQ ID NO: 1686271 - protein, 42 aa, Staphylococcus aureus
TVNVAKTGTAHLFKVPTDADRLDLEFIPDNTAVADASRITTN

SEQ ID NO: 1686272 - protein, 20 aa, Staphylococcus aureus
TVVGLGPRILRAETAPLYAL

SEQ ID NO: 1686273 - protein, 25 aa, Staphylococcus aureus
VCNHVLYHLGYLQDKHYPHLRFGFI

SEQ ID NO: 1686274 - protein, 18 aa, Staphylococcus aureus
VDARYNLGLALFMKNENI

SEQ ID NO: 1686275 - protein, 25 aa, Staphylococcus aureus
VDSVKNEFELLWQKSTPLTEQWINS

SEQ ID NO: 1686276 - protein, 18 aa, Staphylococcus aureus
VEAFFATIPGIIHTEAGR

SEQ ID NO: 1686277 - protein, 27 aa, Staphylococcus aureus
VENEKGILIYRDKSFHAILNFIDENKF

SEQ ID NO: 1686278 - protein, 17 aa, Staphylococcus aureus
VFIDIRGIEDVEKRLFL

SEQ ID NO: 1686279 - protein, 17 aa, Staphylococcus aureus
VFRCSIYYVTNYSIDEQ

SEQ ID NO: 1686280 - protein, 22 aa, Staphylococcus aureus
VKRELGFVLMALNIRKIAAQRA

SEQ ID NO: 1686281 - protein, 27 aa, Staphylococcus aureus
VKVGGTWHYICLFIDLFNREIVGYSAG

SEQ ID NO: 1686282 - protein, 27 aa, Staphylococcus aureus
VSVLDACLTPILAPFTTITHMIGVIDA

SEQ ID NO: 1686283 - protein, 27 aa, Staphylococcus aureus
VSVLDACLTPILAPFTTITHMIGVVDA

SEQ ID NO: 1686284 - protein, 33 aa, Staphylococcus aureus
VTEMKMFEFKQGVKLFGAIVILSQSGYTGEDGF

SEQ ID NO: 1686285 - protein, 27 aa, Staphylococcus aureus
VTQFVDNQYFAVYKWDIHGDLKFNKPH

SEQ ID NO: 1686286 - protein, 25 aa, Staphylococcus aureus
VYLVDRVIPMIPHRLSNGICSLNPN

SEQ ID NO: 1686287 - protein, 17 aa, Staphylococcus aureus
VYSVLINVTSINKLFLY

SEQ ID NO: 1686288 - protein, 34 aa, Staphylococcus aureus
WIAPETFANFDSRSIWYIFDTYKLPKELINEQLK

SEQ ID NO: 1686289 - protein, 27 aa, Staphylococcus aureus
YDFQEKQLIELVTRLGIKLNLPSLDFD

SEQ ID NO: 1686290 - protein, 28 aa, Staphylococcus aureus
YDNYEDVYKLLNWIKLIIIEYISNIVKK

SEQ ID NO: 1686291 - protein, 19 aa, Staphylococcus aureus
YEIRNEIAQIKVIFKTVLK

SEQ ID NO: 1686292 - protein, 18 aa, Staphylococcus aureus
YHKLFTDKHDINGNVPIF

SEQ ID NO: 1686293 - protein, 22 aa, Staphylococcus aureus
YKHSKPFLKQFPTSGEHVLMGP

SEQ ID NO: 1686294 - protein, 17 aa, Staphylococcus aureus
YLELFYLEDYSLSEIAD

SEQ ID NO: 1686295 - protein, 19 aa, Staphylococcus aureus
YLPIYAIQNHLCECGIAGE

SEQ ID NO: 1686296 - protein, 23 aa, Staphylococcus aureus
YLRSLAHNIDPIFQIGKGGINEN

SEQ ID NO: 1686297 - protein, 18 aa, Staphylococcus aureus
YLSGKNIALLFEKNSTRT

SEQ ID NO: 1686298 - protein, 19 aa, Staphylococcus aureus
YMLSYAFTVLNKKGYQKLA

SEQ ID NO: 1686299 - protein, 19 aa, Staphylococcus aureus
YNIHALRHSYASYLANNGV

SEQ ID NO: 1686300 - protein, 18 aa, Staphylococcus aureus
YRVYFNDVQLPLLADQVR

SEQ ID NO: 1686301 - protein, 17 aa, Staphylococcus aureus
YSGTEMDILPDGSLDYD

SEQ ID NO: 1686302 - protein, 23 aa, Staphylococcus aureus
AAIKDFWEKVGLKTNVKLVEFGK

SEQ ID NO: 1686303 - protein, 18 aa, Staphylococcus aureus
AEFKLFNTLVNGELEETC

SEQ ID NO: 1686304 - protein, 19 aa, Staphylococcus aureus
AFGFIKMKNGATIILESAW

SEQ ID NO: 1686305 - protein, 19 aa, Staphylococcus aureus
AIFGEDANFGRIITAIGYS

SEQ ID NO: 1686306 - protein, 17 aa, Staphylococcus aureus
AKPRLPFDHVFHHNKYH

SEQ ID NO: 1686307 - protein, 38 aa, Staphylococcus aureus
ALMSAGLFIVGRIKGVARPALVVTLPTIDGKGFVFLDV

SEQ ID NO: 1686308 - protein, 18 aa, Staphylococcus aureus
AMAIFKYMEKKGYEGKYN

SEQ ID NO: 1686309 - protein, 23 aa, Staphylococcus aureus
AQLTDLKEDLRRLKDASKKLDTA

SEQ ID NO: 1686310 - protein, 20 aa, Staphylococcus aureus
AREFDYIKSLRRLTTKDIEV

SEQ ID NO: 1686311 - protein, 17 aa, Staphylococcus aureus
AYNPKMHHLIDTEQFKM

SEQ ID NO: 1686312 - protein, 17 aa, Staphylococcus aureus
DDYVYAFLDISQVTKGH

SEQ ID NO: 1686313 - protein, 21 aa, Staphylococcus aureus
DEFQAFYDELKPLADLYNAKK

SEQ ID NO: 1686314 - protein, 19 aa, Staphylococcus aureus
DELQNVTIPAIEAIVPQKD

SEQ ID NO: 1686315 - protein, 24 aa, Staphylococcus aureus
DETGGRRFWPMTVNPERVEVNWSK

SEQ ID NO: 1686316 - protein, 23 aa, Staphylococcus aureus
DEYKKYFQPLIKEDDKTFSDGMK

SEQ ID NO: 1686317 - protein, 19 aa, Staphylococcus aureus
DFIHRGLLTLYHNELFVSE

SEQ ID NO: 1686318 - protein, 21 aa, Staphylococcus aureus
DGVYATDPRLLPKAKRLDIVS

SEQ ID NO: 1686319 - protein, 19 aa, Staphylococcus aureus
DKWVYEMLGMDSTCPKDVL

SEQ ID NO: 1686320 - protein, 17 aa, Staphylococcus aureus
DLALYKSNTFIGQPLWG

SEQ ID NO: 1686321 - protein, 23 aa, Staphylococcus aureus
DYMRHMFIEFVRTYYGYDERISL

SEQ ID NO: 1686322 - protein, 22 aa, Staphylococcus aureus
EEMILVINFFNHVEKYYESGVT

SEQ ID NO: 1686323 - protein, 19 aa, Staphylococcus aureus
EEVILQWKAQGIKPDVVMV

SEQ ID NO: 1686324 - protein, 18 aa, Staphylococcus aureus
EFELFHYLSKHMGQVMTR

SEQ ID NO: 1686325 - protein, 27 aa, Staphylococcus aureus
EFKNNLALCVYYLEKLIKDSKDSIMIC

SEQ ID NO: 1686326 - protein, 18 aa, Staphylococcus aureus
EGPITMTLIREMRLMWKE

SEQ ID NO: 1686327 - protein, 25 aa, Staphylococcus aureus
EGQSLYIRPFVFATEGALGVGASHQ

SEQ ID NO: 1686328 - protein, 24 aa, Staphylococcus aureus
EIEYPEKFVTLKHQHILGTLMSLG

SEQ ID NO: 1686329 - protein, 26 aa, Staphylococcus aureus
EIFDDLWMELYRSFKKLRNIFKEEGH

SEQ ID NO: 1686330 - protein, 19 aa, Staphylococcus aureus
EIPFDVYPQDAIMPLPLEE

SEQ ID NO: 1686331 - protein, 25 aa, Staphylococcus aureus
EIVCDYLFCKAFGKLASNIERYTNQ

SEQ ID NO: 1686332 - protein, 17 aa, Staphylococcus aureus
EKEHLLSPLFKDWHKYN

SEQ ID NO: 1686333 - protein, 23 aa, Staphylococcus aureus
ELEKYKQLILDDKMLVVAVRDKS

SEQ ID NO: 1686334 - protein, 22 aa, Staphylococcus aureus
ELGITILINLHFVDLAKEYGTR

SEQ ID NO: 1686335 - protein, 18 aa, Staphylococcus aureus
ELNCSIYFSDLGCPYQRG

SEQ ID NO: 1686336 - protein, 21 aa, Staphylococcus aureus
ERPTTLDYIPYIFDSFMELHG

SEQ ID NO: 1686337 - protein, 26 aa, Staphylococcus aureus
ESHFQRTFDEKTYLSWLAQVGFKHVE

SEQ ID NO: 1686338 - protein, 30 aa, Staphylococcus aureus
ETLIEGYPVTYFSLFATTMPIKLNHIIKFS

SEQ ID NO: 1686339 - protein, 24 aa, Staphylococcus aureus
FASLLHEDLKIRKFIDNELKEASV

SEQ ID NO: 1686340 - protein, 26 aa, Staphylococcus aureus
FDDLWMDLYDLFEELRDLFKEEDLEP

SEQ ID NO: 1686341 - protein, 26 aa, Staphylococcus aureus
FDYVLNQPLYQLIEQVKPRLTKAKIK

SEQ ID NO: 1686342 - protein, 24 aa, Staphylococcus aureus
FGRTFQHRAYFNKRLRTTGGRYLL

SEQ ID NO: 1686343 - protein, 18 aa, Staphylococcus aureus
FIEWVFMFVIKSDDYRDC

SEQ ID NO: 1686344 - protein, 18 aa, Staphylococcus aureus
FLCRFNVAILDDGYYLPM

SEQ ID NO: 1686345 - protein, 17 aa, Staphylococcus aureus
GFPIFQASIPGSLKNVF

SEQ ID NO: 1686346 - protein, 17 aa, Staphylococcus aureus
GFRAYVFAPVIKGKVDK

SEQ ID NO: 1686347 - protein, 19 aa, Staphylococcus aureus
GGIIAGFLFRETEPDIEAL

SEQ ID NO: 1686348 - protein, 18 aa, Staphylococcus aureus
GLEAAFKSYFKQFEENYG

SEQ ID NO: 1686349 - protein, 18 aa, Staphylococcus aureus
HFIDVLKTYLPEGPKYYP

SEQ ID NO: 1686350 - protein, 24 aa, Staphylococcus aureus
HKDGRLFVCYLGDFKSTGGIFAAT

SEQ ID NO: 1686351 - protein, 23 aa, Staphylococcus aureus
HLFEDEYFMYGLQTYAESNNSDV

SEQ ID NO: 1686352 - protein, 17 aa, Staphylococcus aureus
HTDTYHHILKIIQKYEL

SEQ ID NO: 1686353 - protein, 25 aa, Staphylococcus aureus
HVHKILLQHLTEKALVLGPSPAALA

SEQ ID NO: 1686354 - protein, 18 aa, Staphylococcus aureus
IDTIRKVAKRLDKIVAIL

SEQ ID NO: 1686355 - protein, 25 aa, Staphylococcus aureus
IKKDIGMIFQHFNLLNSATVFKNVA

SEQ ID NO: 1686356 - protein, 23 aa, Staphylococcus aureus
ILALFCRIFKYKFGMVNKVVIKL

SEQ ID NO: 1686357 - protein, 19 aa, Staphylococcus aureus
ILKNISWQINEGDKWILYG

SEQ ID NO: 1686358 - protein, 19 aa, Staphylococcus aureus
INAVKTFSEYKKDALAKIA

SEQ ID NO: 1686359 - protein, 19 aa, Staphylococcus aureus
INTQLREYTFLGKEGRFVT

SEQ ID NO: 1686360 - protein, 18 aa, Staphylococcus aureus
IWRSMLEHVNWNMIDNGV

SEQ ID NO: 1686361 - protein, 18 aa, Staphylococcus aureus
IYEYLKYDIIKRLCFEKG

SEQ ID NO: 1686362 - protein, 23 aa, Staphylococcus aureus
KALFEKWFHPKDASTKVFRFNAV

SEQ ID NO: 1686363 - protein, 27 aa, Staphylococcus aureus
KASNGWILHIPSCYLGIAQAARNYAVD

SEQ ID NO: 1686364 - protein, 23 aa, Staphylococcus aureus
KDGYADLKILYSPASDQNYRYAN

SEQ ID NO: 1686365 - protein, 23 aa, Staphylococcus aureus
KGIGAGLIINNQLYRGANGEAGE

SEQ ID NO: 1686366 - protein, 34 aa, Staphylococcus aureus
KGISKMFDLMLPKDPIHMPLSKMNMFGLGNIMMR

SEQ ID NO: 1686367 - protein, 26 aa, Staphylococcus aureus
KGLAGAMMFNLKPINVLKNSAKLAIL

SEQ ID NO: 1686368 - protein, 19 aa, Staphylococcus aureus
KHWYQLNHAILDDIIQNLN

SEQ ID NO: 1686369 - protein, 27 aa, Staphylococcus aureus
KHYGPLLNGFYHIPFPDKYRGMYEQPQ

SEQ ID NO: 1686370 - protein, 24 aa, Staphylococcus aureus
KIKDAKFKTIIKLYEYQKSSENNS

SEQ ID NO: 1686371 - protein, 22 aa, Staphylococcus aureus
KISLQMHAFPKEIRKIVFNEDY

SEQ ID NO: 1686372 - protein, 19 aa, Staphylococcus aureus
KKENPEILAFIKSFKKYIA

SEQ ID NO: 1686373 - protein, 22 aa, Staphylococcus aureus
KKYKIPVIYSTHPRSWKKIEES

SEQ ID NO: 1686374 - protein, 21 aa, Staphylococcus aureus
KLKNEIIRKYDLKPSIISNSI

SEQ ID NO: 1686375 - protein, 28 aa, Staphylococcus aureus
KLQFKSKDWYWNAYFEGPIKLHKEFTIP

SEQ ID NO: 1686376 - protein, 17 aa, Staphylococcus aureus
KNFAIGKLLNINTRSEN

SEQ ID NO: 1686377 - protein, 25 aa, Staphylococcus aureus
KQNANKFYKFAIYGKFGTGKTTFLT

SEQ ID NO: 1686378 - protein, 22 aa, Staphylococcus aureus
KRGEQFFMDNFGLKVKATNVVG

SEQ ID NO: 1686379 - protein, 24 aa, Staphylococcus aureus
KTIRTLITRLYKKEIIKRYKSENI

SEQ ID NO: 1686380 - protein, 19 aa, Staphylococcus aureus
KTNMPPYREFAWVQDKFGV

SEQ ID NO: 1686381 - protein, 30 aa, Staphylococcus aureus
KVNYKLRDWLFSRQRYWGEPIPVIHWEDGT

SEQ ID NO: 1686382 - protein, 28 aa, Staphylococcus aureus
LDIKVIMPMFDDALPYYKQFITEVTIFL

SEQ ID NO: 1686383 - protein, 21 aa, Staphylococcus aureus
LEGVLYNLYTVYLALIEVMNE

SEQ ID NO: 1686384 - protein, 22 aa, Staphylococcus aureus
LERHMWYIVRDVLDNIFDQLVH

SEQ ID NO: 1686385 - protein, 20 aa, Staphylococcus aureus
LFNEIVFVLDNFRNDDDYLT

SEQ ID NO: 1686386 - protein, 24 aa, Staphylococcus aureus
LGAFLAQYNLIKHNLDNGTTFAAP

SEQ ID NO: 1686387 - protein, 17 aa, Staphylococcus aureus
LGHQLFALSQGASSFKM

SEQ ID NO: 1686388 - protein, 17 aa, Staphylococcus aureus
LIEYMDYLSLKDPKRIL

SEQ ID NO: 1686389 - protein, 27 aa, Staphylococcus aureus
LKREFSYWQFRKLFKSYTWQSDVHELK

SEQ ID NO: 1686390 - protein, 19 aa, Staphylococcus aureus
LKSLTFHVACDEWFQNYIK

SEQ ID NO: 1686391 - protein, 20 aa, Staphylococcus aureus
LNIVNFHTLITTKASRIRQI

SEQ ID NO: 1686392 - protein, 20 aa, Staphylococcus aureus
LQSLINKYPQIQKNMKSEFI

SEQ ID NO: 1686393 - protein, 25 aa, Staphylococcus aureus
MEIDYPEKFVTLKHQHILGTLMSLG

SEQ ID NO: 1686394 - protein, 17 aa, Staphylococcus aureus
MQKIFSQELRFKDENSE

SEQ ID NO: 1686395 - protein, 19 aa, Staphylococcus aureus
MSIWTLLKIPDIEPYFHKV

SEQ ID NO: 1686396 - protein, 23 aa, Staphylococcus aureus
MSLKNAELLYKFANGIFSDENYE

SEQ ID NO: 1686397 - protein, 25 aa, Staphylococcus aureus
NALQLLDTPGILWPKFEDEEVGKKL

SEQ ID NO: 1686398 - protein, 32 aa, Staphylococcus aureus
NFDNRPFIDVFLEPTKLYVKPVLALKKEVSIK

SEQ ID NO: 1686399 - protein, 22 aa, Staphylococcus aureus
NGHFQFQETVLYILKSNTYSYN

SEQ ID NO: 1686400 - protein, 21 aa, Staphylococcus aureus
NITFKMIVFGYKRLSKMLFQF

SEQ ID NO: 1686401 - protein, 22 aa, Staphylococcus aureus
NPFELTIAVLLSAQCTDVLVNR

SEQ ID NO: 1686402 - protein, 22 aa, Staphylococcus aureus
NRQMIKWTKLYIDQFLSSWTMP

SEQ ID NO: 1686403 - protein, 18 aa, Staphylococcus aureus
NVFVFPSLEAGNIGYKIA

SEQ ID NO: 1686404 - protein, 35 aa, Staphylococcus aureus
NWTVAYTKLHNFHWYVKGPNFFSLHVKFEELYNEA

SEQ ID NO: 1686405 - protein, 32 aa, Staphylococcus aureus
PAFINDILKVEGVKSIFHVMDFISVDKENDAN

SEQ ID NO: 1686406 - protein, 17 aa, Staphylococcus aureus
PAYTVLYPTQNTSSLFI

SEQ ID NO: 1686407 - protein, 27 aa, Staphylococcus aureus
PEDAEIIAWFDAIGKKRGLIRRGNEID

SEQ ID NO: 1686408 - protein, 17 aa, Staphylococcus aureus
PLTILELDNDTEISILE

SEQ ID NO: 1686409 - protein, 23 aa, Staphylococcus aureus
PSGYDHLCQFVMSGQLSDSEKLL

SEQ ID NO: 1686410 - protein, 17 aa, Staphylococcus aureus
PTLYLAADTVWFEGVEK

SEQ ID NO: 1686411 - protein, 29 aa, Staphylococcus aureus
QDYQEKQYIELLSRLGIKLNLPDLTFDTD

SEQ ID NO: 1686412 - protein, 24 aa, Staphylococcus aureus
QESQYLYRYYNKISEWLAEHPYVN

SEQ ID NO: 1686413 - protein, 17 aa, Staphylococcus aureus
QGLLEGFKNLGFDTYFA

SEQ ID NO: 1686414 - protein, 25 aa, Staphylococcus aureus
QISDSTLYYTCEKFKLLVLQGNVLG

SEQ ID NO: 1686415 - protein, 23 aa, Staphylococcus aureus
QLDDTWMAIFKDMNFELGIMELY

SEQ ID NO: 1686416 - protein, 29 aa, Staphylococcus aureus
QLRLYGLGAYELLSLMYDIHTVRMTIIQP

SEQ ID NO: 1686417 - protein, 20 aa, Staphylococcus aureus
QMADIKFLSIERIVIELTKL

SEQ ID NO: 1686418 - protein, 20 aa, Staphylococcus aureus
QQIALFPHMTIKENIAQVPQ

SEQ ID NO: 1686419 - protein, 17 aa, Staphylococcus aureus
QTFYTMTGKPFDSSDIV

SEQ ID NO: 1686420 - protein, 17 aa, Staphylococcus aureus
QVNYYIDTPDFKLKEHR

SEQ ID NO: 1686421 - protein, 18 aa, Staphylococcus aureus
REEFNKRLNIIHQKLNDN

SEQ ID NO: 1686422 - protein, 29 aa, Staphylococcus aureus
RKEMQQEIPYPFFVIKMPESNRSKYTFDS

SEQ ID NO: 1686423 - protein, 17 aa, Staphylococcus aureus
RKVKRELYDGRGFLSCS

SEQ ID NO: 1686424 - protein, 24 aa, Staphylococcus aureus
RSSRIGYAYFLHPANKVLTETAED

SEQ ID NO: 1686425 - protein, 17 aa, Staphylococcus aureus
RTGIFDLFGYDLKDYDE

SEQ ID NO: 1686426 - protein, 17 aa, Staphylococcus aureus
RVFEDFATLDLISHGRA

SEQ ID NO: 1686427 - protein, 28 aa, Staphylococcus aureus
SDSKNLKVIYMPHWLEFYSIAIHSDVTS

SEQ ID NO: 1686428 - protein, 17 aa, Staphylococcus aureus
SEYSSRTVVLSKGQVVA

SEQ ID NO: 1686429 - protein, 24 aa, Staphylococcus aureus
SGKTLLAQTLAKTLNVPFAIADAT

SEQ ID NO: 1686430 - protein, 24 aa, Staphylococcus aureus
SIHYIATVVSVYRKVIDAYAADPD

SEQ ID NO: 1686431 - protein, 17 aa, Staphylococcus aureus
SIKPIPRVKPKPKFMMR

SEQ ID NO: 1686432 - protein, 23 aa, Staphylococcus aureus
SKNLVFFSRQIAPGLKRIDSIVL

SEQ ID NO: 1686433 - protein, 25 aa, Staphylococcus aureus
SLNNRFQLFDPFGIKSRFFDSIKID

SEQ ID NO: 1686434 - protein, 24 aa, Staphylococcus aureus
SLQRLMGIIISENLIECVKVAADD

SEQ ID NO: 1686435 - protein, 22 aa, Staphylococcus aureus
SMAEWDVMNIIWDKKSVSANEI

SEQ ID NO: 1686436 - protein, 29 aa, Staphylococcus aureus
SNWQINPMLRLLKTDVLTTSYLKSAYLVD

SEQ ID NO: 1686437 - protein, 24 aa, Staphylococcus aureus
SQTPDLTMAYPIYINAMTGGSEWT

SEQ ID NO: 1686438 - protein, 17 aa, Staphylococcus aureus
SRNKLEPIMLIIVNDVD

SEQ ID NO: 1686439 - protein, 20 aa, Staphylococcus aureus
STIFLHCLPAFHDTNTLYGQ

SEQ ID NO: 1686440 - protein, 17 aa, Staphylococcus aureus
SVDLPILCIEMRSDIPL

SEQ ID NO: 1686441 - protein, 31 aa, Staphylococcus aureus
SYEPPIEACGTWRLVYQRLKALEVLTHEHVH

SEQ ID NO: 1686442 - protein, 21 aa, Staphylococcus aureus
TATMPTYLNALAGRGVHVITV

SEQ ID NO: 1686443 - protein, 37 aa, Staphylococcus aureus
TEDVEKALAMKAPLGIFSHQLQRFIHLVWDVRDVIND

SEQ ID NO: 1686444 - protein, 25 aa, Staphylococcus aureus
TESKQQWIPVYKSWRLNERHYGGLQ

SEQ ID NO: 1686445 - protein, 18 aa, Staphylococcus aureus
TFDYVFHHYLENSDLRPK

SEQ ID NO: 1686446 - protein, 19 aa, Staphylococcus aureus
TFGSFRPWPAYQYTIEHSI

SEQ ID NO: 1686447 - protein, 18 aa, Staphylococcus aureus
TFNKNQLAIAPLIEGFDY

SEQ ID NO: 1686448 - protein, 17 aa, Staphylococcus aureus
TFSRTQAFLNEFAESLS

SEQ ID NO: 1686449 - protein, 17 aa, Staphylococcus aureus
TGALMSAGLFIVGRIKG

SEQ ID NO: 1686450 - protein, 25 aa, Staphylococcus aureus
TGDFDKLIYGIPQLIEYKIDETAQL

SEQ ID NO: 1686451 - protein, 23 aa, Staphylococcus aureus
TGKTFLAVVYAAKQLRKGAVKRI

SEQ ID NO: 1686452 - protein, 31 aa, Staphylococcus aureus
TGVVNLINFYYPKLTFRSSILELIKENKVTA

SEQ ID NO: 1686453 - protein, 18 aa, Staphylococcus aureus
TIYNHLHLKHIFESMPFL

SEQ ID NO: 1686454 - protein, 35 aa, Staphylococcus aureus
TLIEFDRSWEKIGVRFVQSLLETFPVHNKEAALRQ

SEQ ID NO: 1686455 - protein, 24 aa, Staphylococcus aureus
TNPLWHVYRLVKFSKVFKNVIIIE

SEQ ID NO: 1686456 - protein, 23 aa, Staphylococcus aureus
TPSKLKSIVGPFAYYIKGFEMLP

SEQ ID NO: 1686457 - protein, 20 aa, Staphylococcus aureus
TYCGIGTIGLYMAPHAKHVY

SEQ ID NO: 1686458 - protein, 17 aa, Staphylococcus aureus
TYLSWLAQVGFKHVETF

SEQ ID NO: 1686459 - protein, 20 aa, Staphylococcus aureus
TYRALTKVFTRFGVEVDFVD

SEQ ID NO: 1686460 - protein, 18 aa, Staphylococcus aureus
VACDEWFQNYIKTSGSKR

SEQ ID NO: 1686461 - protein, 34 aa, Staphylococcus aureus
VAGTKELIDWLKAQSRPFLFSTSLAPGDTKAITE

SEQ ID NO: 1686462 - protein, 17 aa, Staphylococcus aureus
VAQLEVPIPAIISAFEI

SEQ ID NO: 1686463 - protein, 17 aa, Staphylococcus aureus
VELVFGFMKAILGFTRM

SEQ ID NO: 1686464 - protein, 17 aa, Staphylococcus aureus
VFMKDGRMILTEQKDIL

SEQ ID NO: 1686465 - protein, 18 aa, Staphylococcus aureus
VGCRIGCTFCASTLGGLK

SEQ ID NO: 1686466 - protein, 27 aa, Staphylococcus aureus
VGYQNEYFYITYLSRNLKEYRKYYEPL

SEQ ID NO: 1686467 - protein, 26 aa, Staphylococcus aureus
VIEGNSGLFVAMPSKRTPDGEFRDIA

SEQ ID NO: 1686468 - protein, 19 aa, Staphylococcus aureus
VIEWSQFIKDLLPATHLSI

SEQ ID NO: 1686469 - protein, 26 aa, Staphylococcus aureus
VIHLMSRVRRYPLPLVLEISNIESVM

SEQ ID NO: 1686470 - protein, 17 aa, Staphylococcus aureus
VKELRKKTGAGMMDCKK

SEQ ID NO: 1686471 - protein, 27 aa, Staphylococcus aureus
VKQLRKRYNIPTKKAPKLLIKGDGDLK

SEQ ID NO: 1686472 - protein, 17 aa, Staphylococcus aureus
VNVITGLIKANIPTRIA

SEQ ID NO: 1686473 - protein, 19 aa, Staphylococcus aureus
VSIYRYISKLQEHYQFHLA

SEQ ID NO: 1686474 - protein, 22 aa, Staphylococcus aureus
VTTPILVKAPIAGRRILLKEVR

SEQ ID NO: 1686475 - protein, 17 aa, Staphylococcus aureus
WDDLTIFERRRFYQGDV

SEQ ID NO: 1686476 - protein, 21 aa, Staphylococcus aureus
WLNQAPFSFDLSVMAIYPCLA

SEQ ID NO: 1686477 - protein, 30 aa, Staphylococcus aureus
YAFAYTLDDGKAYAYLIFVQETWTMLHENT

SEQ ID NO: 1686478 - protein, 23 aa, Staphylococcus aureus
YALEEYIDIFPTLSLKEIEIKKL

SEQ ID NO: 1686479 - protein, 26 aa, Staphylococcus aureus
YDNPVTEIYFIEPDLHFTIIDFNQEL

SEQ ID NO: 1686480 - protein, 25 aa, Staphylococcus aureus
YMEAEPFMWPVYEVIRKSTVEELKA

SEQ ID NO: 1686481 - protein, 17 aa, Staphylococcus aureus
YPEFAWFEGMINSIVHR

SEQ ID NO: 1686482 - protein, 17 aa, Staphylococcus aureus
YQTRYEVLKQLCTTYKM

SEQ ID NO: 1686483 - protein, 18 aa, Staphylococcus aureus
AESLMALFGDSMNVALLT

SEQ ID NO: 1686484 - protein, 19 aa, Staphylococcus aureus
AFNYMPYFEQLDMNQINVT

SEQ ID NO: 1686485 - protein, 17 aa, Staphylococcus aureus
AKLADRLGFKRIWFTEH

SEQ ID NO: 1686486 - protein, 17 aa, Staphylococcus aureus
ALGKIFYNPDMPLIKDY

SEQ ID NO: 1686487 - protein, 23 aa, Staphylococcus aureus
ANKKDFGWIYSSSLASAAAVYTL

SEQ ID NO: 1686488 - protein, 20 aa, Staphylococcus aureus
APENMEVLIGWTGSPASSPH

SEQ ID NO: 1686489 - protein, 23 aa, Staphylococcus aureus
APHEALLCLDATTGQNALSQARN

SEQ ID NO: 1686490 - protein, 20 aa, Staphylococcus aureus
ATTSKPFFLEFMAKDVSKGN

SEQ ID NO: 1686491 - protein, 27 aa, Staphylococcus aureus
AVMQSFWVDPRTKIIYMTQARPGNHYM

SEQ ID NO: 1686492 - protein, 17 aa, Staphylococcus aureus
CGALMQYYRETGIYAER

SEQ ID NO: 1686493 - protein, 18 aa, Staphylococcus aureus
CLKAIETYVLPQHSVIDV

SEQ ID NO: 1686494 - protein, 23 aa, Staphylococcus aureus
CQTHPFSQLLHDAIQLAFDNDIT

SEQ ID NO: 1686495 - protein, 17 aa, Staphylococcus aureus
DALLFETYYDLEELTNV

SEQ ID NO: 1686496 - protein, 30 aa, Staphylococcus aureus
DERITLPEFINPNIKFTMISSIDIAKIASY

SEQ ID NO: 1686497 - protein, 20 aa, Staphylococcus aureus
DFIHRGLLTLYHNELFVSEN

SEQ ID NO: 1686498 - protein, 17 aa, Staphylococcus aureus
DFYYVPAGTVHAIGSGI

SEQ ID NO: 1686499 - protein, 22 aa, Staphylococcus aureus
DGVYATDPRLLPKAKRLDIVSY

SEQ ID NO: 1686500 - protein, 17 aa, Staphylococcus aureus
DIHLIPETRRSTILSSK

SEQ ID NO: 1686501 - protein, 22 aa, Staphylococcus aureus
DILCCYRLNRLHRNLKNALKLI

SEQ ID NO: 1686502 - protein, 17 aa, Staphylococcus aureus
DPKVAMLSFSTKGSAKS

SEQ ID NO: 1686503 - protein, 29 aa, Staphylococcus aureus
DSIKQYGILQPIVLRKTVQGYYIVVGERR

SEQ ID NO: 1686504 - protein, 21 aa, Staphylococcus aureus
EARIPFIKHMQNSGLFASISV

SEQ ID NO: 1686505 - protein, 26 aa, Staphylococcus aureus
EARVAPHPFTNFMNYALLEKSGADVA

SEQ ID NO: 1686506 - protein, 24 aa, Staphylococcus aureus
EFERYKLAFAIRDAAATKNVGTEN

SEQ ID NO: 1686507 - protein, 22 aa, Staphylococcus aureus
EGRFTEYMNLDPFFEKLSHILK

SEQ ID NO: 1686508 - protein, 20 aa, Staphylococcus aureus
EILQGLIFVSSKKEAYDLAD

SEQ ID NO: 1686509 - protein, 19 aa, Staphylococcus aureus
ELLVLNAIHIPLHAGKIEE

SEQ ID NO: 1686510 - protein, 24 aa, Staphylococcus aureus
ENAERLGDVLVLDNILDKAELQQK

SEQ ID NO: 1686511 - protein, 18 aa, Staphylococcus aureus
ENIKKWFGNAWDGVKSKT

SEQ ID NO: 1686512 - protein, 27 aa, Staphylococcus aureus
ENNDSNEVAYLLKGGKVTKVDGNQNSV

SEQ ID NO: 1686513 - protein, 19 aa, Staphylococcus aureus
EPEFFLFKLDEKGEPTLEL

SEQ ID NO: 1686514 - protein, 20 aa, Staphylococcus aureus
ESIPYVIDPVMLAKSGDSLM

SEQ ID NO: 1686515 - protein, 22 aa, Staphylococcus aureus
EVERLYVFTKAASSLTGDNATI

SEQ ID NO: 1686516 - protein, 31 aa, Staphylococcus aureus
EVPPLMCASLWPKFDLFKKYANSELILTKSA

SEQ ID NO: 1686517 - protein, 17 aa, Staphylococcus aureus
FAWGFRFNSDEPEEGLP

SEQ ID NO: 1686518 - protein, 21 aa, Staphylococcus aureus
FKNYVALLFHKGAILEDKYHT

SEQ ID NO: 1686519 - protein, 18 aa, Staphylococcus aureus
FKPQQYYTLSLTVKGFDF

SEQ ID NO: 1686520 - protein, 26 aa, Staphylococcus aureus
FNVERLLMDYLSALPYQLTESSYLTL

SEQ ID NO: 1686521 - protein, 19 aa, Staphylococcus aureus
FRFEDLFSKEEWLSMSLAE

SEQ ID NO: 1686522 - protein, 24 aa, Staphylococcus aureus
FSFDLSVMAIYPCLASGGTLNLVD

SEQ ID NO: 1686523 - protein, 30 aa, Staphylococcus aureus
FSFSSNLNNKALFGDLWAAKFAPTQMDESD

SEQ ID NO: 1686524 - protein, 29 aa, Staphylococcus aureus
FSQEEVSQLIKERIARERKKSDERIKDAK

SEQ ID NO: 1686525 - protein, 25 aa, Staphylococcus aureus
GDEAKEYWLCWVTTERNEQGPYYAG

SEQ ID NO: 1686526 - protein, 26 aa, Staphylococcus aureus
GFRGNIFGGYILYNLGYIHSTGRYYL

SEQ ID NO: 1686527 - protein, 21 aa, Staphylococcus aureus
GGGVKYFVRPPYHPEKSTPAP

SEQ ID NO: 1686528 - protein, 33 aa, Staphylococcus aureus
GGINEAFLQRCPNLKWIAWFATGVNTLPLDYIA

SEQ ID NO: 1686529 - protein, 21 aa, Staphylococcus aureus
GINRPTYKRFLIQLKGRKFAH

SEQ ID NO: 1686530 - protein, 32 aa, Staphylococcus aureus
GNDKNRKRWPLYRPWALFIKDTEKLNLTTRPT

SEQ ID NO: 1686531 - protein, 23 aa, Staphylococcus aureus
GRDYVFMETFGKTYDEFMSSRGE

SEQ ID NO: 1686532 - protein, 22 aa, Staphylococcus aureus
HDIKIDKRKMDLPNGIHSLGYT

SEQ ID NO: 1686533 - protein, 36 aa, Staphylococcus aureus
HIELAAPVSHIWYFKGIPSRMGLLLDMSPRALEEVI

SEQ ID NO: 1686534 - protein, 18 aa, Staphylococcus aureus
IATYIFRHREETSRFLTM

SEQ ID NO: 1686535 - protein, 19 aa, Staphylococcus aureus
IEMNQGISFLPLYITTNSD

SEQ ID NO: 1686536 - protein, 20 aa, Staphylococcus aureus
IENQKYMFDYSACKYPIGVV

SEQ ID NO: 1686537 - protein, 24 aa, Staphylococcus aureus
IFNNNPLMKWYINNVQLKLDRNGN

SEQ ID NO: 1686538 - protein, 18 aa, Staphylococcus aureus
IGGPTMLRAAAKNYKHVT

SEQ ID NO: 1686539 - protein, 29 aa, Staphylococcus aureus
ILSGTGMYPLWKGLPTVKVLQLITKIYGA

SEQ ID NO: 1686540 - protein, 17 aa, Staphylococcus aureus
ISFLPLYITTNSDYNIS

SEQ ID NO: 1686541 - protein, 18 aa, Staphylococcus aureus
ISKVYIRKKDKKLLDWQL

SEQ ID NO: 1686542 - protein, 20 aa, Staphylococcus aureus
ITVIQILKLLEHVDLPSMGP

SEQ ID NO: 1686543 - protein, 20 aa, Staphylococcus aureus
IVEELFEYAGKWRNIRVQGP

SEQ ID NO: 1686544 - protein, 21 aa, Staphylococcus aureus
IVETFALPTLILNIDREQNHA

SEQ ID NO: 1686545 - protein, 18 aa, Staphylococcus aureus
KDYGIRKYGFHGTSHKFV

SEQ ID NO: 1686546 - protein, 19 aa, Staphylococcus aureus
KEIENFKFFVQYGDFKDIN

SEQ ID NO: 1686547 - protein, 26 aa, Staphylococcus aureus
KGAVVGFFTPELFHGIGSAGFHVHFA

SEQ ID NO: 1686548 - protein, 17 aa, Staphylococcus aureus
KHSPTALRFLKAAMNAD

SEQ ID NO: 1686549 - protein, 19 aa, Staphylococcus aureus
KISFIDKTRVLFNDINKYQ

SEQ ID NO: 1686550 - protein, 18 aa, Staphylococcus aureus
KPIITLFETIQGSKLGLK

SEQ ID NO: 1686551 - protein, 19 aa, Staphylococcus aureus
KQEVADTKAKVLDKINAIQ

SEQ ID NO: 1686552 - protein, 37 aa, Staphylococcus aureus
KTNYLIDLMHRHHLKRPLILLNWNTLTGDTFITNGEY

SEQ ID NO: 1686553 - protein, 18 aa, Staphylococcus aureus
KVFKYGEKYYAIIGAQNN

SEQ ID NO: 1686554 - protein, 27 aa, Staphylococcus aureus
KVQDYNEWLIKQPGYTTNFLNIDDGLA

SEQ ID NO: 1686555 - protein, 18 aa, Staphylococcus aureus
KYVLSVASPVFFGKTDDA

SEQ ID NO: 1686556 - protein, 20 aa, Staphylococcus aureus
LEGVLYNLYTVYLALIEVMN

SEQ ID NO: 1686557 - protein, 18 aa, Staphylococcus aureus
LEKVGLDQSFLYRYPHEL

SEQ ID NO: 1686558 - protein, 18 aa, Staphylococcus aureus
LEREAILKGYNFISVLGW

SEQ ID NO: 1686559 - protein, 17 aa, Staphylococcus aureus
LFAAIGGGGLISGISTY

SEQ ID NO: 1686560 - protein, 19 aa, Staphylococcus aureus
LNYYLKQYVLTVPFKNMDV

SEQ ID NO: 1686561 - protein, 17 aa, Staphylococcus aureus
LPNALFTVTLYDKDRLI

SEQ ID NO: 1686562 - protein, 17 aa, Staphylococcus aureus
LVNDYQLEWVIGAPLES

SEQ ID NO: 1686563 - protein, 25 aa, Staphylococcus aureus
MIFSKNLFRRPTPARLTRIEKSLLQ

SEQ ID NO: 1686564 - protein, 20 aa, Staphylococcus aureus
MKHIQNMIGYIPKSDLQVVF

SEQ ID NO: 1686565 - protein, 17 aa, Staphylococcus aureus
MLFYIMKGIKPNYAELG

SEQ ID NO: 1686566 - protein, 18 aa, Staphylococcus aureus
MPILLVSGYDDPLGDYGK

SEQ ID NO: 1686567 - protein, 22 aa, Staphylococcus aureus
NANGLLRQYYPKGTDFANITQK

SEQ ID NO: 1686568 - protein, 19 aa, Staphylococcus aureus
NEFDIAEFKLFNTLVNGEL

SEQ ID NO: 1686569 - protein, 19 aa, Staphylococcus aureus
NFIENTYKYVLHHGLDKKE

SEQ ID NO: 1686570 - protein, 18 aa, Staphylococcus aureus
NHDESSEWVGLFKGKFTR

SEQ ID NO: 1686571 - protein, 17 aa, Staphylococcus aureus
NHIDLNKIAWKNIDNLS

SEQ ID NO: 1686572 - protein, 18 aa, Staphylococcus aureus
NLQFFADQSDDPDEPGGD

SEQ ID NO: 1686573 - protein, 27 aa, Staphylococcus aureus
NLTEPYTNYSILLVSGTYPGGVIEGFG

SEQ ID NO: 1686574 - protein, 23 aa, Staphylococcus aureus
NPDTWGKRYLLSGYSYDMKELAA

SEQ ID NO: 1686575 - protein, 24 aa, Staphylococcus aureus
NSINFISSGNIRKAIEKNNYDKVI

SEQ ID NO: 1686576 - protein, 18 aa, Staphylococcus aureus
NSSSILTSLFLTANNIPN

SEQ ID NO: 1686577 - protein, 21 aa, Staphylococcus aureus
NTPLEFGLYSLGDHLLNPLKG

SEQ ID NO: 1686578 - protein, 28 aa, Staphylococcus aureus
NVGYQNEYFYITYLSRNLKEYRKYYEPL

SEQ ID NO: 1686579 - protein, 27 aa, Staphylococcus aureus
NVIHLMSRIRRYPLPLVLEISNIESVM

SEQ ID NO: 1686580 - protein, 17 aa, Staphylococcus aureus
NWESNFSLLGPLPNLHI

SEQ ID NO: 1686581 - protein, 20 aa, Staphylococcus aureus
PFFICQILVFLFPTSSHVNL

SEQ ID NO: 1686582 - protein, 17 aa, Staphylococcus aureus
PIGGLPDGSIGTSFDII

SEQ ID NO: 1686583 - protein, 17 aa, Staphylococcus aureus
PITLGLGAALKTSADFE

SEQ ID NO: 1686584 - protein, 18 aa, Staphylococcus aureus
PKARLKLLVALSNNLDKA

SEQ ID NO: 1686585 - protein, 22 aa, Staphylococcus aureus
PLDVVDFHNFAKKSYFILTDSG

SEQ ID NO: 1686586 - protein, 29 aa, Staphylococcus aureus
PMGREHYYMYKKFGIWPEKEYAINWVEKI

SEQ ID NO: 1686587 - protein, 28 aa, Staphylococcus aureus
PVTKEFLNYTYSQFFEEMKPMIAEAFYK

SEQ ID NO: 1686588 - protein, 30 aa, Staphylococcus aureus
QAQTQLFVYGLFIYNQWRGMGTLNSVDVIS

SEQ ID NO: 1686589 - protein, 17 aa, Staphylococcus aureus
QEALPVLRIDEPTLEMT

SEQ ID NO: 1686590 - protein, 17 aa, Staphylococcus aureus
QFLMKKYNIPVKSILGF

SEQ ID NO: 1686591 - protein, 21 aa, Staphylococcus aureus
QKKLAELINIKPSTLSDYLNL

SEQ ID NO: 1686592 - protein, 36 aa, Staphylococcus aureus
QLKTELFDYVNWYNNFRPHSSLQYLTPVAFKNLHMK

SEQ ID NO: 1686593 - protein, 21 aa, Staphylococcus aureus
QPDLLLLDEPTNHLDFESISW

SEQ ID NO: 1686594 - protein, 22 aa, Staphylococcus aureus
QQIDKLIENIPLLQARSKEILA

SEQ ID NO: 1686595 - protein, 17 aa, Staphylococcus aureus
QRRYIFDDRGYLSAIRY

SEQ ID NO: 1686596 - protein, 23 aa, Staphylococcus aureus
QTKKPVIIYFYGGSFENGHGTAE

SEQ ID NO: 1686597 - protein, 27 aa, Staphylococcus aureus
QTTAILTGNFLLALGLEHLMAVKDNRV

SEQ ID NO: 1686598 - protein, 17 aa, Staphylococcus aureus
QYFYQHTLIGANGAMIS

SEQ ID NO: 1686599 - protein, 20 aa, Staphylococcus aureus
REIGYSIVPLKLYLKHGHCK

SEQ ID NO: 1686600 - protein, 30 aa, Staphylococcus aureus
RFKETFHAIQGHFTAVFKQLFGGGDAELQL

SEQ ID NO: 1686601 - protein, 24 aa, Staphylococcus aureus
RKMMGEYIIYYDSVVIGGLYDNRL

SEQ ID NO: 1686602 - protein, 21 aa, Staphylococcus aureus
RNAYGVYFTPEIKKFIAENID

SEQ ID NO: 1686603 - protein, 23 aa, Staphylococcus aureus
SAMIPYAAWQKFARPRFDNMISF

SEQ ID NO: 1686604 - protein, 25 aa, Staphylococcus aureus
SDSSVLLFNIIKNNQPLLLSEENIK

SEQ ID NO: 1686605 - protein, 26 aa, Staphylococcus aureus
SELGGKMRIYPEKIIWDIGGIAPKPC

SEQ ID NO: 1686606 - protein, 20 aa, Staphylococcus aureus
SENIMAVPAVFLNGEEFGNG

SEQ ID NO: 1686607 - protein, 20 aa, Staphylococcus aureus
SEVPAHVQAGWMLTTIASVG

SEQ ID NO: 1686608 - protein, 19 aa, Staphylococcus aureus
SKVIAPFNGLISMIVPTKH

SEQ ID NO: 1686609 - protein, 22 aa, Staphylococcus aureus
SSEWVGLFKGKFTRSSIKGQTK

SEQ ID NO: 1686610 - protein, 26 aa, Staphylococcus aureus
TDDNLTMILHEFLPFIEIKQVPSSSA

SEQ ID NO: 1686611 - protein, 18 aa, Staphylococcus aureus
TDYKGRIFCYVLTEDHYV

SEQ ID NO: 1686612 - protein, 24 aa, Staphylococcus aureus
TEKQDLMILTRKKGAYIRSDVTAK

SEQ ID NO: 1686613 - protein, 20 aa, Staphylococcus aureus
TFEIKPKYDLNIMKSGQTLS

SEQ ID NO: 1686614 - protein, 26 aa, Staphylococcus aureus
THFFNTILKYVKEGSLYPLSYYDGDW

SEQ ID NO: 1686615 - protein, 26 aa, Staphylococcus aureus
TKTGKPQYQKYLAKPIITLFETIQGS

SEQ ID NO: 1686616 - protein, 23 aa, Staphylococcus aureus
TLNPDFFMYQAYAAQVNREIAFV

SEQ ID NO: 1686617 - protein, 17 aa, Staphylococcus aureus
TLRKTIRLANLLDVPVV

SEQ ID NO: 1686618 - protein, 30 aa, Staphylococcus aureus
TRRTHGYDFPMWFIRPFYAKETTANKLRSA

SEQ ID NO: 1686619 - protein, 28 aa, Staphylococcus aureus
TRSYQDMLKIWGHLFQYIKSEHIEDTYL

SEQ ID NO: 1686620 - protein, 18 aa, Staphylococcus aureus
TTSKPFFLEFMAKDVSKG

SEQ ID NO: 1686621 - protein, 18 aa, Staphylococcus aureus
TVCILEAMKLFNEIQAEI

SEQ ID NO: 1686622 - protein, 20 aa, Staphylococcus aureus
TVFKNVAMPLILSKKSKTEI

SEQ ID NO: 1686623 - protein, 31 aa, Staphylococcus aureus
TVSHDRYFLNKVAQSYWFIHDGQMEKIIGTF

SEQ ID NO: 1686624 - protein, 25 aa, Staphylococcus aureus
VASSRDIILFSLLLAAKGIKGAVSD

SEQ ID NO: 1686625 - protein, 49 aa, Staphylococcus aureus
VDGAHIRTLLLTFFYRFMRPLIEAGYVYIAQPPLYKLTQGKQKYYVYND

SEQ ID NO: 1686626 - protein, 24 aa, Staphylococcus aureus
VDSVKNEFDLLWQNSTQLTQQWIN

SEQ ID NO: 1686627 - protein, 33 aa, Staphylococcus aureus
VEAVRKHFDLRPAGIIKMLDLKQPIYKQTAAYG

SEQ ID NO: 1686628 - protein, 29 aa, Staphylococcus aureus
VEDLIRLIAADLVEFDWLEGFDIECRNEE

SEQ ID NO: 1686629 - protein, 17 aa, Staphylococcus aureus
VPLVKAYMGMPGDIFSF

SEQ ID NO: 1686630 - protein, 23 aa, Staphylococcus aureus
VQNGVGFALTYFTEGIIFGSKAN

SEQ ID NO: 1686631 - protein, 17 aa, Staphylococcus aureus
VRNINLALRAQYLFESN

SEQ ID NO: 1686632 - protein, 18 aa, Staphylococcus aureus
WLTKPILGEIFKEIVNDS

SEQ ID NO: 1686633 - protein, 18 aa, Staphylococcus aureus
WTKQFLAVAIRPMIHMLY

SEQ ID NO: 1686634 - protein, 25 aa, Staphylococcus aureus
YANDLLTTPVNLAGLPGISVPCGQS

SEQ ID NO: 1686635 - protein, 27 aa, Staphylococcus aureus
YGIDDLPLGIYKFLMTQDKVYARTLDH

SEQ ID NO: 1686636 - protein, 19 aa, Staphylococcus aureus
YGRFPHQKGFGRLTAEDKK

SEQ ID NO: 1686637 - protein, 17 aa, Staphylococcus aureus
YIFRHREETSRFLTMQR

SEQ ID NO: 1686638 - protein, 17 aa, Staphylococcus aureus
YIILINHGDIYNINHGE

SEQ ID NO: 1686639 - protein, 18 aa, Staphylococcus aureus
YIKSLRRLTTKDIEVGGG

SEQ ID NO: 1686640 - protein, 20 aa, Staphylococcus aureus
YISKLQEHYQFHLAISGHEG

SEQ ID NO: 1686641 - protein, 24 aa, Staphylococcus aureus
YLDEYFRNVLGEKSYLILIDDFSG

SEQ ID NO: 1686642 - protein, 18 aa, Staphylococcus aureus
YLPGILVEKLLIKIDDML

SEQ ID NO: 1686643 - protein, 25 aa, Staphylococcus aureus
YPDIYQEILYLLKESHLIIAHNALF

SEQ ID NO: 1686644 - protein, 26 aa, Staphylococcus aureus
YSVLKLIHYMPKQYIRFSKYSNSPTK

SEQ ID NO: 1686645 - protein, 17 aa, Staphylococcus aureus
AAQLYLLEHNHLPFSQN

SEQ ID NO: 1686646 - protein, 34 aa, Staphylococcus aureus
AKNTSTIIPMCHPLPLTGIDVHFNWDETNAPLYT

SEQ ID NO: 1686647 - protein, 28 aa, Staphylococcus aureus
ALNNATLPYALMLANKGYREAFKSNQPL

SEQ ID NO: 1686648 - protein, 30 aa, Staphylococcus aureus
ALPERDTIITIWVKLLTLSGKYNEQGYIML

SEQ ID NO: 1686649 - protein, 20 aa, Staphylococcus aureus
ALRLMKQAEKFNRPIFTFID

SEQ ID NO: 1686650 - protein, 20 aa, Staphylococcus aureus
APADHPWRTMPRNAMTVHYS

SEQ ID NO: 1686651 - protein, 22 aa, Staphylococcus aureus
AQAFDEILKGLPNAMQDALKED

SEQ ID NO: 1686652 - protein, 24 aa, Staphylococcus aureus
AQIANRLRFFFPDVQVRGYYPSYA

SEQ ID NO: 1686653 - protein, 24 aa, Staphylococcus aureus
ASALHGLGLYIYNGEELPSASDND

SEQ ID NO: 1686654 - protein, 20 aa, Staphylococcus aureus
CVFLSWNRYLYRNAQNYITS

SEQ ID NO: 1686655 - protein, 30 aa, Staphylococcus aureus
DAKVNVLQELKLWMARTIAATRNKAIIDVI

SEQ ID NO: 1686656 - protein, 18 aa, Staphylococcus aureus
DFVTPFGTYQVKSPYVGK

SEQ ID NO: 1686657 - protein, 18 aa, Staphylococcus aureus
DGLNRATATYKFAGGKGI

SEQ ID NO: 1686658 - protein, 29 aa, Staphylococcus aureus
DISAGRIPLEVKTLRILHFVSGDGGKLKI

SEQ ID NO: 1686659 - protein, 26 aa, Staphylococcus aureus
DKQYFPATHWKAINGIPYAGSSDIDG

SEQ ID NO: 1686660 - protein, 23 aa, Staphylococcus aureus
DLKTYFNSVIDWISSIFINVEKE

SEQ ID NO: 1686661 - protein, 26 aa, Staphylococcus aureus
DNTLGKWEPFLNDLKAVSPILDNHLD

SEQ ID NO: 1686662 - protein, 18 aa, Staphylococcus aureus
DRGIDGLIIAQYISSPDA

SEQ ID NO: 1686663 - protein, 26 aa, Staphylococcus aureus
DVGLKYRCKLPNTTFARDLYENMRVG

SEQ ID NO: 1686664 - protein, 17 aa, Staphylococcus aureus
DYKVRNYLLKHKNLYEF

SEQ ID NO: 1686665 - protein, 21 aa, Staphylococcus aureus
EAFTNALEDILSKATEDISDQ

SEQ ID NO: 1686666 - protein, 20 aa, Staphylococcus aureus
EAPMFKKILKKHQLLDDAFR

SEQ ID NO: 1686667 - protein, 29 aa, Staphylococcus aureus
EAQSQFNLPTRYIWGIYEPQSDDQNMNET

SEQ ID NO: 1686668 - protein, 18 aa, Staphylococcus aureus
EEIAFDRKNWVFPIQTHE

SEQ ID NO: 1686669 - protein, 25 aa, Staphylococcus aureus
EEKNYLEAVIGLPANIFYGTSIPTC

SEQ ID NO: 1686670 - protein, 17 aa, Staphylococcus aureus
EELGVSKQTIFNNIKRL

SEQ ID NO: 1686671 - protein, 19 aa, Staphylococcus aureus
EEMSLPLMWEFPGGKIEKN

SEQ ID NO: 1686672 - protein, 21 aa, Staphylococcus aureus
EGGFIDIPYLTGHEFGARLPN

SEQ ID NO: 1686673 - protein, 23 aa, Staphylococcus aureus
EHVELVEVPIKPSDRLKARDMLG

SEQ ID NO: 1686674 - protein, 24 aa, Staphylococcus aureus
EIDYPEKFVTLKHQHILGTLMSLG

SEQ ID NO: 1686675 - protein, 25 aa, Staphylococcus aureus
EIYELWRQTLIQVGINRPTYKKFLI

SEQ ID NO: 1686676 - protein, 26 aa, Staphylococcus aureus
EKFQDWLAMEVLPAIRKHGIYATDNV

SEQ ID NO: 1686677 - protein, 18 aa, Staphylococcus aureus
EKHKLKMITIDDLIEYRK

SEQ ID NO: 1686678 - protein, 17 aa, Staphylococcus aureus
EKYSRLRSVYKYEIFNE

SEQ ID NO: 1686679 - protein, 23 aa, Staphylococcus aureus
ELKHQFTHLTWKIKVYAVSGAIN

SEQ ID NO: 1686680 - protein, 28 aa, Staphylococcus aureus
ELQPENMYQILRKLPPREYSISSSFMAT

SEQ ID NO: 1686681 - protein, 25 aa, Staphylococcus aureus
ELSQNIPVFFSANMSYGVHALTKIL

SEQ ID NO: 1686682 - protein, 30 aa, Staphylococcus aureus
EMLLQEFPEQLTNYLLKYDYRDLEIIKAVI

SEQ ID NO: 1686683 - protein, 34 aa, Staphylococcus aureus
EPYGTVLIIAPFNYPFQLVFEPLIGAIAAGNTAI

SEQ ID NO: 1686684 - protein, 19 aa, Staphylococcus aureus
EQIMLKIESEYKDIYLFRL

SEQ ID NO: 1686685 - protein, 24 aa, Staphylococcus aureus
EREPSVLPARFPNLLANGASGIAV

SEQ ID NO: 1686686 - protein, 24 aa, Staphylococcus aureus
ESISAVKHLLPDFALDALKERINE

SEQ ID NO: 1686687 - protein, 17 aa, Staphylococcus aureus
ESLMALFGDSMNVALLT

SEQ ID NO: 1686688 - protein, 20 aa, Staphylococcus aureus
ESQLFLISITTFFVNVDPIC

SEQ ID NO: 1686689 - protein, 37 aa, Staphylococcus aureus
EVVECAIPMIQGILGKIPFFGICLGHQLFALSQGASS

SEQ ID NO: 1686690 - protein, 19 aa, Staphylococcus aureus
FGECLMIAVRQDCRILDYK

SEQ ID NO: 1686691 - protein, 24 aa, Staphylococcus aureus
FNGPLDLLLHLIQKFEIDIYDIPM

SEQ ID NO: 1686692 - protein, 22 aa, Staphylococcus aureus
FSEYDLFTFFKHPSIKSMTIVT

SEQ ID NO: 1686693 - protein, 20 aa, Staphylococcus aureus
FTGLMDNMRYLYDDKHVSET

SEQ ID NO: 1686694 - protein, 30 aa, Staphylococcus aureus
FVAATAPFTPFYRALDWIVTDPLESIKEEI

SEQ ID NO: 1686695 - protein, 22 aa, Staphylococcus aureus
GDAFYAIKTPTMTSYTLAEYKT

SEQ ID NO: 1686696 - protein, 18 aa, Staphylococcus aureus
GDIIGYVEAMKVLNEVTT

SEQ ID NO: 1686697 - protein, 32 aa, Staphylococcus aureus
GFDYIVTGSGFLYNMVRVLVAFLIEVGKGRHE

SEQ ID NO: 1686698 - protein, 24 aa, Staphylococcus aureus
GKADYIFVDDFHPLIYTVRFRPSQ

SEQ ID NO: 1686699 - protein, 23 aa, Staphylococcus aureus
GQYRGIATWRYDQDRQRLIGTIE

SEQ ID NO: 1686700 - protein, 18 aa, Staphylococcus aureus
GTLTGRVKFIFQPAEELG

SEQ ID NO: 1686701 - protein, 23 aa, Staphylococcus aureus
GTQMLFYYRSLVEKERRFTNLEY

SEQ ID NO: 1686702 - protein, 19 aa, Staphylococcus aureus
GTYGFLHQIKINNPTHQLF

SEQ ID NO: 1686703 - protein, 17 aa, Staphylococcus aureus
GVERSRKALSQADLILF

SEQ ID NO: 1686704 - protein, 18 aa, Staphylococcus aureus
HHARLIYVSTISVGTYFD

SEQ ID NO: 1686705 - protein, 27 aa, Staphylococcus aureus
HVRIASPEFMFPSFYGIDVSTTAELIS

SEQ ID NO: 1686706 - protein, 17 aa, Staphylococcus aureus
IDEAKAYNFKSVCVNPT

SEQ ID NO: 1686707 - protein, 20 aa, Staphylococcus aureus
IDIYDDCEFIVAIRSMLIKK

SEQ ID NO: 1686708 - protein, 20 aa, Staphylococcus aureus
IEGKTYIDLLSSASSQNVGH

SEQ ID NO: 1686709 - protein, 19 aa, Staphylococcus aureus
IKLLNPLTLAYMGDAVLDQ

SEQ ID NO: 1686710 - protein, 17 aa, Staphylococcus aureus
IKQLIKQKPFQLSASVE

SEQ ID NO: 1686711 - protein, 17 aa, Staphylococcus aureus
ILLIDSFIKLVIDFKYI

SEQ ID NO: 1686712 - protein, 22 aa, Staphylococcus aureus
KAEKPIEQLFANRLKEIKQIIA

SEQ ID NO: 1686713 - protein, 22 aa, Staphylococcus aureus
KEEQIILPHTTQFYISNNEEIG

SEQ ID NO: 1686714 - protein, 17 aa, Staphylococcus aureus
KEQGIQVELLNLGGGFG

SEQ ID NO: 1686715 - protein, 17 aa, Staphylococcus aureus
KFEVFWKRYKDNIKKSI

SEQ ID NO: 1686716 - protein, 23 aa, Staphylococcus aureus
KGDILKIGAITKGARGYLTFGHS

SEQ ID NO: 1686717 - protein, 28 aa, Staphylococcus aureus
KIAYVVEFFEWFNTLETFKNWKKKPGKP

SEQ ID NO: 1686718 - protein, 19 aa, Staphylococcus aureus
KLLSKLPNKNLIYFESFHG

SEQ ID NO: 1686719 - protein, 20 aa, Staphylococcus aureus
KLNIMFPMVATINEFREAKA

SEQ ID NO: 1686720 - protein, 32 aa, Staphylococcus aureus
KNLIGAFYRPTAVIYDLDFLKTLPFEQILSGY

SEQ ID NO: 1686721 - protein, 29 aa, Staphylococcus aureus
KNRTWEFHITLPQFLAHEDYLLFINAIEQ

SEQ ID NO: 1686722 - protein, 23 aa, Staphylococcus aureus
KQSEELINIIKLAIDQNIPYTVL

SEQ ID NO: 1686723 - protein, 27 aa, Staphylococcus aureus
KSQEKFLQHDLLFKINGSKILKTEFNN

SEQ ID NO: 1686724 - protein, 35 aa, Staphylococcus aureus
KSYKQLPMTLFQIQSKFRDEKRPRFGLLRGREFIM

SEQ ID NO: 1686725 - protein, 21 aa, Staphylococcus aureus
KTFFEYFLRIVNKTHDYAILE

SEQ ID NO: 1686726 - protein, 22 aa, Staphylococcus aureus
KTTLLRMINALEIPTEGTVFVN

SEQ ID NO: 1686727 - protein, 20 aa, Staphylococcus aureus
KVMKKMIANLLIEKSLDVIS

SEQ ID NO: 1686728 - protein, 19 aa, Staphylococcus aureus
KYDNLYKFFKENEKKYQYT

SEQ ID NO: 1686729 - protein, 31 aa, Staphylococcus aureus
LEENPELAVKPFFQLAYDINTHRGYFRISRE

SEQ ID NO: 1686730 - protein, 33 aa, Staphylococcus aureus
LIDQYLTNGKSRAIPIFVFLNDQFEQETVWGPR

SEQ ID NO: 1686731 - protein, 25 aa, Staphylococcus aureus
LIEHSIYTTFKLLSKLPNKNLIYFE

SEQ ID NO: 1686732 - protein, 25 aa, Staphylococcus aureus
LKHTKFNGRRWYLDDYELKTLIDNE

SEQ ID NO: 1686733 - protein, 18 aa, Staphylococcus aureus
LKIHEIMTEFGYEANLGG

SEQ ID NO: 1686734 - protein, 20 aa, Staphylococcus aureus
LKRSETIFIYGFGASFVVAT

SEQ ID NO: 1686735 - protein, 18 aa, Staphylococcus aureus
LKVGMFDDSKIKYIEALP

SEQ ID NO: 1686736 - protein, 37 aa, Staphylococcus aureus
LNEMLMANYLFNKSDNPRFKRWVIGSILSRTYYHNMV

SEQ ID NO: 1686737 - protein, 25 aa, Staphylococcus aureus
LNQINWVGFYLLEQNELILGPFQGH

SEQ ID NO: 1686738 - protein, 19 aa, Staphylococcus aureus
LSINELDKLNWAPADIPAV

SEQ ID NO: 1686739 - protein, 24 aa, Staphylococcus aureus
LTLSDLFNWSRFKVKTFLDLLESD

SEQ ID NO: 1686740 - protein, 24 aa, Staphylococcus aureus
LVEKLISMLGWDPQSPVPINDRGD

SEQ ID NO: 1686741 - protein, 22 aa, Staphylococcus aureus
LVIQLLMHMIHYVPRTYHSNQS

SEQ ID NO: 1686742 - protein, 46 aa, Staphylococcus aureus
LYNNNTYLIVCTDLRLLFLDKGMIYGLKFHEFPFEKINSVSYKKGL

SEQ ID NO: 1686743 - protein, 18 aa, Staphylococcus aureus
MIAVRQDCRILDYKSAIV

SEQ ID NO: 1686744 - protein, 24 aa, Staphylococcus aureus
MIERKYHFMGYRQMKTFKTELIKM

SEQ ID NO: 1686745 - protein, 25 aa, Staphylococcus aureus
MIFSQNLFRRPTPARLTRIEKSLLQ

SEQ ID NO: 1686746 - protein, 26 aa, Staphylococcus aureus
MKQRLGIAMALIKKPEILVLDEPSNG

SEQ ID NO: 1686747 - protein, 24 aa, Staphylococcus aureus
MSNGIPNIVVYNPAPISINSLNPN

SEQ ID NO: 1686748 - protein, 18 aa, Staphylococcus aureus
NDGAAMMLVMSEDKAKEL

SEQ ID NO: 1686749 - protein, 19 aa, Staphylococcus aureus
NEKLIPYWQDLAEFAKEQD

SEQ ID NO: 1686750 - protein, 17 aa, Staphylococcus aureus
NFILGFRATPEETRGSD

SEQ ID NO: 1686751 - protein, 20 aa, Staphylococcus aureus
NGGKFNGIIPISQLSTHHID

SEQ ID NO: 1686752 - protein, 27 aa, Staphylococcus aureus
NHKDTVYNVPFLWRLSSELNVAQLRQA

SEQ ID NO: 1686753 - protein, 25 aa, Staphylococcus aureus
NLELDMLYQMIDLINDTLVSIRFSV

SEQ ID NO: 1686754 - protein, 19 aa, Staphylococcus aureus
NTFNKNQLAIAPLIEGFDY

SEQ ID NO: 1686755 - protein, 20 aa, Staphylococcus aureus
NTIISGPALVAQWINLQYYA

SEQ ID NO: 1686756 - protein, 19 aa, Staphylococcus aureus
NYKHFLEKYFGLNVTINRI

SEQ ID NO: 1686757 - protein, 17 aa, Staphylococcus aureus
PDNFILGFRATPEETRG

SEQ ID NO: 1686758 - protein, 19 aa, Staphylococcus aureus
PEGPITMTLIREMRLMWKE

SEQ ID NO: 1686759 - protein, 18 aa, Staphylococcus aureus
PLYTLNIQTTVSTTGKTG

SEQ ID NO: 1686760 - protein, 27 aa, Staphylococcus aureus
PNNCRLDNETFIYLITGPNMSGKSTYM

SEQ ID NO: 1686761 - protein, 22 aa, Staphylococcus aureus
PPQLAFAIGNAIKYLSRAPLKN

SEQ ID NO: 1686762 - protein, 17 aa, Staphylococcus aureus
PSKLILLGDGPELVPMR

SEQ ID NO: 1686763 - protein, 37 aa, Staphylococcus aureus
QFLDIDNKPILIHTIEKFILVSEFNEIIIATPAQWIS

SEQ ID NO: 1686764 - protein, 18 aa, Staphylococcus aureus
QFQTYYRLLVEWNEKMNL

SEQ ID NO: 1686765 - protein, 23 aa, Staphylococcus aureus
QIENRYQQIDLLWQEIESFDDDN

SEQ ID NO: 1686766 - protein, 21 aa, Staphylococcus aureus
QLVCEILSQQQLRYFFSHNHS

SEQ ID NO: 1686767 - protein, 25 aa, Staphylococcus aureus
QNRHSLGHKLYLKNKIYALQNDERF

SEQ ID NO: 1686768 - protein, 24 aa, Staphylococcus aureus
QRVALARLILKDPKIILADEPTGS

SEQ ID NO: 1686769 - protein, 17 aa, Staphylococcus aureus
QSLINKYPQIQKNMKSE

SEQ ID NO: 1686770 - protein, 19 aa, Staphylococcus aureus
QSPRLMLGFKNKPLQEAPQ

SEQ ID NO: 1686771 - protein, 22 aa, Staphylococcus aureus
QTRHRLHKVETLRANWIQTTGG

SEQ ID NO: 1686772 - protein, 25 aa, Staphylococcus aureus
QVKTERFYQLPKYLFEDAYFKKMSA

SEQ ID NO: 1686773 - protein, 18 aa, Staphylococcus aureus
QYIALGEDFKALIQGQLD

SEQ ID NO: 1686774 - protein, 25 aa, Staphylococcus aureus
REGKLTVAGLLLFSNNINVYLPGAR

SEQ ID NO: 1686775 - protein, 24 aa, Staphylococcus aureus
RGYQDLLQPILKGKIAYSNPNTTT

SEQ ID NO: 1686776 - protein, 17 aa, Staphylococcus aureus
RGYQKGRFSFNVKGGRC

SEQ ID NO: 1686777 - protein, 25 aa, Staphylococcus aureus
RNMVNLCISIDHRILDGLQTGKFMN

SEQ ID NO: 1686778 - protein, 19 aa, Staphylococcus aureus
RNRIELIEPLDALEFHNFT

SEQ ID NO: 1686779 - protein, 20 aa, Staphylococcus aureus
RPRFDNMISFNSTNDLLTWL

SEQ ID NO: 1686780 - protein, 26 aa, Staphylococcus aureus
RQLNDKSLPLIVTTIQKMAKAIQGNA

SEQ ID NO: 1686781 - protein, 18 aa, Staphylococcus aureus
RTIYRMILKLHNIMLNVK

SEQ ID NO: 1686782 - protein, 20 aa, Staphylococcus aureus
SEYLSLDLQILLWNMVKERD

SEQ ID NO: 1686783 - protein, 36 aa, Staphylococcus aureus
SGLAPEAWLECYLNRTLLPILKLFSNTGISLEAHVQ

SEQ ID NO: 1686784 - protein, 25 aa, Staphylococcus aureus
SGVSIDHLWLYETNKYYALAMELIH

SEQ ID NO: 1686785 - protein, 28 aa, Staphylococcus aureus
SIEWLSINELDKLNWAPADIPAVNKIMT

SEQ ID NO: 1686786 - protein, 18 aa, Staphylococcus aureus
SIGNLLLISNDKDDRQVT

SEQ ID NO: 1686787 - protein, 23 aa, Staphylococcus aureus
SIISRYAFVTYMDQISKNINMTI

SEQ ID NO: 1686788 - protein, 17 aa, Staphylococcus aureus
SKEFNIPKSWKLIAQMP

SEQ ID NO: 1686789 - protein, 23 aa, Staphylococcus aureus
SKYSISLIIPKSDTSTIKAIEQA

SEQ ID NO: 1686790 - protein, 26 aa, Staphylococcus aureus
SNDEIYNLMIYQLGALQGFCRIHQVK

SEQ ID NO: 1686791 - protein, 20 aa, Staphylococcus aureus
SNEVAYLLKGAKVTKVYGDQ

SEQ ID NO: 1686792 - protein, 24 aa, Staphylococcus aureus
SVMPGFDFYFVPTVLNSTDVVFHN

SEQ ID NO: 1686793 - protein, 21 aa, Staphylococcus aureus
SVYTSYAYYQLCEEKGIIRSM

SEQ ID NO: 1686794 - protein, 19 aa, Staphylococcus aureus
SYPSFLEIAPEPFSNEALT

SEQ ID NO: 1686795 - protein, 26 aa, Staphylococcus aureus
TADVLLVYIFGRIEFIPDSYTRKIYN

SEQ ID NO: 1686796 - protein, 21 aa, Staphylococcus aureus
TAEFNIWVDAEAAKRVFESGI

SEQ ID NO: 1686797 - protein, 18 aa, Staphylococcus aureus
TGRKDIMLPTAKAALAVG

SEQ ID NO: 1686798 - protein, 23 aa, Staphylococcus aureus
TSVPIVPELLKSLNFNQFNLVDA

SEQ ID NO: 1686799 - protein, 17 aa, Staphylococcus aureus
VAPMFKSLIGKEISEED

SEQ ID NO: 1686800 - protein, 17 aa, Staphylococcus aureus
VAQILYKSKKPVVLAVN

SEQ ID NO: 1686801 - protein, 28 aa, Staphylococcus aureus
VDEGTYYPRTFIQQLFVDGYFGEATLRK

SEQ ID NO: 1686802 - protein, 21 aa, Staphylococcus aureus
VHTVYKMMTLFNNQSYIDDKG

SEQ ID NO: 1686803 - protein, 17 aa, Staphylococcus aureus
VIFLNESFNISENENKN

SEQ ID NO: 1686804 - protein, 28 aa, Staphylococcus aureus
VIKQKPTVRWLFLTLTVKNVYDGEELNK

SEQ ID NO: 1686805 - protein, 23 aa, Staphylococcus aureus
VKRELGFVLMALNIRKIAAQRAV

SEQ ID NO: 1686806 - protein, 21 aa, Staphylococcus aureus
VLNLFYKLHPSFEGQGYACEA

SEQ ID NO: 1686807 - protein, 18 aa, Staphylococcus aureus
VRYGTMYISMDETLARVV

SEQ ID NO: 1686808 - protein, 17 aa, Staphylococcus aureus
VSQLLFLQAQDSEKDIY

SEQ ID NO: 1686809 - protein, 29 aa, Staphylococcus aureus
VTHSKDGVKLLWASCRELFNVIQADEIGA

SEQ ID NO: 1686810 - protein, 23 aa, Staphylococcus aureus
VTTPILVKAPIAGRRILLKEVRD

SEQ ID NO: 1686811 - protein, 17 aa, Staphylococcus aureus
YHDMNGLLMSKLNNIQM

SEQ ID NO: 1686812 - protein, 18 aa, Staphylococcus aureus
YKHFLEKYFGLNVTINRI

SEQ ID NO: 1686813 - protein, 17 aa, Staphylococcus aureus
YMVMFEFKGHRIVAFKG

SEQ ID NO: 1686814 - protein, 18 aa, Staphylococcus aureus
YQWNEKLIPYWQDLAEFA

SEQ ID NO: 1686815 - protein, 19 aa, Staphylococcus aureus
YRTYFCLDNMLHGRITSNN

SEQ ID NO: 1686816 - protein, 17 aa, Staphylococcus aureus
YTADYLADKGVVPFLKV

SEQ ID NO: 1686817 - protein, 22 aa, Staphylococcus aureus
YTEMKLVFLEGLFKTLLNKNSQ

SEQ ID NO: 1686818 - protein, 26 aa, Staphylococcus aureus
YYDDPMYFIRLNFPDKVSVGDKAKSV

SEQ ID NO: 1686819 - protein, 19 aa, Staphylococcus aureus
AAHIIPIVRVTAVIDRDII

SEQ ID NO: 1686820 - protein, 23 aa, Staphylococcus aureus
AELENILIALDRLSNYAELRLSV

SEQ ID NO: 1686821 - protein, 24 aa, Staphylococcus aureus
AIDTLLEFYNLFKEKYSELKQQDT

SEQ ID NO: 1686822 - protein, 32 aa, Staphylococcus aureus
AIYEFQYAYGLPDYGIIGMQLPLTIVIIGETL

SEQ ID NO: 1686823 - protein, 25 aa, Staphylococcus aureus
ARFAGVALRFLTGPIGATITAITIA

SEQ ID NO: 1686824 - protein, 17 aa, Staphylococcus aureus
ARIAAMKGGLPETVPAF

SEQ ID NO: 1686825 - protein, 18 aa, Staphylococcus aureus
ARRLGESLQLINILRDVG

SEQ ID NO: 1686826 - protein, 26 aa, Staphylococcus aureus
DDAYYGLFYEDVYTQSLFTALTNLHS

SEQ ID NO: 1686827 - protein, 30 aa, Staphylococcus aureus
DGEAFGKFFKLMLNQGINLAPSKFEAWFLT

SEQ ID NO: 1686828 - protein, 24 aa, Staphylococcus aureus
DGSYLFDHPIWQRFGSYTGGLNFN

SEQ ID NO: 1686829 - protein, 17 aa, Staphylococcus aureus
DHSLNLKNGFYLNEFLK

SEQ ID NO: 1686830 - protein, 27 aa, Staphylococcus aureus
DMANYRYPKGFRFYRYSSGFVPEPGDI

SEQ ID NO: 1686831 - protein, 20 aa, Staphylococcus aureus
DPEYLRFYKSKTWQNMRRIV

SEQ ID NO: 1686832 - protein, 28 aa, Staphylococcus aureus
DYHDIKSPMVGTFFLQDSKELTEPIVKV

SEQ ID NO: 1686833 - protein, 19 aa, Staphylococcus aureus
EARIPFIKHMQNSGLFASI

SEQ ID NO: 1686834 - protein, 22 aa, Staphylococcus aureus
EAYKWMHPCYTLNNKNVVLIHG

SEQ ID NO: 1686835 - protein, 25 aa, Staphylococcus aureus
EEDLDPTFMWHLAFAYGQEERDKEA

SEQ ID NO: 1686836 - protein, 27 aa, Staphylococcus aureus
EFEQQIIGYLGLWIVIDQAQITTVAID

SEQ ID NO: 1686837 - protein, 26 aa, Staphylococcus aureus
EFKNNLALCVYYLEKLIKDSKDSIMI

SEQ ID NO: 1686838 - protein, 26 aa, Staphylococcus aureus
EIFEKDFDLLFVKWIPREQNKEANQH

SEQ ID NO: 1686839 - protein, 17 aa, Staphylococcus aureus
EISGWRYMLDRCETMLS

SEQ ID NO: 1686840 - protein, 22 aa, Staphylococcus aureus
ELFPVNEGILQFWISSEDQMYG

SEQ ID NO: 1686841 - protein, 24 aa, Staphylococcus aureus
ELKHQFTHLTWKIKVYAASGAINI

SEQ ID NO: 1686842 - protein, 25 aa, Staphylococcus aureus
ETKGAFPTWLAPKQVQIIPVNVDLH

SEQ ID NO: 1686843 - protein, 24 aa, Staphylococcus aureus
ETQFIVITHRKGTMEFADRLYGVT

SEQ ID NO: 1686844 - protein, 17 aa, Staphylococcus aureus
FESRSFLFKAIFNITKL

SEQ ID NO: 1686845 - protein, 24 aa, Staphylococcus aureus
FIEKYRFFDMLQASLHPYGSWQEY

SEQ ID NO: 1686846 - protein, 18 aa, Staphylococcus aureus
FIKARWNQDFRLEDFKKV

SEQ ID NO: 1686847 - protein, 27 aa, Staphylococcus aureus
FKEDRTVYLPKAYHPLLNRETVVANTI

SEQ ID NO: 1686848 - protein, 20 aa, Staphylococcus aureus
FKQDILAVKVLAQLFSKIKP

SEQ ID NO: 1686849 - protein, 18 aa, Staphylococcus aureus
FLEGLFKTLLNKNSQVVF

SEQ ID NO: 1686850 - protein, 24 aa, Staphylococcus aureus
FQGSKYLVDGSIGNLLLISNDKDD

SEQ ID NO: 1686851 - protein, 24 aa, Staphylococcus aureus
FSNYYEFLVRYKKIDTLLTENESK

SEQ ID NO: 1686852 - protein, 18 aa, Staphylococcus aureus
FTRLNFYLIDLFRQQNQL

SEQ ID NO: 1686853 - protein, 27 aa, Staphylococcus aureus
FVCNHTLYHLGYLQDKHYPHLRFGFIH

SEQ ID NO: 1686854 - protein, 17 aa, Staphylococcus aureus
FVQMVKAYDVQLIAIGN

SEQ ID NO: 1686855 - protein, 17 aa, Staphylococcus aureus
GCPKCRPAINYYLNMVY

SEQ ID NO: 1686856 - protein, 17 aa, Staphylococcus aureus
GCVFAFYGHTHVAKYEY

SEQ ID NO: 1686857 - protein, 26 aa, Staphylococcus aureus
GDGSYLFEYPIWQRFGRYTGGLNFNG

SEQ ID NO: 1686858 - protein, 21 aa, Staphylococcus aureus
GGLYDNRLLVKATKSARHQFQ

SEQ ID NO: 1686859 - protein, 19 aa, Staphylococcus aureus
GHGLLLKDFMTYNVDDWWE

SEQ ID NO: 1686860 - protein, 24 aa, Staphylococcus aureus
GHSYSHYLLIEQAINALKDAGYAF

SEQ ID NO: 1686861 - protein, 30 aa, Staphylococcus aureus
GKRFPSKNILFWYVLFMDQSQMHDDIEKLL

SEQ ID NO: 1686862 - protein, 20 aa, Staphylococcus aureus
GKSLAYLLAALMYNIETGKH

SEQ ID NO: 1686863 - protein, 25 aa, Staphylococcus aureus
GLNKPNRLYLLKPNYDIEASLTKEL

SEQ ID NO: 1686864 - protein, 25 aa, Staphylococcus aureus
GPIKLHKEFAIPVKFTIKVVLTDPY

SEQ ID NO: 1686865 - protein, 20 aa, Staphylococcus aureus
GSFVMRYLLDGRVPNLPLAI

SEQ ID NO: 1686866 - protein, 18 aa, Staphylococcus aureus
HAIQLLSIGFLGQDAIII

SEQ ID NO: 1686867 - protein, 35 aa, Staphylococcus aureus
HFKEVFSLYKLDRKFRNVLLEYLLVFETHIKSRIS

SEQ ID NO: 1686868 - protein, 27 aa, Staphylococcus aureus
HGGIPDTGFYRFWTQGIFARWTDNPNI

SEQ ID NO: 1686869 - protein, 17 aa, Staphylococcus aureus
HTALVNGGVFVYVPKNV

SEQ ID NO: 1686870 - protein, 25 aa, Staphylococcus aureus
HYSNLRQYINISPYPATANLLEGVT

SEQ ID NO: 1686871 - protein, 17 aa, Staphylococcus aureus
IAIPDWFWSYQMAMTLN

SEQ ID NO: 1686872 - protein, 25 aa, Staphylococcus aureus
IAREDLFITSKLYFEDFGRENVAAA

SEQ ID NO: 1686873 - protein, 26 aa, Staphylococcus aureus
IDAIKKYILTLKIEIIIFCIHITEDA

SEQ ID NO: 1686874 - protein, 26 aa, Staphylococcus aureus
IDEPYFDLKWLLNQSEYKLFYSGIDN

SEQ ID NO: 1686875 - protein, 17 aa, Staphylococcus aureus
IDKVCVMVNPDLTTIEH

SEQ ID NO: 1686876 - protein, 19 aa, Staphylococcus aureus
IEENKYVFVLKHSETCPIS

SEQ ID NO: 1686877 - protein, 22 aa, Staphylococcus aureus
IGKAFARRLQGFNTKILYHNRS

SEQ ID NO: 1686878 - protein, 25 aa, Staphylococcus aureus
IGNLKDAIVLFDRSQYQASWTDYMH

SEQ ID NO: 1686879 - protein, 21 aa, Staphylococcus aureus
IHEWLMLKQFSKYKSAPSLPI

SEQ ID NO: 1686880 - protein, 25 aa, Staphylococcus aureus
IIFNNNPLMKWYINNVQLKLDRNGN

SEQ ID NO: 1686881 - protein, 25 aa, Staphylococcus aureus
IKGESKFDILLFSSIGVIDGDYLAG

SEQ ID NO: 1686882 - protein, 28 aa, Staphylococcus aureus
ILSGTGMYSLWKGLPTVKVLQLITKIYG

SEQ ID NO: 1686883 - protein, 17 aa, Staphylococcus aureus
IMKHSPTALRFLKAAMN

SEQ ID NO: 1686884 - protein, 19 aa, Staphylococcus aureus
IPYKQYCKHEFVLSGVRQK

SEQ ID NO: 1686885 - protein, 20 aa, Staphylococcus aureus
IQNRIIPRILKRTNLIGQSQ

SEQ ID NO: 1686886 - protein, 28 aa, Staphylococcus aureus
ISSFVYKRRLPFHAKRFNDWLESMSNNV

SEQ ID NO: 1686887 - protein, 23 aa, Staphylococcus aureus
IVATYDIPRFDKSPYDGFAIRSV

SEQ ID NO: 1686888 - protein, 23 aa, Staphylococcus aureus
IVVPDYMDIYDFTPIQYPADDQN

SEQ ID NO: 1686889 - protein, 25 aa, Staphylococcus aureus
KAIYKRDYLCILGETVKEKLTHELQ

SEQ ID NO: 1686890 - protein, 25 aa, Staphylococcus aureus
KDDTNKLFNFTPYNSKKIYTRSITN

SEQ ID NO: 1686891 - protein, 18 aa, Staphylococcus aureus
KEIENFKFFVQYGDFKDI

SEQ ID NO: 1686892 - protein, 20 aa, Staphylococcus aureus
KLIQPIMQLFIDNAILNIVQ

SEQ ID NO: 1686893 - protein, 17 aa, Staphylococcus aureus
KLRALKPGEALVQTEYC

SEQ ID NO: 1686894 - protein, 25 aa, Staphylococcus aureus
KNNKKTIMLYLSSDWFAELGFTFFN

SEQ ID NO: 1686895 - protein, 18 aa, Staphylococcus aureus
KSAILFASLFSNDTTVIK

SEQ ID NO: 1686896 - protein, 18 aa, Staphylococcus aureus
KSFPFEITELPKDTKYLA

SEQ ID NO: 1686897 - protein, 17 aa, Staphylococcus aureus
KTRKLLEALILVGAFDA

SEQ ID NO: 1686898 - protein, 18 aa, Staphylococcus aureus
KVNDLEYPLFFMVTKNLS

SEQ ID NO: 1686899 - protein, 26 aa, Staphylococcus aureus
KVQDYNEWLIKQPGYTTNFLNIDDGL

SEQ ID NO: 1686900 - protein, 29 aa, Staphylococcus aureus
KWKEKVHIIRWFLAYKKVPKILVDKIIAI

SEQ ID NO: 1686901 - protein, 26 aa, Staphylococcus aureus
KYIDWFKSHPLFARAIYPLASYYFEN

SEQ ID NO: 1686902 - protein, 24 aa, Staphylococcus aureus
KYIDWIKYHLFYNKFVPLDYLSIK

SEQ ID NO: 1686903 - protein, 25 aa, Staphylococcus aureus
KYRGFAIRREVLEELGFDFSNSYNP

SEQ ID NO: 1686904 - protein, 21 aa, Staphylococcus aureus
KYVSVKFGWEDGHIYGYTIND

SEQ ID NO: 1686905 - protein, 30 aa, Staphylococcus aureus
LEDIMIPNYRKHWHVIFELSNDKKLIYSDI

SEQ ID NO: 1686906 - protein, 22 aa, Staphylococcus aureus
LERHMWYIVRDVLDNIFDQLVL

SEQ ID NO: 1686907 - protein, 24 aa, Staphylococcus aureus
LGLAHGVLGPMSLFALCVIKGITI

SEQ ID NO: 1686908 - protein, 18 aa, Staphylococcus aureus
LIEQPDLLLLDEPTNHLD

SEQ ID NO: 1686909 - protein, 20 aa, Staphylococcus aureus
LKMFVYDYDTHLIKNVMVAA

SEQ ID NO: 1686910 - protein, 27 aa, Staphylococcus aureus
LKQGYNVIMDIPLLFENELENTVDEVW

SEQ ID NO: 1686911 - protein, 25 aa, Staphylococcus aureus
LMITHYQRLLNYITPDKVHVMYAGK

SEQ ID NO: 1686912 - protein, 25 aa, Staphylococcus aureus
LNADQLVMLKLTIPTEPNLYKELAE

SEQ ID NO: 1686913 - protein, 23 aa, Staphylococcus aureus
LNVQAVCYDPWNAQSFITTIESM

SEQ ID NO: 1686914 - protein, 21 aa, Staphylococcus aureus
LRQWFQHDPKLFGAFKEKYEK

SEQ ID NO: 1686915 - protein, 27 aa, Staphylococcus aureus
LRSLVTTEFIWSVPGHFDIYGPQILIQ

SEQ ID NO: 1686916 - protein, 25 aa, Staphylococcus aureus
LTEHHIRILDLPLATGLVAEVGQGL

SEQ ID NO: 1686917 - protein, 17 aa, Staphylococcus aureus
LTSLFLTANNIPNNLSS

SEQ ID NO: 1686918 - protein, 25 aa, Staphylococcus aureus
MIFSKNLFRRPAPARLTRIEKSLLQ

SEQ ID NO: 1686919 - protein, 19 aa, Staphylococcus aureus
MRSFIGNSDREHLILICMN

SEQ ID NO: 1686920 - protein, 18 aa, Staphylococcus aureus
NATPSARRYARENGVNLA

SEQ ID NO: 1686921 - protein, 24 aa, Staphylococcus aureus
NDYLDKILPEAYALVREGSKRVFN

SEQ ID NO: 1686922 - protein, 21 aa, Staphylococcus aureus
NEIAPYKRPLSNMAPTIVMYH

SEQ ID NO: 1686923 - protein, 21 aa, Staphylococcus aureus
NGKIVPIDYILQTGDIVEIRT

SEQ ID NO: 1686924 - protein, 17 aa, Staphylococcus aureus
NHAHFTFIGDGPTLNDC

SEQ ID NO: 1686925 - protein, 21 aa, Staphylococcus aureus
NHTFYRVNIPTINVLNPVGSG

SEQ ID NO: 1686926 - protein, 18 aa, Staphylococcus aureus
NMFGYTGTYKGKEVSVMG

SEQ ID NO: 1686927 - protein, 22 aa, Staphylococcus aureus
NNATFPAYHRPTSPDYTVGTEP

SEQ ID NO: 1686928 - protein, 26 aa, Staphylococcus aureus
NNCRLDNETFIYLITGPNMSGKSTYM

SEQ ID NO: 1686929 - protein, 23 aa, Staphylococcus aureus
NNISLYFTAITLTDSISLKLKGK

SEQ ID NO: 1686930 - protein, 26 aa, Staphylococcus aureus
NTHNGVPLWILVNYLTLGNVSKMYSN

SEQ ID NO: 1686931 - protein, 22 aa, Staphylococcus aureus
NTTPEAIRYIKPADFHVPGDIS

SEQ ID NO: 1686932 - protein, 25 aa, Staphylococcus aureus
PEGPITMTLIREMRLMWKEMMAILQ

SEQ ID NO: 1686933 - protein, 22 aa, Staphylococcus aureus
PFFICQILAFLFPKFPHINLLL

SEQ ID NO: 1686934 - protein, 24 aa, Staphylococcus aureus
PKTIRTLITRLYKKGFIDRKKDNK

SEQ ID NO: 1686935 - protein, 17 aa, Staphylococcus aureus
QADPSLFIEKYQRFTLD

SEQ ID NO: 1686936 - protein, 29 aa, Staphylococcus aureus
QFKCHIDTIIKKQVPVCCFTFGIPNESII

SEQ ID NO: 1686937 - protein, 18 aa, Staphylococcus aureus
QGFDIEHLANIKSLVNIP

SEQ ID NO: 1686938 - protein, 33 aa, Staphylococcus aureus
QGIAKMFDLMLPKKNIRMPLSKMNMFGLGNMMM

SEQ ID NO: 1686939 - protein, 26 aa, Staphylococcus aureus
QLCTTYKMVLDFYIELSSNTVKGRYV

SEQ ID NO: 1686940 - protein, 20 aa, Staphylococcus aureus
QLEVPIPAIISAFEIAKAHG

SEQ ID NO: 1686941 - protein, 21 aa, Staphylococcus aureus
QQLMSQLGLTSLLNKLPSEIS

SEQ ID NO: 1686942 - protein, 21 aa, Staphylococcus aureus
QRVAIARALVTNPKILLCDEA

SEQ ID NO: 1686943 - protein, 28 aa, Staphylococcus aureus
QSGVDHFKIVPLLIFSAMHYLKDIPNIV

SEQ ID NO: 1686944 - protein, 22 aa, Staphylococcus aureus
QTKKPVIIYFYGGSFENGHGTA

SEQ ID NO: 1686945 - protein, 20 aa, Staphylococcus aureus
RDNYIEVMTIEQIKQAWMQS

SEQ ID NO: 1686946 - protein, 25 aa, Staphylococcus aureus
RGRRANLYGLFNKAIEFENSSFRGL

SEQ ID NO: 1686947 - protein, 25 aa, Staphylococcus aureus
RHLDDKASVAMILQLLKKLKEEQII

SEQ ID NO: 1686948 - protein, 19 aa, Staphylococcus aureus
RLITNKAAYFKKSQLIEQF

SEQ ID NO: 1686949 - protein, 31 aa, Staphylococcus aureus
RQKVSMIFQHFNLLWSRTVLKNIMFPLEIAG

SEQ ID NO: 1686950 - protein, 23 aa, Staphylococcus aureus
SDLRKIKHSYLKKSFLEIVETLK

SEQ ID NO: 1686951 - protein, 17 aa, Staphylococcus aureus
SFENILDIYFKTFDPTD

SEQ ID NO: 1686952 - protein, 17 aa, Staphylococcus aureus
SILTSLFLTANNIPNNL

SEQ ID NO: 1686953 - protein, 17 aa, Staphylococcus aureus
SIVSRWIKKLVLKGYIT

SEQ ID NO: 1686954 - protein, 17 aa, Staphylococcus aureus
SKVYIRKKDKKLLDWQL

SEQ ID NO: 1686955 - protein, 30 aa, Staphylococcus aureus
SLNAGGKRIRPVLLLLTLDSLNTEYELGMK

SEQ ID NO: 1686956 - protein, 24 aa, Staphylococcus aureus
SLQRLMGIIISENLIECVKAAADD

SEQ ID NO: 1686957 - protein, 21 aa, Staphylococcus aureus
SMASFLNSFPMFKDDTRNTHP

SEQ ID NO: 1686958 - protein, 21 aa, Staphylococcus aureus
SMSVTLLSKLAFNYLTQKFNL

SEQ ID NO: 1686959 - protein, 17 aa, Staphylococcus aureus
SPELLRYRYKHKMRGDE

SEQ ID NO: 1686960 - protein, 30 aa, Staphylococcus aureus
SQCWDTPNFIFKRYWGFVTWGNAKDMANYR

SEQ ID NO: 1686961 - protein, 36 aa, Staphylococcus aureus
SQPTLPVFKQMYALYFKFVMPIFGKLFAKSKEEYEW

SEQ ID NO: 1686962 - protein, 23 aa, Staphylococcus aureus
SQTPDLTMAYPVYINAMTGGSEW

SEQ ID NO: 1686963 - protein, 22 aa, Staphylococcus aureus
TDTLAWVYVPDTLSSIALDAYE

SEQ ID NO: 1686964 - protein, 17 aa, Staphylococcus aureus
TFLAKRLAYSLIGSKCK

SEQ ID NO: 1686965 - protein, 25 aa, Staphylococcus aureus
TGERKLYRVWFCKSRLCPMCNWRRA

SEQ ID NO: 1686966 - protein, 18 aa, Staphylococcus aureus
TGLPKAYYRDEDSWLASF

SEQ ID NO: 1686967 - protein, 26 aa, Staphylococcus aureus
TILKKISWQIAKGDKWILYGLNGAGK

SEQ ID NO: 1686968 - protein, 22 aa, Staphylococcus aureus
TKIATVCKFDLPKLAQMKPKDT

SEQ ID NO: 1686969 - protein, 19 aa, Staphylococcus aureus
TNCQILIQNKYLTGEVLDD

SEQ ID NO: 1686970 - protein, 18 aa, Staphylococcus aureus
TNGEPWFPVNLNYKTINV

SEQ ID NO: 1686971 - protein, 27 aa, Staphylococcus aureus
VFDAYHTDYFKPYNPAFRKASMEDGLH

SEQ ID NO: 1686972 - protein, 22 aa, Staphylococcus aureus
VGEKKLQLMPLDNLKNVTGYIR

SEQ ID NO: 1686973 - protein, 23 aa, Staphylococcus aureus
VKSAILFASLFSKEPTIIKELDV

SEQ ID NO: 1686974 - protein, 17 aa, Staphylococcus aureus
VLARRRLIKFDKDISIP

SEQ ID NO: 1686975 - protein, 22 aa, Staphylococcus aureus
VNDWEKLPLFQSQLELPVEIQH

SEQ ID NO: 1686976 - protein, 17 aa, Staphylococcus aureus
VPRRRAKQKALELVELV

SEQ ID NO: 1686977 - protein, 27 aa, Staphylococcus aureus
VTVKGKAPNTLYIEKRNLMKQKLEMLG

SEQ ID NO: 1686978 - protein, 17 aa, Staphylococcus aureus
VYAFLDISQVTKGHTLL

SEQ ID NO: 1686979 - protein, 23 aa, Staphylococcus aureus
WKDNSIIGFVMRPLINYDAIKNE

SEQ ID NO: 1686980 - protein, 21 aa, Staphylococcus aureus
YDLIQLSYRLLPEVSLDCIID

SEQ ID NO: 1686981 - protein, 17 aa, Staphylococcus aureus
YEYILTVAKAGMTEKEL

SEQ ID NO: 1686982 - protein, 20 aa, Staphylococcus aureus
YLFEAVYGAGIIRMYELNTH

SEQ ID NO: 1686983 - protein, 17 aa, Staphylococcus aureus
YLKHLKTVFPERQYITN

SEQ ID NO: 1686984 - protein, 24 aa, Staphylococcus aureus
YLRSLAHNIDPIFQIGKGGINENM

SEQ ID NO: 1686985 - protein, 22 aa, Staphylococcus aureus
AEVKDYVFINNHDPRLFEGFSM

SEQ ID NO: 1686986 - protein, 23 aa, Staphylococcus aureus
AIKELICQFKYLSAFEKDVMYLM

SEQ ID NO: 1686987 - protein, 18 aa, Staphylococcus aureus
AKFLMRYIEDVDKAHYDA

SEQ ID NO: 1686988 - protein, 23 aa, Staphylococcus aureus
AKYSISLIIPKSDTSTIKAIEQA

SEQ ID NO: 1686989 - protein, 23 aa, Staphylococcus aureus
ALHAPYGMRLAEYKEIVLSKIME

SEQ ID NO: 1686990 - protein, 17 aa, Staphylococcus aureus
DAASQGLGILLKEQGHD

SEQ ID NO: 1686991 - protein, 18 aa, Staphylococcus aureus
DALVLRYLTPHGKWNIHS

SEQ ID NO: 1686992 - protein, 20 aa, Staphylococcus aureus
DAVNVSFPGFLPKLKLLENE

SEQ ID NO: 1686993 - protein, 23 aa, Staphylococcus aureus
DAYLKVAYQFSLPFGKDYADAHE

SEQ ID NO: 1686994 - protein, 26 aa, Staphylococcus aureus
DDAYYGLFYEDVYTQSLFTALSNLNS

SEQ ID NO: 1686995 - protein, 32 aa, Staphylococcus aureus
DENNNKLYMIELLEPLPFLEKISKLTTVKSIK

SEQ ID NO: 1686996 - protein, 26 aa, Staphylococcus aureus
DEQGIDYLPFQYLADYIRSLKYDGIM

SEQ ID NO: 1686997 - protein, 17 aa, Staphylococcus aureus
DEVYKMIKQRMVDAFIL

SEQ ID NO: 1686998 - protein, 25 aa, Staphylococcus aureus
DFETFKIALFDPAVKKYAFNANFER

SEQ ID NO: 1686999 - protein, 32 aa, Staphylococcus aureus
DGFHNFSTIEYLIIKGLIKYAKSVTIILTTDG

SEQ ID NO: 1687000 - protein, 17 aa, Staphylococcus aureus
DGTLIEFDRSWEKIGVR

SEQ ID NO: 1687001 - protein, 19 aa, Staphylococcus aureus
DIFHSVLKYISERINGDFK

SEQ ID NO: 1687002 - protein, 17 aa, Staphylococcus aureus
DILCPFHYFGVTDYVHQ

SEQ ID NO: 1687003 - protein, 23 aa, Staphylococcus aureus
DLDYRLIVLNHAPNLRTFLHRYD

SEQ ID NO: 1687004 - protein, 25 aa, Staphylococcus aureus
EDTELNLFSFVRRLSDIPLGGIIYT

SEQ ID NO: 1687005 - protein, 20 aa, Staphylococcus aureus
EEDIELFKDIADKVKQTNSY

SEQ ID NO: 1687006 - protein, 24 aa, Staphylococcus aureus
EGYPIVLIHTVLDNYSVFNKLAAE

SEQ ID NO: 1687007 - protein, 18 aa, Staphylococcus aureus
EILFLGEDLAKKPENELI

SEQ ID NO: 1687008 - protein, 17 aa, Staphylococcus aureus
EILGDFKAPMGCRSFLP

SEQ ID NO: 1687009 - protein, 19 aa, Staphylococcus aureus
ELDTLWQLRNLFTDSTDFT

SEQ ID NO: 1687010 - protein, 25 aa, Staphylococcus aureus
ELPFDNRFLFKSFILKRETGNIVIY

SEQ ID NO: 1687011 - protein, 17 aa, Staphylococcus aureus
ENISFDIYKGETLGLVG

SEQ ID NO: 1687012 - protein, 17 aa, Staphylococcus aureus
ENQKYMFDYSACKYPIG

SEQ ID NO: 1687013 - protein, 23 aa, Staphylococcus aureus
EQPDIILLDLGLPDIDGLSLIQQ

SEQ ID NO: 1687014 - protein, 18 aa, Staphylococcus aureus
EQSVRLWYETLLDKIVEV

SEQ ID NO: 1687015 - protein, 21 aa, Staphylococcus aureus
ERKRRLRPWLYDGTPQKHSRD

SEQ ID NO: 1687016 - protein, 27 aa, Staphylococcus aureus
ERLADSEVLVCTVIGFPLGASTTATKV

SEQ ID NO: 1687017 - protein, 27 aa, Staphylococcus aureus
ERLADSGVLVCTVIGFPLGASTTATKA

SEQ ID NO: 1687018 - protein, 20 aa, Staphylococcus aureus
ETGKEDFYFIKLNQFNDDTV

SEQ ID NO: 1687019 - protein, 27 aa, Staphylococcus aureus
ETYSKALLGLVIPLVTKYGIALEAHLQ

SEQ ID NO: 1687020 - protein, 18 aa, Staphylococcus aureus
EYALKLVHNGLFNILAEL

SEQ ID NO: 1687021 - protein, 27 aa, Staphylococcus aureus
FDEANRFYVLELIKKVLKSKFNQIFIF

SEQ ID NO: 1687022 - protein, 17 aa, Staphylococcus aureus
FKLALPYLMTAAELDKD

SEQ ID NO: 1687023 - protein, 17 aa, Staphylococcus aureus
FNDMLNALPKQLTKRKI

SEQ ID NO: 1687024 - protein, 18 aa, Staphylococcus aureus
FNITKLLHIKRSKTILFT

SEQ ID NO: 1687025 - protein, 20 aa, Staphylococcus aureus
FVSFLNFYYKKYNDEELRVA

SEQ ID NO: 1687026 - protein, 32 aa, Staphylococcus aureus
GAKQVRKKFPDALFIFLAPPSLEHLRERLVGR

SEQ ID NO: 1687027 - protein, 24 aa, Staphylococcus aureus
GDAHVDYLVTWNIPEGITMDQYLA

SEQ ID NO: 1687028 - protein, 33 aa, Staphylococcus aureus
GEVQGVAQLLFKKVPKLPYTLCYISRGFVVDYS

SEQ ID NO: 1687029 - protein, 29 aa, Staphylococcus aureus
GGHQWKDWKPLLSDILLYFLSKNTDDQLY

SEQ ID NO: 1687030 - protein, 42 aa, Staphylococcus aureus
GHTPGTTLFLWDDGHHRYLFTGDFICFEGKRWRTVILGSSDR

SEQ ID NO: 1687031 - protein, 19 aa, Staphylococcus aureus
GNVPIFINIGEWDGDDEEL

SEQ ID NO: 1687032 - protein, 20 aa, Staphylococcus aureus
GVEAFFATIPGIIHTEAGRA

SEQ ID NO: 1687033 - protein, 19 aa, Staphylococcus aureus
HAIQLLSIGFLGQDAIIIS

SEQ ID NO: 1687034 - protein, 24 aa, Staphylococcus aureus
HAPNLRTFLHRYDLYETKYWSVFD

SEQ ID NO: 1687035 - protein, 22 aa, Staphylococcus aureus
HFEIPYKQYCKHEFVLSGVRQK

SEQ ID NO: 1687036 - protein, 18 aa, Staphylococcus aureus
HFVKSWLLDARAPKVELP

SEQ ID NO: 1687037 - protein, 17 aa, Staphylococcus aureus
HIDAYLKVAYQFSLPFG

SEQ ID NO: 1687038 - protein, 17 aa, Staphylococcus aureus
HPFNQMRLKLTTELLLN

SEQ ID NO: 1687039 - protein, 18 aa, Staphylococcus aureus
HVKYAAERLADSGVLVCT

SEQ ID NO: 1687040 - protein, 28 aa, Staphylococcus aureus
HYNVNNLLNMPFGACHFAVAAKPETTNY

SEQ ID NO: 1687041 - protein, 21 aa, Staphylococcus aureus
IAYAQYLATRKVYPTQSIGVI

SEQ ID NO: 1687042 - protein, 23 aa, Staphylococcus aureus
IDTPIKIILLNIEPTQITTILDE

SEQ ID NO: 1687043 - protein, 24 aa, Staphylococcus aureus
IFEKDFDLLFVKWIPREQNKEANQ

SEQ ID NO: 1687044 - protein, 24 aa, Staphylococcus aureus
IGEMLTFLKYFDAPQPFKIMASHY

SEQ ID NO: 1687045 - protein, 18 aa, Staphylococcus aureus
IGHTFDLAYLLDSTKSYK

SEQ ID NO: 1687046 - protein, 17 aa, Staphylococcus aureus
IGYVEAMKVLNEVTTDV

SEQ ID NO: 1687047 - protein, 22 aa, Staphylococcus aureus
IIIDAIGQLIGMRASSDFVRHG

SEQ ID NO: 1687048 - protein, 17 aa, Staphylococcus aureus
IKKGEILFLGEDLAKKP

SEQ ID NO: 1687049 - protein, 22 aa, Staphylococcus aureus
IKSKYDIDFITGHSLGGRDAVV

SEQ ID NO: 1687050 - protein, 25 aa, Staphylococcus aureus
INLTDKWIIQIAYGKLIIMAKNNGD

SEQ ID NO: 1687051 - protein, 26 aa, Staphylococcus aureus
INSIRRVFEEFLSFKLKNSDLAQKSN

SEQ ID NO: 1687052 - protein, 24 aa, Staphylococcus aureus
IPSFEVIDWLRNGLELHNVEESIC

SEQ ID NO: 1687053 - protein, 23 aa, Staphylococcus aureus
IQLKHSISEIPNIKALLNSMNQD

SEQ ID NO: 1687054 - protein, 27 aa, Staphylococcus aureus
ITNHDDYFLLLLIKENKIIGLSGMCKM

SEQ ID NO: 1687055 - protein, 17 aa, Staphylococcus aureus
IVATYDIPRFDKSPYDG

SEQ ID NO: 1687056 - protein, 18 aa, Staphylococcus aureus
IVPDLIRLSKTFLIESRE

SEQ ID NO: 1687057 - protein, 21 aa, Staphylococcus aureus
KDDFLSYLKDLKFTGSIRSMQ

SEQ ID NO: 1687058 - protein, 28 aa, Staphylococcus aureus
KFADIKTYIFYHLFDTYIIDYSMASATG

SEQ ID NO: 1687059 - protein, 24 aa, Staphylococcus aureus
KFCENIISVPLPPIFKYTLALTND

SEQ ID NO: 1687060 - protein, 20 aa, Staphylococcus aureus
KHDINGNVPIFINIGEWDGD

SEQ ID NO: 1687061 - protein, 20 aa, Staphylococcus aureus
KIKVYVGNYDFWYQSSQLAQ

SEQ ID NO: 1687062 - protein, 18 aa, Staphylococcus aureus
KILFVAATAPFTPFYRAL

SEQ ID NO: 1687063 - protein, 27 aa, Staphylococcus aureus
KIVKLKIHNLVVKILLPISDLHIKEKL

SEQ ID NO: 1687064 - protein, 17 aa, Staphylococcus aureus
KKIMKKYNIPTADYKEV

SEQ ID NO: 1687065 - protein, 22 aa, Staphylococcus aureus
KLKNEIIRKYDLKPSIISNSIK

SEQ ID NO: 1687066 - protein, 24 aa, Staphylococcus aureus
KLNLELRIPIIIISGNHDGKERLN

SEQ ID NO: 1687067 - protein, 24 aa, Staphylococcus aureus
KNGKQYIRWETINKYLGKYLSQEV

SEQ ID NO: 1687068 - protein, 26 aa, Staphylococcus aureus
KNVDTPLYLFPTKSYIKKEPYGTVLI

SEQ ID NO: 1687069 - protein, 19 aa, Staphylococcus aureus
KRLIAFEGLSLKDFASEIE

SEQ ID NO: 1687070 - protein, 17 aa, Staphylococcus aureus
KRYYKSYSRGTVVYVKL

SEQ ID NO: 1687071 - protein, 22 aa, Staphylococcus aureus
KTPYKKLFQEIYELSRKSQKDI

SEQ ID NO: 1687072 - protein, 33 aa, Staphylococcus aureus
KVIRPVYLNQSTIPTFYIVNVGGGYLDGDRYRM

SEQ ID NO: 1687073 - protein, 23 aa, Staphylococcus aureus
KVLIMMPRSIATYELYIAALKLG

SEQ ID NO: 1687074 - protein, 26 aa, Staphylococcus aureus
KVMQDSFKLLVTYRTKLQGGYGQFTN

SEQ ID NO: 1687075 - protein, 18 aa, Staphylococcus aureus
KYDNLYKFFKENEKKYQY

SEQ ID NO: 1687076 - protein, 17 aa, Staphylococcus aureus
LAQDLSNRLIQMRKRRG

SEQ ID NO: 1687077 - protein, 29 aa, Staphylococcus aureus
LDIDFKVEPPWFKVSPTHFVKSWLLDARA

SEQ ID NO: 1687078 - protein, 23 aa, Staphylococcus aureus
LGAKRVMPLAVSGPFHSSLMKVI

SEQ ID NO: 1687079 - protein, 18 aa, Staphylococcus aureus
LIQLLTDLSKVFITAAYD

SEQ ID NO: 1687080 - protein, 19 aa, Staphylococcus aureus
LLAQDYYYKDQKHLTFDER

SEQ ID NO: 1687081 - protein, 19 aa, Staphylococcus aureus
LPHPINMVRVRLFGVKLKE

SEQ ID NO: 1687082 - protein, 23 aa, Staphylococcus aureus
LQDRRKAFQFAYLSLMQEEKIQA

SEQ ID NO: 1687083 - protein, 18 aa, Staphylococcus aureus
LQVCHQDILAIENHYQDI

SEQ ID NO: 1687084 - protein, 17 aa, Staphylococcus aureus
LRTIMTFLGVPSYETII

SEQ ID NO: 1687085 - protein, 22 aa, Staphylococcus aureus
LSQIIKFHGPLNALINYDYVHT

SEQ ID NO: 1687086 - protein, 18 aa, Staphylococcus aureus
MDLPNGIHSLGYTNVPVK

SEQ ID NO: 1687087 - protein, 17 aa, Staphylococcus aureus
MIANLLIEKSLDVISTK

SEQ ID NO: 1687088 - protein, 20 aa, Staphylococcus aureus
NAYRYIDGELWIYSAVLDSN

SEQ ID NO: 1687089 - protein, 19 aa, Staphylococcus aureus
NFISLKHGFISDNLNITEF

SEQ ID NO: 1687090 - protein, 30 aa, Staphylococcus aureus
NINKLVPIYINPKTILFPLKHKRAPIQIYI

SEQ ID NO: 1687091 - protein, 25 aa, Staphylococcus aureus
NKKNELIYQFNPKAQIYGFIVGSDL

SEQ ID NO: 1687092 - protein, 27 aa, Staphylococcus aureus
NLDGVWLGDLILIKRGLSDREKAGILF

SEQ ID NO: 1687093 - protein, 18 aa, Staphylococcus aureus
NLGPLDDIMKMIPGMNKM

SEQ ID NO: 1687094 - protein, 17 aa, Staphylococcus aureus
NLPPTLFKNEKARKSIL

SEQ ID NO: 1687095 - protein, 19 aa, Staphylococcus aureus
NMVRVRLFGVKLKEIIAKS

SEQ ID NO: 1687096 - protein, 20 aa, Staphylococcus aureus
NNGGVVLRWLRDELLASEVE

SEQ ID NO: 1687097 - protein, 24 aa, Staphylococcus aureus
NNLDLPYVYIPTKKGEEILKKTEY

SEQ ID NO: 1687098 - protein, 24 aa, Staphylococcus aureus
NVDTPLYLFPTKSYIKKEPYGTVL

SEQ ID NO: 1687099 - protein, 19 aa, Staphylococcus aureus
NVTIPAIEAIVPQKDPNAN

SEQ ID NO: 1687100 - protein, 23 aa, Staphylococcus aureus
PCLRYHQTFYTMTGKPFDSSDIV

SEQ ID NO: 1687101 - protein, 17 aa, Staphylococcus aureus
PMHPWRRSTTVPHLGNW

SEQ ID NO: 1687102 - protein, 22 aa, Staphylococcus aureus
PTARDLKLPEHHSYIISYNGSK

SEQ ID NO: 1687103 - protein, 18 aa, Staphylococcus aureus
PTQMLISAKIFGKTAHAS

SEQ ID NO: 1687104 - protein, 22 aa, Staphylococcus aureus
QDGIICYIQFQMKYLADKFDDV

SEQ ID NO: 1687105 - protein, 19 aa, Staphylococcus aureus
QEAARKLNFKARKTMMVAQ

SEQ ID NO: 1687106 - protein, 28 aa, Staphylococcus aureus
QFLAVAIRPMIHMLYYHGIAFESHAQNM

SEQ ID NO: 1687107 - protein, 21 aa, Staphylococcus aureus
QGEGRVIGRKTMFVRTAGCDY

SEQ ID NO: 1687108 - protein, 28 aa, Staphylococcus aureus
QHNNPFHMSPYFGYAARLLATSGIDYTY

SEQ ID NO: 1687109 - protein, 17 aa, Staphylococcus aureus
QQCVWNELRQVPYGTLT

SEQ ID NO: 1687110 - protein, 26 aa, Staphylococcus aureus
QSTSKLYDFSPWKNRSFWGVINNTLE

SEQ ID NO: 1687111 - protein, 22 aa, Staphylococcus aureus
QTHIEIIYLKSCDLTTILHNLY

SEQ ID NO: 1687112 - protein, 25 aa, Staphylococcus aureus
QVANDKEFYIFDSLIQGRSFKDISN

SEQ ID NO: 1687113 - protein, 20 aa, Staphylococcus aureus
QWVRSFKLRGAYNAISVLSD

SEQ ID NO: 1687114 - protein, 24 aa, Staphylococcus aureus
RAHSIYLYEYYWSEAYKNYKEGYL

SEQ ID NO: 1687115 - protein, 29 aa, Staphylococcus aureus
READVILYDRLVNPLILQYANLTTEIIDV

SEQ ID NO: 1687116 - protein, 18 aa, Staphylococcus aureus
RHKNCVFLVDTFHTLKSG

SEQ ID NO: 1687117 - protein, 25 aa, Staphylococcus aureus
RLADSEVLVCTVIGFPLGASTTATK

SEQ ID NO: 1687118 - protein, 17 aa, Staphylococcus aureus
RNFGGFKSYRLLRPAKG

SEQ ID NO: 1687119 - protein, 20 aa, Staphylococcus aureus
RPVHLHLPIDVAISEIEIPT

SEQ ID NO: 1687120 - protein, 25 aa, Staphylococcus aureus
RQTISLIERNNFMPSVLTAIKIARI

SEQ ID NO: 1687121 - protein, 20 aa, Staphylococcus aureus
RSVVEKLITLGKKGDLASRR

SEQ ID NO: 1687122 - protein, 29 aa, Staphylococcus aureus
RVTFNEYGTKWYTYYDGDYNNFIMVSYIK

SEQ ID NO: 1687123 - protein, 18 aa, Staphylococcus aureus
SDWFAELGFTFFNYHYTA

SEQ ID NO: 1687124 - protein, 29 aa, Staphylococcus aureus
SEGEKNLIAFLFFYFELFEDEKQETIKSN

SEQ ID NO: 1687125 - protein, 20 aa, Staphylococcus aureus
SFDFEMLRQMLGKHFISQDI

SEQ ID NO: 1687126 - protein, 29 aa, Staphylococcus aureus
SFNSTNDLLTWLQDPFIKDMPGKRVNISD

SEQ ID NO: 1687127 - protein, 26 aa, Staphylococcus aureus
SHFEFTKLTLPLLKNADIYFDNEELS

SEQ ID NO: 1687128 - protein, 21 aa, Staphylococcus aureus
SREYLALGLQSIWDENKRFLN

SEQ ID NO: 1687129 - protein, 19 aa, Staphylococcus aureus
SRNLRYNEIAFKKFDSHLL

SEQ ID NO: 1687130 - protein, 26 aa, Staphylococcus aureus
SYHPKMMLKIILYAYTQSVFSGRRIE

SEQ ID NO: 1687131 - protein, 17 aa, Staphylococcus aureus
TEEKLELAKKVIISHRY

SEQ ID NO: 1687132 - protein, 20 aa, Staphylococcus aureus
TSVPIVPELLQSLNFNQFNL

SEQ ID NO: 1687133 - protein, 17 aa, Staphylococcus aureus
TTIFIDEGWAFSASRQG

SEQ ID NO: 1687134 - protein, 29 aa, Staphylococcus aureus
TVSHDRYFLNKVAQSYWFIHDGQMEKIIG

SEQ ID NO: 1687135 - protein, 29 aa, Staphylococcus aureus
VAALQHALDVWLLGKLQFAEFEDFPSVDT

SEQ ID NO: 1687136 - protein, 18 aa, Staphylococcus aureus
VAPMFKSLIGKEISEEDA

SEQ ID NO: 1687137 - protein, 23 aa, Staphylococcus aureus
VEFGEHYARLRPKKLKANIEYTT

SEQ ID NO: 1687138 - protein, 24 aa, Staphylococcus aureus
VGFLNHMLTLFTFHSGLSLNIEAQ

SEQ ID NO: 1687139 - protein, 22 aa, Staphylococcus aureus
VGFNMQLDEYLEASKNGKTWLA

SEQ ID NO: 1687140 - protein, 21 aa, Staphylococcus aureus
VIMFTICMDVIDSAFAPGVSA

SEQ ID NO: 1687141 - protein, 22 aa, Staphylococcus aureus
VKAGAMSLVPLLKSNTPFANTK

SEQ ID NO: 1687142 - protein, 30 aa, Staphylococcus aureus
VKEAIGVSGLITPWNFPTNQTSLKLAAAFA

SEQ ID NO: 1687143 - protein, 26 aa, Staphylococcus aureus
VKPAKKFLYLVIEKLMSLITDSIICV

SEQ ID NO: 1687144 - protein, 23 aa, Staphylococcus aureus
VNQIVYEHLAGRIPLIASGGINS

SEQ ID NO: 1687145 - protein, 18 aa, Staphylococcus aureus
VQEYAPILYQIWKKKNKQ

SEQ ID NO: 1687146 - protein, 18 aa, Staphylococcus aureus
VQVIGSMIVIYRESKENK

SEQ ID NO: 1687147 - protein, 25 aa, Staphylococcus aureus
VTNDDFTHWRKIMGAAPISEEEREN

SEQ ID NO: 1687148 - protein, 23 aa, Staphylococcus aureus
VVKSYPMIPGIDLAGTIVESEAP

SEQ ID NO: 1687149 - protein, 18 aa, Staphylococcus aureus
YDDFETLIEGYPVTYFSL

SEQ ID NO: 1687150 - protein, 22 aa, Staphylococcus aureus
YDLDLLHMHYAVPHAICGILAR

SEQ ID NO: 1687151 - protein, 24 aa, Staphylococcus aureus
YIVRSLINTMYPHQPCYEGGMCVC

SEQ ID NO: 1687152 - protein, 21 aa, Staphylococcus aureus
YLRPETLFGSKFEGYLNQKIQ

SEQ ID NO: 1687153 - protein, 19 aa, Staphylococcus aureus
YLSSAYTKTIAALGAGAIS

SEQ ID NO: 1687154 - protein, 25 aa, Staphylococcus aureus
YMSRLMNPVRFLDYLDVSKLNGGEV

SEQ ID NO: 1687155 - protein, 20 aa, Staphylococcus aureus
YQFGYFVLVKKIDCSVIGIC

SEQ ID NO: 1687156 - protein, 18 aa, Staphylococcus aureus
YTFIKRLIKQFGKPQMII

SEQ ID NO: 1687157 - protein, 18 aa, Staphylococcus aureus
YTLFTLEEHTTYLSELSL

SEQ ID NO: 1687158 - protein, 17 aa, Staphylococcus aureus
YVMTYKELATYLKVLSD

SEQ ID NO: 1687159 - protein, 19 aa, Staphylococcus aureus
YVRCKLFLEKEEEKIHVAN

SEQ ID NO: 1687160 - protein, 27 aa, Staphylococcus aureus
ADAAWITTPLNVYYFTGYRSEPHERLF

SEQ ID NO: 1687161 - protein, 26 aa, Staphylococcus aureus
ADLKVEGALAMILKDAIKPNLVQSIE

SEQ ID NO: 1687162 - protein, 20 aa, Staphylococcus aureus
AFMVIKPTSIVLPGKLDRLT

SEQ ID NO: 1687163 - protein, 17 aa, Staphylococcus aureus
AFYQELFDFYYDLFKSD

SEQ ID NO: 1687164 - protein, 19 aa, Staphylococcus aureus
AGTLLRYYTGLLEHSKVQP

SEQ ID NO: 1687165 - protein, 18 aa, Staphylococcus aureus
AIHNNLVTQFDIIGHTFI

SEQ ID NO: 1687166 - protein, 28 aa, Staphylococcus aureus
ALDIKIIMPMFDDALPYYKQFITEVTTF

SEQ ID NO: 1687167 - protein, 24 aa, Staphylococcus aureus
ALNVNEAWLMGFDISKNRKIENND

SEQ ID NO: 1687168 - protein, 20 aa, Staphylococcus aureus
ALSFIVHRDFAYERGKALVE

SEQ ID NO: 1687169 - protein, 21 aa, Staphylococcus aureus
AMVPYAAWQKFARPRFDNMIS

SEQ ID NO: 1687170 - protein, 23 aa, Staphylococcus aureus
ANVDYFELLHILEFKKAERVKDC

SEQ ID NO: 1687171 - protein, 17 aa, Staphylococcus aureus
AQALYQDGERQSKVIID

SEQ ID NO: 1687172 - protein, 18 aa, Staphylococcus aureus
AQYPPQLAFAIGNAIKYL

SEQ ID NO: 1687173 - protein, 24 aa, Staphylococcus aureus
ASAPKNMLLSLILNSDLVSPKDLE

SEQ ID NO: 1687174 - protein, 18 aa, Staphylococcus aureus
ATKPTRIKLKWTPQIMHQ

SEQ ID NO: 1687175 - protein, 22 aa, Staphylococcus aureus
DAHVDYLVTWNIPEGITMDQYL

SEQ ID NO: 1687176 - protein, 27 aa, Staphylococcus aureus
DELVATEYPVLLATSRKRFTKKMMGYD

SEQ ID NO: 1687177 - protein, 19 aa, Staphylococcus aureus
DGITKLVYIKSIQDTIEAV

SEQ ID NO: 1687178 - protein, 18 aa, Staphylococcus aureus
DIAYMRDMLYSLTTDIEP

SEQ ID NO: 1687179 - protein, 21 aa, Staphylococcus aureus
DILCCYRLNRLHRNLKNALKL

SEQ ID NO: 1687180 - protein, 25 aa, Staphylococcus aureus
DIRQKLTMIFNQFNQMSLSHYPIQD

SEQ ID NO: 1687181 - protein, 17 aa, Staphylococcus aureus
DIVAVTSLYRPGPMEEI

SEQ ID NO: 1687182 - protein, 24 aa, Staphylococcus aureus
DKDDPRFDNPTKPIGPFYTKEEVE

SEQ ID NO: 1687183 - protein, 24 aa, Staphylococcus aureus
DNQIEVIDIKFSSSVFYFGVMIIY

SEQ ID NO: 1687184 - protein, 30 aa, Staphylococcus aureus
DRLKARDMLGKYYKLFTDKHDINGNVPIFI

SEQ ID NO: 1687185 - protein, 19 aa, Staphylococcus aureus
DVAFVPGAFEIPLVAKKLA

SEQ ID NO: 1687186 - protein, 19 aa, Staphylococcus aureus
DVLVPWVTIKDEPLVYFVE

SEQ ID NO: 1687187 - protein, 27 aa, Staphylococcus aureus
DYLSKFEIREIRIIKSVLLKGKKSFNT

SEQ ID NO: 1687188 - protein, 18 aa, Staphylococcus aureus
DYNAEIKTILSKLGIHDT

SEQ ID NO: 1687189 - protein, 18 aa, Staphylococcus aureus
EAIKNASFPVLLAGMRSS

SEQ ID NO: 1687190 - protein, 29 aa, Staphylococcus aureus
EANSFASCLLFPLHIRYKYINNFNIEQIS

SEQ ID NO: 1687191 - protein, 20 aa, Staphylococcus aureus
EARIPFIKHMQNSGLFASIS

SEQ ID NO: 1687192 - protein, 23 aa, Staphylococcus aureus
EELIRRLRRGIYAKQKVVVFKPA

SEQ ID NO: 1687193 - protein, 22 aa, Staphylococcus aureus
EFKLQMVRLYKNGKPRNEIIRE

SEQ ID NO: 1687194 - protein, 21 aa, Staphylococcus aureus
EGTLTGRVKFIFQPAEELGHG

SEQ ID NO: 1687195 - protein, 23 aa, Staphylococcus aureus
EHVELIEVPIKPSDRLKARDMLG

SEQ ID NO: 1687196 - protein, 26 aa, Staphylococcus aureus
EIDHLIDYFILPLRQIEQVSIARSKI

SEQ ID NO: 1687197 - protein, 18 aa, Staphylococcus aureus
EKDRFSISIIFKDTYHTL

SEQ ID NO: 1687198 - protein, 23 aa, Staphylococcus aureus
ELEKYKQLILDDKMLVVGVRDHS

SEQ ID NO: 1687199 - protein, 26 aa, Staphylococcus aureus
ELERTLGFSNGQIRRWEKTKPGIDKV

SEQ ID NO: 1687200 - protein, 22 aa, Staphylococcus aureus
ELKPFYEDILGLNIINETLTSI

SEQ ID NO: 1687201 - protein, 17 aa, Staphylococcus aureus
ELPLAIEDIINNIDLVI

SEQ ID NO: 1687202 - protein, 21 aa, Staphylococcus aureus
ENFKFFGQYADFKSLKSYNHG

SEQ ID NO: 1687203 - protein, 25 aa, Staphylococcus aureus
ENVSYEIIYSIALYESLKAQQDMKI

SEQ ID NO: 1687204 - protein, 23 aa, Staphylococcus aureus
EQFRDEFHFAKRRSTEALYEQQQ

SEQ ID NO: 1687205 - protein, 22 aa, Staphylococcus aureus
EQLKMFVYDYDTNLIKNVMVAA

SEQ ID NO: 1687206 - protein, 29 aa, Staphylococcus aureus
ETAEKYMIFLTWIFSATNNKLRDLGTKSL

SEQ ID NO: 1687207 - protein, 26 aa, Staphylococcus aureus
EVASTFRILIKYLIYSKIKQQPYNAN

SEQ ID NO: 1687208 - protein, 17 aa, Staphylococcus aureus
EVLPELEGKLHGMALRV

SEQ ID NO: 1687209 - protein, 20 aa, Staphylococcus aureus
FAENDYFYIMHRFDEEARIP

SEQ ID NO: 1687210 - protein, 24 aa, Staphylococcus aureus
FDRPYIVAISIMYLFEMFSISNEE

SEQ ID NO: 1687211 - protein, 17 aa, Staphylococcus aureus
FHAAALKQVPSCEFFPV

SEQ ID NO: 1687212 - protein, 26 aa, Staphylococcus aureus
FKDIEARIYPVGRLDYDTSGLLLLTN

SEQ ID NO: 1687213 - protein, 19 aa, Staphylococcus aureus
FLNLPPTLFKNEKARKSIL

SEQ ID NO: 1687214 - protein, 27 aa, Staphylococcus aureus
FSYYDRFRNRIMFPLKNAQGRIVGYSG

SEQ ID NO: 1687215 - protein, 33 aa, Staphylococcus aureus
GDITAPYYRDLAFVTYMGISAYDTFLSAFGKKD

SEQ ID NO: 1687216 - protein, 22 aa, Staphylococcus aureus
GDLAPLSHLALALIGEGKVLYR

SEQ ID NO: 1687217 - protein, 21 aa, Staphylococcus aureus
GEQYARLRPKKLKANIEYTTP

SEQ ID NO: 1687218 - protein, 20 aa, Staphylococcus aureus
GINPNWLTKPILGEIFKEIV

SEQ ID NO: 1687219 - protein, 26 aa, Staphylococcus aureus
GKGDFIPEPMVYKLAFKAGNAVAEKF

SEQ ID NO: 1687220 - protein, 20 aa, Staphylococcus aureus
GKQNNYVAVWFRQERRDGTF

SEQ ID NO: 1687221 - protein, 17 aa, Staphylococcus aureus
GKTLLMLSGGIDSPVAG

SEQ ID NO: 1687222 - protein, 33 aa, Staphylococcus aureus
GLGFKAFWEEETGFHYDLFDKIDPKLSKVIQDK

SEQ ID NO: 1687223 - protein, 18 aa, Staphylococcus aureus
GLNFDRQGQLFLLDVFEG

SEQ ID NO: 1687224 - protein, 25 aa, Staphylococcus aureus
GLSSQILMLTIMNLNFELNEVSDYI

SEQ ID NO: 1687225 - protein, 33 aa, Staphylococcus aureus
GTAKGGIVLAIRNELHIPVKYVGLGEQLDDLQP

SEQ ID NO: 1687226 - protein, 17 aa, Staphylococcus aureus
GTEHILLGLIRENEGVA

SEQ ID NO: 1687227 - protein, 18 aa, Staphylococcus aureus
GYKESKLVSYIACGATGA

SEQ ID NO: 1687228 - protein, 25 aa, Staphylococcus aureus
HGVVKIDRFPIFIPQALINEQIEYK

SEQ ID NO: 1687229 - protein, 18 aa, Staphylococcus aureus
HMHRKTSLGYYLDKEFEG

SEQ ID NO: 1687230 - protein, 18 aa, Staphylococcus aureus
HPESYKVTYQLLDKLGFG

SEQ ID NO: 1687231 - protein, 22 aa, Staphylococcus aureus
HPNMATMLAFITTDASIESNTL

SEQ ID NO: 1687232 - protein, 20 aa, Staphylococcus aureus
HQQIELIKRLVSYVPKIELH

SEQ ID NO: 1687233 - protein, 23 aa, Staphylococcus aureus
HVDYIGVGPIYPTPSKHDAHTPV

SEQ ID NO: 1687234 - protein, 17 aa, Staphylococcus aureus
IANIEMLYQLATGINEP

SEQ ID NO: 1687235 - protein, 19 aa, Staphylococcus aureus
IDYYHRFVERFPTVEVLSQ

SEQ ID NO: 1687236 - protein, 21 aa, Staphylococcus aureus
IEQPLLHIDFNDMLNALPKQL

SEQ ID NO: 1687237 - protein, 17 aa, Staphylococcus aureus
IGLHHRICYTTSASVLT

SEQ ID NO: 1687238 - protein, 19 aa, Staphylococcus aureus
IGNAIKYLSRAPLKNGHED

SEQ ID NO: 1687239 - protein, 17 aa, Staphylococcus aureus
IKDRLLFHPRLEKELRA

SEQ ID NO: 1687240 - protein, 26 aa, Staphylococcus aureus
IKGESKFDILLFSSIGVIDGDYLAGS

SEQ ID NO: 1687241 - protein, 27 aa, Staphylococcus aureus
IKNKYDKVYIVPLDKLTKQELLELCES

SEQ ID NO: 1687242 - protein, 18 aa, Staphylococcus aureus
IKTGFGTGGWQLAALNIC

SEQ ID NO: 1687243 - protein, 18 aa, Staphylococcus aureus
ILEIHLPREIPSVNLIPY

SEQ ID NO: 1687244 - protein, 23 aa, Staphylococcus aureus
INHKYLTEFLPFVEYITKVEGSK

SEQ ID NO: 1687245 - protein, 21 aa, Staphylococcus aureus
IVYNDLLPMNRLRFTLAHEYG

SEQ ID NO: 1687246 - protein, 23 aa, Staphylococcus aureus
IYHGDFAIYYPVESALIIETDTP

SEQ ID NO: 1687247 - protein, 20 aa, Staphylococcus aureus
KAFIMNIYDEYRSYVIEELD

SEQ ID NO: 1687248 - protein, 22 aa, Staphylococcus aureus
KDADATLALVKKFDTPATVAVK

SEQ ID NO: 1687249 - protein, 26 aa, Staphylococcus aureus
KDDTNKLFNFTPYNSKKIYTRSITNG

SEQ ID NO: 1687250 - protein, 20 aa, Staphylococcus aureus
KEEWLSMSLAERQKAEKAFR

SEQ ID NO: 1687251 - protein, 23 aa, Staphylococcus aureus
KGKKAIVYFYPRDNTPTCTTEAC

SEQ ID NO: 1687252 - protein, 24 aa, Staphylococcus aureus
KKEIEEFKFFVQYGNFKELENYKE

SEQ ID NO: 1687253 - protein, 22 aa, Staphylococcus aureus
KLDRYQFLEILLQEIEKRYNQF

SEQ ID NO: 1687254 - protein, 22 aa, Staphylococcus aureus
KLIVNSIRHLLKVKDKLGFHVV

SEQ ID NO: 1687255 - protein, 21 aa, Staphylococcus aureus
KLSFKYIDRILLNWKKNNVKT

SEQ ID NO: 1687256 - protein, 26 aa, Staphylococcus aureus
KNNINEIYLIAHAFLESGYGTSNFAS

SEQ ID NO: 1687257 - protein, 22 aa, Staphylococcus aureus
KQEYLRILPHMQELPISNLDKA

SEQ ID NO: 1687258 - protein, 18 aa, Staphylococcus aureus
KQIVFSPEILSWIEQRNL

SEQ ID NO: 1687259 - protein, 29 aa, Staphylococcus aureus
KQTKITLFEALRAWLYDEIVADSWLDAYQ

SEQ ID NO: 1687260 - protein, 24 aa, Staphylococcus aureus
KQWREFIINWVQDTMDGYTEIECI

SEQ ID NO: 1687261 - protein, 17 aa, Staphylococcus aureus
KQYLITDFRYIDQATKQ

SEQ ID NO: 1687262 - protein, 21 aa, Staphylococcus aureus
KSAILFASLFSKEATIIKELD

SEQ ID NO: 1687263 - protein, 17 aa, Staphylococcus aureus
KSDAQIVEILKNQIDTL

SEQ ID NO: 1687264 - protein, 19 aa, Staphylococcus aureus
KSDEKILLDQMVSHFKKFE

SEQ ID NO: 1687265 - protein, 20 aa, Staphylococcus aureus
KSILVYFKDIQYSKNSWVVP

SEQ ID NO: 1687266 - protein, 25 aa, Staphylococcus aureus
KSKFNQIFIFTHSWNDFCDITYRLK

SEQ ID NO: 1687267 - protein, 25 aa, Staphylococcus aureus
KSYRNEYFYKNTILNKLLLGRHSIN

SEQ ID NO: 1687268 - protein, 25 aa, Staphylococcus aureus
KTDKPIIRIYPLPFNPDTYADDNEI

SEQ ID NO: 1687269 - protein, 37 aa, Staphylococcus aureus
KTNYLIDLMHRHRLKRPLILLNWNTLTGDTFITNGEY

SEQ ID NO: 1687270 - protein, 30 aa, Staphylococcus aureus
KVARELIELIIAFMFHHQIPMSVETSKLLS

SEQ ID NO: 1687271 - protein, 20 aa, Staphylococcus aureus
KVSFLIDKKSGYFYIVNDEL

SEQ ID NO: 1687272 - protein, 19 aa, Staphylococcus aureus
KYNNHIKRFIFASSAAVYG

SEQ ID NO: 1687273 - protein, 19 aa, Staphylococcus aureus
KYTIAKFYKLYIERSNKGE

SEQ ID NO: 1687274 - protein, 20 aa, Staphylococcus aureus
LAQYCSFYSDFVKASLILER

SEQ ID NO: 1687275 - protein, 30 aa, Staphylococcus aureus
LDDIVKNMKPLIVQMLFEPSHYDDMFILNT

SEQ ID NO: 1687276 - protein, 26 aa, Staphylococcus aureus
LGPTAIRYAGLIPRLKQLDLDVNDKG

SEQ ID NO: 1687277 - protein, 22 aa, Staphylococcus aureus
LKNSFRPEFLNRVDDIIVFHKL

SEQ ID NO: 1687278 - protein, 17 aa, Staphylococcus aureus
LKTVIDLVDKRVPVIAG

SEQ ID NO: 1687279 - protein, 21 aa, Staphylococcus aureus
LLVQQLAKENVPFTAGVRQSD

SEQ ID NO: 1687280 - protein, 27 aa, Staphylococcus aureus
LNPAKNQGYFIMYGDKVQFQRSYHGTM

SEQ ID NO: 1687281 - protein, 19 aa, Staphylococcus aureus
LRLLEIIKKYNNHIKRFIF

SEQ ID NO: 1687282 - protein, 18 aa, Staphylococcus aureus
LRTIMTFLGVPSYETIII

SEQ ID NO: 1687283 - protein, 18 aa, Staphylococcus aureus
LSSVLMLEHLGWQEAADK

SEQ ID NO: 1687284 - protein, 20 aa, Staphylococcus aureus
LTELSSYWVYQDINKDNDFT

SEQ ID NO: 1687285 - protein, 21 aa, Staphylococcus aureus
LTSHDVVFKLRKILKTKKIGH

SEQ ID NO: 1687286 - protein, 23 aa, Staphylococcus aureus
LVNGGTLAIYMGVKRLGKIITQI

SEQ ID NO: 1687287 - protein, 22 aa, Staphylococcus aureus
MYHSPIRLLVVVQAPDFVVARL

SEQ ID NO: 1687288 - protein, 20 aa, Staphylococcus aureus
NAFFLGFNFEDYIDAVLELK

SEQ ID NO: 1687289 - protein, 32 aa, Staphylococcus aureus
NFGASLKADQFKYEVTLPQGVTYVNDSLTTTF

SEQ ID NO: 1687290 - protein, 29 aa, Staphylococcus aureus
NHLDFESISWLINYVKQYPHTVLFVTHDR

SEQ ID NO: 1687291 - protein, 24 aa, Staphylococcus aureus
NHNLSYNNLIALSIHKGIGAGLII

SEQ ID NO: 1687292 - protein, 22 aa, Staphylococcus aureus
NIKVLVETLPDFKFHIAAITEM

SEQ ID NO: 1687293 - protein, 26 aa, Staphylococcus aureus
NKTIPWLYVERGFEIPSFNYVLKTEN

SEQ ID NO: 1687294 - protein, 19 aa, Staphylococcus aureus
NKVMYITDGVFSMDGDVAK

SEQ ID NO: 1687295 - protein, 17 aa, Staphylococcus aureus
NLIRYFSIPCKPTKVNG

SEQ ID NO: 1687296 - protein, 23 aa, Staphylococcus aureus
NNMAYLQHYGLRTTLIDITENPF

SEQ ID NO: 1687297 - protein, 24 aa, Staphylococcus aureus
NPVQKIFIITTNDWSFNTLELEKI

SEQ ID NO: 1687298 - protein, 24 aa, Staphylococcus aureus
NQRERLWLKLYLEGYKQFEIAEIM

SEQ ID NO: 1687299 - protein, 28 aa, Staphylococcus aureus
NTEQIVHKYIMKLAPYLQSGQYNNSLFG

SEQ ID NO: 1687300 - protein, 19 aa, Staphylococcus aureus
NVVATLRLLEIIKKYNNHI

SEQ ID NO: 1687301 - protein, 32 aa, Staphylococcus aureus
PSIDYVIFTNDFKIDGLNRATATYKFAGGKGI

SEQ ID NO: 1687302 - protein, 21 aa, Staphylococcus aureus
PYSNSIWLFDVGEGTQHQILH

SEQ ID NO: 1687303 - protein, 23 aa, Staphylococcus aureus
QDEQNIIINFYNGKTIKDVIEDI

SEQ ID NO: 1687304 - protein, 32 aa, Staphylococcus aureus
QFKCHIDTIIKKQVPVCCFTFGIPSEQIISRL

SEQ ID NO: 1687305 - protein, 25 aa, Staphylococcus aureus
QHEDADILYIGFISTKGAIQEGSNR

SEQ ID NO: 1687306 - protein, 25 aa, Staphylococcus aureus
QIIEATLDWTFYNDIPLSYKTSNLL

SEQ ID NO: 1687307 - protein, 25 aa, Staphylococcus aureus
QINGIPFSYFMSYVSGAGLSFIRHW

SEQ ID NO: 1687308 - protein, 26 aa, Staphylococcus aureus
QLDINVNTLYPKYKYYKTHGIETLLT

SEQ ID NO: 1687309 - protein, 19 aa, Staphylococcus aureus
QLQRRYIFDDRGYLSAIRY

SEQ ID NO: 1687310 - protein, 20 aa, Staphylococcus aureus
QRLLDFVISLIGQPQLILLD

SEQ ID NO: 1687311 - protein, 18 aa, Staphylococcus aureus
QVIGSMIVIYRESKDNKE

SEQ ID NO: 1687312 - protein, 18 aa, Staphylococcus aureus
QVYVNQHIFLDEDILFPY

SEQ ID NO: 1687313 - protein, 19 aa, Staphylococcus aureus
RAISKNMLFIPFEGENVDG

SEQ ID NO: 1687314 - protein, 19 aa, Staphylococcus aureus
RASKKFTIVPSWETYAKEA

SEQ ID NO: 1687315 - protein, 27 aa, Staphylococcus aureus
REILDLPDYVFPLFGMAVGEPAEDENG

SEQ ID NO: 1687316 - protein, 19 aa, Staphylococcus aureus
REYTFLGKEGRFVTLPEYP

SEQ ID NO: 1687317 - protein, 23 aa, Staphylococcus aureus
RGRKTLLFGPMKPVGLEDPKTGK

SEQ ID NO: 1687318 - protein, 28 aa, Staphylococcus aureus
RHDIKVTAWMPLMRNRGLLDDPVIVKIA

SEQ ID NO: 1687319 - protein, 17 aa, Staphylococcus aureus
RIADFLIPTYSYVSVIE

SEQ ID NO: 1687320 - protein, 17 aa, Staphylococcus aureus
RLLFHPRLEKELRAQGI

SEQ ID NO: 1687321 - protein, 17 aa, Staphylococcus aureus
RLLKDYGVSIYPANISE

SEQ ID NO: 1687322 - protein, 20 aa, Staphylococcus aureus
RLVKPIGIKVTRLAQGLSVG

SEQ ID NO: 1687323 - protein, 19 aa, Staphylococcus aureus
RPRFDNMISFNSTNDLLTW

SEQ ID NO: 1687324 - protein, 30 aa, Staphylococcus aureus
RQEIISFKLGIKYLLTIKRGNIEKDRFSIS

SEQ ID NO: 1687325 - protein, 24 aa, Staphylococcus aureus
RQKERQLLVDLFKDEGLTEEDVLN

SEQ ID NO: 1687326 - protein, 25 aa, Staphylococcus aureus
RQLDVKLFYRKKYGMELTEEGLAYV

SEQ ID NO: 1687327 - protein, 18 aa, Staphylococcus aureus
RRYGSVPHCGFGLGLERT

SEQ ID NO: 1687328 - protein, 25 aa, Staphylococcus aureus
RVATDKEFYIFDSLIQGRSYQDISG

SEQ ID NO: 1687329 - protein, 27 aa, Staphylococcus aureus
SDIVYHLIALLRYGGGISYQLLDDHSN

SEQ ID NO: 1687330 - protein, 18 aa, Staphylococcus aureus
SEALWNIANLTNVLGINL

SEQ ID NO: 1687331 - protein, 28 aa, Staphylococcus aureus
SGIAIGVSNFYYAPILKDTENEWETGAG

SEQ ID NO: 1687332 - protein, 17 aa, Staphylococcus aureus
SIRMMWLSQNQKPSYKT

SEQ ID NO: 1687333 - protein, 17 aa, Staphylococcus aureus
SISIIFKDTYHTLVRID

SEQ ID NO: 1687334 - protein, 29 aa, Staphylococcus aureus
SIYGDFQRFYQPAIKALHTLGARDVIQSG

SEQ ID NO: 1687335 - protein, 30 aa, Staphylococcus aureus
SKVQPCCFKLYNDPFDMAYVMMNSKLFGHV

SEQ ID NO: 1687336 - protein, 17 aa, Staphylococcus aureus
SLGYYLDKEFEGHGIMT

SEQ ID NO: 1687337 - protein, 18 aa, Staphylococcus aureus
SLIHMRCNRIFGIDKDQE

SEQ ID NO: 1687338 - protein, 26 aa, Staphylococcus aureus
SLPVPKYRYFKLNNKKIQKMLYRILQ

SEQ ID NO: 1687339 - protein, 26 aa, Staphylococcus aureus
SNDHNLFFMNYYLNFKELRAFVTGNA

SEQ ID NO: 1687340 - protein, 30 aa, Staphylococcus aureus
SNLSAKAKGILLYFLSRPDNWQIYTSEVVK

SEQ ID NO: 1687341 - protein, 23 aa, Staphylococcus aureus
SNTYSYNLISLMIEYLRFANCTQ

SEQ ID NO: 1687342 - protein, 26 aa, Staphylococcus aureus
SNWQVNPMLRLLKTDVLTASYLKSAY

SEQ ID NO: 1687343 - protein, 20 aa, Staphylococcus aureus
SQDTFIIDNLYPFVKHLKDK

SEQ ID NO: 1687344 - protein, 19 aa, Staphylococcus aureus
SRLTTFLEHALAKTTSLHG

SEQ ID NO: 1687345 - protein, 24 aa, Staphylococcus aureus
SSAEWEVMNIIWMKKYASANNIIE

SEQ ID NO: 1687346 - protein, 31 aa, Staphylococcus aureus
SSAWSNAKSVFNGFRKWLSKTYDWIRDIGKD

SEQ ID NO: 1687347 - protein, 21 aa, Staphylococcus aureus
STYIELLATKLHQAKQPIIIT

SEQ ID NO: 1687348 - protein, 24 aa, Staphylococcus aureus
SVSYKKGLLFGEIIIHHGSSSIAI

SEQ ID NO: 1687349 - protein, 24 aa, Staphylococcus aureus
SYSDNLNYILNKLSLHNDDFVKKI

SEQ ID NO: 1687350 - protein, 26 aa, Staphylococcus aureus
TDINPYIKNMMYVLADNRHISLIADV

SEQ ID NO: 1687351 - protein, 24 aa, Staphylococcus aureus
TGKWFAMEWEQVVPDIYILGKALG

SEQ ID NO: 1687352 - protein, 23 aa, Staphylococcus aureus
TGYKGEMIIYFSYERMGDYFLSE

SEQ ID NO: 1687353 - protein, 21 aa, Staphylococcus aureus
TILPGIQFIQGFEVIIHPSCE

SEQ ID NO: 1687354 - protein, 20 aa, Staphylococcus aureus
TLGEIVDLLYKFKQSRLDRT

SEQ ID NO: 1687355 - protein, 18 aa, Staphylococcus aureus
TLMKIICGILQQDSGEIK

SEQ ID NO: 1687356 - protein, 23 aa, Staphylococcus aureus
TLNVLYDRYQLPLFIVENGFGAV

SEQ ID NO: 1687357 - protein, 27 aa, Staphylococcus aureus
TLSHGIPGIILFLDAYQKVFDINTEQI

SEQ ID NO: 1687358 - protein, 29 aa, Staphylococcus aureus
TNYKPSPDGIIYILQKYDLHNKDTIYVGD

SEQ ID NO: 1687359 - protein, 18 aa, Staphylococcus aureus
TQNNIRLLKDYGVSIYPA

SEQ ID NO: 1687360 - protein, 23 aa, Staphylococcus aureus
TQNYYSIMVYGKSGTGKTTLATR

SEQ ID NO: 1687361 - protein, 24 aa, Staphylococcus aureus
TTNEATIAAITPDANVKPQAKQAI

SEQ ID NO: 1687362 - protein, 25 aa, Staphylococcus aureus
TVDTGILCWAWFEEAYQIETFAKFS

SEQ ID NO: 1687363 - protein, 25 aa, Staphylococcus aureus
TVHIALMHDWLKGKIIVDSLGLHSN

SEQ ID NO: 1687364 - protein, 17 aa, Staphylococcus aureus
TVIDYYHRFVERFPTVE

SEQ ID NO: 1687365 - protein, 18 aa, Staphylococcus aureus
VILNNLYKQTPLQTSFGV

SEQ ID NO: 1687366 - protein, 20 aa, Staphylococcus aureus
VIQLLMHMIHYVPRTYHSNQ

SEQ ID NO: 1687367 - protein, 25 aa, Staphylococcus aureus
VKHKFSELHVFPYSPRIGTPAARMD

SEQ ID NO: 1687368 - protein, 25 aa, Staphylococcus aureus
VKYDDIFLGNEYENFVFTNDKKKSI

SEQ ID NO: 1687369 - protein, 18 aa, Staphylococcus aureus
VMTTLFLIGQALQDDEII

SEQ ID NO: 1687370 - protein, 17 aa, Staphylococcus aureus
VPWISIYDENITKETKD

SEQ ID NO: 1687371 - protein, 29 aa, Staphylococcus aureus
VVASPLPQSILEHQLIRTLADGKNIVIAC

SEQ ID NO: 1687372 - protein, 24 aa, Staphylococcus aureus
VVTRPLMEEWLFNTVAFIGGPSEI

SEQ ID NO: 1687373 - protein, 24 aa, Staphylococcus aureus
WKGTSKWFSNSYKSLKGWTGDMYS

SEQ ID NO: 1687374 - protein, 19 aa, Staphylococcus aureus
WVEKVGDLYVFSMTPELQD

SEQ ID NO: 1687375 - protein, 20 aa, Staphylococcus aureus
YAIRLLEDKVLYNKLQKNML

SEQ ID NO: 1687376 - protein, 17 aa, Staphylococcus aureus
YDKVISFIKINDSNYRL

SEQ ID NO: 1687377 - protein, 17 aa, Staphylococcus aureus
YENITIYNLFKKPNRLC

SEQ ID NO: 1687378 - protein, 18 aa, Staphylococcus aureus
YFVKTFYNKGKFPDRKNY

SEQ ID NO: 1687379 - protein, 27 aa, Staphylococcus aureus
YHDIKSPMVGTFFLQDSKELTEPIVNV

SEQ ID NO: 1687380 - protein, 25 aa, Staphylococcus aureus
YKVFTSFYRKWRPYLRHRDVYHYDL

SEQ ID NO: 1687381 - protein, 19 aa, Staphylococcus aureus
YMISMFIPDNDFMASLISD

SEQ ID NO: 1687382 - protein, 20 aa, Staphylococcus aureus
YNTLFILSSFLKSINIIEER

SEQ ID NO: 1687383 - protein, 22 aa, Staphylococcus aureus
YQLLLDEGYIYSRPRSGYFVSE

SEQ ID NO: 1687384 - protein, 24 aa, Staphylococcus aureus
YREQLEMILYKYSFSTKQMIEFLG

SEQ ID NO: 1687385 - protein, 19 aa, Staphylococcus aureus
YSFHLTLTQVKLLNLLVKY

SEQ ID NO: 1687386 - protein, 23 aa, Staphylococcus aureus
AGNDWFFDKMSNLGFEHTGFHKG

SEQ ID NO: 1687387 - protein, 20 aa, Staphylococcus aureus
AIAHANCMVMLPGGSRGFKA

SEQ ID NO: 1687388 - protein, 20 aa, Staphylococcus aureus
AIEYYFGLRTDKPDEFVPLR

SEQ ID NO: 1687389 - protein, 26 aa, Staphylococcus aureus
AKESLLKYLIRMSTRPTPFGLLSGIN

SEQ ID NO: 1687390 - protein, 31 aa, Staphylococcus aureus
AKNTSTLIPMCHPLPLTGIDVHFSWDETNAP

SEQ ID NO: 1687391 - protein, 18 aa, Staphylococcus aureus
AQHYPLKRIAVMSAPKEK

SEQ ID NO: 1687392 - protein, 24 aa, Staphylococcus aureus
ATEINLFFAMCNKLKEQDTNTLRL

SEQ ID NO: 1687393 - protein, 24 aa, Staphylococcus aureus
ATIRPQFIAYQIPIRLGSIKSSLE

SEQ ID NO: 1687394 - protein, 17 aa, Staphylococcus aureus
AVCDGAFFKNKRLFVIG

SEQ ID NO: 1687395 - protein, 22 aa, Staphylococcus aureus
AVDALQLRFILDWNSQAHRPQF

SEQ ID NO: 1687396 - protein, 17 aa, Staphylococcus aureus
CKVLLQQLDIDIYSRVV

SEQ ID NO: 1687397 - protein, 17 aa, Staphylococcus aureus
CLYVLVDPYLIENLRNA

SEQ ID NO: 1687398 - protein, 17 aa, Staphylococcus aureus
DAQIVEILKNQIDTLNN

SEQ ID NO: 1687399 - protein, 24 aa, Staphylococcus aureus
DCIQPIIEPIKYTTTFKNTLQYCG

SEQ ID NO: 1687400 - protein, 25 aa, Staphylococcus aureus
DERPLIRATAYWAIGQILGEEARDF

SEQ ID NO: 1687401 - protein, 17 aa, Staphylococcus aureus
DESLFNRYWPADIHLMA

SEQ ID NO: 1687402 - protein, 26 aa, Staphylococcus aureus
DEYKDVVFIYPMHRNPKVRAIAEKYL

SEQ ID NO: 1687403 - protein, 19 aa, Staphylococcus aureus
DFAGFIAATLLRGVHFIQV

SEQ ID NO: 1687404 - protein, 19 aa, Staphylococcus aureus
DFIKARWNQDFRLEDFKKV

SEQ ID NO: 1687405 - protein, 27 aa, Staphylococcus aureus
DGNLGYITAILLRKLYPEAKTYVFGKT

SEQ ID NO: 1687406 - protein, 17 aa, Staphylococcus aureus
DKIIDAFGMRPYIKKKV

SEQ ID NO: 1687407 - protein, 25 aa, Staphylococcus aureus
DKNIEACTSLKIRFLNNLELIKGDV

SEQ ID NO: 1687408 - protein, 25 aa, Staphylococcus aureus
DNELYNYHYLYLHQRYAIDLVIKEN

SEQ ID NO: 1687409 - protein, 21 aa, Staphylococcus aureus
DPSLFIEKYQRFTLDGDGTGR

SEQ ID NO: 1687410 - protein, 20 aa, Staphylococcus aureus
DTYLTKFPGIGKKTARQIVL

SEQ ID NO: 1687411 - protein, 23 aa, Staphylococcus aureus
DVTKLPFIEFQADPIYINQIKEW

SEQ ID NO: 1687412 - protein, 17 aa, Staphylococcus aureus
DYGPFYRYDPNQCILCG

SEQ ID NO: 1687413 - protein, 23 aa, Staphylococcus aureus
EAQPIIELAARIYIEILDEVRQA

SEQ ID NO: 1687414 - protein, 21 aa, Staphylococcus aureus
EDLANFLYFVAQKNMGIGAGD

SEQ ID NO: 1687415 - protein, 19 aa, Staphylococcus aureus
EEIAFDRKNWVFPIQTHEN

SEQ ID NO: 1687416 - protein, 30 aa, Staphylococcus aureus
EGTEAFIETAKIVLRWLKEQDIQVELLNLG

SEQ ID NO: 1687417 - protein, 21 aa, Staphylococcus aureus
EHELRAMLRMMPSLIDTGDDN

SEQ ID NO: 1687418 - protein, 18 aa, Staphylococcus aureus
EIQPKFELLPKLDKQRKI

SEQ ID NO: 1687419 - protein, 18 aa, Staphylococcus aureus
EKHGLNFDLLVDEDFKLA

SEQ ID NO: 1687420 - protein, 24 aa, Staphylococcus aureus
EKWRNHWQQYQFGYFVLVKKIDCS

SEQ ID NO: 1687421 - protein, 23 aa, Staphylococcus aureus
ELGMTGKTWLFFGDQHRSSDFLY

SEQ ID NO: 1687422 - protein, 17 aa, Staphylococcus aureus
EMKPMIAEAFYKKFDEA

SEQ ID NO: 1687423 - protein, 35 aa, Staphylococcus aureus
ENDGLLIQKRRGLNKPNILYLMKPIVTERDIYKIE

SEQ ID NO: 1687424 - protein, 22 aa, Staphylococcus aureus
ENNLKIIASCSFAKHMLEKEDS

SEQ ID NO: 1687425 - protein, 17 aa, Staphylococcus aureus
ENPFSLYPQTINKLLIE

SEQ ID NO: 1687426 - protein, 17 aa, Staphylococcus aureus
ENTIVEFATINPVAIFG

SEQ ID NO: 1687427 - protein, 32 aa, Staphylococcus aureus
EPILYLEGFNFDNGKAKLFPLSFDNYFKQDEV

SEQ ID NO: 1687428 - protein, 33 aa, Staphylococcus aureus
EPILYLEGFNFDNGKAKLFPLSFDNYFKQDEVY

SEQ ID NO: 1687429 - protein, 18 aa, Staphylococcus aureus
EREAILKGYNFISVLGWP

SEQ ID NO: 1687430 - protein, 24 aa, Staphylococcus aureus
ESEIYLSFLDTKSWCKNKFQVTNQ

SEQ ID NO: 1687431 - protein, 22 aa, Staphylococcus aureus
ETLILSHYIFMNELKINLLEFR

SEQ ID NO: 1687432 - protein, 28 aa, Staphylococcus aureus
ETRQLINDFAYKYRIPWIYGGVVQSTYT

SEQ ID NO: 1687433 - protein, 26 aa, Staphylococcus aureus
EVLKLHYSPWVIDIKKGSISLSAYGK

SEQ ID NO: 1687434 - protein, 21 aa, Staphylococcus aureus
EYIHLEYYTFALDGLGKRILH

SEQ ID NO: 1687435 - protein, 19 aa, Staphylococcus aureus
FDLILKQNKVRDAHPEVTL

SEQ ID NO: 1687436 - protein, 17 aa, Staphylococcus aureus
FIRLANPSKNTAKEMKK

SEQ ID NO: 1687437 - protein, 18 aa, Staphylococcus aureus
FKELVNLFNERYDIIIVD

SEQ ID NO: 1687438 - protein, 19 aa, Staphylococcus aureus
FNGAFDLILKQNKVRDAHP

SEQ ID NO: 1687439 - protein, 27 aa, Staphylococcus aureus
FPWRQHDVKLVFFLAISQKDTAFTKQM

SEQ ID NO: 1687440 - protein, 17 aa, Staphylococcus aureus
FRENQKWMTPLGRLGKP

SEQ ID NO: 1687441 - protein, 24 aa, Staphylococcus aureus
FRERFEPLYRSRIVKFITEKSELM

SEQ ID NO: 1687442 - protein, 19 aa, Staphylococcus aureus
FRYFGKPIPAIQGLYSRGE

SEQ ID NO: 1687443 - protein, 21 aa, Staphylococcus aureus
FSNILKNFRKAEDLTLDTLSK

SEQ ID NO: 1687444 - protein, 24 aa, Staphylococcus aureus
FYGQQLAPAYFVFIGTRNEDKGFV

SEQ ID NO: 1687445 - protein, 32 aa, Staphylococcus aureus
GEEHLLNLDGIFVQIGLLPNTSWLNDAVELNE

SEQ ID NO: 1687446 - protein, 25 aa, Staphylococcus aureus
GEVEAFFASKLPLLNFRMNNRNHRK

SEQ ID NO: 1687447 - protein, 17 aa, Staphylococcus aureus
GFKFNRWLDLAFYELDL

SEQ ID NO: 1687448 - protein, 25 aa, Staphylococcus aureus
GISSKCVYVKWNPYSYTYAKQHQIE

SEQ ID NO: 1687449 - protein, 19 aa, Staphylococcus aureus
GKQNNYVAVWFRQERRDGT

SEQ ID NO: 1687450 - protein, 22 aa, Staphylococcus aureus
GLEPWTSCEFDFTRDGKLNVSF

SEQ ID NO: 1687451 - protein, 25 aa, Staphylococcus aureus
GRSSRIGYAYFLHPANKVLTENAED

SEQ ID NO: 1687452 - protein, 19 aa, Staphylococcus aureus
GSKEMILILDFTEATNLTD

SEQ ID NO: 1687453 - protein, 22 aa, Staphylococcus aureus
GTYYFHGHIVPGWQSVKKTFDT

SEQ ID NO: 1687454 - protein, 19 aa, Staphylococcus aureus
GVDALLFETYYDLEELTNV

SEQ ID NO: 1687455 - protein, 25 aa, Staphylococcus aureus
GVYVVPAFVGLGTPYWDSEARGAIF

SEQ ID NO: 1687456 - protein, 17 aa, Staphylococcus aureus
GYYIVVGERRFRASKIA

SEQ ID NO: 1687457 - protein, 19 aa, Staphylococcus aureus
HAIYVNDYLFYVRKMGKDN

SEQ ID NO: 1687458 - protein, 24 aa, Staphylococcus aureus
HKGSLMMELYISIRTLMVVITGEG

SEQ ID NO: 1687459 - protein, 20 aa, Staphylococcus aureus
HLFNDDHYFIFPKNRRDDVT

SEQ ID NO: 1687460 - protein, 22 aa, Staphylococcus aureus
HLNDFIRIYADTLPNNEICLSD

SEQ ID NO: 1687461 - protein, 27 aa, Staphylococcus aureus
HPEGIYLSGALLMFAGSKSYYLYGASS

SEQ ID NO: 1687462 - protein, 18 aa, Staphylococcus aureus
IAELLYKLPDIKKWADEV

SEQ ID NO: 1687463 - protein, 19 aa, Staphylococcus aureus
IAHPFKQQLAPAGMGGIKF

SEQ ID NO: 1687464 - protein, 21 aa, Staphylococcus aureus
IEADFIAIFEASFNYDEYEIN

SEQ ID NO: 1687465 - protein, 18 aa, Staphylococcus aureus
IEGKTYIDLLSSASSQNV

SEQ ID NO: 1687466 - protein, 18 aa, Staphylococcus aureus
IEPMYLREIRRKEELNYR

SEQ ID NO: 1687467 - protein, 23 aa, Staphylococcus aureus
IIHHMKALFKCKNYLQIDTKIDM

SEQ ID NO: 1687468 - protein, 17 aa, Staphylococcus aureus
IISQVKFYHVPDGITIE

SEQ ID NO: 1687469 - protein, 17 aa, Staphylococcus aureus
IITGDWFYGMKIPSHRQ

SEQ ID NO: 1687470 - protein, 22 aa, Staphylococcus aureus
IKEYLIAVKGPLTTPIGGGIRS

SEQ ID NO: 1687471 - protein, 19 aa, Staphylococcus aureus
IKTGFGTGGWQLAALNICS

SEQ ID NO: 1687472 - protein, 25 aa, Staphylococcus aureus
ILQDGTFNFVFFDQSLFECVNYERK

SEQ ID NO: 1687473 - protein, 17 aa, Staphylococcus aureus
INFAKISFLSHSLLFLS

SEQ ID NO: 1687474 - protein, 29 aa, Staphylococcus aureus
INLMLRSEAPFKKALLYAPLYPVEVTSTK

SEQ ID NO: 1687475 - protein, 26 aa, Staphylococcus aureus
IPIIEDDIFRDIFFSDPTPSIKTYDK

SEQ ID NO: 1687476 - protein, 18 aa, Staphylococcus aureus
IQKLILAYEKTEIGFGEE

SEQ ID NO: 1687477 - protein, 22 aa, Staphylococcus aureus
IRDYPMIPGIDFAGIVESSSND

SEQ ID NO: 1687478 - protein, 24 aa, Staphylococcus aureus
IRTPLLSVEFFNLFLNTEQIKYSD

SEQ ID NO: 1687479 - protein, 20 aa, Staphylococcus aureus
ISSHILRHSHISLLSQQGVS

SEQ ID NO: 1687480 - protein, 21 aa, Staphylococcus aureus
ITIVSVFVNPLQFGPNEDFDA

SEQ ID NO: 1687481 - protein, 17 aa, Staphylococcus aureus
IYIDGFHNFSTIEYLII

SEQ ID NO: 1687482 - protein, 19 aa, Staphylococcus aureus
IYSILKNWLPHVRQTTEVS

SEQ ID NO: 1687483 - protein, 19 aa, Staphylococcus aureus
KARIMMIFSLYKGEKKKTT

SEQ ID NO: 1687484 - protein, 23 aa, Staphylococcus aureus
KDGYADIKILYSPASDQNYRYAN

SEQ ID NO: 1687485 - protein, 32 aa, Staphylococcus aureus
KDNANYFLSIGIKTVLITLGKQGTYFATKNQS

SEQ ID NO: 1687486 - protein, 18 aa, Staphylococcus aureus
KEKHLNYPFDTSTNTRQN

SEQ ID NO: 1687487 - protein, 23 aa, Staphylococcus aureus
KEREFIQEYYFNKKTLIAVCYDI

SEQ ID NO: 1687488 - protein, 26 aa, Staphylococcus aureus
KGIYNKFYAPQFLNHFNKIIEKQRFV

SEQ ID NO: 1687489 - protein, 24 aa, Staphylococcus aureus
KHDINGNVPIFINIGEWDGGDEGL

SEQ ID NO: 1687490 - protein, 18 aa, Staphylococcus aureus
KHDKIIILPATSNTINKI

SEQ ID NO: 1687491 - protein, 17 aa, Staphylococcus aureus
KHLLGTKSGLLATPNED

SEQ ID NO: 1687492 - protein, 24 aa, Staphylococcus aureus
KHNHTFYRVNIPTISVLNPVGSGD

SEQ ID NO: 1687493 - protein, 23 aa, Staphylococcus aureus
KHSKPFLKQFPTSGDHVLMGPGE

SEQ ID NO: 1687494 - protein, 27 aa, Staphylococcus aureus
KHVNKQIFLMFNPVSKLNWVYKYFFEH

SEQ ID NO: 1687495 - protein, 30 aa, Staphylococcus aureus
KIVEYIGEMLTFLKYFDAPQPFKIMASHYM

SEQ ID NO: 1687496 - protein, 21 aa, Staphylococcus aureus
KIVIDLLLKLLDENKTMIVVT

SEQ ID NO: 1687497 - protein, 17 aa, Staphylococcus aureus
KKKFVLGSVSHKVAKRA

SEQ ID NO: 1687498 - protein, 27 aa, Staphylococcus aureus
KKKVDFYRYTLGYLFQNFALLENQTIS

SEQ ID NO: 1687499 - protein, 17 aa, Staphylococcus aureus
KLILRRAAQFLTYGDTI

SEQ ID NO: 1687500 - protein, 20 aa, Staphylococcus aureus
KLKLYLAAQRIVMESWSPLM

SEQ ID NO: 1687501 - protein, 21 aa, Staphylococcus aureus
KLNWVYKYFFEHGEPMENVMI

SEQ ID NO: 1687502 - protein, 24 aa, Staphylococcus aureus
KNEMNLVPLRRFTATEINLFFAMC

SEQ ID NO: 1687503 - protein, 23 aa, Staphylococcus aureus
KPLPNMIFHQVEVNQYAVFQYPP

SEQ ID NO: 1687504 - protein, 22 aa, Staphylococcus aureus
KQNELFAIRELLEKGLIGDCIQ

SEQ ID NO: 1687505 - protein, 17 aa, Staphylococcus aureus
KQNLQHTLLPLADVVTP

SEQ ID NO: 1687506 - protein, 21 aa, Staphylococcus aureus
KRGYKMLPHFQIGMFEDQLFV

SEQ ID NO: 1687507 - protein, 24 aa, Staphylococcus aureus
KSNMYSYNLISLMIEYLRFANCTQ

SEQ ID NO: 1687508 - protein, 17 aa, Staphylococcus aureus
KTWQDFFDKCLSVNANF

SEQ ID NO: 1687509 - protein, 17 aa, Staphylococcus aureus
KTYQFDYVIHLAALVSV

SEQ ID NO: 1687510 - protein, 18 aa, Staphylococcus aureus
KVHIGVVFKITVSTNDVE

SEQ ID NO: 1687511 - protein, 25 aa, Staphylococcus aureus
KVKRELGFVLMALNIRKVVAQRAEN

SEQ ID NO: 1687512 - protein, 25 aa, Staphylococcus aureus
KVLYEHLGPQFWWPADNDIEMMLGA

SEQ ID NO: 1687513 - protein, 37 aa, Staphylococcus aureus
LAILDYALRRRFAFYNMQPAFHTTKFKKLLKAINNTE

SEQ ID NO: 1687514 - protein, 29 aa, Staphylococcus aureus
LIIDDVVKGFLTYKIPKKVIKHAGYVRCK

SEQ ID NO: 1687515 - protein, 18 aa, Staphylococcus aureus
LIVMDSEYAPAIGAAILG

SEQ ID NO: 1687516 - protein, 17 aa, Staphylococcus aureus
LLEVYRIIGELYGKSVE

SEQ ID NO: 1687517 - protein, 17 aa, Staphylococcus aureus
LLKLLTEQGTSIIISSH

SEQ ID NO: 1687518 - protein, 17 aa, Staphylococcus aureus
LLQYVSGLSSQIAKNII

SEQ ID NO: 1687519 - protein, 20 aa, Staphylococcus aureus
LNIVNVLKKYPLFIISDEIY

SEQ ID NO: 1687520 - protein, 18 aa, Staphylococcus aureus
LPIYAIQNHLCECGIAGE

SEQ ID NO: 1687521 - protein, 33 aa, Staphylococcus aureus
LPKVQFNLLNSSAYYRYLSRRIGAIVETTLSAL

SEQ ID NO: 1687522 - protein, 21 aa, Staphylococcus aureus
LQEPQFSLLGPALEASKFYIS

SEQ ID NO: 1687523 - protein, 37 aa, Staphylococcus aureus
LSKFGYWNEPQGSFYIWFKLSVPVNIKLLFNEAIKEN

SEQ ID NO: 1687524 - protein, 24 aa, Staphylococcus aureus
LSRDGQVFYLYNKVQSIYEKREQL

SEQ ID NO: 1687525 - protein, 17 aa, Staphylococcus aureus
LYDMIDYFYTLVEKDER

SEQ ID NO: 1687526 - protein, 17 aa, Staphylococcus aureus
LYFVAQKNMGIGAGDHL

SEQ ID NO: 1687527 - protein, 18 aa, Staphylococcus aureus
MFELFKKDTQDYSDLEEQ

SEQ ID NO: 1687528 - protein, 28 aa, Staphylococcus aureus
MIPCKPDHPLVYWATFSNASDLLSSGVK

SEQ ID NO: 1687529 - protein, 26 aa, Staphylococcus aureus
MKEGLKALLMNWFNTEKINLDVEAST

SEQ ID NO: 1687530 - protein, 35 aa, Staphylococcus aureus
MKEYKDEFLAAPAEIKFLLYFAKMTKKDKNKLYHF

SEQ ID NO: 1687531 - protein, 18 aa, Staphylococcus aureus
MKFLPEDGSLQLTAGWTG

SEQ ID NO: 1687532 - protein, 25 aa, Staphylococcus aureus
MLGDAYEFLIGRFAATAGKKAGEFY

SEQ ID NO: 1687533 - protein, 18 aa, Staphylococcus aureus
MNLPELIQWAWDNPKLSG

SEQ ID NO: 1687534 - protein, 18 aa, Staphylococcus aureus
MSFEAFLEKAAVSSSQTV

SEQ ID NO: 1687535 - protein, 24 aa, Staphylococcus aureus
MSNGIPNIVVYNPAPISITSLNPN

SEQ ID NO: 1687536 - protein, 33 aa, Staphylococcus aureus
NDELHVINFERLRNYFFIKKPKRMKYINKFNEE

SEQ ID NO: 1687537 - protein, 19 aa, Staphylococcus aureus
NFHIINNLDLPYVYIPTKK

SEQ ID NO: 1687538 - protein, 26 aa, Staphylococcus aureus
NFQPMNANFGLLPSLETRIKDKKERY

SEQ ID NO: 1687539 - protein, 24 aa, Staphylococcus aureus
NHRERLWLKLYLEGYKQFEIAEIM

SEQ ID NO: 1687540 - protein, 22 aa, Staphylococcus aureus
NLHVDVVKLYFKKAKAWSEKHR

SEQ ID NO: 1687541 - protein, 17 aa, Staphylococcus aureus
NNKFVRFQYRTGEITYG

SEQ ID NO: 1687542 - protein, 21 aa, Staphylococcus aureus
NPKMHHLIDTEQFKMMKSTVY

SEQ ID NO: 1687543 - protein, 19 aa, Staphylococcus aureus
NRNDIFGVIGYSGAGKSTL

SEQ ID NO: 1687544 - protein, 26 aa, Staphylococcus aureus
NSDKKHLPDFILKKSFQKIKNNDFTR

SEQ ID NO: 1687545 - protein, 25 aa, Staphylococcus aureus
NSIVQVLIMPFLYANTYYTIDQLID

SEQ ID NO: 1687546 - protein, 20 aa, Staphylococcus aureus
NTVKQQVNFTDADQGKKDAY

SEQ ID NO: 1687547 - protein, 30 aa, Staphylococcus aureus
NVDMRGTFLMTKMMLPLMMNQGGSIVNTSS

SEQ ID NO: 1687548 - protein, 17 aa, Staphylococcus aureus
NVGFKFNRWLDLAFYEL

SEQ ID NO: 1687549 - protein, 19 aa, Staphylococcus aureus
NVLVRVLDPLFAGFTVEHD

SEQ ID NO: 1687550 - protein, 34 aa, Staphylococcus aureus
NYFDYYKNRWGLFGYCRFIPYLKKRLNNKIVLMK

SEQ ID NO: 1687551 - protein, 19 aa, Staphylococcus aureus
PADHPWRTMPRNAMTVHYS

SEQ ID NO: 1687552 - protein, 18 aa, Staphylococcus aureus
PFSLYPQTINKLLIESEH

SEQ ID NO: 1687553 - protein, 22 aa, Staphylococcus aureus
PGFWVPNDYVVVKVALRGSDKS

SEQ ID NO: 1687554 - protein, 25 aa, Staphylococcus aureus
PGVKGEVLVNAFSKYDIMISTTSAC

SEQ ID NO: 1687555 - protein, 17 aa, Staphylococcus aureus
PIIEKQFAEQLYNGLWF

SEQ ID NO: 1687556 - protein, 18 aa, Staphylococcus aureus
PITLGLGAALKTSADFEG

SEQ ID NO: 1687557 - protein, 20 aa, Staphylococcus aureus
PLTDMIKFKYPRLFENVRLA

SEQ ID NO: 1687558 - protein, 17 aa, Staphylococcus aureus
PLTLLDKNPIIVKNPGI

SEQ ID NO: 1687559 - protein, 18 aa, Staphylococcus aureus
PNKGIIMDPFNKLSRNVD

SEQ ID NO: 1687560 - protein, 36 aa, Staphylococcus aureus
PRVEKLMQAFWPGPISFILPLKLGYLCRKVSGGLSS

SEQ ID NO: 1687561 - protein, 21 aa, Staphylococcus aureus
PYLTQHKLKLYLAAQRIVMES

SEQ ID NO: 1687562 - protein, 22 aa, Staphylococcus aureus
QASDFLKFRGLVDQYKEIELNK

SEQ ID NO: 1687563 - protein, 19 aa, Staphylococcus aureus
QDTIQFKWISFQEAVDKNR

SEQ ID NO: 1687564 - protein, 19 aa, Staphylococcus aureus
QFIGKPEPIIMVKALEILG

SEQ ID NO: 1687565 - protein, 21 aa, Staphylococcus aureus
QFNPNAIYINCPLFNEMPEIL

SEQ ID NO: 1687566 - protein, 18 aa, Staphylococcus aureus
QIKCNYVLMTYYNIICHY

SEQ ID NO: 1687567 - protein, 18 aa, Staphylococcus aureus
QIVEILKNQIDTLNNQIE

SEQ ID NO: 1687568 - protein, 22 aa, Staphylococcus aureus
QLADLHVIINPQFNFESANIEQ

SEQ ID NO: 1687569 - protein, 18 aa, Staphylococcus aureus
QRFYQLTQILNTLKLVNK

SEQ ID NO: 1687570 - protein, 24 aa, Staphylococcus aureus
QRIGIRMADLLEKETFERLLKSNI

SEQ ID NO: 1687571 - protein, 30 aa, Staphylococcus aureus
QSGRYSYLFNKIYFLRISTLPLSLGQESCV

SEQ ID NO: 1687572 - protein, 22 aa, Staphylococcus aureus
QVIEYPLLEIIMRYNDNGYETR

SEQ ID NO: 1687573 - protein, 24 aa, Staphylococcus aureus
QVVIRCLMVYFNKVSRAEAVDLKV

SEQ ID NO: 1687574 - protein, 17 aa, Staphylococcus aureus
QYPTLPVGVERPGARLS

SEQ ID NO: 1687575 - protein, 25 aa, Staphylococcus aureus
RDETGGRRFWPMTVNPERVEVNWSK

SEQ ID NO: 1687576 - protein, 21 aa, Staphylococcus aureus
RDYIDAFKIFIHHVALHVSHR

SEQ ID NO: 1687577 - protein, 33 aa, Staphylococcus aureus
RHILFDKQTWPFKQILLPLLYQRDSGGGSMPSG

SEQ ID NO: 1687578 - protein, 26 aa, Staphylococcus aureus
RISKKYQWIAYYEILAKLVDKFPDVQ

SEQ ID NO: 1687579 - protein, 20 aa, Staphylococcus aureus
RKKIFAMCRDIELHWGEPVE

SEQ ID NO: 1687580 - protein, 18 aa, Staphylococcus aureus
RKRYNIPTQKAPKLLLKG

SEQ ID NO: 1687581 - protein, 22 aa, Staphylococcus aureus
RLGKLLDLYDIPDVAKVACLTI

SEQ ID NO: 1687582 - protein, 20 aa, Staphylococcus aureus
RLMDSLINYLDAIEFTTLSE

SEQ ID NO: 1687583 - protein, 17 aa, Staphylococcus aureus
RQFKYLSAFEKDVMYLM

SEQ ID NO: 1687584 - protein, 20 aa, Staphylococcus aureus
RQRGKLLDVVVIETAQKLRD

SEQ ID NO: 1687585 - protein, 23 aa, Staphylococcus aureus
RQTISLIERNNFMPSVLTAIKIA

SEQ ID NO: 1687586 - protein, 27 aa, Staphylococcus aureus
RRQHAYDFPMWFIRPNFKSETAPRSVQ

SEQ ID NO: 1687587 - protein, 22 aa, Staphylococcus aureus
RVKFEKVFAEHFFNLYEKTKDK

SEQ ID NO: 1687588 - protein, 17 aa, Staphylococcus aureus
SGDFYYVPAGTVHAIGS

SEQ ID NO: 1687589 - protein, 25 aa, Staphylococcus aureus
SKLVQPIMQLFIDKAILNNVQNDAL

SEQ ID NO: 1687590 - protein, 27 aa, Staphylococcus aureus
SKPDWKIFQAIANKLSFDWNYKHPSEI

SEQ ID NO: 1687591 - protein, 17 aa, Staphylococcus aureus
SLFNRYWPADIHLMAKE

SEQ ID NO: 1687592 - protein, 26 aa, Staphylococcus aureus
SLNADQLVMLKLTIPTEPNLYKELAE

SEQ ID NO: 1687593 - protein, 19 aa, Staphylococcus aureus
SMVTDFEDLKELGKEMEQI

SEQ ID NO: 1687594 - protein, 20 aa, Staphylococcus aureus
SPRIGIPNKGDWTHKSLRYT

SEQ ID NO: 1687595 - protein, 20 aa, Staphylococcus aureus
SSGTIQWWDKTYSDSGMNGI

SEQ ID NO: 1687596 - protein, 20 aa, Staphylococcus aureus
STYIELLATKLHQAKQPIII

SEQ ID NO: 1687597 - protein, 21 aa, Staphylococcus aureus
TATFMILGAVCTRACRFCAVK

SEQ ID NO: 1687598 - protein, 19 aa, Staphylococcus aureus
TCPHGRPIIINFSKYELEK

SEQ ID NO: 1687599 - protein, 22 aa, Staphylococcus aureus
TDQKVIDWLWETQDKSFFSSKE

SEQ ID NO: 1687600 - protein, 19 aa, Staphylococcus aureus
TEHQLLVSAIPRHKINNDP

SEQ ID NO: 1687601 - protein, 17 aa, Staphylococcus aureus
TEQIAPIVQQLADLHVI

SEQ ID NO: 1687602 - protein, 24 aa, Staphylococcus aureus
THEQFEEWWKLYNKKKDKKMSFTK

SEQ ID NO: 1687603 - protein, 26 aa, Staphylococcus aureus
THYMGIPIEESFLKLADRPLDEAALA

SEQ ID NO: 1687604 - protein, 20 aa, Staphylococcus aureus
TIHWQFGHVLTIFESALAVA

SEQ ID NO: 1687605 - protein, 21 aa, Staphylococcus aureus
TIVEFATINPVAIFGPSLDAH

SEQ ID NO: 1687606 - protein, 17 aa, Staphylococcus aureus
TNQTHIEIIYLKSCDLT

SEQ ID NO: 1687607 - protein, 36 aa, Staphylococcus aureus
TSICKKWYINSFKYFRNMYKGFYYSRPDKLDKCFYK

SEQ ID NO: 1687608 - protein, 32 aa, Staphylococcus aureus
TSKGFKGLAGAMLFNLKPINVLKNSAKLAILP

SEQ ID NO: 1687609 - protein, 29 aa, Staphylococcus aureus
TWNSQKFFDLIKYFELPLQTKIKTFSRGM

SEQ ID NO: 1687610 - protein, 18 aa, Staphylococcus aureus
VANSIVSQLLFLQAQDSE

SEQ ID NO: 1687611 - protein, 17 aa, Staphylococcus aureus
VELLADLELPLAKILSE

SEQ ID NO: 1687612 - protein, 26 aa, Staphylococcus aureus
VETFSKTWELVFGKFHLYVDKVIYQR

SEQ ID NO: 1687613 - protein, 27 aa, Staphylococcus aureus
VFDDLWMDLYDLFEELRDLFKEEDLEP

SEQ ID NO: 1687614 - protein, 19 aa, Staphylococcus aureus
VGPIKLHIVPFTELQKRVN

SEQ ID NO: 1687615 - protein, 20 aa, Staphylococcus aureus
VKRDAVIKVGQLFENIRECG

SEQ ID NO: 1687616 - protein, 19 aa, Staphylococcus aureus
VMARLDELVATEYPVLLAT

SEQ ID NO: 1687617 - protein, 30 aa, Staphylococcus aureus
VNNRDVREYLPFESLILDLNQPFDVTETKG

SEQ ID NO: 1687618 - protein, 17 aa, Staphylococcus aureus
VRCKLFLEKEEEKIHVA

SEQ ID NO: 1687619 - protein, 27 aa, Staphylococcus aureus
VSGGARFAGVALKFLTGPIGATITAIT

SEQ ID NO: 1687620 - protein, 18 aa, Staphylococcus aureus
VSIESLIEFCRLAQLPKN

SEQ ID NO: 1687621 - protein, 19 aa, Staphylococcus aureus
VTLYGLKRLNYQGVATVCG

SEQ ID NO: 1687622 - protein, 17 aa, Staphylococcus aureus
VYGFAQLKRAAALANFD

SEQ ID NO: 1687623 - protein, 18 aa, Staphylococcus aureus
WMHDKYWVDESVVRIIFS

SEQ ID NO: 1687624 - protein, 21 aa, Staphylococcus aureus
WPTAYSEIYDYQWNEKLIPYW

SEQ ID NO: 1687625 - protein, 33 aa, Staphylococcus aureus
YDNARKYSNIYLYFGLRDFLKKLMSNYSYYDSK

SEQ ID NO: 1687626 - protein, 21 aa, Staphylococcus aureus
YILKYVFANGIAREIIYALLE

SEQ ID NO: 1687627 - protein, 24 aa, Staphylococcus aureus
YIVRSLINTMYPHQPCYEGAMCVC

SEQ ID NO: 1687628 - protein, 17 aa, Staphylococcus aureus
YKTLSALYHNFDGFGLN

SEQ ID NO: 1687629 - protein, 17 aa, Staphylococcus aureus
YLSMIRGQVLTTFSTIK

SEQ ID NO: 1687630 - protein, 21 aa, Staphylococcus aureus
YPHAFIHMVGFSRGGLQGLLT

SEQ ID NO: 1687631 - protein, 26 aa, Staphylococcus aureus
YRSCDISLVMRALDSILSFLEKGNTI

SEQ ID NO: 1687632 - protein, 19 aa, Staphylococcus aureus
YRVLRIGSFLLSESGYKIF

SEQ ID NO: 1687633 - protein, 17 aa, Staphylococcus aureus
YSKGIYKFKYAILEAVR

SEQ ID NO: 1687634 - protein, 33 aa, Staphylococcus aureus
YSPRIRYKNVILKPAYWKINEMVLPLPKNEEWD

SEQ ID NO: 1687635 - protein, 20 aa, Staphylococcus aureus
YTADYLADKGVVPFLKVDKG

SEQ ID NO: 1687636 - protein, 17 aa, Staphylococcus aureus
YVFSVEPSNLYTTKVRH

SEQ ID NO: 1687637 - protein, 19 aa, Staphylococcus aureus
YYLDLRRYGSVPHCGFGLG

SEQ ID NO: 1687638 - protein, 25 aa, Staphylococcus aureus
AAFGQLLPESLLALPNLGAINVHAS

SEQ ID NO: 1687639 - protein, 26 aa, Staphylococcus aureus
ADYETFKIALFDPAVKKYAFNANFER

SEQ ID NO: 1687640 - protein, 29 aa, Staphylococcus aureus
AEELTRIGLDLPFPIKINQMLGHQTSFLT

SEQ ID NO: 1687641 - protein, 17 aa, Staphylococcus aureus
AEIILFIEKQYGIDEEL

SEQ ID NO: 1687642 - protein, 26 aa, Staphylococcus aureus
AEQLDQAMERLINGIQDKDQVKQSVN

SEQ ID NO: 1687643 - protein, 27 aa, Staphylococcus aureus
AGENYIDIAWLARKYAYQVTLKDDGLY

SEQ ID NO: 1687644 - protein, 29 aa, Staphylococcus aureus
AIDFSNPNLLFPLLDEDFHLPLVVATTGE

SEQ ID NO: 1687645 - protein, 21 aa, Staphylococcus aureus
AISNLLLVTGNYRRPGTGAYP

SEQ ID NO: 1687646 - protein, 23 aa, Staphylococcus aureus
ALEVKKRFSAWAEINLKHFKENR

SEQ ID NO: 1687647 - protein, 33 aa, Staphylococcus aureus
ANNALGLAKRKIDLRFVPGVTFTNPSIATVGLT

SEQ ID NO: 1687648 - protein, 19 aa, Staphylococcus aureus
ANRIGALYIGGKSTADIIL

SEQ ID NO: 1687649 - protein, 24 aa, Staphylococcus aureus
ANTAIDALTQLNTPQKAKLKEQVG

SEQ ID NO: 1687650 - protein, 25 aa, Staphylococcus aureus
ANVKGYFIWSLMDVFSWSNGYEKRY

SEQ ID NO: 1687651 - protein, 18 aa, Staphylococcus aureus
ARIAAMKGGLPETVPAFT

SEQ ID NO: 1687652 - protein, 35 aa, Staphylococcus aureus
ARLILDKVGNKKPLRRLWISSVTKKAIQQGFKNLK

SEQ ID NO: 1687653 - protein, 22 aa, Staphylococcus aureus
ARRQAVYTGIFQWQNGQLVTIL

SEQ ID NO: 1687654 - protein, 26 aa, Staphylococcus aureus
AVMQSFWVDPRTKIIYMTQARPGNHY

SEQ ID NO: 1687655 - protein, 18 aa, Staphylococcus aureus
AVVLFKMHPFVKNRLNIA

SEQ ID NO: 1687656 - protein, 25 aa, Staphylococcus aureus
AVVMGSGPIGLLVAQVLKSKGATVV

SEQ ID NO: 1687657 - protein, 27 aa, Staphylococcus aureus
AWCALDTLMFPALIGRTVHIASPCHGT

SEQ ID NO: 1687658 - protein, 25 aa, Staphylococcus aureus
CDNPVTEIYFIEPDLHFTIIDFNQE

SEQ ID NO: 1687659 - protein, 17 aa, Staphylococcus aureus
CFTGFELFVKPAVKHMC

SEQ ID NO: 1687660 - protein, 22 aa, Staphylococcus aureus
CINGYRWITYIANNGQRCYIAT

SEQ ID NO: 1687661 - protein, 33 aa, Staphylococcus aureus
DACYQLNVLQLIRLCRYFVDVLRQSANGRIIVI

SEQ ID NO: 1687662 - protein, 25 aa, Staphylococcus aureus
DAMTQLKQGIANKAQIKGSENYHDA

SEQ ID NO: 1687663 - protein, 24 aa, Staphylococcus aureus
DEGKYFTDFSFIKPYKKGDDVVNK

SEQ ID NO: 1687664 - protein, 35 aa, Staphylococcus aureus
DFIHDSNISWKAKGILLYLLSRPDNWQIYETELEQ

SEQ ID NO: 1687665 - protein, 19 aa, Staphylococcus aureus
DFVFLPKNELLTFDEMARI

SEQ ID NO: 1687666 - protein, 18 aa, Staphylococcus aureus
DGAYCINGYRWITYIANN

SEQ ID NO: 1687667 - protein, 20 aa, Staphylococcus aureus
DHYFIFPKNRRDDVTKLPFI

SEQ ID NO: 1687668 - protein, 17 aa, Staphylococcus aureus
DICLIEELAPFFEAGID

SEQ ID NO: 1687669 - protein, 25 aa, Staphylococcus aureus
DINPIPIKALTSYLGFGNYELRLPL

SEQ ID NO: 1687670 - protein, 23 aa, Staphylococcus aureus
DKLEQDLIKKFKLSGLVNADQTV

SEQ ID NO: 1687671 - protein, 24 aa, Staphylococcus aureus
DLIGKFCHLVLKWKFNEDEGKYFT

SEQ ID NO: 1687672 - protein, 25 aa, Staphylococcus aureus
DLKKANAALLIYYGVPKENIYTTAY

SEQ ID NO: 1687673 - protein, 20 aa, Staphylococcus aureus
DLLVEYDGELPFWDKSSPEA

SEQ ID NO: 1687674 - protein, 18 aa, Staphylococcus aureus
DLVILTHLHIDHFDPKAI

SEQ ID NO: 1687675 - protein, 19 aa, Staphylococcus aureus
DLYLSVLGMPGQTAYHGLL

SEQ ID NO: 1687676 - protein, 20 aa, Staphylococcus aureus
DNTKRSVNYTDADQPKQQAY

SEQ ID NO: 1687677 - protein, 25 aa, Staphylococcus aureus
DRDDKFYYNRLKYYKERVLVPLAYI

SEQ ID NO: 1687678 - protein, 20 aa, Staphylococcus aureus
DTLRYYEKVGVIPPVNRDEN

SEQ ID NO: 1687679 - protein, 18 aa, Staphylococcus aureus
DTMTYFATITPIASMFEG

SEQ ID NO: 1687680 - protein, 22 aa, Staphylococcus aureus
DTNGFVKLITLKEDDTLIGAQV

SEQ ID NO: 1687681 - protein, 26 aa, Staphylococcus aureus
DTYCGIGTIGLYMAPLAKHVYGVEVV

SEQ ID NO: 1687682 - protein, 19 aa, Staphylococcus aureus
DVDIIPIGGLPDGSIGTSF

SEQ ID NO: 1687683 - protein, 28 aa, Staphylococcus aureus
DYHDIKSPMVGTFFLQDSKELTEPIVNV

SEQ ID NO: 1687684 - protein, 21 aa, Staphylococcus aureus
EAIREVVNKQIEIIENADADA

SEQ ID NO: 1687685 - protein, 24 aa, Staphylococcus aureus
EDLEPWTSCEFDFTRKGNLKVSFD

SEQ ID NO: 1687686 - protein, 25 aa, Staphylococcus aureus
EDNLPKEWFEAAGAPTVEYEKFGEK

SEQ ID NO: 1687687 - protein, 27 aa, Staphylococcus aureus
EDSKFGLSIQYGLAIKAINKVQQSKYL

SEQ ID NO: 1687688 - protein, 20 aa, Staphylococcus aureus
EENVLLLRKYYAFIKLDHND

SEQ ID NO: 1687689 - protein, 17 aa, Staphylococcus aureus
EEVILQWKAQGIKPDVV

SEQ ID NO: 1687690 - protein, 25 aa, Staphylococcus aureus
EFDKVLPIYYNVFYQMFDEGIIEDA

SEQ ID NO: 1687691 - protein, 17 aa, Staphylococcus aureus
EFRRHRLRAINADKSKL

SEQ ID NO: 1687692 - protein, 18 aa, Staphylococcus aureus
EGFKNLGFDTYFAVPKTP

SEQ ID NO: 1687693 - protein, 17 aa, Staphylococcus aureus
EGPITMTLIREMRLMWK

SEQ ID NO: 1687694 - protein, 28 aa, Staphylococcus aureus
EHEVFDELYLVILKYLNTVSIENISHSE

SEQ ID NO: 1687695 - protein, 17 aa, Staphylococcus aureus
EKNKFPKNLSYLKSYTD

SEQ ID NO: 1687696 - protein, 30 aa, Staphylococcus aureus
EKTLNLIDILNPYLCIIFCNSRDNANDLAR

SEQ ID NO: 1687697 - protein, 17 aa, Staphylococcus aureus
EKYIDLIEEYGFDLIRG

SEQ ID NO: 1687698 - protein, 19 aa, Staphylococcus aureus
ELAKEKYFMTYKELSNYLN

SEQ ID NO: 1687699 - protein, 20 aa, Staphylococcus aureus
ELFDAVLMTIKYVMRESKVN

SEQ ID NO: 1687700 - protein, 18 aa, Staphylococcus aureus
ELIASFSRALASDLRADQ

SEQ ID NO: 1687701 - protein, 25 aa, Staphylococcus aureus
ELIKDVADIFYLTEEDLLPLDRMGQ

SEQ ID NO: 1687702 - protein, 19 aa, Staphylococcus aureus
ELVRLLSDIDLLVLDDMGV

SEQ ID NO: 1687703 - protein, 31 aa, Staphylococcus aureus
EMEYRKLGKYPPYYYLINFTISHKEMKKVMV

SEQ ID NO: 1687704 - protein, 17 aa, Staphylococcus aureus
EMLRSYLESMSQDFNVG

SEQ ID NO: 1687705 - protein, 29 aa, Staphylococcus aureus
EMRLMWKEMMVILQAFRVPSVNLLQFMVK

SEQ ID NO: 1687706 - protein, 19 aa, Staphylococcus aureus
ERTVNFNGFIYVSNIIKQP

SEQ ID NO: 1687707 - protein, 24 aa, Staphylococcus aureus
ESIPLDLQILLWHMVEKKDNQPHT

SEQ ID NO: 1687708 - protein, 20 aa, Staphylococcus aureus
ETVYFMLTETPFYAISGGQV

SEQ ID NO: 1687709 - protein, 18 aa, Staphylococcus aureus
EVPQRLAVIGSGYIAAEL

SEQ ID NO: 1687710 - protein, 25 aa, Staphylococcus aureus
EVQKDIAIYAPLTGEFVKIEDIPDP

SEQ ID NO: 1687711 - protein, 20 aa, Staphylococcus aureus
EVQKIIVYYANKQYFFNNET

SEQ ID NO: 1687712 - protein, 22 aa, Staphylococcus aureus
FDDEEYLFHVLRNGAKGYILKN

SEQ ID NO: 1687713 - protein, 18 aa, Staphylococcus aureus
FEIINWLFSNYKKLDEET

SEQ ID NO: 1687714 - protein, 18 aa, Staphylococcus aureus
FFENINFTIVTWPRKLCY

SEQ ID NO: 1687715 - protein, 19 aa, Staphylococcus aureus
FGRYVFGYAVRNWVKGFKS

SEQ ID NO: 1687716 - protein, 17 aa, Staphylococcus aureus
FHHYLENSDLRPKTKRR

SEQ ID NO: 1687717 - protein, 17 aa, Staphylococcus aureus
FHVLRNGAKGYILKNAP

SEQ ID NO: 1687718 - protein, 18 aa, Staphylococcus aureus
FKGAHGLLYEHQLGLQAT

SEQ ID NO: 1687719 - protein, 17 aa, Staphylococcus aureus
FLSEYLLEKYRNVDKRD

SEQ ID NO: 1687720 - protein, 17 aa, Staphylococcus aureus
FNEIIIATPAQWISHTQ

SEQ ID NO: 1687721 - protein, 19 aa, Staphylococcus aureus
FNIIKSYRGKNLKLHHMDC

SEQ ID NO: 1687722 - protein, 22 aa, Staphylococcus aureus
FQKQICNLFSPTSGELYFKGKP

SEQ ID NO: 1687723 - protein, 18 aa, Staphylococcus aureus
FRFEDLFSKEEWLSMSLA

SEQ ID NO: 1687724 - protein, 18 aa, Staphylococcus aureus
FRHDYVNILTTLSEYIRE

SEQ ID NO: 1687725 - protein, 30 aa, Staphylococcus aureus
FVAATAPFTPFYRALNWIVTDPLESIKEEI

SEQ ID NO: 1687726 - protein, 18 aa, Staphylococcus aureus
FYNRMAFDFGTLGNHEFN

SEQ ID NO: 1687727 - protein, 17 aa, Staphylococcus aureus
GASFLVLSPEHALVNSI

SEQ ID NO: 1687728 - protein, 20 aa, Staphylococcus aureus
GDTLIPPFISVPGLGENVAK

SEQ ID NO: 1687729 - protein, 21 aa, Staphylococcus aureus
GDYDLLIIGSGGAAFSAAIKA

SEQ ID NO: 1687730 - protein, 23 aa, Staphylococcus aureus
GEDFILFNKDFYLNDKIIENAKN

SEQ ID NO: 1687731 - protein, 17 aa, Staphylococcus aureus
GFCIQRHITVRDKVLIF

SEQ ID NO: 1687732 - protein, 28 aa, Staphylococcus aureus
GGEKARLLLALLMLQRDNVLILDEPTNH

SEQ ID NO: 1687733 - protein, 25 aa, Staphylococcus aureus
GGETYKLHLVPSGIFYKDKLAVIGN

SEQ ID NO: 1687734 - protein, 23 aa, Staphylococcus aureus
GKSTLLSAICRLIRFENGEVKID

SEQ ID NO: 1687735 - protein, 19 aa, Staphylococcus aureus
GLLQPQMGLLRQQLELYVK

SEQ ID NO: 1687736 - protein, 20 aa, Staphylococcus aureus
GLMIQRFGMTYVLTTKKEAA

SEQ ID NO: 1687737 - protein, 26 aa, Staphylococcus aureus
GMSNDIKHIVVYNPAPLAIKDVSGLY

SEQ ID NO: 1687738 - protein, 22 aa, Staphylococcus aureus
GPQQREIVFPISTDNASWGGTT

SEQ ID NO: 1687739 - protein, 21 aa, Staphylococcus aureus
GRLMDSLINYLDAIEFTTLSE

SEQ ID NO: 1687740 - protein, 19 aa, Staphylococcus aureus
GSERFKELVDLFNKRYDII

SEQ ID NO: 1687741 - protein, 31 aa, Staphylococcus aureus
GSQFIGKRISNAFLKIVIRDVAKRTAAKQTK

SEQ ID NO: 1687742 - protein, 25 aa, Staphylococcus aureus
GTAVLVRAKLPKSAIGFRKLMSEER

SEQ ID NO: 1687743 - protein, 24 aa, Staphylococcus aureus
GTIDMYTFGRYFPTLKELPKEYLM

SEQ ID NO: 1687744 - protein, 25 aa, Staphylococcus aureus
GYACGYHLVKYFLQKTNIPIEVATT

SEQ ID NO: 1687745 - protein, 27 aa, Staphylococcus aureus
HAVQTGGQLRIWLYERNKRADGKHHGM

SEQ ID NO: 1687746 - protein, 21 aa, Staphylococcus aureus
HDHVWGQPLYDSKALFKLLAL

SEQ ID NO: 1687747 - protein, 23 aa, Staphylococcus aureus
HDKLWNNAQYLKNGLSKLGYDTG

SEQ ID NO: 1687748 - protein, 19 aa, Staphylococcus aureus
HHARLIYVSTISVGTYFDI

SEQ ID NO: 1687749 - protein, 21 aa, Staphylococcus aureus
HKGKMAFRVYPKWCNQLNKRA

SEQ ID NO: 1687750 - protein, 26 aa, Staphylococcus aureus
HLKSDVQALFAGRFYLRELATPDNSI

SEQ ID NO: 1687751 - protein, 25 aa, Staphylococcus aureus
HLNNDFYRLTPYFTKDFNNISLYFT

SEQ ID NO: 1687752 - protein, 18 aa, Staphylococcus aureus
HMLTLFRGGPTVWISNED

SEQ ID NO: 1687753 - protein, 18 aa, Staphylococcus aureus
HRIKYDMLQPNPLRQEVM

SEQ ID NO: 1687754 - protein, 24 aa, Staphylococcus aureus
HSGPLLKNGRRFGFYRGYNGHSHI

SEQ ID NO: 1687755 - protein, 18 aa, Staphylococcus aureus
HTDEMMIIFVTNGKKWPQ

SEQ ID NO: 1687756 - protein, 22 aa, Staphylococcus aureus
HVDYIGVGPIYPTPSKHDAHTP

SEQ ID NO: 1687757 - protein, 19 aa, Staphylococcus aureus
IAELILPRSTDKPLKGKEL

SEQ ID NO: 1687758 - protein, 19 aa, Staphylococcus aureus
IAHANCMVMLPGGSRGFKA

SEQ ID NO: 1687759 - protein, 27 aa, Staphylococcus aureus
IDDELNGYFLFPRELLVEKGILASSKY

SEQ ID NO: 1687760 - protein, 28 aa, Staphylococcus aureus
IEDLTDSFAPYLTMAEGLKLAALTFDKD

SEQ ID NO: 1687761 - protein, 19 aa, Staphylococcus aureus
IEDVEKRLFLARKQLEFYS

SEQ ID NO: 1687762 - protein, 23 aa, Staphylococcus aureus
IEYIADFALYLDGKLIEVIDIKG

SEQ ID NO: 1687763 - protein, 18 aa, Staphylococcus aureus
IFCKHGEQYFRNLEFTCL

SEQ ID NO: 1687764 - protein, 21 aa, Staphylococcus aureus
IGDFFKKMDILISKQKIKIEI

SEQ ID NO: 1687765 - protein, 22 aa, Staphylococcus aureus
IGGLYDNRLLVKATKSVRHQLQ

SEQ ID NO: 1687766 - protein, 17 aa, Staphylococcus aureus
IIFKEFYPDQQAIVIVI

SEQ ID NO: 1687767 - protein, 18 aa, Staphylococcus aureus
ILDNVLYRRQVHKCATGF

SEQ ID NO: 1687768 - protein, 19 aa, Staphylococcus aureus
ILLLLEDIPRDEWNRLVNE

SEQ ID NO: 1687769 - protein, 18 aa, Staphylococcus aureus
IMGCYGIGISRTLSAIVE

SEQ ID NO: 1687770 - protein, 17 aa, Staphylococcus aureus
IMSIYGKISFIKMIDFK

SEQ ID NO: 1687771 - protein, 21 aa, Staphylococcus aureus
INDSRYLLIEFPSNEVPHYTD

SEQ ID NO: 1687772 - protein, 30 aa, Staphylococcus aureus
INGKDAFKLYDTYGFPIELTEEIAVQAGLK

SEQ ID NO: 1687773 - protein, 17 aa, Staphylococcus aureus
IPYTVLRDNIYTHPTMA

SEQ ID NO: 1687774 - protein, 23 aa, Staphylococcus aureus
ISDSTLYYTCEKFKLLVLQGNVL

SEQ ID NO: 1687775 - protein, 27 aa, Staphylococcus aureus
ISNIFYDIDLCLDFLLDHNFSLTMHLD

SEQ ID NO: 1687776 - protein, 18 aa, Staphylococcus aureus
ITGGYLPLAATLTSKKIY

SEQ ID NO: 1687777 - protein, 17 aa, Staphylococcus aureus
ITQLFAIEPARLDQQII

SEQ ID NO: 1687778 - protein, 26 aa, Staphylococcus aureus
IVTISIKYIFLRISTLPLSLGQESCV

SEQ ID NO: 1687779 - protein, 17 aa, Staphylococcus aureus
IYIFNYCYRYNLQDSLS

SEQ ID NO: 1687780 - protein, 17 aa, Staphylococcus aureus
KDASLVLILSDHSEFKN

SEQ ID NO: 1687781 - protein, 23 aa, Staphylococcus aureus
KDSEHYGLWAFKKVWGTYLSEKI

SEQ ID NO: 1687782 - protein, 20 aa, Staphylococcus aureus
KGVAYRKFDTAREIITSVLE

SEQ ID NO: 1687783 - protein, 20 aa, Staphylococcus aureus
KHIGGFPVSGLFLRCTNQEV

SEQ ID NO: 1687784 - protein, 24 aa, Staphylococcus aureus
KIEMESWGIWRVIESQLHLSVVER

SEQ ID NO: 1687785 - protein, 30 aa, Staphylococcus aureus
KIVEFIGEMLTFLKYFDAPQPFKIMASHYL

SEQ ID NO: 1687786 - protein, 17 aa, Staphylococcus aureus
KIYEYFNDALRAYGLTV

SEQ ID NO: 1687787 - protein, 18 aa, Staphylococcus aureus
KIYEYFNDALRAYGLTVK

SEQ ID NO: 1687788 - protein, 29 aa, Staphylococcus aureus
KKLVIQTYFERAHLKFLSSLPVGGIGLDF

SEQ ID NO: 1687789 - protein, 28 aa, Staphylococcus aureus
KLQFKSKDWYWNAYFEGPIKLHKEFAIP

SEQ ID NO: 1687790 - protein, 28 aa, Staphylococcus aureus
KLRDENHIIYLFLGQFFTKNEDPWHQIL

SEQ ID NO: 1687791 - protein, 24 aa, Staphylococcus aureus
KNHPLNIWALHKLLKQCNLGKRDF

SEQ ID NO: 1687792 - protein, 22 aa, Staphylococcus aureus
KNIEFYLIPTKGAAKVEKTLNL

SEQ ID NO: 1687793 - protein, 23 aa, Staphylococcus aureus
KPTIEELLINNGMKYYMVGSTYR

SEQ ID NO: 1687794 - protein, 18 aa, Staphylococcus aureus
KQFNYRGLQCPGPIVKIS

SEQ ID NO: 1687795 - protein, 23 aa, Staphylococcus aureus
KTGKVYYRPGYVQTGRAFFKLKV

SEQ ID NO: 1687796 - protein, 26 aa, Staphylococcus aureus
KTKEGLFTKGLRRRAKLLETILKNTR

SEQ ID NO: 1687797 - protein, 25 aa, Staphylococcus aureus
KVDVSNCIFILTSNFNSIEEAIVNI

SEQ ID NO: 1687798 - protein, 20 aa, Staphylococcus aureus
LDENGLFINDFRVPYVLEEG

SEQ ID NO: 1687799 - protein, 22 aa, Staphylococcus aureus
LDTSLLFNIIPERFQGRTIDDD

SEQ ID NO: 1687800 - protein, 18 aa, Staphylococcus aureus
LEGLEFMGVYWDPKKNEN

SEQ ID NO: 1687801 - protein, 18 aa, Staphylococcus aureus
LEKVGLDQTFLYRYPHEL

SEQ ID NO: 1687802 - protein, 19 aa, Staphylococcus aureus
LFERDMFALRATMHIAYMN

SEQ ID NO: 1687803 - protein, 21 aa, Staphylococcus aureus
LKGVAYRKFDTAREIITSVLE

SEQ ID NO: 1687804 - protein, 25 aa, Staphylococcus aureus
LKVQKYYTPLEFGKLRKVAMDKGFK

SEQ ID NO: 1687805 - protein, 24 aa, Staphylococcus aureus
LLFSNNINVYLPGARIRFMRYEGT

SEQ ID NO: 1687806 - protein, 17 aa, Staphylococcus aureus
LLIAIVSVKFDINYSLK

SEQ ID NO: 1687807 - protein, 28 aa, Staphylococcus aureus
LNQSKIGGMPFLKSFKDIPLDENNVPMV

SEQ ID NO: 1687808 - protein, 22 aa, Staphylococcus aureus
LNVPLIGFTGAPFTLASYMIEG

SEQ ID NO: 1687809 - protein, 25 aa, Staphylococcus aureus
LNVRDLDLMTTFYKNILGLSVKSSD

SEQ ID NO: 1687810 - protein, 18 aa, Staphylococcus aureus
LRGINKIKHRYYSKIFYS

SEQ ID NO: 1687811 - protein, 19 aa, Staphylococcus aureus
LRNRILLCSKLYAPKSKKE

SEQ ID NO: 1687812 - protein, 26 aa, Staphylococcus aureus
LSQFKDEVPILSLPTDYVRPNIKTTN

SEQ ID NO: 1687813 - protein, 17 aa, Staphylococcus aureus
LTIFRVFIIDSQALKRS

SEQ ID NO: 1687814 - protein, 17 aa, Staphylococcus aureus
LTIPEIFCKHGEQYFRN

SEQ ID NO: 1687815 - protein, 18 aa, Staphylococcus aureus
LTLYLTSHYKKIDYEFLY

SEQ ID NO: 1687816 - protein, 19 aa, Staphylococcus aureus
LTSILTLSDLFNWSRFKVK

SEQ ID NO: 1687817 - protein, 18 aa, Staphylococcus aureus
LTVTITLNEYRKLIEIKA

SEQ ID NO: 1687818 - protein, 17 aa, Staphylococcus aureus
LVYDEHIQLVTKSPKIS

SEQ ID NO: 1687819 - protein, 24 aa, Staphylococcus aureus
LYATQFLMRKYNIPVKSILGFGDS

SEQ ID NO: 1687820 - protein, 35 aa, Staphylococcus aureus
MEAKKIGVIIPLSKEFLKWTAKDFFNEVKPLIAEA

SEQ ID NO: 1687821 - protein, 24 aa, Staphylococcus aureus
MGEPDEVWKERLELLKPYQVNKEI

SEQ ID NO: 1687822 - protein, 17 aa, Staphylococcus aureus
MILILDFTEATNLTDLF

SEQ ID NO: 1687823 - protein, 25 aa, Staphylococcus aureus
MKQKLGIAIAFLNKPQFIILDEPMN

SEQ ID NO: 1687824 - protein, 17 aa, Staphylococcus aureus
MMETLYLQQNPNNAEHL

SEQ ID NO: 1687825 - protein, 18 aa, Staphylococcus aureus
MSLKNAELLYKFANSIFS

SEQ ID NO: 1687826 - protein, 28 aa, Staphylococcus aureus
NAQDEAGLFLWETLRNNFYYSAINVPKA

SEQ ID NO: 1687827 - protein, 18 aa, Staphylococcus aureus
NDLAVFTINNSIKTMTIV

SEQ ID NO: 1687828 - protein, 27 aa, Staphylococcus aureus
NEGAIEPWIPTSSDFYPTLLKRVCEVY

SEQ ID NO: 1687829 - protein, 23 aa, Staphylococcus aureus
NFEKKFYRQCKLGRGPNIEAGGK

SEQ ID NO: 1687830 - protein, 22 aa, Staphylococcus aureus
NGDSMEPLFKNGQIIFIEKSHT

SEQ ID NO: 1687831 - protein, 24 aa, Staphylococcus aureus
NKAILQFWECATAYLKNPPTREQL

SEQ ID NO: 1687832 - protein, 17 aa, Staphylococcus aureus
NKARLVYNKCSSYLHGS

SEQ ID NO: 1687833 - protein, 30 aa, Staphylococcus aureus
NKIKHRYYSKIFYSGNYIALGGYDDLNKAR

SEQ ID NO: 1687834 - protein, 18 aa, Staphylococcus aureus
NNGGVVLRWLRDELLASE

SEQ ID NO: 1687835 - protein, 30 aa, Staphylococcus aureus
NPDSLRYFYTDYIHELLLLEDSNKFKGVKA

SEQ ID NO: 1687836 - protein, 22 aa, Staphylococcus aureus
NTAFFVKLFNTALAERDYYFNI

SEQ ID NO: 1687837 - protein, 20 aa, Staphylococcus aureus
NTNWPVCGIPEKFYTDHGSD

SEQ ID NO: 1687838 - protein, 20 aa, Staphylococcus aureus
NTWRYRISLGKDAETGKYKY

SEQ ID NO: 1687839 - protein, 17 aa, Staphylococcus aureus
NVEAFSNAVKKAVNEAV

SEQ ID NO: 1687840 - protein, 18 aa, Staphylococcus aureus
NVKYPLADFALTPDVAII

SEQ ID NO: 1687841 - protein, 25 aa, Staphylococcus aureus
NVVTRPLMEEWLFNTVAFIGGPSEI

SEQ ID NO: 1687842 - protein, 17 aa, Staphylococcus aureus
NYRGLQCPGPIVKISQE

SEQ ID NO: 1687843 - protein, 26 aa, Staphylococcus aureus
NYRIQDLKFMNLTLYSVLVGEISKEN

SEQ ID NO: 1687844 - protein, 25 aa, Staphylococcus aureus
PEEVAKLVVFLASDDSSFITGETIR

SEQ ID NO: 1687845 - protein, 22 aa, Staphylococcus aureus
PFQSGLKTFIPETLDLGKMNRA

SEQ ID NO: 1687846 - protein, 24 aa, Staphylococcus aureus
PGVKGEVLVNAFSKYDIMISTTSA

SEQ ID NO: 1687847 - protein, 23 aa, Staphylococcus aureus
PKGTYDICKPLTIYGNTTLLLDN

SEQ ID NO: 1687848 - protein, 19 aa, Staphylococcus aureus
PLTDMIKFKYPRLFENVRL

SEQ ID NO: 1687849 - protein, 21 aa, Staphylococcus aureus
PLTGITAYETFFDTFKISHNP

SEQ ID NO: 1687850 - protein, 46 aa, Staphylococcus aureus
PPGKKLQHLSLLSGGERALTAIALLFAILKVRSAPFVILDEVEAAL

SEQ ID NO: 1687851 - protein, 30 aa, Staphylococcus aureus
PWEDLPKVKSLWPQPGDYLLVTLRIDRENH

SEQ ID NO: 1687852 - protein, 17 aa, Staphylococcus aureus
PYTEGFLFPMQYNTADL

SEQ ID NO: 1687853 - protein, 25 aa, Staphylococcus aureus
QAIVKIETLFPYITLSHFGINIDES

SEQ ID NO: 1687854 - protein, 29 aa, Staphylococcus aureus
QDFYHYNEIMSFLIELNRQGKTIIMITHD

SEQ ID NO: 1687855 - protein, 22 aa, Staphylococcus aureus
QDNWSYPPFQLTEKDGKLYGRG

SEQ ID NO: 1687856 - protein, 20 aa, Staphylococcus aureus
QFDILLNHPLIDEEVANSLI

SEQ ID NO: 1687857 - protein, 29 aa, Staphylococcus aureus
QGEAVSMEWLFRPLLKMLAEGDPVPVEDI

SEQ ID NO: 1687858 - protein, 21 aa, Staphylococcus aureus
QGRVVGYGLTLFPTPHRFEVD

SEQ ID NO: 1687859 - protein, 20 aa, Staphylococcus aureus
QHALNLLGLATLSLLDTFSC

SEQ ID NO: 1687860 - protein, 25 aa, Staphylococcus aureus
QHTQKYLYALIQIHTLRIAHRIRCT

SEQ ID NO: 1687861 - protein, 22 aa, Staphylococcus aureus
QKAIMLPPGLAFVAYSHRAKEH

SEQ ID NO: 1687862 - protein, 34 aa, Staphylococcus aureus
QLFITSEHFAIDIDKLLFQLNLNVRYIKMEGNTS

SEQ ID NO: 1687863 - protein, 25 aa, Staphylococcus aureus
QMYDSDGFRLYFNDVQLPLLADQVR

SEQ ID NO: 1687864 - protein, 23 aa, Staphylococcus aureus
QPGYKLMFDTLRAMYQQHPIRVD

SEQ ID NO: 1687865 - protein, 24 aa, Staphylococcus aureus
QPQRDALRNQINQAQALATVEQTK

SEQ ID NO: 1687866 - protein, 25 aa, Staphylococcus aureus
QQIDKLIENIPLLQARSKEILAFVN

SEQ ID NO: 1687867 - protein, 20 aa, Staphylococcus aureus
QRVAIARALVTNPKILLCDE

SEQ ID NO: 1687868 - protein, 25 aa, Staphylococcus aureus
QSASKLYDFSPWKNKSFWGVINNTL

SEQ ID NO: 1687869 - protein, 32 aa, Staphylococcus aureus
QSLVIVIRSVFKYAFKYYDLHDISVLDKIDIP

SEQ ID NO: 1687870 - protein, 27 aa, Staphylococcus aureus
QYKFSKDYYLCELLAHLIEIPQTSYDY

SEQ ID NO: 1687871 - protein, 19 aa, Staphylococcus aureus
RDMLGKYHKLFTDKHDING

SEQ ID NO: 1687872 - protein, 18 aa, Staphylococcus aureus
REFDYIKSLRRLTTKDIE

SEQ ID NO: 1687873 - protein, 20 aa, Staphylococcus aureus
RERQLLLSVDNIECILVKGS

SEQ ID NO: 1687874 - protein, 21 aa, Staphylococcus aureus
REVNDILFFTDLLISDYSSLI

SEQ ID NO: 1687875 - protein, 18 aa, Staphylococcus aureus
RFNVMRSLLAQPRVLICD

SEQ ID NO: 1687876 - protein, 26 aa, Staphylococcus aureus
RFYMKKGFLMIELPSGRALAYPKASV

SEQ ID NO: 1687877 - protein, 17 aa, Staphylococcus aureus
RIEFIPDSYTRKIYNKL

SEQ ID NO: 1687878 - protein, 27 aa, Staphylococcus aureus
RKMMGEYIIYYDGVVIGGLYDNRLLVK

SEQ ID NO: 1687879 - protein, 19 aa, Staphylococcus aureus
RLFAEVYTIPGTECYGNAT

SEQ ID NO: 1687880 - protein, 18 aa, Staphylococcus aureus
RMGDYFLSEYLLEKYRNV

SEQ ID NO: 1687881 - protein, 23 aa, Staphylococcus aureus
RQNHQLLLSIHPNFSRLQLTTKK

SEQ ID NO: 1687882 - protein, 20 aa, Staphylococcus aureus
RRVNFLFGDIVKVTPSSKVV

SEQ ID NO: 1687883 - protein, 22 aa, Staphylococcus aureus
RSLGLDLSIYGKAYELMIRNQD

SEQ ID NO: 1687884 - protein, 23 aa, Staphylococcus aureus
RWSTGKLPYLIELGAIEVSINFR

SEQ ID NO: 1687885 - protein, 28 aa, Staphylococcus aureus
SEEIVYYIYAILHHKYYVNKYSSDLSKG

SEQ ID NO: 1687886 - protein, 25 aa, Staphylococcus aureus
SFGNAVMKWFLDSNIKEIRIFSRDE

SEQ ID NO: 1687887 - protein, 23 aa, Staphylococcus aureus
SFYKKWRPYLRHRDVYHYDLKSF

SEQ ID NO: 1687888 - protein, 24 aa, Staphylococcus aureus
SIGCDLLVIRHPFNNYYEKLANIN

SEQ ID NO: 1687889 - protein, 25 aa, Staphylococcus aureus
SQTLNTAMKGLRDSIANEATIKAGQ

SEQ ID NO: 1687890 - protein, 21 aa, Staphylococcus aureus
SQYDTFILISKHEGLPISIIE

SEQ ID NO: 1687891 - protein, 18 aa, Staphylococcus aureus
SRLIWYNSGPWKRTIVYK

SEQ ID NO: 1687892 - protein, 25 aa, Staphylococcus aureus
STYSKNMFRLLKQYKHTGYLKIHID

SEQ ID NO: 1687893 - protein, 26 aa, Staphylococcus aureus
SYDITSLYTFKQPVSPHLAFKMANQI

SEQ ID NO: 1687894 - protein, 19 aa, Staphylococcus aureus
SYHSLWHQYNNSIFYYYMV

SEQ ID NO: 1687895 - protein, 23 aa, Staphylococcus aureus
TCKECLFYPYLLVQGEAGIGKSH

SEQ ID NO: 1687896 - protein, 35 aa, Staphylococcus aureus
TDDERLVRDFLHDAFFFINIAEIILFIEKQYGIDE

SEQ ID NO: 1687897 - protein, 29 aa, Staphylococcus aureus
TDRRKWRDKFRLPYLLGKADYIFVDDFHP

SEQ ID NO: 1687898 - protein, 21 aa, Staphylococcus aureus
TEGLLKEIEDVYKKARAFDEI

SEQ ID NO: 1687899 - protein, 31 aa, Staphylococcus aureus
TGAQAWVGTLLKMKPVLKFEDGKIIPEEKVR

SEQ ID NO: 1687900 - protein, 17 aa, Staphylococcus aureus
TKEDIARFKEIFIIIYE

SEQ ID NO: 1687901 - protein, 20 aa, Staphylococcus aureus
TKKKDWLDQLKGNIGKKAGE

SEQ ID NO: 1687902 - protein, 18 aa, Staphylococcus aureus
TLGPQFVYVAAYEGGIVA

SEQ ID NO: 1687903 - protein, 21 aa, Staphylococcus aureus
TLMRHIVSFLKTHGYTVATIK

SEQ ID NO: 1687904 - protein, 25 aa, Staphylococcus aureus
TNVKKEHWGFDDPAGKPWSEFQRVR

SEQ ID NO: 1687905 - protein, 28 aa, Staphylococcus aureus
TPKTKGLINAVFFAKAKPSLQIINVARG

SEQ ID NO: 1687906 - protein, 23 aa, Staphylococcus aureus
TSLIQRHFQIGYNRAARIIDQLE

SEQ ID NO: 1687907 - protein, 29 aa, Staphylococcus aureus
TSLNTAMGNLKHALAEKDNTKRSVNYTDA

SEQ ID NO: 1687908 - protein, 17 aa, Staphylococcus aureus
TYLESIKASLKRLEDEI

SEQ ID NO: 1687909 - protein, 24 aa, Staphylococcus aureus
VAKTILENTLIYDFLDTVEFRKKK

SEQ ID NO: 1687910 - protein, 24 aa, Staphylococcus aureus
VARDYALTGLEFACGIPGSIGGAV

SEQ ID NO: 1687911 - protein, 25 aa, Staphylococcus aureus
VDSVKSEFDLLWQKSTPLTEQWINS

SEQ ID NO: 1687912 - protein, 18 aa, Staphylococcus aureus
VIFDLLVEYDGELPFWDK

SEQ ID NO: 1687913 - protein, 30 aa, Staphylococcus aureus
VIFNIETRRYYLMLMLFSKENAMSLNHFSI

SEQ ID NO: 1687914 - protein, 26 aa, Staphylococcus aureus
VKNELLGRYEHYCFKIRELHPESKAN

SEQ ID NO: 1687915 - protein, 26 aa, Staphylococcus aureus
VSENDYFEYIDIKSFLRYDCEVKGNI

SEQ ID NO: 1687916 - protein, 25 aa, Staphylococcus aureus
VSFGYVDWIKLSLGPLARENYYMYK

SEQ ID NO: 1687917 - protein, 17 aa, Staphylococcus aureus
VSLFLLLQMENVQLIGV

SEQ ID NO: 1687918 - protein, 23 aa, Staphylococcus aureus
VSNYHFTVLLGDRQKPLMYLNKN

SEQ ID NO: 1687919 - protein, 25 aa, Staphylococcus aureus
VTATTILVITLQLLGAQVGWHIPNR

SEQ ID NO: 1687920 - protein, 18 aa, Staphylococcus aureus
VTFNPWSERHWLKPTFFD

SEQ ID NO: 1687921 - protein, 22 aa, Staphylococcus aureus
WFMNAHIYLELADDYQALAILP

SEQ ID NO: 1687922 - protein, 19 aa, Staphylococcus aureus
WINTLEFFKNWKKQPGKPL

SEQ ID NO: 1687923 - protein, 20 aa, Staphylococcus aureus
WINTLEFFKNWKKQPGKPLD

SEQ ID NO: 1687924 - protein, 17 aa, Staphylococcus aureus
WMHDKYWVDESVVRIIF

SEQ ID NO: 1687925 - protein, 23 aa, Staphylococcus aureus
WNPKMKKYIFTERNGIYIIDLQK

SEQ ID NO: 1687926 - protein, 29 aa, Staphylococcus aureus
WVNATMRAFKLGVILPVTKEFLNYTYSQF

SEQ ID NO: 1687927 - protein, 26 aa, Staphylococcus aureus
YEQNDLLFIRYPLKDKVLNVHIGVIN

SEQ ID NO: 1687928 - protein, 22 aa, Staphylococcus aureus
YGIDEELQWQWVKGIIEAYQEA

SEQ ID NO: 1687929 - protein, 21 aa, Staphylococcus aureus
YHFNKIYFFENINFTIVTWPR

SEQ ID NO: 1687930 - protein, 26 aa, Staphylococcus aureus
YIDLIEEYGFDLIRGEASFIDDKTIQ

SEQ ID NO: 1687931 - protein, 17 aa, Staphylococcus aureus
YIMHRFDEEARIPFIKH

SEQ ID NO: 1687932 - protein, 20 aa, Staphylococcus aureus
YINSIRTWHNIRAKIIPLSI

SEQ ID NO: 1687933 - protein, 25 aa, Staphylococcus aureus
YKTHIDYVPIFKRRPIEEKEDFETG

SEQ ID NO: 1687934 - protein, 26 aa, Staphylococcus aureus
YLKDFGIDVIWLSPMFKSPNDDNGYD

SEQ ID NO: 1687935 - protein, 17 aa, Staphylococcus aureus
YNLEKEWQEFLNSGKEV

SEQ ID NO: 1687936 - protein, 20 aa, Staphylococcus aureus
YNRGLINELFIKLANEFNIE

SEQ ID NO: 1687937 - protein, 18 aa, Staphylococcus aureus
YPHLDGVLSLDLTTVLIL

SEQ ID NO: 1687938 - protein, 17 aa, Staphylococcus aureus
YQLLLIKMWQLSQIYKP

SEQ ID NO: 1687939 - protein, 30 aa, Staphylococcus aureus
YTFTGPIDRHLFYQFIMKLPESVLRLKGYV

SEQ ID NO: 1687940 - protein, 25 aa, Staphylococcus aureus
AAGTLYNIVGFQTHLKWGAQKEVIK

SEQ ID NO: 1687941 - protein, 21 aa, Staphylococcus aureus
AHSITAIWNFEKQNYYLKNLR

SEQ ID NO: 1687942 - protein, 17 aa, Staphylococcus aureus
AMDKLRQSIADNATTKQ

SEQ ID NO: 1687943 - protein, 19 aa, Staphylococcus aureus
AMLAGYFSKAGNSGQIPVD

SEQ ID NO: 1687944 - protein, 18 aa, Staphylococcus aureus
AQEKLIPEYITIDIAHGH

SEQ ID NO: 1687945 - protein, 25 aa, Staphylococcus aureus
ASAPKNMLLSLILNSDLVSPKDLEE

SEQ ID NO: 1687946 - protein, 25 aa, Staphylococcus aureus
ATQKYNIIKPFILGKQSLSSISKSK

SEQ ID NO: 1687947 - protein, 19 aa, Staphylococcus aureus
AVYTLNQFKAAPLIVTEDT

SEQ ID NO: 1687948 - protein, 18 aa, Staphylococcus aureus
AYFKKCLPGYTLINKLHP

SEQ ID NO: 1687949 - protein, 23 aa, Staphylococcus aureus
CREAGYPCYFTMDAGPNVKILVE

SEQ ID NO: 1687950 - protein, 18 aa, Staphylococcus aureus
CRPAINYYLNMVYPHDHE

SEQ ID NO: 1687951 - protein, 17 aa, Staphylococcus aureus
DDEDKEMFLEDLGIEEP

SEQ ID NO: 1687952 - protein, 24 aa, Staphylococcus aureus
DEDLRDYHIAAQILKYFNIEHINL

SEQ ID NO: 1687953 - protein, 18 aa, Staphylococcus aureus
DGKYARLPVTDKILCMNG

SEQ ID NO: 1687954 - protein, 17 aa, Staphylococcus aureus
DHAYLPIYAIQNHLCEC

SEQ ID NO: 1687955 - protein, 17 aa, Staphylococcus aureus
DIMLLINRINNNILQIP

SEQ ID NO: 1687956 - protein, 24 aa, Staphylococcus aureus
DKPHIVFMMTFPEDIKPIIKALNN

SEQ ID NO: 1687957 - protein, 21 aa, Staphylococcus aureus
DKQGVLRLFLKYGQNDERVIT

SEQ ID NO: 1687958 - protein, 23 aa, Staphylococcus aureus
DMAEIRVFYRDEFLCTAISPDLA

SEQ ID NO: 1687959 - protein, 27 aa, Staphylococcus aureus
DNPFNPPMFARVFRKHLEGGIIESIKQ

SEQ ID NO: 1687960 - protein, 20 aa, Staphylococcus aureus
DRKNYFYPDNPKAYQISQFD

SEQ ID NO: 1687961 - protein, 18 aa, Staphylococcus aureus
DTDYGWNVKLGKNVYVNT

SEQ ID NO: 1687962 - protein, 18 aa, Staphylococcus aureus
DTNPSLIISFYPGYAVHP

SEQ ID NO: 1687963 - protein, 26 aa, Staphylococcus aureus
DTWDVYFNDRRYRNLLGDFEDLITET

SEQ ID NO: 1687964 - protein, 37 aa, Staphylococcus aureus
DVILDWQGKSYFFPSKLAFALFFIKQLEITEHHFVIN

SEQ ID NO: 1687965 - protein, 28 aa, Staphylococcus aureus
DYHDIKSPMIGTFFLQDSKELTEPIVNV

SEQ ID NO: 1687966 - protein, 17 aa, Staphylococcus aureus
DYQLFPNMTVYKNITFM

SEQ ID NO: 1687967 - protein, 25 aa, Staphylococcus aureus
DYQNKPIMYNLDRIVVYMRLRRVGN

SEQ ID NO: 1687968 - protein, 21 aa, Staphylococcus aureus
EATEGLPINVGFTGKGQATNP

SEQ ID NO: 1687969 - protein, 20 aa, Staphylococcus aureus
EDCRRTMDIFRLLGVDIKED

SEQ ID NO: 1687970 - protein, 30 aa, Staphylococcus aureus
EEIFDDLWMNLYYLFKNLRNLFKTEEHEPW

SEQ ID NO: 1687971 - protein, 33 aa, Staphylococcus aureus
EFNQLINWVMDVSNIQYLAIASWGRHIYQNTSR

SEQ ID NO: 1687972 - protein, 24 aa, Staphylococcus aureus
EGHSYSHYLLIEQAINALKDTGYA

SEQ ID NO: 1687973 - protein, 19 aa, Staphylococcus aureus
EGLLKEIEDVYKKAQAFDE

SEQ ID NO: 1687974 - protein, 18 aa, Staphylococcus aureus
EHASVIYKLALKKLDEKI

SEQ ID NO: 1687975 - protein, 29 aa, Staphylococcus aureus
EIFDDLWMNLYYLFKNLRNLFKTEGHEPW

SEQ ID NO: 1687976 - protein, 33 aa, Staphylococcus aureus
EKERMIPYFIQQQYWFLFYHDENYFAVKYSDNG

SEQ ID NO: 1687977 - protein, 27 aa, Staphylococcus aureus
EKGTSYHKILIKNFNLWQAQREDSLLD

SEQ ID NO: 1687978 - protein, 18 aa, Staphylococcus aureus
EKTLNLIDILNPYLCIVF

SEQ ID NO: 1687979 - protein, 17 aa, Staphylococcus aureus
ELIATAPSVIYQCVLRD

SEQ ID NO: 1687980 - protein, 20 aa, Staphylococcus aureus
ELLECFDYLIKHKRHATRKR

SEQ ID NO: 1687981 - protein, 17 aa, Staphylococcus aureus
ELPCIVAYKNNDIVGLL

SEQ ID NO: 1687982 - protein, 21 aa, Staphylococcus aureus
ELPKEYLMPEFLRDIFKEKLL

SEQ ID NO: 1687983 - protein, 26 aa, Staphylococcus aureus
ENVRLKPYFDVLVEKVIYPYRNNEEY

SEQ ID NO: 1687984 - protein, 17 aa, Staphylococcus aureus
EPMYLREIRRKEELNYR

SEQ ID NO: 1687985 - protein, 26 aa, Staphylococcus aureus
ERKDGTFRTVLLPKVMFTNPKIDGET

SEQ ID NO: 1687986 - protein, 18 aa, Staphylococcus aureus
ERRFFNMAMTLEQWEFGG

SEQ ID NO: 1687987 - protein, 21 aa, Staphylococcus aureus
EVLKMPFHYVLSIYQNKNNDI

SEQ ID NO: 1687988 - protein, 18 aa, Staphylococcus aureus
EVLKYIDFNAGNIAKQLL

SEQ ID NO: 1687989 - protein, 24 aa, Staphylococcus aureus
EYIGQFKTGYFSPLANLARLTEEV

SEQ ID NO: 1687990 - protein, 18 aa, Staphylococcus aureus
EYTFLGKEGRFVTLPEYP

SEQ ID NO: 1687991 - protein, 26 aa, Staphylococcus aureus
FASARPIRDLLPVLPSVFHQHTLIGA

SEQ ID NO: 1687992 - protein, 33 aa, Staphylococcus aureus
FDGSYGWQCFDLVNVYWNHLYGHGLKGYGAKDI

SEQ ID NO: 1687993 - protein, 18 aa, Staphylococcus aureus
FHHDALYSDYLIASDYSF

SEQ ID NO: 1687994 - protein, 22 aa, Staphylococcus aureus
FKEGAFYITFSNVTELLSENDD

SEQ ID NO: 1687995 - protein, 23 aa, Staphylococcus aureus
FKRALTRVLNSYGLSSKIMKEDK

SEQ ID NO: 1687996 - protein, 26 aa, Staphylococcus aureus
FSKSIFPSCRVAYMVLPYSIMKKYHS

SEQ ID NO: 1687997 - protein, 34 aa, Staphylococcus aureus
GASKNIIDEKLIPKDYWLSQAPKLNSKQLIDDLK

SEQ ID NO: 1687998 - protein, 24 aa, Staphylococcus aureus
GASMILLIVNILSDKQLKDLYNYA

SEQ ID NO: 1687999 - protein, 23 aa, Staphylococcus aureus
GATVSVIYVPAPFAADSILESAD

SEQ ID NO: 1688000 - protein, 25 aa, Staphylococcus aureus
GDIDQYFLMRYIKQGDILKLRLFRN

SEQ ID NO: 1688001 - protein, 36 aa, Staphylococcus aureus
GEEHLLNLDGIFVQIGLLPSTSWLKDAVELNERGEI

SEQ ID NO: 1688002 - protein, 19 aa, Staphylococcus aureus
GFHYDLFDKVDPKLSKVIQ

SEQ ID NO: 1688003 - protein, 20 aa, Staphylococcus aureus
GFHYDLFDKVDPKLSKVIQD

SEQ ID NO: 1688004 - protein, 27 aa, Staphylococcus aureus
GFKDQEVIWLYQYFSDISLAPTTYTLD

SEQ ID NO: 1688005 - protein, 23 aa, Staphylococcus aureus
GHAMSGILMSRTQAIILAELNKV

SEQ ID NO: 1688006 - protein, 18 aa, Staphylococcus aureus
GIPEMYFYSYVSGATISI

SEQ ID NO: 1688007 - protein, 18 aa, Staphylococcus aureus
GKEDFYFIKLNQFNDDTV

SEQ ID NO: 1688008 - protein, 28 aa, Staphylococcus aureus
GNESTIQPILKEKFISLGLDVKEDEAAK

SEQ ID NO: 1688009 - protein, 51 aa, Staphylococcus aureus
GTINKPYLLEAPFWTVDTLFYCTPKKETDILFILSLFRKINWKVYDESTGV

SEQ ID NO: 1688010 - protein, 26 aa, Staphylococcus aureus
GTLFRKNIYQMIPQEVTPLIPSSLVA

SEQ ID NO: 1688011 - protein, 23 aa, Staphylococcus aureus
GTYYFHGHIVPGWKSVKKTFDTA

SEQ ID NO: 1688012 - protein, 36 aa, Staphylococcus aureus
GVNFYPMHINCRSDCALLPKSMWPKKPNKKRQTKYF

SEQ ID NO: 1688013 - protein, 24 aa, Staphylococcus aureus
HKYPDESELLIYFIEGLMSENQTD

SEQ ID NO: 1688014 - protein, 29 aa, Staphylococcus aureus
IASERIEVLVPLKYLLIGGEVLNAKWVDL

SEQ ID NO: 1688015 - protein, 19 aa, Staphylococcus aureus
IDFIVKFITTHDLNVQAVC

SEQ ID NO: 1688016 - protein, 19 aa, Staphylococcus aureus
IDFIVVTAALDIELLRSLV

SEQ ID NO: 1688017 - protein, 20 aa, Staphylococcus aureus
IDGGKFYQRPASIIAIYSAK

SEQ ID NO: 1688018 - protein, 30 aa, Staphylococcus aureus
IDLKAHGLTPRLHLFMEDGSIFKNEPLIMD

SEQ ID NO: 1688019 - protein, 29 aa, Staphylococcus aureus
IDNYDGHLLIQWYSKGIYKFKYAILEAVR

SEQ ID NO: 1688020 - protein, 18 aa, Staphylococcus aureus
IDPKLRQQIWQQFKQMTK

SEQ ID NO: 1688021 - protein, 23 aa, Staphylococcus aureus
IDPKLRQQIWQQFKQMTKDGKSV

SEQ ID NO: 1688022 - protein, 20 aa, Staphylococcus aureus
IDVAFVPGAFEIPLVAKKLA

SEQ ID NO: 1688023 - protein, 20 aa, Staphylococcus aureus
IEENKYVFVLKHSETCPISA

SEQ ID NO: 1688024 - protein, 26 aa, Staphylococcus aureus
IEIAARFLYLNKTGFNGLYRVNSQGK

SEQ ID NO: 1688025 - protein, 17 aa, Staphylococcus aureus
IEIFIPNDNKILLTIMN

SEQ ID NO: 1688026 - protein, 19 aa, Staphylococcus aureus
IEIQPKFELLPKLDKQRKI

SEQ ID NO: 1688027 - protein, 20 aa, Staphylococcus aureus
IENIIFKLADQGVAIMWITH

SEQ ID NO: 1688028 - protein, 25 aa, Staphylococcus aureus
IETLPDDMIWFDLSDRDQYTFPVPM

SEQ ID NO: 1688029 - protein, 28 aa, Staphylococcus aureus
IETYSKALLGLVIPLVTKYGIALEAHLQ

SEQ ID NO: 1688030 - protein, 23 aa, Staphylococcus aureus
IEYIADFALYLDDKLIEVIDIKG

SEQ ID NO: 1688031 - protein, 18 aa, Staphylococcus aureus
IEYPVIPSAVFTVPKMAS

SEQ ID NO: 1688032 - protein, 18 aa, Staphylococcus aureus
IFKNSWFKVYRMFDELRE

SEQ ID NO: 1688033 - protein, 19 aa, Staphylococcus aureus
IFVTIIRSFSHFSNQLYPP

SEQ ID NO: 1688034 - protein, 23 aa, Staphylococcus aureus
IGGLYDNRLLVKATKSVRHQLQD

SEQ ID NO: 1688035 - protein, 21 aa, Staphylococcus aureus
IIGELLMCDIIDAFINAEYKA

SEQ ID NO: 1688036 - protein, 22 aa, Staphylococcus aureus
IIGELLMCDIIDAFINAEYKAT

SEQ ID NO: 1688037 - protein, 34 aa, Staphylococcus aureus
IIWSIATFYYSRMMKIMNLAILKIKIGGVNMVNI

SEQ ID NO: 1688038 - protein, 19 aa, Staphylococcus aureus
IKRICELLEIPPTKVGRYF

SEQ ID NO: 1688039 - protein, 20 aa, Staphylococcus aureus
IKRVIVHLPNFESDTDTFVA

SEQ ID NO: 1688040 - protein, 19 aa, Staphylococcus aureus
IMCLHYEGILQERLDELGE

SEQ ID NO: 1688041 - protein, 21 aa, Staphylococcus aureus
INLEQIYPIYLDCFKKAKKMI

SEQ ID NO: 1688042 - protein, 25 aa, Staphylococcus aureus
INTENYFVPYLATPEGYFVQVSVTV

SEQ ID NO: 1688043 - protein, 17 aa, Staphylococcus aureus
IVHLIEYGHVQKGTGKF

SEQ ID NO: 1688044 - protein, 17 aa, Staphylococcus aureus
IYQDESTPIWIYTENPN

SEQ ID NO: 1688045 - protein, 27 aa, Staphylococcus aureus
KDKAIQSINQALANKLKEIEASNATDQ

SEQ ID NO: 1688046 - protein, 18 aa, Staphylococcus aureus
KDRYKIVHLIEYGHVQKG

SEQ ID NO: 1688047 - protein, 18 aa, Staphylococcus aureus
KEAAMLAGYFSKAGNSGQ

SEQ ID NO: 1688048 - protein, 24 aa, Staphylococcus aureus
KEFIDIPVLFDDEGNFRIKQVIDY

SEQ ID NO: 1688049 - protein, 17 aa, Staphylococcus aureus
KEKYSLFDITHQPELCA

SEQ ID NO: 1688050 - protein, 17 aa, Staphylococcus aureus
KEPYRIGLKLSNGGWVY

SEQ ID NO: 1688051 - protein, 37 aa, Staphylococcus aureus
KETKDGYYLVYLFHPEGEGIYLSLNQGWSKISDMFPR

SEQ ID NO: 1688052 - protein, 17 aa, Staphylococcus aureus
KEYYLDYFGLEQSAYMD

SEQ ID NO: 1688053 - protein, 19 aa, Staphylococcus aureus
KFVRFQYRTGEITYGNEMQ

SEQ ID NO: 1688054 - protein, 22 aa, Staphylococcus aureus
KGHTVAFMHIPMLMDRIKATYN

SEQ ID NO: 1688055 - protein, 19 aa, Staphylococcus aureus
KKDYGLYWVKSQGYDIVLE

SEQ ID NO: 1688056 - protein, 19 aa, Staphylococcus aureus
KKKDWLDQLKGNIGKKAGE

SEQ ID NO: 1688057 - protein, 24 aa, Staphylococcus aureus
KKMQQWEPSYVDRGFIFTTCQGNP

SEQ ID NO: 1688058 - protein, 34 aa, Staphylococcus aureus
KKYLKMNFDLKWEYYLRLFLNLISAQNNSAILKE

SEQ ID NO: 1688059 - protein, 20 aa, Staphylococcus aureus
KLRQQIWQQFKQMTKDGKSV

SEQ ID NO: 1688060 - protein, 21 aa, Staphylococcus aureus
KLSEYQLLTQFNPAFINKKIK

SEQ ID NO: 1688061 - protein, 19 aa, Staphylococcus aureus
KLVKLTLTNNKILIGKVID

SEQ ID NO: 1688062 - protein, 17 aa, Staphylococcus aureus
KMGPYIKGMPFGHEFSG

SEQ ID NO: 1688063 - protein, 17 aa, Staphylococcus aureus
KMNQDLLAKCYLSCLKL

SEQ ID NO: 1688064 - protein, 24 aa, Staphylococcus aureus
KNYPSLDILIAMSDLFGITLDHLI

SEQ ID NO: 1688065 - protein, 22 aa, Staphylococcus aureus
KQLRKRYDIPTKKAPKLLIKGD

SEQ ID NO: 1688066 - protein, 27 aa, Staphylococcus aureus
KQNIDQATKLQPIAELVDQATQLNQSM

SEQ ID NO: 1688067 - protein, 23 aa, Staphylococcus aureus
KRSEKLLHGMWQFPMFESEHARR

SEQ ID NO: 1688068 - protein, 23 aa, Staphylococcus aureus
KSIDSLLSIVQMPGGIPVATTAI

SEQ ID NO: 1688069 - protein, 25 aa, Staphylococcus aureus
KTKEGLFTKGLRRRAKLLETILKNT

SEQ ID NO: 1688070 - protein, 30 aa, Staphylococcus aureus
KTTAINLIYRIMKYDWANILVVRRFSNTNK

SEQ ID NO: 1688071 - protein, 26 aa, Staphylococcus aureus
KTVHIALMHDWLKGKIIVDSLGLHSN

SEQ ID NO: 1688072 - protein, 20 aa, Staphylococcus aureus
KYIIHTVGPQIRRLPVSKMN

SEQ ID NO: 1688073 - protein, 20 aa, Staphylococcus aureus
KYNHYLFNAELFKHFKKDAV

SEQ ID NO: 1688074 - protein, 22 aa, Staphylococcus aureus
LDELVATEYPVLLATSRKRFTK

SEQ ID NO: 1688075 - protein, 23 aa, Staphylococcus aureus
LENKVVGFIGELHPILAADNDLK

SEQ ID NO: 1688076 - protein, 29 aa, Staphylococcus aureus
LIMDDVVKGFITYKIPKKVIKHAGYVRCK

SEQ ID NO: 1688077 - protein, 17 aa, Staphylococcus aureus
LISLKKDIGYLLLDVNQ

SEQ ID NO: 1688078 - protein, 29 aa, Staphylococcus aureus
LKALQDWKYPRRILWLRKVQSTIKDSLFE

SEQ ID NO: 1688079 - protein, 19 aa, Staphylococcus aureus
LKLNLQHFADTGVSGIAIG

SEQ ID NO: 1688080 - protein, 21 aa, Staphylococcus aureus
LNDFIRIYADTLPNNEICLSD

SEQ ID NO: 1688081 - protein, 25 aa, Staphylococcus aureus
LNHRERLWLKLYLEGYKQFEIAEIM

SEQ ID NO: 1688082 - protein, 19 aa, Staphylococcus aureus
LPGKYFIFKDLQIEEYQSK

SEQ ID NO: 1688083 - protein, 20 aa, Staphylococcus aureus
LRENLFMNNRYKNVLDYILG

SEQ ID NO: 1688084 - protein, 18 aa, Staphylococcus aureus
LSAKYIIHTVGPQIRRLP

SEQ ID NO: 1688085 - protein, 17 aa, Staphylococcus aureus
LSLIPNVTCNYIKTKLE

SEQ ID NO: 1688086 - protein, 20 aa, Staphylococcus aureus
LSNVTVYALAKLYDIEVDQI

SEQ ID NO: 1688087 - protein, 19 aa, Staphylococcus aureus
LSTLYRWNKLYKEQGLTGL

SEQ ID NO: 1688088 - protein, 20 aa, Staphylococcus aureus
LYFEHKKAYRFLKEEVPEEY

SEQ ID NO: 1688089 - protein, 28 aa, Staphylococcus aureus
MGREHYYMYKKFGIWPEKEYAINWVEKI

SEQ ID NO: 1688090 - protein, 23 aa, Staphylococcus aureus
MHQIRVLRELDFHFQLVIDANES

SEQ ID NO: 1688091 - protein, 18 aa, Staphylococcus aureus
MKFYRQCELGWDDEINFA

SEQ ID NO: 1688092 - protein, 26 aa, Staphylococcus aureus
MNNVPLKSFYVVDLSELYIAMDAMHD

SEQ ID NO: 1688093 - protein, 22 aa, Staphylococcus aureus
NAKDLINQTGNPTLDKSQVEQL

SEQ ID NO: 1688094 - protein, 18 aa, Staphylococcus aureus
NDFAIYHEPFLGGGATLL

SEQ ID NO: 1688095 - protein, 27 aa, Staphylococcus aureus
NDKQYFPATHWKAINGIPYAGSSDIDG

SEQ ID NO: 1688096 - protein, 25 aa, Staphylococcus aureus
NDMDWIKKNYDLYSKLIAGAIHGKP

SEQ ID NO: 1688097 - protein, 25 aa, Staphylococcus aureus
NDTLKLQRMGVLPKFHGGTKKKKWM

SEQ ID NO: 1688098 - protein, 17 aa, Staphylococcus aureus
NEIAFKKFDSHLLSISE

SEQ ID NO: 1688099 - protein, 25 aa, Staphylococcus aureus
NFEEKLRYFLIEDYNQKEHSAIQST

SEQ ID NO: 1688100 - protein, 27 aa, Staphylococcus aureus
NFSTQLLDRFLVIAHSYQLNARILVTK

SEQ ID NO: 1688101 - protein, 20 aa, Staphylococcus aureus
NFVRGAHLHFQLMQGSHPGN

SEQ ID NO: 1688102 - protein, 21 aa, Staphylococcus aureus
NFVRGAHLHFQLMQGSHPGND

SEQ ID NO: 1688103 - protein, 29 aa, Staphylococcus aureus
NIQIWKKPSSFVIKPLPKNKYPDSIEDST

SEQ ID NO: 1688104 - protein, 29 aa, Staphylococcus aureus
NIVEKMVKGRLRKYLQEICAVDQDFVKNP

SEQ ID NO: 1688105 - protein, 21 aa, Staphylococcus aureus
NKAYEMLQGYGFPVISRKEMQ

SEQ ID NO: 1688106 - protein, 24 aa, Staphylococcus aureus
NKIFECIHAGLPVILSPVKEHIYL

SEQ ID NO: 1688107 - protein, 18 aa, Staphylococcus aureus
NLTHLNDAQKQSFESQIT

SEQ ID NO: 1688108 - protein, 27 aa, Staphylococcus aureus
NLTRLSIFIFIINILNQLRGIVIYQND

SEQ ID NO: 1688109 - protein, 31 aa, Staphylococcus aureus
NMLADPERLKHWLPVDLYIGGVEHAVLHLLY

SEQ ID NO: 1688110 - protein, 20 aa, Staphylococcus aureus
NQFKLIFEFMNITNYRFLIG

SEQ ID NO: 1688111 - protein, 28 aa, Staphylococcus aureus
NRPEQGLLKLRKSLNLFVNIRPTTVVKG

SEQ ID NO: 1688112 - protein, 22 aa, Staphylococcus aureus
NTKIKEFWNGDIPWIQSSDVKV

SEQ ID NO: 1688113 - protein, 26 aa, Staphylococcus aureus
NVLANHQIIVYLPDTYKTTPELSFAV

SEQ ID NO: 1688114 - protein, 22 aa, Staphylococcus aureus
NYIAQYPNRFVGFATLPINEPE

SEQ ID NO: 1688115 - protein, 17 aa, Staphylococcus aureus
PCIVAYKNNDIVGLLTY

SEQ ID NO: 1688116 - protein, 22 aa, Staphylococcus aureus
PGDIVPIYLKKNPNFKFPMKQD

SEQ ID NO: 1688117 - protein, 17 aa, Staphylococcus aureus
PGIYPFMSGYENLKLLN

SEQ ID NO: 1688118 - protein, 18 aa, Staphylococcus aureus
PHLFNVPQKHPRGRYACY

SEQ ID NO: 1688119 - protein, 26 aa, Staphylococcus aureus
PILLKVNHLYGYFISLDLTYSSVEVM

SEQ ID NO: 1688120 - protein, 23 aa, Staphylococcus aureus
PISKFRIRKVLPQKIKNPVIDSS

SEQ ID NO: 1688121 - protein, 24 aa, Staphylococcus aureus
PKITNMGALWPTLGTIPTSSFTPE

SEQ ID NO: 1688122 - protein, 31 aa, Staphylococcus aureus
PKLNLENALKIELEFYFTPPKSWSKKKKTQA

SEQ ID NO: 1688123 - protein, 22 aa, Staphylococcus aureus
PLLDKFMKDLIIQILAMISEQE

SEQ ID NO: 1688124 - protein, 18 aa, Staphylococcus aureus
PLNNDILLKFDRLSVDYT

SEQ ID NO: 1688125 - protein, 17 aa, Staphylococcus aureus
PNFYRQCKLGWDNEINF

SEQ ID NO: 1688126 - protein, 18 aa, Staphylococcus aureus
PNLKLYIDGDIKGSSVGY

SEQ ID NO: 1688127 - protein, 23 aa, Staphylococcus aureus
QDNWTYPPFQLTEKDDKLYGRGT

SEQ ID NO: 1688128 - protein, 24 aa, Staphylococcus aureus
QDNWTYPPFQLTEKDDKLYGRGTT

SEQ ID NO: 1688129 - protein, 22 aa, Staphylococcus aureus
QECARLLKKWGLPANRNTIRLH

SEQ ID NO: 1688130 - protein, 17 aa, Staphylococcus aureus
QLVLLDINLPTLNGFHW

SEQ ID NO: 1688131 - protein, 30 aa, Staphylococcus aureus
QNDPELVEKLIFMLGWDPQSPVPINDHGDT

SEQ ID NO: 1688132 - protein, 21 aa, Staphylococcus aureus
QNHQLLLSIHPNFSRLQLTTK

SEQ ID NO: 1688133 - protein, 24 aa, Staphylococcus aureus
QPMSVTFEFQLNHRIYKVHRQGPY

SEQ ID NO: 1688134 - protein, 31 aa, Staphylococcus aureus
QPSPDCLMLFQHHNLLPWKTINDNIRIGFQQ

SEQ ID NO: 1688135 - protein, 23 aa, Staphylococcus aureus
QRQLVCEILSQQQLRYFFSHNHS

SEQ ID NO: 1688136 - protein, 20 aa, Staphylococcus aureus
QVELLDIKLTPENLAGMIKL

SEQ ID NO: 1688137 - protein, 25 aa, Staphylococcus aureus
RAESFDILPLFISSRNKQIEYWSSD

SEQ ID NO: 1688138 - protein, 23 aa, Staphylococcus aureus
RCAMQNLKPLFDSPARIVISHGN

SEQ ID NO: 1688139 - protein, 23 aa, Staphylococcus aureus
RGSFIMRYLLDGRVPNLPLAICY

SEQ ID NO: 1688140 - protein, 17 aa, Staphylococcus aureus
RGYLNIDSFNKTLEQPV

SEQ ID NO: 1688141 - protein, 18 aa, Staphylococcus aureus
RHPYVSVTGFVRPPYSKD

SEQ ID NO: 1688142 - protein, 19 aa, Staphylococcus aureus
RHRLHKVETLRANWIQTTG

SEQ ID NO: 1688143 - protein, 34 aa, Staphylococcus aureus
RLILDKVGNKKPLRRLWISSVTKKAIQQGFKNLK

SEQ ID NO: 1688144 - protein, 20 aa, Staphylococcus aureus
RLNNQITSIIFKYLQENGIE

SEQ ID NO: 1688145 - protein, 25 aa, Staphylococcus aureus
RNIKKIYIQNPPKRVFQSLNSFHDS

SEQ ID NO: 1688146 - protein, 38 aa, Staphylococcus aureus
RPKAKMPSQLFQFFMSYLLARFDISLATLLGVHQGLGH

SEQ ID NO: 1688147 - protein, 17 aa, Staphylococcus aureus
RQLGRFLQKKGYTSYAP

SEQ ID NO: 1688148 - protein, 27 aa, Staphylococcus aureus
RQLNDKSLPLIVTTIQKMAKAIQGNAP

SEQ ID NO: 1688149 - protein, 24 aa, Staphylococcus aureus
RQNHQLLLSIHPNFSRLQLTTKKY

SEQ ID NO: 1688150 - protein, 18 aa, Staphylococcus aureus
RRVGNKFSIKTWKFDHIK

SEQ ID NO: 1688151 - protein, 24 aa, Staphylococcus aureus
RSNLVMMGVLPLEFKKGESADSLG

SEQ ID NO: 1688152 - protein, 17 aa, Staphylococcus aureus
RWVTSDVLPAIRKHGIY

SEQ ID NO: 1688153 - protein, 17 aa, Staphylococcus aureus
SADDLCDYFKEKQIKHV

SEQ ID NO: 1688154 - protein, 24 aa, Staphylococcus aureus
SDGSIINTFGIPSVILGVGYEKIH

SEQ ID NO: 1688155 - protein, 18 aa, Staphylococcus aureus
SDIHYLLKRFEGEKNHKG

SEQ ID NO: 1688156 - protein, 19 aa, Staphylococcus aureus
SEKETYLESIKASLKRLED

SEQ ID NO: 1688157 - protein, 29 aa, Staphylococcus aureus
SFNKTLEQPVLYPGWNRFKSNKVMKQITF

SEQ ID NO: 1688158 - protein, 21 aa, Staphylococcus aureus
SISIPFDTDYGWNVKLGKNVY

SEQ ID NO: 1688159 - protein, 17 aa, Staphylococcus aureus
SKTPKLLFKGSGDIKGS

SEQ ID NO: 1688160 - protein, 22 aa, Staphylococcus aureus
SMASFLNSFPMFKDDTRNTHPK

SEQ ID NO: 1688161 - protein, 18 aa, Staphylococcus aureus
SQVTNAKGALNGNHNLEQ

SEQ ID NO: 1688162 - protein, 19 aa, Staphylococcus aureus
SSHILRHSHISLLSQQGVS

SEQ ID NO: 1688163 - protein, 17 aa, Staphylococcus aureus
STLTTLILKELGVKKVT

SEQ ID NO: 1688164 - protein, 22 aa, Staphylococcus aureus
SVMPGFDFYFVPTVLNSTDVAF

SEQ ID NO: 1688165 - protein, 18 aa, Staphylococcus aureus
SYMVMFEFKGHRIVAFKG

SEQ ID NO: 1688166 - protein, 17 aa, Staphylococcus aureus
TFSPLLLDTLYHLNETT

SEQ ID NO: 1688167 - protein, 23 aa, Staphylococcus aureus
TIDMYTFGRYFPTLKELPKEYLM

SEQ ID NO: 1688168 - protein, 19 aa, Staphylococcus aureus
TLKIAVSVLIRAIFLKINA

SEQ ID NO: 1688169 - protein, 22 aa, Staphylococcus aureus
TLMRHIVSFLKTHGYTVATIKH

SEQ ID NO: 1688170 - protein, 23 aa, Staphylococcus aureus
TMYHSPIRLLVVIQAPDYVVARL

SEQ ID NO: 1688171 - protein, 24 aa, Staphylococcus aureus
TNIDFMSDYYFYLIEIGQMEQAIT

SEQ ID NO: 1688172 - protein, 24 aa, Staphylococcus aureus
TNISEAAYLLWLLSRNNIGFTDLK

SEQ ID NO: 1688173 - protein, 18 aa, Staphylococcus aureus
TNPKILLCDEATSALDPA

SEQ ID NO: 1688174 - protein, 23 aa, Staphylococcus aureus
TSDDIGLFIPHQANIRIMESARE

SEQ ID NO: 1688175 - protein, 23 aa, Staphylococcus aureus
TSPVQIIYVLTEKGKALAEALHP

SEQ ID NO: 1688176 - protein, 26 aa, Staphylococcus aureus
TTEFEDLLYMVDGTYYYAVYFDSHVD

SEQ ID NO: 1688177 - protein, 31 aa, Staphylococcus aureus
TTLHTSLIEMIDYFKALFPNGGLYIHLDQAT

SEQ ID NO: 1688178 - protein, 29 aa, Staphylococcus aureus
TTNERMPIKSLNLLASQVLEIIKIVARQS

SEQ ID NO: 1688179 - protein, 23 aa, Staphylococcus aureus
TTVKPLKTLMLLHGLSSDETTYM

SEQ ID NO: 1688180 - protein, 19 aa, Staphylococcus aureus
TVTPGPWHIHRMLEATEGL

SEQ ID NO: 1688181 - protein, 28 aa, Staphylococcus aureus
VAKRAQSFGMKILAFDPYLTDEKAKSLS

SEQ ID NO: 1688182 - protein, 17 aa, Staphylococcus aureus
VDATYRTFYQHILVYEV

SEQ ID NO: 1688183 - protein, 22 aa, Staphylococcus aureus
VELKIWERWLHKQGYKDIHLDI

SEQ ID NO: 1688184 - protein, 24 aa, Staphylococcus aureus
VFSRIDSCIKFLYLTQEEKQKVIE

SEQ ID NO: 1688185 - protein, 22 aa, Staphylococcus aureus
VGAPTQMLISAKILAKRLMQVR

SEQ ID NO: 1688186 - protein, 34 aa, Staphylococcus aureus
VGSTLYLNESLDQFILLIFYGTFPGGDFTEFGNP

SEQ ID NO: 1688187 - protein, 17 aa, Staphylococcus aureus
VILFAPTFRGNGHGTAH

SEQ ID NO: 1688188 - protein, 23 aa, Staphylococcus aureus
VKEANLKIIYWLQGTGVVSINLQ

SEQ ID NO: 1688189 - protein, 18 aa, Staphylococcus aureus
VKQGVNFTDADKAKRDAY

SEQ ID NO: 1688190 - protein, 17 aa, Staphylococcus aureus
VLDSLRYAIYTHTKPER

SEQ ID NO: 1688191 - protein, 20 aa, Staphylococcus aureus
VLEGLEFMGVYWDPKKNENL

SEQ ID NO: 1688192 - protein, 20 aa, Staphylococcus aureus
VSIESLIEFCRLAQLPKNEN

SEQ ID NO: 1688193 - protein, 17 aa, Staphylococcus aureus
WAFKKVWGTYLSEKIGE

SEQ ID NO: 1688194 - protein, 19 aa, Staphylococcus aureus
YAIRLLEDKALYNKLQKNM

SEQ ID NO: 1688195 - protein, 22 aa, Staphylococcus aureus
YHDKKFILMTAHRRENIGKPME

SEQ ID NO: 1688196 - protein, 18 aa, Staphylococcus aureus
YHLVVRILSKMITPQVID

SEQ ID NO: 1688197 - protein, 17 aa, Staphylococcus aureus
YLNMLIEHGEMAELFGL

SEQ ID NO: 1688198 - protein, 19 aa, Staphylococcus aureus
YMISMFIPDNDFMASLVSD

SEQ ID NO: 1688199 - protein, 24 aa, Staphylococcus aureus
YMSRLMNPVRFLDYLDVSKLNGGE

SEQ ID NO: 1688200 - protein, 18 aa, Staphylococcus aureus
YRYLERYTDPLTGKYKTV

SEQ ID NO: 1688201 - protein, 17 aa, Staphylococcus aureus
YVLMTYYNIICHYGEQA

SEQ ID NO: 1688202 - protein, 18 aa, Staphylococcus aureus
YVMSLQEQLELEDCEKYT

SEQ ID NO: 1688203 - protein, 24 aa, Staphylococcus aureus
ADKITWNWKGVFYPNPEKAIRVRK

SEQ ID NO: 1688204 - protein, 17 aa, Staphylococcus aureus
AFRNNFLDVLLIKMPQK

SEQ ID NO: 1688205 - protein, 39 aa, Staphylococcus aureus
AGNMTKFWEIFYERIDVLHDALLYRINRLKDAVPNNAPI

SEQ ID NO: 1688206 - protein, 17 aa, Staphylococcus aureus
AGRRILLKEVRDSIFRE

SEQ ID NO: 1688207 - protein, 21 aa, Staphylococcus aureus
AHQIALKYNLPTIAVLAFGHQ

SEQ ID NO: 1688208 - protein, 23 aa, Staphylococcus aureus
AIPKLFDYIHKRYAKLSLEDLIN

SEQ ID NO: 1688209 - protein, 18 aa, Staphylococcus aureus
AIRLLEDKALYNKLQKNM

SEQ ID NO: 1688210 - protein, 24 aa, Staphylococcus aureus
AIYTIAAMAPCPYIYAELAKRSQS

SEQ ID NO: 1688211 - protein, 24 aa, Staphylococcus aureus
AKETAKRALASYSNLNNAQSTAAT

SEQ ID NO: 1688212 - protein, 25 aa, Staphylococcus aureus
ALGKAQELNLPTSLVDRFLGDSDED

SEQ ID NO: 1688213 - protein, 18 aa, Staphylococcus aureus
ALMDMVVQGLNPAKNQGY

SEQ ID NO: 1688214 - protein, 25 aa, Staphylococcus aureus
AMENNYACILLDLMLPEMDGIQVAT

SEQ ID NO: 1688215 - protein, 20 aa, Staphylococcus aureus
AMITDILPNFQFIGNGKGFA

SEQ ID NO: 1688216 - protein, 19 aa, Staphylococcus aureus
AREFDYIKSLRRLTTKDIE

SEQ ID NO: 1688217 - protein, 19 aa, Staphylococcus aureus
ARLVYNKCSSYLHGSDAIL

SEQ ID NO: 1688218 - protein, 22 aa, Staphylococcus aureus
ARRHGFISAVPLREIVEAYNYG

SEQ ID NO: 1688219 - protein, 23 aa, Staphylococcus aureus
ASYISDFINGYFLGNPIQYQDDD

SEQ ID NO: 1688220 - protein, 29 aa, Staphylococcus aureus
ATELNTAMTALKRAIADKADTKASGNYVN

SEQ ID NO: 1688221 - protein, 22 aa, Staphylococcus aureus
AVKCIFFNQPYLKKKIELNQTI

SEQ ID NO: 1688222 - protein, 24 aa, Staphylococcus aureus
DDYNNFIMISYMKDKVNALYTNQN

SEQ ID NO: 1688223 - protein, 27 aa, Staphylococcus aureus
DFKLNLMLNAFSSDFYYFVKNNQKLTK

SEQ ID NO: 1688224 - protein, 23 aa, Staphylococcus aureus
DFNEYVIVILDKSTIGEKIRLDI

SEQ ID NO: 1688225 - protein, 17 aa, Staphylococcus aureus
DFRGLQCPGPIVNISKE

SEQ ID NO: 1688226 - protein, 18 aa, Staphylococcus aureus
DGAMQRLQSAIANKDQTK

SEQ ID NO: 1688227 - protein, 20 aa, Staphylococcus aureus
DITISLLPRALDRHKIHNEW

SEQ ID NO: 1688228 - protein, 29 aa, Staphylococcus aureus
DKELNYTLKLFNQVFKIIKSMMKEERYHT

SEQ ID NO: 1688229 - protein, 21 aa, Staphylococcus aureus
DKQAFELDYVDGRQLFVGLVS

SEQ ID NO: 1688230 - protein, 21 aa, Staphylococcus aureus
DNVFLINYLKKRQNSFLSMLK

SEQ ID NO: 1688231 - protein, 20 aa, Staphylococcus aureus
DQAFDRLKLNIFISLAELES

SEQ ID NO: 1688232 - protein, 21 aa, Staphylococcus aureus
DQKVIDWLWETQDKSFFSSKE

SEQ ID NO: 1688233 - protein, 26 aa, Staphylococcus aureus
DRDDKFYYNRLKYYKERVLVPLAYIN

SEQ ID NO: 1688234 - protein, 20 aa, Staphylococcus aureus
DTNWPVCGIPEKFYTDHGSD

SEQ ID NO: 1688235 - protein, 24 aa, Staphylococcus aureus
DTRVKIAYVLSLEGELCVCDVANI

SEQ ID NO: 1688236 - protein, 19 aa, Staphylococcus aureus
DTVLQTRWTQKGRLKIHEI

SEQ ID NO: 1688237 - protein, 18 aa, Staphylococcus aureus
DVAFVPGAFEIPLVAKKL

SEQ ID NO: 1688238 - protein, 18 aa, Staphylococcus aureus
DVDIIPIGGLPDGSIGTS

SEQ ID NO: 1688239 - protein, 17 aa, Staphylococcus aureus
DVPAYDLGATLIEHIIK

SEQ ID NO: 1688240 - protein, 17 aa, Staphylococcus aureus
DYREVNDILFFTDLLIS

SEQ ID NO: 1688241 - protein, 19 aa, Staphylococcus aureus
EAAEGLPINVGFTGKGQAT

SEQ ID NO: 1688242 - protein, 24 aa, Staphylococcus aureus
EAEKLYLTLHLLSTSVQWTDLQES

SEQ ID NO: 1688243 - protein, 24 aa, Staphylococcus aureus
EAPMFKKILKKHQLLDDAFRATQQ

SEQ ID NO: 1688244 - protein, 20 aa, Staphylococcus aureus
EFFILFMNIMYSKDFLKYRF

SEQ ID NO: 1688245 - protein, 27 aa, Staphylococcus aureus
EGAKNAVLPILTASLLASDKPSKLVNV

SEQ ID NO: 1688246 - protein, 19 aa, Staphylococcus aureus
EGTLTGRVKFIFQPAEELG

SEQ ID NO: 1688247 - protein, 27 aa, Staphylococcus aureus
EHSKAILNLPIRTWFDKAESEILAREL

SEQ ID NO: 1688248 - protein, 17 aa, Staphylococcus aureus
EIRLWDILQTNFKAKAL

SEQ ID NO: 1688249 - protein, 24 aa, Staphylococcus aureus
EKNVAPLELALSSGATFVAQGFSS

SEQ ID NO: 1688250 - protein, 25 aa, Staphylococcus aureus
ELAKNYNIPLYLGKTLSNVKGTWII

SEQ ID NO: 1688251 - protein, 17 aa, Staphylococcus aureus
ELFDFYYDLFKSDDDTY

SEQ ID NO: 1688252 - protein, 25 aa, Staphylococcus aureus
ELLGRYEFYRFRLNELQIESRANKA

SEQ ID NO: 1688253 - protein, 17 aa, Staphylococcus aureus
ELNTAMGQLQHGIDDEN

SEQ ID NO: 1688254 - protein, 17 aa, Staphylococcus aureus
EMFLGNKARLDMLEQLQ

SEQ ID NO: 1688255 - protein, 20 aa, Staphylococcus aureus
ENALNGDANLQRAKTEATQA

SEQ ID NO: 1688256 - protein, 30 aa, Staphylococcus aureus
ENKFDVEYGFYILFIKPIFEIVFSSNYVKE

SEQ ID NO: 1688257 - protein, 23 aa, Staphylococcus aureus
ENTIVEFATINPVAIFGPSLDAH

SEQ ID NO: 1688258 - protein, 17 aa, Staphylococcus aureus
ENYYMYKKFGVLPEMEY

SEQ ID NO: 1688259 - protein, 18 aa, Staphylococcus aureus
EPKIKLYVSLKCPNFDDV

SEQ ID NO: 1688260 - protein, 22 aa, Staphylococcus aureus
EQRKKIFAMCRDIELHWGEPVE

SEQ ID NO: 1688261 - protein, 24 aa, Staphylococcus aureus
ERMNEYFNWLKQNYIFKELDSSTE

SEQ ID NO: 1688262 - protein, 17 aa, Staphylococcus aureus
ESDIIIFSTPLYWYSMS

SEQ ID NO: 1688263 - protein, 19 aa, Staphylococcus aureus
ESIPYVIDPVMLAKSGDSL

SEQ ID NO: 1688264 - protein, 18 aa, Staphylococcus aureus
FDDAKRLANTLLNSDNTN

SEQ ID NO: 1688265 - protein, 19 aa, Staphylococcus aureus
FDILLNHPLIDEEVANSLI

SEQ ID NO: 1688266 - protein, 17 aa, Staphylococcus aureus
FEHNPINFDFTFDEEPN

SEQ ID NO: 1688267 - protein, 18 aa, Staphylococcus aureus
FIMSIYGKISFIKMIDFK

SEQ ID NO: 1688268 - protein, 19 aa, Staphylococcus aureus
FKELVNLFNERYDIIIVDT

SEQ ID NO: 1688269 - protein, 18 aa, Staphylococcus aureus
FKEMEEIGLSTGLPLVLH

SEQ ID NO: 1688270 - protein, 17 aa, Staphylococcus aureus
FMLRYKDKCLIIDAKFY

SEQ ID NO: 1688271 - protein, 18 aa, Staphylococcus aureus
FMNELKINLLEFRQQMDL

SEQ ID NO: 1688272 - protein, 28 aa, Staphylococcus aureus
FNSTNDLLTWLQDPFIKDMPGKRVNISD

SEQ ID NO: 1688273 - protein, 17 aa, Staphylococcus aureus
FPLFGMAVGEPAEDENG

SEQ ID NO: 1688274 - protein, 20 aa, Staphylococcus aureus
FQTHLKWGAQKEVIKLIPGL

SEQ ID NO: 1688275 - protein, 26 aa, Staphylococcus aureus
FSEDPNYILNLLLSVITVSMKTLGLI

SEQ ID NO: 1688276 - protein, 21 aa, Staphylococcus aureus
FSSDFYYFVKHNQKLTKQQFL

SEQ ID NO: 1688277 - protein, 18 aa, Staphylococcus aureus
FSTPFILLNGNPMYHVDL

SEQ ID NO: 1688278 - protein, 19 aa, Staphylococcus aureus
FVRGAHLHFQLMQGSHPGN

SEQ ID NO: 1688279 - protein, 17 aa, Staphylococcus aureus
FVYVPKNVVVEHPVQYV

SEQ ID NO: 1688280 - protein, 17 aa, Staphylococcus aureus
GAVKRIVLTRPAVEAGE

SEQ ID NO: 1688281 - protein, 21 aa, Staphylococcus aureus
GDKWILYGLNGAGKTTLLNIL

SEQ ID NO: 1688282 - protein, 31 aa, Staphylococcus aureus
GDLIILQGTDDDWLHGYWAGVPIGTDKTDTK

SEQ ID NO: 1688283 - protein, 17 aa, Staphylococcus aureus
GFITKFNRLIERRLLRH

SEQ ID NO: 1688284 - protein, 29 aa, Staphylococcus aureus
GILPGAISFAPFSLVLRFGYDGIDVIDLN

SEQ ID NO: 1688285 - protein, 23 aa, Staphylococcus aureus
GKISLQMHAFPKEIRKIVFNEDY

SEQ ID NO: 1688286 - protein, 18 aa, Staphylococcus aureus
GLPVILSPVKEHIYLNEK

SEQ ID NO: 1688287 - protein, 28 aa, Staphylococcus aureus
GNSLNANILPFILRGIKLIGIDSVYVDH

SEQ ID NO: 1688288 - protein, 22 aa, Staphylococcus aureus
GNTVCYMWLRFNMDQQFEDTAI

SEQ ID NO: 1688289 - protein, 20 aa, Staphylococcus aureus
GTVNNKLIFSIPGSTGAVKL

SEQ ID NO: 1688290 - protein, 19 aa, Staphylococcus aureus
HDHVWGQPLYDSKALFKLL

SEQ ID NO: 1688291 - protein, 32 aa, Staphylococcus aureus
HDINHYIQYLIQLGYPLDMITDLDFETLYQYM

SEQ ID NO: 1688292 - protein, 21 aa, Staphylococcus aureus
HLPREIPSVNLIPYARKLEVL

SEQ ID NO: 1688293 - protein, 26 aa, Staphylococcus aureus
HPEMTRYFMTIPEASRLVLQAGALAE

SEQ ID NO: 1688294 - protein, 19 aa, Staphylococcus aureus
HPGAKLRKGLNALQTFLYS

SEQ ID NO: 1688295 - protein, 24 aa, Staphylococcus aureus
IAGIPSNKIWLDPGIGFAKTRNEE

SEQ ID NO: 1688296 - protein, 22 aa, Staphylococcus aureus
IDELFKKLNVQKLLIHKKIESL

SEQ ID NO: 1688297 - protein, 19 aa, Staphylococcus aureus
IDGLNRATATYKFAGGKGI

SEQ ID NO: 1688298 - protein, 40 aa, Staphylococcus aureus
IDYTYVRMAMYMDPLKPYLPELMNMHKLIYPAGDGRINYI

SEQ ID NO: 1688299 - protein, 21 aa, Staphylococcus aureus
IGKAFARRLQGFNTKILYHNR

SEQ ID NO: 1688300 - protein, 17 aa, Staphylococcus aureus
IGKLYIDEQTFVPCTPL

SEQ ID NO: 1688301 - protein, 24 aa, Staphylococcus aureus
IIDQFKLMFKDGEIIDFSAGKGEA

SEQ ID NO: 1688302 - protein, 18 aa, Staphylococcus aureus
IKKTAMVFGQMNEPPGAR

SEQ ID NO: 1688303 - protein, 24 aa, Staphylococcus aureus
IKSEQLELLRILFNYDRLSQYDLT

SEQ ID NO: 1688304 - protein, 25 aa, Staphylococcus aureus
ILSGFDPIRREIARTALVNLVSDGR

SEQ ID NO: 1688305 - protein, 28 aa, Staphylococcus aureus
INLTEPYTNYSILLVSGTYPGGVIEGFG

SEQ ID NO: 1688306 - protein, 24 aa, Staphylococcus aureus
INTENYFVPYLATPEGYFVQVSVT

SEQ ID NO: 1688307 - protein, 22 aa, Staphylococcus aureus
IQLKHSISEIPNIKALLNSMNQ

SEQ ID NO: 1688308 - protein, 24 aa, Staphylococcus aureus
IQLKHSISEIPNIKALLNSMNQDT

SEQ ID NO: 1688309 - protein, 18 aa, Staphylococcus aureus
ISTFSKSIFPSCRVAYMV

SEQ ID NO: 1688310 - protein, 24 aa, Staphylococcus aureus
ITHKKQIHFLNYMKTKNLNHFIYS

SEQ ID NO: 1688311 - protein, 20 aa, Staphylococcus aureus
ITTIESMALDWPLIEVGQSF

SEQ ID NO: 1688312 - protein, 19 aa, Staphylococcus aureus
ITVPAYFNDAERQATKDAG

SEQ ID NO: 1688313 - protein, 17 aa, Staphylococcus aureus
IVVIETFKAFVIDKDES

SEQ ID NO: 1688314 - protein, 28 aa, Staphylococcus aureus
IYKGDKLAQLVIVPIWTPELKQVEEFES

SEQ ID NO: 1688315 - protein, 24 aa, Staphylococcus aureus
IYRDIKNYYLYIYEKRVSELTIDD

SEQ ID NO: 1688316 - protein, 20 aa, Staphylococcus aureus
KAAQMILDDYEWIKSGKSLK

SEQ ID NO: 1688317 - protein, 20 aa, Staphylococcus aureus
KAERAFLKHLMRDKDTFLNY

SEQ ID NO: 1688318 - protein, 26 aa, Staphylococcus aureus
KAHELKPDLILMDLLMDDMDGVEATT

SEQ ID NO: 1688319 - protein, 23 aa, Staphylococcus aureus
KDIGMIFQHFNLLNSATVFKNVA

SEQ ID NO: 1688320 - protein, 18 aa, Staphylococcus aureus
KEAMFLKGFNLSDLSRET

SEQ ID NO: 1688321 - protein, 23 aa, Staphylococcus aureus
KEVKDYMPPVYHSEFRDFKGWTK

SEQ ID NO: 1688322 - protein, 24 aa, Staphylococcus aureus
KEYRKYYEPLIRKNDKEFKEGMER

SEQ ID NO: 1688323 - protein, 18 aa, Staphylococcus aureus
KGNTLNTAMGALRTSIQN

SEQ ID NO: 1688324 - protein, 21 aa, Staphylococcus aureus
KIVIDLLLNLLDENKTMIVIT

SEQ ID NO: 1688325 - protein, 17 aa, Staphylococcus aureus
KIYLEKISLRDRQEWWY

SEQ ID NO: 1688326 - protein, 26 aa, Staphylococcus aureus
KKDKKLLDWQLLIKNVYLDTEEDDNL

SEQ ID NO: 1688327 - protein, 25 aa, Staphylococcus aureus
KLVMDLQPLIIRRIKTFGFNHYDLE

SEQ ID NO: 1688328 - protein, 30 aa, Staphylococcus aureus
KMKEEEFFLKSKLPLYLYSFNYVDEYTMKL

SEQ ID NO: 1688329 - protein, 24 aa, Staphylococcus aureus
KRQNSFLSMLKRSWKKNTVKKIFY

SEQ ID NO: 1688330 - protein, 20 aa, Staphylococcus aureus
KSAILFASLFSKEATIIKEL

SEQ ID NO: 1688331 - protein, 20 aa, Staphylococcus aureus
KSDIGRLTDLNNAQRTAANA

SEQ ID NO: 1688332 - protein, 28 aa, Staphylococcus aureus
KSIDVQLIFCTLPLELRGFQIVSLDDIE

SEQ ID NO: 1688333 - protein, 26 aa, Staphylococcus aureus
KSIHYIATVVSVYRKVIDAYAADPDN

SEQ ID NO: 1688334 - protein, 29 aa, Staphylococcus aureus
KSQEDAYIEKFLMSLYLYEMASQTSMQFD

SEQ ID NO: 1688335 - protein, 22 aa, Staphylococcus aureus
KTAKELLATAVQRLAADHTSES

SEQ ID NO: 1688336 - protein, 21 aa, Staphylococcus aureus
KTIITEFHDLKVFVSEDLKDK

SEQ ID NO: 1688337 - protein, 17 aa, Staphylococcus aureus
KTLNLIDILNPYLCIVF

SEQ ID NO: 1688338 - protein, 20 aa, Staphylococcus aureus
KTLPPVFIAHCNGDYDVPVE

SEQ ID NO: 1688339 - protein, 23 aa, Staphylococcus aureus
KVGFNMQLDEYLEASKNGKTWLA

SEQ ID NO: 1688340 - protein, 18 aa, Staphylococcus aureus
KVPKIAYASHLKSDVQAL

SEQ ID NO: 1688341 - protein, 20 aa, Staphylococcus aureus
KVYAGNIQIWKKPSSFVIKP

SEQ ID NO: 1688342 - protein, 19 aa, Staphylococcus aureus
KYNGYKWMEMNGLGSFNTE

SEQ ID NO: 1688343 - protein, 20 aa, Staphylococcus aureus
LAARKGLPYVFAGHFAPQQM

SEQ ID NO: 1688344 - protein, 20 aa, Staphylococcus aureus
LARPTNFDDPRHPNWLVIEV

SEQ ID NO: 1688345 - protein, 23 aa, Staphylococcus aureus
LDDIMKMIPGMNKMKGLDKLNMS

SEQ ID NO: 1688346 - protein, 25 aa, Staphylococcus aureus
LDINVNTLYPKYKYYKTHGIETLLT

SEQ ID NO: 1688347 - protein, 17 aa, Staphylococcus aureus
LDNVLYRRQVHKCATGF

SEQ ID NO: 1688348 - protein, 17 aa, Staphylococcus aureus
LEIHLPREIPSVNLIPY

SEQ ID NO: 1688349 - protein, 30 aa, Staphylococcus aureus
LESDIIIFSTPLYWYSMSASLKLFIDRWTE

SEQ ID NO: 1688350 - protein, 17 aa, Staphylococcus aureus
LEYLKPGASITTTSSVQ

SEQ ID NO: 1688351 - protein, 18 aa, Staphylococcus aureus
LGFKRVIIPKNNIGGWTY

SEQ ID NO: 1688352 - protein, 20 aa, Staphylococcus aureus
LLITMAVVTWKVWKIERNTR

SEQ ID NO: 1688353 - protein, 18 aa, Staphylococcus aureus
LNGDLPAFLSPEPGLQSG

SEQ ID NO: 1688354 - protein, 17 aa, Staphylococcus aureus
LPSLTNPFFSALMQSIH

SEQ ID NO: 1688355 - protein, 17 aa, Staphylococcus aureus
LQILLWNMVKERDNQPH

SEQ ID NO: 1688356 - protein, 24 aa, Staphylococcus aureus
LQQIALFPHMTIKENIAQVPQMKK

SEQ ID NO: 1688357 - protein, 28 aa, Staphylococcus aureus
LRKAEQYKRLEFNLSFALDDIESTAKDV

SEQ ID NO: 1688358 - protein, 25 aa, Staphylococcus aureus
LRKIEADVPIYYYGFKDSDDIYAQN

SEQ ID NO: 1688359 - protein, 19 aa, Staphylococcus aureus
LRPETLFGNKFEGYLNQKA

SEQ ID NO: 1688360 - protein, 18 aa, Staphylococcus aureus
MDHIAPLGNIYQAGTLSG

SEQ ID NO: 1688361 - protein, 17 aa, Staphylococcus aureus
MVRLSQDWKLRHVLIEM

SEQ ID NO: 1688362 - protein, 25 aa, Staphylococcus aureus
MYLRDGIKEHFILKKVRKKFKKLNE

SEQ ID NO: 1688363 - protein, 25 aa, Staphylococcus aureus
NCLMEVLGLTLPYNGTALAVSDQRR

SEQ ID NO: 1688364 - protein, 17 aa, Staphylococcus aureus
NDINQTAPATTAKAAAL

SEQ ID NO: 1688365 - protein, 23 aa, Staphylococcus aureus
NEFDIAEFKLFNTLVNGELEETC

SEQ ID NO: 1688366 - protein, 19 aa, Staphylococcus aureus
NELGGIYYDVPYDLNEPNT

SEQ ID NO: 1688367 - protein, 17 aa, Staphylococcus aureus
NHKKQFYVTLKLNNEII

SEQ ID NO: 1688368 - protein, 17 aa, Staphylococcus aureus
NHSIYFDGIPNMDVFKK

SEQ ID NO: 1688369 - protein, 26 aa, Staphylococcus aureus
NKNKALRKYDYLIKKIAFIDEYEEYI

SEQ ID NO: 1688370 - protein, 18 aa, Staphylococcus aureus
NKYGIEFNFDKYNSFMLF

SEQ ID NO: 1688371 - protein, 17 aa, Staphylococcus aureus
NLGLKRILPTKKGKGSV

SEQ ID NO: 1688372 - protein, 19 aa, Staphylococcus aureus
NLIRYFSIPCKPTKVNGGR

SEQ ID NO: 1688373 - protein, 22 aa, Staphylococcus aureus
NLKIHHLRHSYASYLINNGVDM

SEQ ID NO: 1688374 - protein, 25 aa, Staphylococcus aureus
NMHPDLVKIVGRLNYRTSYGQNVLK

SEQ ID NO: 1688375 - protein, 21 aa, Staphylococcus aureus
NNMAYLQHYGLRTTLIDITEN

SEQ ID NO: 1688376 - protein, 22 aa, Staphylococcus aureus
NQEIIDYIDTLNYIDQYSSAGS

SEQ ID NO: 1688377 - protein, 33 aa, Staphylococcus aureus
NQPMPLMEFQKFIVGSLYGWRRGQYRMFTKAYI

SEQ ID NO: 1688378 - protein, 23 aa, Staphylococcus aureus
NRSLGLDLSIYGKAYELMIRNQD

SEQ ID NO: 1688379 - protein, 24 aa, Staphylococcus aureus
NSLDNLIIYALYDQSRDMITLTDD

SEQ ID NO: 1688380 - protein, 17 aa, Staphylococcus aureus
NSPTQLLAWLKDDQGLD

SEQ ID NO: 1688381 - protein, 18 aa, Staphylococcus aureus
NVLKHSIEVAHLASMLAA

SEQ ID NO: 1688382 - protein, 25 aa, Staphylococcus aureus
PENRKTVLIFYKIQPDNIYITNQYG

SEQ ID NO: 1688383 - protein, 24 aa, Staphylococcus aureus
PSAIFGTMKPKKLENGRIPVSKPS

SEQ ID NO: 1688384 - protein, 34 aa, Staphylococcus aureus
PSEFKFGLSFLTRSIALARFPWLSANIEYNVTKE

SEQ ID NO: 1688385 - protein, 24 aa, Staphylococcus aureus
PSKSYIKEAVKGSLKRLGIDHIDL

SEQ ID NO: 1688386 - protein, 21 aa, Staphylococcus aureus
PVMRSDFMLRYKDKCLIIDAK

SEQ ID NO: 1688387 - protein, 18 aa, Staphylococcus aureus
QELRELLKLLTEQGTSII

SEQ ID NO: 1688388 - protein, 17 aa, Staphylococcus aureus
QHYGLRTTLIDITENPF

SEQ ID NO: 1688389 - protein, 20 aa, Staphylococcus aureus
QIKIRYIEQFGLSNSLKRKV

SEQ ID NO: 1688390 - protein, 26 aa, Staphylococcus aureus
QIRVHMKYIGFPLVGDPKYGPKKTLD

SEQ ID NO: 1688391 - protein, 21 aa, Staphylococcus aureus
QLLHHMRSGLTLLDSVKIVST

SEQ ID NO: 1688392 - protein, 24 aa, Staphylococcus aureus
QQIDKLIENIPLLQARSKEILAFV

SEQ ID NO: 1688393 - protein, 25 aa, Staphylococcus aureus
QQRVALARLILKDPKIILADEPTGS

SEQ ID NO: 1688394 - protein, 26 aa, Staphylococcus aureus
QVDQALQNILNAKQALNGDERVALAK

SEQ ID NO: 1688395 - protein, 17 aa, Staphylococcus aureus
QVYVNQHIFLDEDILFP

SEQ ID NO: 1688396 - protein, 31 aa, Staphylococcus aureus
QYFNMAEKILPLPHIIDIPKRVFAKLDIPAN

SEQ ID NO: 1688397 - protein, 17 aa, Staphylococcus aureus
QYTFILSSFLKSINTIE

SEQ ID NO: 1688398 - protein, 20 aa, Staphylococcus aureus
RASFIRLANPSKSTAKEMKK

SEQ ID NO: 1688399 - protein, 18 aa, Staphylococcus aureus
RAYFFQYVNKGPYPDEEE

SEQ ID NO: 1688400 - protein, 21 aa, Staphylococcus aureus
RDDLDVYYFGDTFLMCTIISF

SEQ ID NO: 1688401 - protein, 21 aa, Staphylococcus aureus
RDNYIEVMTIEQIKQAWMQSS

SEQ ID NO: 1688402 - protein, 25 aa, Staphylococcus aureus
REILDLPDYVFPLFGMAVGEPAEDE

SEQ ID NO: 1688403 - protein, 17 aa, Staphylococcus aureus
RELLKLLTEQGTSIIIS

SEQ ID NO: 1688404 - protein, 19 aa, Staphylococcus aureus
RFEAIFTELRNRDITFIAA

SEQ ID NO: 1688405 - protein, 19 aa, Staphylococcus aureus
RFTDFPKDFKGIAGWILEV

SEQ ID NO: 1688406 - protein, 30 aa, Staphylococcus aureus
RGHFQGELHLRFQLAFYLFTNRGVICDPNQ

SEQ ID NO: 1688407 - protein, 21 aa, Staphylococcus aureus
RGQRQMELIKILFQKAQEVDS

SEQ ID NO: 1688408 - protein, 17 aa, Staphylococcus aureus
RIQFLNYLASELQLQDV

SEQ ID NO: 1688409 - protein, 23 aa, Staphylococcus aureus
RKGYQIYRPLLAVSKKEIKQFQE

SEQ ID NO: 1688410 - protein, 19 aa, Staphylococcus aureus
RLKYRYLDLRRHELAQTFK

SEQ ID NO: 1688411 - protein, 18 aa, Staphylococcus aureus
RLNSKWISVLYLSTKEQV

SEQ ID NO: 1688412 - protein, 21 aa, Staphylococcus aureus
RQMIKWTKLYIDQFLSSWTMP

SEQ ID NO: 1688413 - protein, 18 aa, Staphylococcus aureus
RTIGLTAQSINLLKKLML

SEQ ID NO: 1688414 - protein, 25 aa, Staphylococcus aureus
SDSSVLLFNITKNNQPLLLSEENIK

SEQ ID NO: 1688415 - protein, 19 aa, Staphylococcus aureus
SGMLYVTISDVYSGSPTLT

SEQ ID NO: 1688416 - protein, 23 aa, Staphylococcus aureus
SGSFHLLENLLNGSMKRVPQIPL

SEQ ID NO: 1688417 - protein, 20 aa, Staphylococcus aureus
SHHLRLLKNLGIAKYRKEGK

SEQ ID NO: 1688418 - protein, 28 aa, Staphylococcus aureus
SLLNFLNTKKLSIGWKIYLEKISLRDRQ

SEQ ID NO: 1688419 - protein, 25 aa, Staphylococcus aureus
SLSAGLKNLLFKKINQKLSGYVSEI

SEQ ID NO: 1688420 - protein, 17 aa, Staphylococcus aureus
SLYSLIDQAIDQDIKLI

SEQ ID NO: 1688421 - protein, 26 aa, Staphylococcus aureus
SRPVKMNSLLKLYFDRNILTPQKLLN

SEQ ID NO: 1688422 - protein, 32 aa, Staphylococcus aureus
SSAWSNAKSVFNGFRKWLSRTYEWIRDIGKDM

SEQ ID NO: 1688423 - protein, 20 aa, Staphylococcus aureus
SSLLQYVSGLSSQIAKNIIA

SEQ ID NO: 1688424 - protein, 28 aa, Staphylococcus aureus
SVFTAMKLRQRVWRRLAKDLMPENLHEI

SEQ ID NO: 1688425 - protein, 17 aa, Staphylococcus aureus
TADVFIDRNLPFLIHHI

SEQ ID NO: 1688426 - protein, 18 aa, Staphylococcus aureus
TFISWTRGLTQKFSKGKN

SEQ ID NO: 1688427 - protein, 19 aa, Staphylococcus aureus
TGKEDFYFIKLNQFNDDTV

SEQ ID NO: 1688428 - protein, 20 aa, Staphylococcus aureus
TGRRILILGDVLELGENSKE

SEQ ID NO: 1688429 - protein, 18 aa, Staphylococcus aureus
TINDYYEIYKGDKLAQLV

SEQ ID NO: 1688430 - protein, 17 aa, Staphylococcus aureus
TMSILCSELLFNYLSES

SEQ ID NO: 1688431 - protein, 23 aa, Staphylococcus aureus
TNIDFMSDYYFYLIEIGQMEQAI

SEQ ID NO: 1688432 - protein, 21 aa, Staphylococcus aureus
TQKYLDAEPSKKSAYDQAVNA

SEQ ID NO: 1688433 - protein, 23 aa, Staphylococcus aureus
TSKPFVVITPIYDLPSDFMSDKY

SEQ ID NO: 1688434 - protein, 22 aa, Staphylococcus aureus
TTINGLQHLTTAQKDKLKQQVQ

SEQ ID NO: 1688435 - protein, 30 aa, Staphylococcus aureus
TTWNSQKFFDLIKYFELPLQTKIKTFSRGM

SEQ ID NO: 1688436 - protein, 18 aa, Staphylococcus aureus
TVFKGTGYKYVLHPKVDA

SEQ ID NO: 1688437 - protein, 26 aa, Staphylococcus aureus
TWGYAKSILNTWLNANLKSIEQVRAF

SEQ ID NO: 1688438 - protein, 26 aa, Staphylococcus aureus
TWKDNSIIGFVMRPLINYDAIKNETT

SEQ ID NO: 1688439 - protein, 29 aa, Staphylococcus aureus
VDEGTYYPRTFIQQLFVDGYFGEATLRKN

SEQ ID NO: 1688440 - protein, 22 aa, Staphylococcus aureus
VDGNKFIDYLQAYGPIITGHAH

SEQ ID NO: 1688441 - protein, 18 aa, Staphylococcus aureus
VDMYLLMELMRHSNITET

SEQ ID NO: 1688442 - protein, 21 aa, Staphylococcus aureus
VKFTIKVVLTDPYKYSVTGNK

SEQ ID NO: 1688443 - protein, 20 aa, Staphylococcus aureus
VKKALPEHALFNNVGDASNG

SEQ ID NO: 1688444 - protein, 25 aa, Staphylococcus aureus
VKNMKPLIVQMIFEPSHYDDMFILN

SEQ ID NO: 1688445 - protein, 19 aa, Staphylococcus aureus
VLEGLEFMGVYWDPKKNEN

SEQ ID NO: 1688446 - protein, 18 aa, Staphylococcus aureus
VNDTLWYDTSNPDVAVLR

SEQ ID NO: 1688447 - protein, 21 aa, Staphylococcus aureus
VNMIALVNGRPKLINLKEALV

SEQ ID NO: 1688448 - protein, 21 aa, Staphylococcus aureus
VNQLVDLLYTSTFIIEKPSYP

SEQ ID NO: 1688449 - protein, 20 aa, Staphylococcus aureus
VPLTNFYRNEIIQPGVLPEK

SEQ ID NO: 1688450 - protein, 17 aa, Staphylococcus aureus
VPSKFFDLAKEGKDFYM

SEQ ID NO: 1688451 - protein, 19 aa, Staphylococcus aureus
VQEYAPILYQIWKKKHKKA

SEQ ID NO: 1688452 - protein, 28 aa, Staphylococcus aureus
VTFNEYGTKWYTYYDGDYNNFIMVSYIK

SEQ ID NO: 1688453 - protein, 20 aa, Staphylococcus aureus
VVGKALLKYQQRDDIVIGTK

SEQ ID NO: 1688454 - protein, 20 aa, Staphylococcus aureus
VVYMRLRRVGNKFSIKTWKF

SEQ ID NO: 1688455 - protein, 17 aa, Staphylococcus aureus
WEDLTIFERRRFYQGDV

SEQ ID NO: 1688456 - protein, 19 aa, Staphylococcus aureus
WHTYKVSKYWRSILLINTN

SEQ ID NO: 1688457 - protein, 28 aa, Staphylococcus aureus
WVNATMRAFKLGVILPVTKEFLNYTYSQ

SEQ ID NO: 1688458 - protein, 24 aa, Staphylococcus aureus
YARRHGFISAVPLREIVEAYNYGV

SEQ ID NO: 1688459 - protein, 18 aa, Staphylococcus aureus
YATWFEVARLDYISKLGF

SEQ ID NO: 1688460 - protein, 25 aa, Staphylococcus aureus
YCPNCGRLLQYDYIHYNQIGHYHCQ

SEQ ID NO: 1688461 - protein, 25 aa, Staphylococcus aureus
YDITSLYTFKQPVSPHLAFKMANQI

SEQ ID NO: 1688462 - protein, 17 aa, Staphylococcus aureus
YDNAITAAKAILNKQHG

SEQ ID NO: 1688463 - protein, 17 aa, Staphylococcus aureus
YEHLFDYNPLFGVPNNK

SEQ ID NO: 1688464 - protein, 25 aa, Staphylococcus aureus
YEYALKLVHNGLFNILAELDFEDEA

SEQ ID NO: 1688465 - protein, 17 aa, Staphylococcus aureus
YFHPKPSVDSVLIVLER

SEQ ID NO: 1688466 - protein, 19 aa, Staphylococcus aureus
YFNMAEKILPLPHIIDIPK

SEQ ID NO: 1688467 - protein, 17 aa, Staphylococcus aureus
YHKLFTDKHDINGNVPI

SEQ ID NO: 1688468 - protein, 19 aa, Staphylococcus aureus
YINSIRTWHNIRAKIIPLS

SEQ ID NO: 1688469 - protein, 17 aa, Staphylococcus aureus
YLLGSALGPDPFPTIVR

SEQ ID NO: 1688470 - protein, 17 aa, Staphylococcus aureus
YLYSFNYVDEYTMKLLD

SEQ ID NO: 1688471 - protein, 26 aa, Staphylococcus aureus
YPVINGIYFALELTPQEGRDIFFNED

SEQ ID NO: 1688472 - protein, 40 aa, Staphylococcus aureus
YQDIAILYRDESYAYLFDSILPLYNIPYNIDTKRSMTHHP

SEQ ID NO: 1688473 - protein, 21 aa, Staphylococcus aureus
YSKQITQATLVPNVNAIQQAA

SEQ ID NO: 1688474 - protein, 19 aa, Staphylococcus aureus
YTGMRAGELLALKWSDIDF

SEQ ID NO: 1688475 - protein, 18 aa, Staphylococcus aureus
YVYVKGYDDLQFFESFIL

SEQ ID NO: 1688476 - protein, 20 aa, Staphylococcus aureus
YYKSYSRGTVVYVKLGSNIG

SEQ ID NO: 1688477 - protein, 18 aa, Staphylococcus aureus
AARKGLPYVFAGHFAPQQ

SEQ ID NO: 1688478 - protein, 20 aa, Staphylococcus aureus
ACAMITFRLLKNYENLTYVT

SEQ ID NO: 1688479 - protein, 17 aa, Staphylococcus aureus
AEDIFEVVWAKIEAAYQ

SEQ ID NO: 1688480 - protein, 26 aa, Staphylococcus aureus
AERAGQFYINQRWLGGLLTNYKTISK

SEQ ID NO: 1688481 - protein, 22 aa, Staphylococcus aureus
AERAVYKVYFKNGSSKYVDLKT

SEQ ID NO: 1688482 - protein, 23 aa, Staphylococcus aureus
AISNLLLVTGNYRRPGTGAYPLR

SEQ ID NO: 1688483 - protein, 24 aa, Staphylococcus aureus
AKIGYHRLFDIKPVNTRYGGRIIF

SEQ ID NO: 1688484 - protein, 20 aa, Staphylococcus aureus
AMKNIIITYIWIISVNENAC

SEQ ID NO: 1688485 - protein, 21 aa, Staphylococcus aureus
ANLTSQIERGTTVAGVQGIQA

SEQ ID NO: 1688486 - protein, 18 aa, Staphylococcus aureus
ANYFGDIQLSKHEVLQLA

SEQ ID NO: 1688487 - protein, 17 aa, Staphylococcus aureus
AQYPPQLAFAIGNAIKY

SEQ ID NO: 1688488 - protein, 49 aa, Staphylococcus aureus
ARIDELIDEDVFKLITNPQAFNLLDWKKRRSLLFEIAKPINDEDVIKTN

SEQ ID NO: 1688489 - protein, 25 aa, Staphylococcus aureus
ARVAPHPFTNFMNYALLEKSGADVA

SEQ ID NO: 1688490 - protein, 33 aa, Staphylococcus aureus
ASKNIIDEKLIPKDYWLSQAPKLNSKQLIDDLK

SEQ ID NO: 1688491 - protein, 24 aa, Staphylococcus aureus
ASYISDFINGYFLGNPIQCQDDDK

SEQ ID NO: 1688492 - protein, 31 aa, Staphylococcus aureus; identical to SEQ ID NO: 1593177

SEQ ID NO: 1688493 - protein, 17 aa, Staphylococcus aureus
AVYFLQQGTPFIYQGQE

SEQ ID NO: 1688494 - protein, 19 aa, Staphylococcus aureus
AYAFIKRLIKQFGKPQKVI

SEQ ID NO: 1688495 - protein, 19 aa, Staphylococcus aureus
CIDIKPRMLGQQAGAAILN

SEQ ID NO: 1688496 - protein, 24 aa, Staphylococcus aureus
CKSYKVPFRKFGNRNELGIALGKG

SEQ ID NO: 1688497 - protein, 20 aa, Staphylococcus aureus
CTQIYFVHPINKNNIYITID

SEQ ID NO: 1688498 - protein, 19 aa, Staphylococcus aureus
DCRRTMDIFRLLGVDIKED

SEQ ID NO: 1688499 - protein, 20 aa, Staphylococcus aureus
DEIRRFLPRKVRTFQLQEAQ

SEQ ID NO: 1688500 - protein, 21 aa, Staphylococcus aureus
DEWHTYKVSKYWRSILLTNTN

SEQ ID NO: 1688501 - protein, 18 aa, Staphylococcus aureus
DFKLNLMLNAFSSDFYYF

SEQ ID NO: 1688502 - protein, 26 aa, Staphylococcus aureus
DGVGLPLFTALPIVSGMLEKYGIRDK

SEQ ID NO: 1688503 - protein, 17 aa, Staphylococcus aureus
DIFHSVLKYISERINGD

SEQ ID NO: 1688504 - protein, 21 aa, Staphylococcus aureus
DISNYVLLEYGQPLHMFDQDA

SEQ ID NO: 1688505 - protein, 23 aa, Staphylococcus aureus
DISNYVLLEYGQPLHMFDQDAIG

SEQ ID NO: 1688506 - protein, 24 aa, Staphylococcus aureus
DIYYKLNVSFPQAALGDEIKIPTL

SEQ ID NO: 1688507 - protein, 21 aa, Staphylococcus aureus
DKLHYSFNRLKYSLKPVVTAV

SEQ ID NO: 1688508 - protein, 28 aa, Staphylococcus aureus
DKVHLETDVLFKYVENILNKDKDQLSVD

SEQ ID NO: 1688509 - protein, 24 aa, Staphylococcus aureus
DLIGKFCHLVLKWKFNKDEGKYFT

SEQ ID NO: 1688510 - protein, 21 aa, Staphylococcus aureus
DLPQIKVLMLTSFIEDKEVYR

SEQ ID NO: 1688511 - protein, 21 aa, Staphylococcus aureus
DLYNKLDMILGYKDEERKKKR

SEQ ID NO: 1688512 - protein, 24 aa, Staphylococcus aureus
DNELYNYHYLYLHQRYAIDLVIKE

SEQ ID NO: 1688513 - protein, 25 aa, Staphylococcus aureus
DNELYNYHYLYPHQRYAIDLVIKEN

SEQ ID NO: 1688514 - protein, 19 aa, Staphylococcus aureus
DNYIAFRNTITSIESIVNT

SEQ ID NO: 1688515 - protein, 23 aa, Staphylococcus aureus
DPEQFAQDHLAFCKAHHLKGRIL

SEQ ID NO: 1688516 - protein, 20 aa, Staphylococcus aureus
DPSLFIEKYQRFTLDGDGTG

SEQ ID NO: 1688517 - protein, 17 aa, Staphylococcus aureus
DRLKLRKQTRQLAAIYL

SEQ ID NO: 1688518 - protein, 17 aa, Staphylococcus aureus
DSITILEQNWLGGAYWS

SEQ ID NO: 1688519 - protein, 25 aa, Staphylococcus aureus
DTGHYISYPTIYRYIRNGLVKVDVK

SEQ ID NO: 1688520 - protein, 19 aa, Staphylococcus aureus
DTQVKQVYDEAVDKAKQAL

SEQ ID NO: 1688521 - protein, 29 aa, Staphylococcus aureus
DVDNALNAVTRAKAALNGADNLRNAKTSA

SEQ ID NO: 1688522 - protein, 24 aa, Staphylococcus aureus
DVHTVYKMMTLFNNQSYIDDKGDI

SEQ ID NO: 1688523 - protein, 18 aa, Staphylococcus aureus
DYIDLYYIHFPDDNTPKD

SEQ ID NO: 1688524 - protein, 21 aa, Staphylococcus aureus
ECARLLKKWGLPANRNTIRLH

SEQ ID NO: 1688525 - protein, 33 aa, Staphylococcus aureus
EESKFEFDPLVKQLKPFGFFDYNALQKDAFVVL

SEQ ID NO: 1688526 - protein, 21 aa, Staphylococcus aureus
EESSILKFPGVLIRTSTERPE

SEQ ID NO: 1688527 - protein, 26 aa, Staphylococcus aureus
EIFDDLWMELYRSFKKLRNIFKEESL

SEQ ID NO: 1688528 - protein, 17 aa, Staphylococcus aureus
EIKGLITAKILRAQEMN

SEQ ID NO: 1688529 - protein, 17 aa, Staphylococcus aureus
EIKKLFRIFDNAVAEII

SEQ ID NO: 1688530 - protein, 20 aa, Staphylococcus aureus
EKSFTIFNISINDLHFHLQD

SEQ ID NO: 1688531 - protein, 17 aa, Staphylococcus aureus
ELCHYHLHIAGKGYQHK

SEQ ID NO: 1688532 - protein, 24 aa, Staphylococcus aureus
ELEKYKQLILDDKMLVVGVRDHSS

SEQ ID NO: 1688533 - protein, 23 aa, Staphylococcus aureus
ELFPVNEGILQFWISSEDQMYGM

SEQ ID NO: 1688534 - protein, 23 aa, Staphylococcus aureus
ELFYYTSVIKKYNLLKSSFMDSV

SEQ ID NO: 1688535 - protein, 17 aa, Staphylococcus aureus
ELQDGVGLPLFTALPIV

SEQ ID NO: 1688536 - protein, 17 aa, Staphylococcus aureus
ENALSQVTNAKGALNGN

SEQ ID NO: 1688537 - protein, 24 aa, Staphylococcus aureus
ENMNAWLKPYRRALHLEEPVVKIT

SEQ ID NO: 1688538 - protein, 24 aa, Staphylococcus aureus
ENYKERFYQIPKVFFTSENYKNLT

SEQ ID NO: 1688539 - protein, 23 aa, Staphylococcus aureus
EQQKIGDLFYKIDKYISFNKCKI

SEQ ID NO: 1688540 - protein, 18 aa, Staphylococcus aureus
EQTKLNVEAFSNAVKKAV

SEQ ID NO: 1688541 - protein, 25 aa, Staphylococcus aureus
EQTPGVNFTFDERLRIALQLEKWGV

SEQ ID NO: 1688542 - protein, 20 aa, Staphylococcus aureus
EQYARLRPKKLKANIEYTTP

SEQ ID NO: 1688543 - protein, 28 aa, Staphylococcus aureus
EVIGNPLLDKFMKDLIIQILAMVSEQER

SEQ ID NO: 1688544 - protein, 25 aa, Staphylococcus aureus
EYKGRKCFFYYAKLIYTPEVCPNCN

SEQ ID NO: 1688545 - protein, 27 aa, Staphylococcus aureus
FDDLWMDLYDLFEELRDLFKEEGLEPW

SEQ ID NO: 1688546 - protein, 19 aa, Staphylococcus aureus
FDNAITQAESYLNKDHGAN

SEQ ID NO: 1688547 - protein, 29 aa, Staphylococcus aureus
FDQVIKKDGYWWIRFKYQREGSSTNNFYC

SEQ ID NO: 1688548 - protein, 31 aa, Staphylococcus aureus
FGVHGENFMILLASRLDAVVYSLGLARTRRQ

SEQ ID NO: 1688549 - protein, 30 aa, Staphylococcus aureus; identical to SEQ ID NO: 1592226

SEQ ID NO: 1688550 - protein, 18 aa, Staphylococcus aureus
FNAMVMTPYFPKPDVMIY

SEQ ID NO: 1688551 - protein, 17 aa, Staphylococcus aureus
FSTPFILLNGNPMYHVD

SEQ ID NO: 1688552 - protein, 17 aa, Staphylococcus aureus
FVIPVSETLDMKKAAAL

SEQ ID NO: 1688553 - protein, 18 aa, Staphylococcus aureus
FVKPLARLAYNGGGEFKA

SEQ ID NO: 1688554 - protein, 23 aa, Staphylococcus aureus
GARRLHTILEKMLEDLSFEAPRM

SEQ ID NO: 1688555 - protein, 34 aa, Staphylococcus aureus
GDITAPYYRDLAFVTYMGISAYDTFLSAFGKKDD

SEQ ID NO: 1688556 - protein, 26 aa, Staphylococcus aureus
GDVEPTSIISILVAAADALSAARPGA

SEQ ID NO: 1688557 - protein, 22 aa, Staphylococcus aureus
GGGQVIFYYTKPRNDELYYYSS

SEQ ID NO: 1688558 - protein, 32 aa, Staphylococcus aureus
GINEAFLQRCPNLKWIAWFATGVNTLPLDYIA

SEQ ID NO: 1688559 - protein, 18 aa, Staphylococcus aureus
GIPVIREQHDGFKGIDAV

SEQ ID NO: 1688560 - protein, 24 aa, Staphylococcus aureus
GKISLQMHAFPKEIRKIVFNEDYD

SEQ ID NO: 1688561 - protein, 18 aa, Staphylococcus aureus
GKQNNYVAVWFRQERKDG

SEQ ID NO: 1688562 - protein, 26 aa, Staphylococcus aureus
GLGEAFKYVAPVAGALGYTIEDTSIA

SEQ ID NO: 1688563 - protein, 23 aa, Staphylococcus aureus
GRGYRRVVPSPQPISIIELESIK

SEQ ID NO: 1688564 - protein, 18 aa, Staphylococcus aureus
GTAKGGIVLAIRNELHIP

SEQ ID NO: 1688565 - protein, 20 aa, Staphylococcus aureus
GTEHILLGLIRENEGVAARV

SEQ ID NO: 1688566 - protein, 30 aa, Staphylococcus aureus
GVSAPAVLGLYPHTVLELAKRIIPSDKVSS

SEQ ID NO: 1688567 - protein, 23 aa, Staphylococcus aureus
GYDDYYYYYIDPLWSHIRRGLVL

SEQ ID NO: 1688568 - protein, 27 aa, Staphylococcus aureus
HAVTDLNQLNGLNNPQRQALESQINNA

SEQ ID NO: 1688569 - protein, 17 aa, Staphylococcus aureus
HERWLQRYDLISERNHF

SEQ ID NO: 1688570 - protein, 24 aa, Staphylococcus aureus
HEVEKLYVFTKAASSLTGDNATIP

SEQ ID NO: 1688571 - protein, 22 aa, Staphylococcus aureus
HKRLEKLFIKYLGVEDTEVNRT

SEQ ID NO: 1688572 - protein, 17 aa, Staphylococcus aureus
HKTIFLTDIEDMGFSKS

SEQ ID NO: 1688573 - protein, 19 aa, Staphylococcus aureus
HSVIDDLISKNQSVAEAIR

SEQ ID NO: 1688574 - protein, 24 aa, Staphylococcus aureus
IATYELYIAALKLGVAIIPCSEML

SEQ ID NO: 1688575 - protein, 18 aa, Staphylococcus aureus
IDAIEAALITAYKKNYDS

SEQ ID NO: 1688576 - protein, 20 aa, Staphylococcus aureus
IDEETFLKLYHKVLDYLDKK

SEQ ID NO: 1688577 - protein, 20 aa, Staphylococcus aureus
IDKLCSYLHISPSEFFEHNP

SEQ ID NO: 1688578 - protein, 19 aa, Staphylococcus aureus
IDLNDAMETLKHLVDNEIP

SEQ ID NO: 1688579 - protein, 21 aa, Staphylococcus aureus
IDNTFLTPYLSTPLAEGADIV

SEQ ID NO: 1688580 - protein, 21 aa, Staphylococcus aureus
IDVAFVPGAFEIPLVAKKLAS

SEQ ID NO: 1688581 - protein, 19 aa, Staphylococcus aureus
IEFNFDKYNSFMLFGVQVV

SEQ ID NO: 1688582 - protein, 24 aa, Staphylococcus aureus
IETLPDDMIWFDLSDRDQYTFPVP

SEQ ID NO: 1688583 - protein, 20 aa, Staphylococcus aureus
IGDFFKKMDILISKQKIKIE

SEQ ID NO: 1688584 - protein, 26 aa, Staphylococcus aureus
IIIFSTPLYWYSMSASLKLFIDRWTE

SEQ ID NO: 1688585 - protein, 22 aa, Staphylococcus aureus
IKELICQFKYLSAFEKDVMYLM

SEQ ID NO: 1688586 - protein, 41 aa, Staphylococcus aureus
ILVHPWQYDHTIGKYFEAWIAKKILIPTPFTILSKATLSFR

SEQ ID NO: 1688587 - protein, 19 aa, Staphylococcus aureus
ILVNILDLEDKFIDGINIT

SEQ ID NO: 1688588 - protein, 18 aa, Staphylococcus aureus
INDINQTAPATTAKAAAL

SEQ ID NO: 1688589 - protein, 28 aa, Staphylococcus aureus
INGKDAFKLYDTYGFPIELTEEIAVQAG

SEQ ID NO: 1688590 - protein, 18 aa, Staphylococcus aureus
INHIDLNKIAWKNIDNLS

SEQ ID NO: 1688591 - protein, 25 aa, Staphylococcus aureus
INSSFKYHEIYLMNGKGLGELIWKD

SEQ ID NO: 1688592 - protein, 17 aa, Staphylococcus aureus
IPIGIIPASIKKVRNIL

SEQ ID NO: 1688593 - protein, 29 aa, Staphylococcus aureus
IQYDVALFSYNKLLEIFFSVIDPLDTGGQ

SEQ ID NO: 1688594 - protein, 24 aa, Staphylococcus aureus
IRRAMQNLKPLFDSPARIVISHGN

SEQ ID NO: 1688595 - protein, 18 aa, Staphylococcus aureus
IRVFYRDEFLCTAICPEI

SEQ ID NO: 1688596 - protein, 27 aa, Staphylococcus aureus
ISINDLHFHLQDINNYKFYKGIRLTDN

SEQ ID NO: 1688597 - protein, 17 aa, Staphylococcus aureus
ISRDLKIIANETGAIIV

SEQ ID NO: 1688598 - protein, 17 aa, Staphylococcus aureus
ITYIWIISVNENACKDT

SEQ ID NO: 1688599 - protein, 21 aa, Staphylococcus aureus
IVDVIKYLINTIPKIRKNLRH

SEQ ID NO: 1688600 - protein, 18 aa, Staphylococcus aureus
IVVWRLDRLGRNMADLIT

SEQ ID NO: 1688601 - protein, 25 aa, Staphylococcus aureus
KAQIYGFIVGSGLRGPLHKGLPTIE

SEQ ID NO: 1688602 - protein, 18 aa, Staphylococcus aureus
KAVITVPAYFNDAERQAT

SEQ ID NO: 1688603 - protein, 24 aa, Staphylococcus aureus
KDEGKYFTDFSFIKPYKKGDDVVN

SEQ ID NO: 1688604 - protein, 22 aa, Staphylococcus aureus
KDGYADIKILYSPASDQNYRYA

SEQ ID NO: 1688605 - protein, 20 aa, Staphylococcus aureus
KDLINKTTDPTLAKSIIDQA

SEQ ID NO: 1688606 - protein, 21 aa, Staphylococcus aureus
KFCENIIYVPLPRLIYRYYTY

SEQ ID NO: 1688607 - protein, 19 aa, Staphylococcus aureus
KFGLRLPGEFNRQQMTEAV

SEQ ID NO: 1688608 - protein, 24 aa, Staphylococcus aureus
KGESKFDILLFSSIGVIDGDYLAG

SEQ ID NO: 1688609 - protein, 24 aa, Staphylococcus aureus
KHDINGNVPIFINIGEWDGDDEDL

SEQ ID NO: 1688610 - protein, 24 aa, Staphylococcus aureus
KHDINGNVPIFINIGEWDGDDEEL

SEQ ID NO: 1688611 - protein, 18 aa, Staphylococcus aureus
KHDNSFDIHLIPETRRST

SEQ ID NO: 1688612 - protein, 17 aa, Staphylococcus aureus
KIAFLINDLNTTAIQKL

SEQ ID NO: 1688613 - protein, 22 aa, Staphylococcus aureus
KKELGRFLKSIRKQKGKTASEI

SEQ ID NO: 1688614 - protein, 18 aa, Staphylococcus aureus
KKHLKNSGGIALLPEFIV

SEQ ID NO: 1688615 - protein, 29 aa, Staphylococcus aureus
KLDNAMGAVQQYIDEQHLGVISSTNYINA

SEQ ID NO: 1688616 - protein, 25 aa, Staphylococcus aureus
KNFYNTDLPAIPHTKLRDALAHEIN

SEQ ID NO: 1688617 - protein, 24 aa, Staphylococcus aureus
KNHLNDFIRIYADTLPNNEICLSD

SEQ ID NO: 1688618 - protein, 19 aa, Staphylococcus aureus
KNMMYVLADNRHISLIADV

SEQ ID NO: 1688619 - protein, 22 aa, Staphylococcus aureus
KNYPELYIHVYLNNSDTVLQHI

SEQ ID NO: 1688620 - protein, 26 aa, Staphylococcus aureus
KPDWKIFQAIANKLSFDWNYKHPSEI

SEQ ID NO: 1688621 - protein, 23 aa, Staphylococcus aureus
KQCNLGKRDFLWTQYISINNEKV

SEQ ID NO: 1688622 - protein, 18 aa, Staphylococcus aureus
KRIQFLNYLASELQLQDV

SEQ ID NO: 1688623 - protein, 17 aa, Staphylococcus aureus
KSVDIMGPLMDLLSASV

SEQ ID NO: 1688624 - protein, 19 aa, Staphylococcus aureus
KTFSKLIERLTGETYSNIE

SEQ ID NO: 1688625 - protein, 22 aa, Staphylococcus aureus
KVAEIIAQAQALNEAMKALKES

SEQ ID NO: 1688626 - protein, 27 aa, Staphylococcus aureus
KVKRELGFVLMALNIRKIVARRAVYYQ

SEQ ID NO: 1688627 - protein, 23 aa, Staphylococcus aureus
KVTTPILVKAPIAGRRILLKEVR

SEQ ID NO: 1688628 - protein, 26 aa, Staphylococcus aureus
KVYLDQIHQRLFLEQSLITERIKKYF

SEQ ID NO: 1688629 - protein, 24 aa, Staphylococcus aureus
KYEKAWELLDLPEKIKQYGTPLPV

SEQ ID NO: 1688630 - protein, 24 aa, Staphylococcus aureus
LADLLPEHRIIINKQPLSIESAIA

SEQ ID NO: 1688631 - protein, 25 aa, Staphylococcus aureus
LADLLPEHRIIINKQPLSIESAIAV

SEQ ID NO: 1688632 - protein, 25 aa, Staphylococcus aureus
LAIPTFKNQLLFTKHNLRGIEFPGG

SEQ ID NO: 1688633 - protein, 19 aa, Staphylococcus aureus
LAQAKQDAIANLDTLRDLN

SEQ ID NO: 1688634 - protein, 17 aa, Staphylococcus aureus
LCEKYNIPQGYQAIQLL

SEQ ID NO: 1688635 - protein, 21 aa, Staphylococcus aureus
LDELVATEYPVLLATSRKRFT

SEQ ID NO: 1688636 - protein, 22 aa, Staphylococcus aureus
LDQLTHLNNAQRQLAIQQINNA

SEQ ID NO: 1688637 - protein, 25 aa, Staphylococcus aureus
LGPTAIRYAGLIPRLKQLDLDVNDK

SEQ ID NO: 1688638 - protein, 30 aa, Staphylococcus aureus
LGTKSLVKLFKTFPTKIIGLLKLFENNNDP

SEQ ID NO: 1688639 - protein, 24 aa, Staphylococcus aureus
LIKDVADIFYLTEEDLLPLDRMGQ

SEQ ID NO: 1688640 - protein, 22 aa, Staphylococcus aureus
LIQYIQAAYHEPLREEFKNLTP

SEQ ID NO: 1688641 - protein, 26 aa, Staphylococcus aureus
LKEIYQFPLLLFYKGNIKLIKIICII

SEQ ID NO: 1688642 - protein, 19 aa, Staphylococcus aureus
LKIIANETGAIIVLLSQLN

SEQ ID NO: 1688643 - protein, 23 aa, Staphylococcus aureus
LKKGIFDYFLDTVGSNVTLYGLK

SEQ ID NO: 1688644 - protein, 17 aa, Staphylococcus aureus
LKNLGIAKYRKEGKVVY

SEQ ID NO: 1688645 - protein, 26 aa, Staphylococcus aureus
LKREFSYWQFRKLFKSYTRQSDVHEL

SEQ ID NO: 1688646 - protein, 28 aa, Staphylococcus aureus
LLRSLVTTEFIWSVPGRFDIYGPQILIQ

SEQ ID NO: 1688647 - protein, 20 aa, Staphylococcus aureus
LLSVFGFKVVDADKAAREAV

SEQ ID NO: 1688648 - protein, 17 aa, Staphylococcus aureus
LMLFVQRCKDMQDAGQL

SEQ ID NO: 1688649 - protein, 21 aa, Staphylococcus aureus
LNVNPAYLMGWVEENDDEVQH

SEQ ID NO: 1688650 - protein, 17 aa, Staphylococcus aureus
LPGILVEKLLIKIDDML

SEQ ID NO: 1688651 - protein, 20 aa, Staphylococcus aureus
LQGLYAYNIPFDNKAKIEKY

SEQ ID NO: 1688652 - protein, 34 aa, Staphylococcus aureus
LQHFEGTILFVSHDRYFINQLANKVFDLTIDGGK

SEQ ID NO: 1688653 - protein, 36 aa, Staphylococcus aureus
LSKFGYWNEPQGSFYIWFKLSVPVNIKLLFNEAIKE

SEQ ID NO: 1688654 - protein, 17 aa, Staphylococcus aureus
LVRFFNHYFNKGDIYQA

SEQ ID NO: 1688655 - protein, 18 aa, Staphylococcus aureus
LVRLLSDIDLLVLDDMGV

SEQ ID NO: 1688656 - protein, 19 aa, Staphylococcus aureus
LVTPDKIAIALGLGADFVN

SEQ ID NO: 1688657 - protein, 20 aa, Staphylococcus aureus
LYDTLLMNYNFVIIDTPPVN

SEQ ID NO: 1688658 - protein, 17 aa, Staphylococcus aureus
LYPFVFNTLFEAIDKLA

SEQ ID NO: 1688659 - protein, 21 aa, Staphylococcus aureus
LYSVKEIFRYFTDSNLQRKKI

SEQ ID NO: 1688660 - protein, 23 aa, Staphylococcus aureus
MEIIDRMMDIPYSREFISFDDNN

SEQ ID NO: 1688661 - protein, 25 aa, Staphylococcus aureus
MKNNDDFFFLYSDLKGNELKEELLY

SEQ ID NO: 1688662 - protein, 25 aa, Staphylococcus aureus
MRVQVRRLLKKYGYPPDLQKMAVEQ

SEQ ID NO: 1688663 - protein, 18 aa, Staphylococcus aureus
MTLQKNPLTLLVSTAGDN

SEQ ID NO: 1688664 - protein, 26 aa, Staphylococcus aureus
MVKLALELYNSPWIAWYHQQMQDKKA

SEQ ID NO: 1688665 - protein, 17 aa, Staphylococcus aureus
MVYVVMNNKLFGHVYIK

SEQ ID NO: 1688666 - protein, 24 aa, Staphylococcus aureus
NAAKDVWINGFTPQYTMSVWMGFS

SEQ ID NO: 1688667 - protein, 24 aa, Staphylococcus aureus
NDNRKLTVYFVTNSPLTGFISILK

SEQ ID NO: 1688668 - protein, 17 aa, Staphylococcus aureus
NDPVLYFEHKKAYRFLK

SEQ ID NO: 1688669 - protein, 27 aa, Staphylococcus aureus
NEVASTFRILIKYLIYSKIKQQPYNAN

SEQ ID NO: 1688670 - protein, 20 aa, Staphylococcus aureus
NGDIIFQIGPGLFGVRDKEG

SEQ ID NO: 1688671 - protein, 24 aa, Staphylococcus aureus
NIHDKILYLYRKFLDLLDLTDNTF

SEQ ID NO: 1688672 - protein, 23 aa, Staphylococcus aureus
NKDIAWWSIVQSYPLLMRQEKSN

SEQ ID NO: 1688673 - protein, 19 aa, Staphylococcus aureus
NKLFSILVRGPNTEADEKS

SEQ ID NO: 1688674 - protein, 17 aa, Staphylococcus aureus
NNDLFLRELMRVRKIAD

SEQ ID NO: 1688675 - protein, 26 aa, Staphylococcus aureus
NPAKGLLQYIPQTFRHYAVRGHNNIY

SEQ ID NO: 1688676 - protein, 26 aa, Staphylococcus aureus
NSAKENINCRCKLLYYIDENELPTVM

SEQ ID NO: 1688677 - protein, 17 aa, Staphylococcus aureus
NSFDIHLIPETRRSTIL

SEQ ID NO: 1688678 - protein, 21 aa, Staphylococcus aureus
NTFNKNQLAIAPLIEGFDYEE

SEQ ID NO: 1688679 - protein, 26 aa, Staphylococcus aureus
NTLENQVLMIGYTFYHSNKNEVEDLY

SEQ ID NO: 1688680 - protein, 25 aa, Staphylococcus aureus
NVLANHQIIVYLPDTYKTTPELSFA

SEQ ID NO: 1688681 - protein, 21 aa, Staphylococcus aureus
NVNFDYLFAAIGGGGLISGIS

SEQ ID NO: 1688682 - protein, 17 aa, Staphylococcus aureus
PAKSLSYSFFKNRNETV

SEQ ID NO: 1688683 - protein, 23 aa, Staphylococcus aureus
PDHPEHWLLKDYIENTDPKAGIL

SEQ ID NO: 1688684 - protein, 25 aa, Staphylococcus aureus
PEGEYSKIYLFSSNLEKITAFRDEL

SEQ ID NO: 1688685 - protein, 17 aa, Staphylococcus aureus
PESISVPVIKRALSVFN

SEQ ID NO: 1688686 - protein, 18 aa, Staphylococcus aureus
PGIYPFMSGYENLKLLNE

SEQ ID NO: 1688687 - protein, 25 aa, Staphylococcus aureus
PKNFSALFNYLLIDVNDRKSKVNNL

SEQ ID NO: 1688688 - protein, 20 aa, Staphylococcus aureus
PLTFFVKKFKQAKSSISEDV

SEQ ID NO: 1688689 - protein, 27 aa, Staphylococcus aureus
PPHTPIAKYRFPERNRIISGLSKGVLI

SEQ ID NO: 1688690 - protein, 22 aa, Staphylococcus aureus
PVEWEQVFTIAYVTDQAGEVIF

SEQ ID NO: 1688691 - protein, 25 aa, Staphylococcus aureus
PYDRDSWNPVYGNQLFMKTRNGSMK

SEQ ID NO: 1688692 - protein, 27 aa, Staphylococcus aureus
QDAIANLDTLRDLNQPQRDALRNQINQ

SEQ ID NO: 1688693 - protein, 17 aa, Staphylococcus aureus
QFKLIFEFMNITNYRFL

SEQ ID NO: 1688694 - protein, 17 aa, Staphylococcus aureus
QIAQRFLIYGYARGTGE

SEQ ID NO: 1688695 - protein, 20 aa, Staphylococcus aureus
QKFLDLFDKHELDSAVIGEV

SEQ ID NO: 1688696 - protein, 18 aa, Staphylococcus aureus
QNTFGYLPEYIVADAGYG

SEQ ID NO: 1688697 - protein, 19 aa, Staphylococcus aureus
QPCCFKLYNDPFDMVYVVM

SEQ ID NO: 1688698 - protein, 24 aa, Staphylococcus aureus
QQELFPVKEGILQFWISSEDQMYG

SEQ ID NO: 1688699 - protein, 20 aa, Staphylococcus aureus
QQLKLLCEKYNIPQGYQAIQ

SEQ ID NO: 1688700 - protein, 25 aa, Staphylococcus aureus
QQRLGHVDFCFLELLKKGYNRDAII

SEQ ID NO: 1688701 - protein, 19 aa, Staphylococcus aureus
QRFKGLKEWHFGIFEGESV

SEQ ID NO: 1688702 - protein, 21 aa, Staphylococcus aureus
QRLLDFVISLIGQPQLILLDE

SEQ ID NO: 1688703 - protein, 23 aa, Staphylococcus aureus
QTDYIDLYYIHFPDNNTPKDQAV

SEQ ID NO: 1688704 - protein, 24 aa, Staphylococcus aureus
QTQKQDWFMLINHGAKRTGKTILN

SEQ ID NO: 1688705 - protein, 24 aa, Staphylococcus aureus
QTQQQIVYKAPKPLAGLNGESHDF

SEQ ID NO: 1688706 - protein, 24 aa, Staphylococcus aureus
QTVQRFYNKGFFHENGQPDFLNIK

SEQ ID NO: 1688707 - protein, 17 aa, Staphylococcus aureus
QVLAPMYKGNAGIKRLN

SEQ ID NO: 1688708 - protein, 26 aa, Staphylococcus aureus
QYKFSKDYYLCELLAHLIEIPQTSYD

SEQ ID NO: 1688709 - protein, 17 aa, Staphylococcus aureus
RAETILNKTQGANTPKQ

SEQ ID NO: 1688710 - protein, 19 aa, Staphylococcus aureus
RAIAGYFLSFDAPNAQNTA

SEQ ID NO: 1688711 - protein, 32 aa, Staphylococcus aureus
RARAGLKDPKRPIGSFIFLGPTGVGKTELARA

SEQ ID NO: 1688712 - protein, 24 aa, Staphylococcus aureus
RATETLNNLSNLNTPQRQALENQI

SEQ ID NO: 1688713 - protein, 17 aa, Staphylococcus aureus
RFYQLTQILNTLKLVNK

SEQ ID NO: 1688714 - protein, 28 aa, Staphylococcus aureus
RGEIDPVIRFYTWNPATLSIGYFQRLQK

SEQ ID NO: 1688715 - protein, 18 aa, Staphylococcus aureus
RHSYASYLINNGVDMYLL

SEQ ID NO: 1688716 - protein, 27 aa, Staphylococcus aureus
RKAEQYKRLEFNLSFALDDIESTAKDV

SEQ ID NO: 1688717 - protein, 18 aa, Staphylococcus aureus
RKLLDSPIFQNEKLFKVF

SEQ ID NO: 1688718 - protein, 20 aa, Staphylococcus aureus
RLKKLIDSGKAIHACPELLG

SEQ ID NO: 1688719 - protein, 18 aa, Staphylococcus aureus
RLLPKAKRLDIVSYEEMM

SEQ ID NO: 1688720 - protein, 26 aa, Staphylococcus aureus
RLVDTQALFLEYRKKLQDVYTDVEDV

SEQ ID NO: 1688721 - protein, 17 aa, Staphylococcus aureus
RLWDILQTNFKAKALKE

SEQ ID NO: 1688722 - protein, 22 aa, Staphylococcus aureus
RPQDLIFLSDMKSSFENSVTAP

SEQ ID NO: 1688723 - protein, 21 aa, Staphylococcus aureus
RQLTKLLFYSGLRIGEALALQ

SEQ ID NO: 1688724 - protein, 25 aa, Staphylococcus aureus
RSTNFSIVWILPISSIDNMPIKDMV

SEQ ID NO: 1688725 - protein, 18 aa, Staphylococcus aureus
RVALIRMMLKDPIVMLAD

SEQ ID NO: 1688726 - protein, 20 aa, Staphylococcus aureus
RYGCALAIEVLKRLKDENIG

SEQ ID NO: 1688727 - protein, 20 aa, Staphylococcus aureus
RYKYFDENYFIFGGLEPIRY

SEQ ID NO: 1688728 - protein, 18 aa, Staphylococcus aureus
SCNAYINGGKYKTLDYLE

SEQ ID NO: 1688729 - protein, 33 aa, Staphylococcus aureus
SELKTLTFHALLDEWLEYHIKTSGFKVTTLDNL

SEQ ID NO: 1688730 - protein, 29 aa, Staphylococcus aureus
SFNSTNDLLTWLQDPFIKDMPGKRVNIND

SEQ ID NO: 1688731 - protein, 18 aa, Staphylococcus aureus
SFPSNKLIESYLMNIKDT

SEQ ID NO: 1688732 - protein, 20 aa, Staphylococcus aureus
SIDQLYQHLGERYYSSNMAS

SEQ ID NO: 1688733 - protein, 24 aa, Staphylococcus aureus
SILSKSIIKLLPEKISKLSNGEVI

SEQ ID NO: 1688734 - protein, 30 aa, Staphylococcus aureus
SIYGDFQRFYQPAIKALHTLGARDVIQSGR

SEQ ID NO: 1688735 - protein, 27 aa, Staphylococcus aureus
SLNADQLVMLKLTIPTEPNLYKELAEH

SEQ ID NO: 1688736 - protein, 32 aa, Staphylococcus aureus
SNGMPIIVNGVMKPIPTLYKPLNSVDINTKED

SEQ ID NO: 1688737 - protein, 25 aa, Staphylococcus aureus
SQLFEDEYFMYGLQTYVESNNSDVF

SEQ ID NO: 1688738 - protein, 23 aa, Staphylococcus aureus
SRLEILDLLSCGELCACDLLAHF

SEQ ID NO: 1688739 - protein, 22 aa, Staphylococcus aureus
SSLPIEASLLDIPTIFYVYDEG

SEQ ID NO: 1688740 - protein, 21 aa, Staphylococcus aureus
STNKPDAKLFILLVGERPEEV

SEQ ID NO: 1688741 - protein, 17 aa, Staphylococcus aureus
SVEFLLNMDAKSFTMGD

SEQ ID NO: 1688742 - protein, 18 aa, Staphylococcus aureus
SVIDDLISKNQSVAEAIR

SEQ ID NO: 1688743 - protein, 22 aa, Staphylococcus aureus
SVYELYKQFQNLRNLFKEEGHE

SEQ ID NO: 1688744 - protein, 18 aa, Staphylococcus aureus
TAAKAILNKQHGPNTAQN

SEQ ID NO: 1688745 - protein, 18 aa, Staphylococcus aureus
TDPTLAKSIIDQATQAVT

SEQ ID NO: 1688746 - protein, 19 aa, Staphylococcus aureus
TDYIDLYYIHFPDDNTPKD

SEQ ID NO: 1688747 - protein, 24 aa, Staphylococcus aureus
TEEQMLYFGLPRINKYYTADRATV

SEQ ID NO: 1688748 - protein, 33 aa, Staphylococcus aureus
TETFETNVYPLFWTVQKALEYLKPGASITTTSS

SEQ ID NO: 1688749 - protein, 19 aa, Staphylococcus aureus
TETGIFVTIIRSFSHFSNQ

SEQ ID NO: 1688750 - protein, 20 aa, Staphylococcus aureus
TILEQNWLGGAYWSPPEVTT

SEQ ID NO: 1688751 - protein, 20 aa, Staphylococcus aureus
TIVVWRLDRLGRNMEDLITL

SEQ ID NO: 1688752 - protein, 20 aa, Staphylococcus aureus
TLASLVLGLFKPVKGEIYLS

SEQ ID NO: 1688753 - protein, 18 aa, Staphylococcus aureus
TLIPHRGIVRLVHQNHYV

SEQ ID NO: 1688754 - protein, 25 aa, Staphylococcus aureus
TLKGKKAIIYFYPRYNTPTCTTEAC

SEQ ID NO: 1688755 - protein, 33 aa, Staphylococcus aureus
TLYLTSHYKQIDYEFLYLLSMDKLFGNKRNRLT

SEQ ID NO: 1688756 - protein, 31 aa, Staphylococcus aureus
TMNGSYVFDLLISLCLFLNKHDYIKLVKNMD

SEQ ID NO: 1688757 - protein, 36 aa, Staphylococcus aureus
TNYLIDLMHRHHLKRPLILLNWNTLTGDTFITNGEY

SEQ ID NO: 1688758 - protein, 25 aa, Staphylococcus aureus
TRTLIPFLTMIQNTFGYLPEYIVAD

SEQ ID NO: 1688759 - protein, 26 aa, Staphylococcus aureus
TSRLESFIMLELQRIKGASVKLYTIP

SEQ ID NO: 1688760 - protein, 22 aa, Staphylococcus aureus
TTIIRLIMDLYQPQTGVIRVLE

SEQ ID NO: 1688761 - protein, 19 aa, Staphylococcus aureus
TTKAALNGTQNLEKAKQHA

SEQ ID NO: 1688762 - protein, 20 aa, Staphylococcus aureus
TYYFHGHIVPGWQSVKKTFD

SEQ ID NO: 1688763 - protein, 21 aa, Staphylococcus aureus
TYYFHGHIVPGWQSVKKTFDT

SEQ ID NO: 1688764 - protein, 24 aa, Staphylococcus aureus
VEDNRLTLVSLNKKYKDLYFYDNE

SEQ ID NO: 1688765 - protein, 21 aa, Staphylococcus aureus
VEGFRPVMEVQFLGFVFEVFD

SEQ ID NO: 1688766 - protein, 17 aa, Staphylococcus aureus
VEHARENNLKIIASCSF

SEQ ID NO: 1688767 - protein, 18 aa, Staphylococcus aureus
VELPLAIEDIINNIDLVI

SEQ ID NO: 1688768 - protein, 23 aa, Staphylococcus aureus
VEPVFGFMKAILGFTRMSVRGIN

SEQ ID NO: 1688769 - protein, 18 aa, Staphylococcus aureus
VGPIKLHIVPFTELQKQV

SEQ ID NO: 1688770 - protein, 17 aa, Staphylococcus aureus
VGVIRALAADPPVILMD

SEQ ID NO: 1688771 - protein, 22 aa, Staphylococcus aureus
VIDRFHIVQLLNRALNGIRVTV

SEQ ID NO: 1688772 - protein, 18 aa, Staphylococcus aureus
VINVDGFDFKLAVKKKDH

SEQ ID NO: 1688773 - protein, 17 aa, Staphylococcus aureus
VIYPYSIKKYVADVLEY

SEQ ID NO: 1688774 - protein, 24 aa, Staphylococcus aureus
VKRELGFVLMALNIRKIVARRAVY

SEQ ID NO: 1688775 - protein, 18 aa, Staphylococcus aureus
VLSYDLFQNPTDTRTLIP

SEQ ID NO: 1688776 - protein, 25 aa, Staphylococcus aureus
VMTSLNAYFKPEILNRMDDIVLFKP

SEQ ID NO: 1688777 - protein, 19 aa, Staphylococcus aureus
VNATPSARRYARENGVNLA

SEQ ID NO: 1688778 - protein, 26 aa, Staphylococcus aureus
VNIELLYVEPQFRKLGIATQLKIALE

SEQ ID NO: 1688779 - protein, 25 aa, Staphylococcus aureus
VNNKFIISSWLGTMGCGLPGAIASK

SEQ ID NO: 1688780 - protein, 19 aa, Staphylococcus aureus
VQNIEVLRFANAMFEPLWN

SEQ ID NO: 1688781 - protein, 28 aa, Staphylococcus aureus
VTNLDIKRYFYLVIHKDKYIDTKLNEVI

SEQ ID NO: 1688782 - protein, 24 aa, Staphylococcus aureus
VVTIWKNQAFLTLNDNRKLTVYFV

SEQ ID NO: 1688783 - protein, 21 aa, Staphylococcus aureus
WKDNSIIGFVMRPLINYDAIK

SEQ ID NO: 1688784 - protein, 17 aa, Staphylococcus aureus
WKKNTVKKIFYMRQYIW

SEQ ID NO: 1688785 - protein, 18 aa, Staphylococcus aureus
YAVKFYNYPNEHILNSVT

SEQ ID NO: 1688786 - protein, 18 aa, Staphylococcus aureus
YIMHRFDEEARIPFIKHM

SEQ ID NO: 1688787 - protein, 20 aa, Staphylococcus aureus
YIVRSLINTMYPHQPCYEGG

SEQ ID NO: 1688788 - protein, 22 aa, Staphylococcus aureus
YKEELIEFILSIQKNEFNIKID

SEQ ID NO: 1688789 - protein, 26 aa, Staphylococcus aureus
YKGTNFKRLLKSLSPYVKVKNDVNAA

SEQ ID NO: 1688790 - protein, 19 aa, Staphylococcus aureus
YNTLFILSSFLKSINIIEE

SEQ ID NO: 1688791 - protein, 21 aa, Staphylococcus aureus
YPQLAHHNFFFTENAYLNYQQ

SEQ ID NO: 1688792 - protein, 17 aa, Staphylococcus aureus
YQLLLDEGYIYSRPRSG

SEQ ID NO: 1688793 - protein, 20 aa, Staphylococcus aureus
YTNAVSRAETILNKTQGANT

SEQ ID NO: 1688794 - protein, 18 aa, Staphylococcus aureus
YVMTYKELATFLKVLSDS

SEQ ID NO: 1688795 - protein, 29 aa, Staphylococcus aureus
AARATIVMALYQMFHVLPSFSVAYGATAS

SEQ ID NO: 1688796 - protein, 30 aa, Staphylococcus aureus
ADDAKRTAYSQAVNAAATILNKTSGGNTPK

SEQ ID NO: 1688797 - protein, 23 aa, Staphylococcus aureus
ADKITWNWKGVFYPNPEKAIRVR

SEQ ID NO: 1688798 - protein, 22 aa, Staphylococcus aureus
ADKVYIEPLTHNFIARIIRKEQ

SEQ ID NO: 1688799 - protein, 27 aa, Staphylococcus aureus
AEEKTEALAMIKQITDQAKQGITDATT

SEQ ID NO: 1688800 - protein, 26 aa, Staphylococcus aureus
AEKNKRKFYKFAVYGKIGSGKTTFAT

SEQ ID NO: 1688801 - protein, 23 aa, Staphylococcus aureus
AEPFIKSNRLKGLSLKDVELSVL

SEQ ID NO: 1688802 - protein, 18 aa, Staphylococcus aureus
AFGFIKMKNGATIILESA

SEQ ID NO: 1688803 - protein, 25 aa, Staphylococcus aureus
AFYNMQPAFHTTKFKKLLKAINNTE

SEQ ID NO: 1688804 - protein, 24 aa, Staphylococcus aureus
AKGYTVLYMNVPQLISTIKNTYNN

SEQ ID NO: 1688805 - protein, 18 aa, Staphylococcus aureus
AKKIMKKYNIPTADYKEV

SEQ ID NO: 1688806 - protein, 34 aa, Staphylococcus aureus
AKPLKENIEIALKLLKILLKELERVLGRNTFAER

SEQ ID NO: 1688807 - protein, 17 aa, Staphylococcus aureus
ALDLLGLATLSLLDTFS

SEQ ID NO: 1688808 - protein, 21 aa, Staphylococcus aureus
ALENIRLYEKCKLLSQIETTS

SEQ ID NO: 1688809 - protein, 17 aa, Staphylococcus aureus
ALKNVFDLLPVNAFRDK

SEQ ID NO: 1688810 - protein, 18 aa, Staphylococcus aureus
ALNGTQNLEKAKQHANTA

SEQ ID NO: 1688811 - protein, 27 aa, Staphylococcus aureus
ANIQCDQLIILTAIDYVYINFNTENQQ

SEQ ID NO: 1688812 - protein, 17 aa, Staphylococcus aureus
APSGVALEFLYTNLNLK

SEQ ID NO: 1688813 - protein, 24 aa, Staphylococcus aureus
AQAFDEIREAINAQWVEYPEDWAS

SEQ ID NO: 1688814 - protein, 24 aa, Staphylococcus aureus
AQKLSFNQLILMFDQLTEAHKKLN

SEQ ID NO: 1688815 - protein, 21 aa, Staphylococcus aureus
AQSKFINRPFKEKGHWYNLEK

SEQ ID NO: 1688816 - protein, 21 aa, Staphylococcus aureus
ARPRFDNMISFNSTNDLLTWL

SEQ ID NO: 1688817 - protein, 22 aa, Staphylococcus aureus
ASTYIELLATKLHQAKQPIIIT

SEQ ID NO: 1688818 - protein, 19 aa, Staphylococcus aureus
ASYPSTVLMTATLAQVAGV

SEQ ID NO: 1688819 - protein, 27 aa, Staphylococcus aureus
ATAKLNAKTYLNTLTSITDAQKNNLIS

SEQ ID NO: 1688820 - protein, 17 aa, Staphylococcus aureus
CDYPNYHKQLEDLRSEI

SEQ ID NO: 1688821 - protein, 27 aa, Staphylococcus aureus
CFDTANQYWLYLFNHRLKGVGAADIPT

SEQ ID NO: 1688822 - protein, 20 aa, Staphylococcus aureus
CTTYKMALDFYIELSSNTVK

SEQ ID NO: 1688823 - protein, 23 aa, Staphylococcus aureus
DDLWMDLYDLFEELRDLFKEEDL

SEQ ID NO: 1688824 - protein, 18 aa, Staphylococcus aureus
DDMFILNTQAHARLDQMA

SEQ ID NO: 1688825 - protein, 19 aa, Staphylococcus aureus
DEPKLNGLAGNLDKKMNPE

SEQ ID NO: 1688826 - protein, 20 aa, Staphylococcus aureus
DGIYIDVYCALKHGVNISKT

SEQ ID NO: 1688827 - protein, 19 aa, Staphylococcus aureus
DGKHHGVFAYVVIEEHEWS

SEQ ID NO: 1688828 - protein, 19 aa, Staphylococcus aureus
DIPFAARHFHYFASVIETE

SEQ ID NO: 1688829 - protein, 20 aa, Staphylococcus aureus
DIPVAPNTLGKSGVLVVYVV

SEQ ID NO: 1688830 - protein, 24 aa, Staphylococcus aureus
DKAWAHSKSIWKGTSKWFSNAYKS

SEQ ID NO: 1688831 - protein, 26 aa, Staphylococcus aureus
DKGWHDLKIVPYGPIEISPAAQGVHY

SEQ ID NO: 1688832 - protein, 17 aa, Staphylococcus aureus
DKLARKAKVAIQELLWF

SEQ ID NO: 1688833 - protein, 22 aa, Staphylococcus aureus
DKLYAKFGFMPTEPDSGGMYIK

SEQ ID NO: 1688834 - protein, 21 aa, Staphylococcus aureus
DKTETLNSINFTDADQAKKDA

SEQ ID NO: 1688835 - protein, 27 aa, Staphylococcus aureus
DLIHYYSVETIFDLALLTLLKGDLSID

SEQ ID NO: 1688836 - protein, 17 aa, Staphylococcus aureus
DLNIYRPLFGNGSSPDE

SEQ ID NO: 1688837 - protein, 24 aa, Staphylococcus aureus
DPGFWVPNDYVVVKVALRGSDKSK

SEQ ID NO: 1688838 - protein, 27 aa, Staphylococcus aureus
DQVIKKDGYWWIRFKYQREGSSTNNFY

SEQ ID NO: 1688839 - protein, 24 aa, Staphylococcus aureus
DSCLKIKYMFPKAHAAAYVLMAVR

SEQ ID NO: 1688840 - protein, 21 aa, Staphylococcus aureus
DSEVLVCTVIGFPLGASTTAT

SEQ ID NO: 1688841 - protein, 26 aa, Staphylococcus aureus
DVEPVFGFMKAILGFTRMSVRGLNKV

SEQ ID NO: 1688842 - protein, 18 aa, Staphylococcus aureus
DVYLKHFYDSIAPSFYFD

SEQ ID NO: 1688843 - protein, 26 aa, Staphylococcus aureus
DWRTKKPVIFRATPQWFASISKVRQD

SEQ ID NO: 1688844 - protein, 23 aa, Staphylococcus aureus
EADASLAMLLYRDDYYNRDEDDS

SEQ ID NO: 1688845 - protein, 24 aa, Staphylococcus aureus
EDLRSEIMTPWIPTDTNIGGEFVP

SEQ ID NO: 1688846 - protein, 25 aa, Staphylococcus aureus
EDRKNTVLYLMHYHKRITDKQWEDA

SEQ ID NO: 1688847 - protein, 21 aa, Staphylococcus aureus
EEDIELFKDIADKVKQTNSYD

SEQ ID NO: 1688848 - protein, 17 aa, Staphylococcus aureus
EEMRLVYVALTRAKEQL

SEQ ID NO: 1688849 - protein, 33 aa, Staphylococcus aureus
EGANIEIGYLPGRLKWLVADLLTKQSLKVVNDD

SEQ ID NO: 1688850 - protein, 25 aa, Staphylococcus aureus
EGEVLKQFYNYLKQFDLTSYKIENQ

SEQ ID NO: 1688851 - protein, 22 aa, Staphylococcus aureus
EHGEILVYERLSGGGEARLHGQ

SEQ ID NO: 1688852 - protein, 19 aa, Staphylococcus aureus
EIAELLYKLPDIKKWADEV

SEQ ID NO: 1688853 - protein, 21 aa, Staphylococcus aureus
EIAQYFTDKIIGLSISDLDEY

SEQ ID NO: 1688854 - protein, 25 aa, Staphylococcus aureus
EIDENISFYKLVNKFSPEVAPEDTV

SEQ ID NO: 1688855 - protein, 26 aa, Staphylococcus aureus
EIENYQHFVYVVNFLPQILQEMRENG

SEQ ID NO: 1688856 - protein, 26 aa, Staphylococcus aureus
EIVCDYLFCKAFGKLASNIEKYTNQG

SEQ ID NO: 1688857 - protein, 21 aa, Staphylococcus aureus
EKHLELIMKWCAQELKNNFQL

SEQ ID NO: 1688858 - protein, 23 aa, Staphylococcus aureus
EKIRVKDYMFTNEKFKTFFNYVM

SEQ ID NO: 1688859 - protein, 17 aa, Staphylococcus aureus
EKRFIAKKAASLIEDGD

SEQ ID NO: 1688860 - protein, 22 aa, Staphylococcus aureus
EKYLQMAHEFCPYSKATQGNIN

SEQ ID NO: 1688861 - protein, 24 aa, Staphylococcus aureus
ELECPSIISQVKFYHVPDGITIET

SEQ ID NO: 1688862 - protein, 19 aa, Staphylococcus aureus
ELIASFSRALASDLRAGQS

SEQ ID NO: 1688863 - protein, 18 aa, Staphylococcus aureus
ELIQWAWDNPKLSGNKRF

SEQ ID NO: 1688864 - protein, 18 aa, Staphylococcus aureus
ELLRILFNYDRLSQYDLT

SEQ ID NO: 1688865 - protein, 27 aa, Staphylococcus aureus
ELPISRLLQWGADFVKPLARLAYNGGG

SEQ ID NO: 1688866 - protein, 23 aa, Staphylococcus aureus
ELRQRISYLMQQSDLFGETIEDN

SEQ ID NO: 1688867 - protein, 17 aa, Staphylococcus aureus
ENFKFFSQYADFRDLKY

SEQ ID NO: 1688868 - protein, 19 aa, Staphylococcus aureus
ENYIRRLERLETLSESYDG

SEQ ID NO: 1688869 - protein, 17 aa, Staphylococcus aureus
EQHLGVISSTNYINADD

SEQ ID NO: 1688870 - protein, 27 aa, Staphylococcus aureus
EQREIIEELMLVKGYRDANDKAFKALK

SEQ ID NO: 1688871 - protein, 17 aa, Staphylococcus aureus
ERIKSLYEEIIELQNEK

SEQ ID NO: 1688872 - protein, 20 aa, Staphylococcus aureus
ERKRRLRPWLYDGTPQKHSR

SEQ ID NO: 1688873 - protein, 19 aa, Staphylococcus aureus
ESLNTAMGNLINAIADHQT

SEQ ID NO: 1688874 - protein, 22 aa, Staphylococcus aureus
EVERLYVFTKAASSLTGDNAKI

SEQ ID NO: 1688875 - protein, 36 aa, Staphylococcus aureus
EVVECAILMIQGILGKIPFFGICLGHQLFALSQGAS

SEQ ID NO: 1688876 - protein, 17 aa, Staphylococcus aureus
EVVYGFAQLKRAAALAN

SEQ ID NO: 1688877 - protein, 26 aa, Staphylococcus aureus
EWENKFIKDIFIFENNRRKPITSSLR

SEQ ID NO: 1688878 - protein, 19 aa, Staphylococcus aureus
FCEADDWKPFYEAYGSQFG

SEQ ID NO: 1688879 - protein, 22 aa, Staphylococcus aureus
FEPLRKMEAPMFKKILKKHQLL

SEQ ID NO: 1688880 - protein, 18 aa, Staphylococcus aureus
FFIGGYVKGDIPDYQASS

SEQ ID NO: 1688881 - protein, 26 aa, Staphylococcus aureus
FFNEVKPLIAEAFYKAFDQAVIFGTK

SEQ ID NO: 1688882 - protein, 21 aa, Staphylococcus aureus
FFSQYADFRDLKYYKNGNISS

SEQ ID NO: 1688883 - protein, 21 aa, Staphylococcus aureus
FHAIYVNDYLFYVRKMGKDND

SEQ ID NO: 1688884 - protein, 18 aa, Staphylococcus aureus
FHHYLENSDLRPKTKRRK

SEQ ID NO: 1688885 - protein, 17 aa, Staphylococcus aureus
FIHDSNISWKAKGILLY

SEQ ID NO: 1688886 - protein, 17 aa, Staphylococcus aureus
FIKARWNQDFRLEDFKK

SEQ ID NO: 1688887 - protein, 22 aa, Staphylococcus aureus
FITTIESMALDWPLIEVGQSFK

SEQ ID NO: 1688888 - protein, 19 aa, Staphylococcus aureus
FKDYIAMPKQNLYQSLHTT

SEQ ID NO: 1688889 - protein, 18 aa, Staphylococcus aureus
FKGFEYLVYEKPTEMPFS

SEQ ID NO: 1688890 - protein, 18 aa, Staphylococcus aureus
FKSKDWYWNAYFEGPIKL

SEQ ID NO: 1688891 - protein, 20 aa, Staphylococcus aureus
FLKLNLQHFADTGVSGIAIG

SEQ ID NO: 1688892 - protein, 18 aa, Staphylococcus aureus
FLNQFSLEAPLDESLYPI

SEQ ID NO: 1688893 - protein, 34 aa, Staphylococcus aureus
FMTQYLMNHPNKLIPLTFFVKKFKQAKSSISEDV

SEQ ID NO: 1688894 - protein, 25 aa, Staphylococcus aureus
FNHNLSYNNLIALSIHKGIGAGLII

SEQ ID NO: 1688895 - protein, 28 aa, Staphylococcus aureus
FPWRQHDVKLVFFLAISQKDTAFTKQMM

SEQ ID NO: 1688896 - protein, 26 aa, Staphylococcus aureus
FQCYDYANMFFMLATGERLQGLYAYN

SEQ ID NO: 1688897 - protein, 26 aa, Staphylococcus aureus
GDITAPYYRDLAFVTYMGISAYDTFL

SEQ ID NO: 1688898 - protein, 19 aa, Staphylococcus aureus
GDWDYARYGILQGIEYAIS

SEQ ID NO: 1688899 - protein, 28 aa, Staphylococcus aureus
GEIEEFLERPIPSDYWYRTLEEKRVSAH

SEQ ID NO: 1688900 - protein, 32 aa, Staphylococcus aureus
GEIEGIAYDRLWIHLIPVIKEQQLRIKKLEES

SEQ ID NO: 1688901 - protein, 23 aa, Staphylococcus aureus
GFIVYKGVRIINTEDLVLPGEHN

SEQ ID NO: 1688902 - protein, 21 aa, Staphylococcus aureus
GGTFRLFEFYEQQYNIKFKYV

SEQ ID NO: 1688903 - protein, 36 aa, Staphylococcus aureus
GGVEHAVLHLLYARFWHKVLYDLAIVPTKEPFQKLF

SEQ ID NO: 1688904 - protein, 32 aa, Staphylococcus aureus
GHAAPPDEILKSSPFVWFKDALDGYDYLVEQG

SEQ ID NO: 1688905 - protein, 25 aa, Staphylococcus aureus
GIENIQPLLYHFYDMSVGICHNGNL

SEQ ID NO: 1688906 - protein, 28 aa, Staphylococcus aureus
GIKSLKISFNKVFGYFIEITRANLQNFE

SEQ ID NO: 1688907 - protein, 23 aa, Staphylococcus aureus
GKAHAIRRRAVPTWGVFLDEEAQ

SEQ ID NO: 1688908 - protein, 23 aa, Staphylococcus aureus
GKQNNYVAIWFRQERRDGTFRTV

SEQ ID NO: 1688909 - protein, 19 aa, Staphylococcus aureus
GLITAKILRAQEMNIPISI

SEQ ID NO: 1688910 - protein, 25 aa, Staphylococcus aureus
GMSNGIPNIVVYNPAPISINSLNPN

SEQ ID NO: 1688911 - protein, 20 aa, Staphylococcus aureus
GMTLQKNPLTLLVSTAGDNL

SEQ ID NO: 1688912 - protein, 18 aa, Staphylococcus aureus
GNLINAIADHQTVEQLGN

SEQ ID NO: 1688913 - protein, 21 aa, Staphylococcus aureus
GNQNIILCERGIRTYEKATRN

SEQ ID NO: 1688914 - protein, 18 aa, Staphylococcus aureus
GPAVLAGGLLIRAVGSAA

SEQ ID NO: 1688915 - protein, 22 aa, Staphylococcus aureus
GPKIYQQKLYQLGIEPNIIEIF

SEQ ID NO: 1688916 - protein, 24 aa, Staphylococcus aureus
GQHPNVVFWIGWNQEAFDVIAELK

SEQ ID NO: 1688917 - protein, 25 aa, Staphylococcus aureus
GQIDQSPEIAIVNQVKQTATSLDHA

SEQ ID NO: 1688918 - protein, 24 aa, Staphylococcus aureus
GRRANLYGLFNKAIEFENSSFRGL

SEQ ID NO: 1688919 - protein, 23 aa, Staphylococcus aureus
GTAIHIIVPIAAVDKVTHLRALL

SEQ ID NO: 1688920 - protein, 17 aa, Staphylococcus aureus
GVNVRICTPKSLNPKEA

SEQ ID NO: 1688921 - protein, 24 aa, Staphylococcus aureus
GVYGLIIPDLPYELSQRLKQQFSH

SEQ ID NO: 1688922 - protein, 19 aa, Staphylococcus aureus
GYKMLPHFQIGMFEDQLFV

SEQ ID NO: 1688923 - protein, 26 aa, Staphylococcus aureus
HDAHTAYMLVLAETLAEMKDSFTGKV

SEQ ID NO: 1688924 - protein, 32 aa, Staphylococcus aureus
HDHDFEKHMYAIHILTSLYAPTSNTPHIGEQQ

SEQ ID NO: 1688925 - protein, 32 aa, Staphylococcus aureus
HDSNISWKAKGILLYLLSRPDNWQIYETELEQ

SEQ ID NO: 1688926 - protein, 17 aa, Staphylococcus aureus
HDTIVAGGNYTNTSPDK

SEQ ID NO: 1688927 - protein, 23 aa, Staphylococcus aureus
HNHTFYRVNIPTISVLNPVGSGD

SEQ ID NO: 1688928 - protein, 17 aa, Staphylococcus aureus
HNIDPIFQIGKGGINEN

SEQ ID NO: 1688929 - protein, 28 aa, Staphylococcus aureus
HSLGGRDAIFLGLRYNIKNVVAYNPAPL

SEQ ID NO: 1688930 - protein, 21 aa, Staphylococcus aureus
HVNDYIVYSFALLWGQFACKP

SEQ ID NO: 1688931 - protein, 27 aa, Staphylococcus aureus
HYYDDPMYFIRLNFPDKVSVGDKAKSV

SEQ ID NO: 1688932 - protein, 22 aa, Staphylococcus aureus
IAYAQYLATRKVYPTQSIGVIN

SEQ ID NO: 1688933 - protein, 29 aa, Staphylococcus aureus
ICDNLLLTICHTAFEKLSIFPNMNLRMWE

SEQ ID NO: 1688934 - protein, 23 aa, Staphylococcus aureus
IDIRSSHLLILVDENPLTFDVDM

SEQ ID NO: 1688935 - protein, 19 aa, Staphylococcus aureus
IDLVILTHLHIDHFDPKAI

SEQ ID NO: 1688936 - protein, 24 aa, Staphylococcus aureus
IDTTIPFHIKLLNNDIFRSGKFNT

SEQ ID NO: 1688937 - protein, 20 aa, Staphylococcus aureus
IEACTSLKIRFLNNLELIKG

SEQ ID NO: 1688938 - protein, 26 aa, Staphylococcus aureus
IETRRYYLMLMLFSKENAMSLNHFSI

SEQ ID NO: 1688939 - protein, 25 aa, Staphylococcus aureus
IFEKDFDLLFVKWIPREQNKEANQH

SEQ ID NO: 1688940 - protein, 17 aa, Staphylococcus aureus
IGQCLGPCVYDVDLSKY

SEQ ID NO: 1688941 - protein, 25 aa, Staphylococcus aureus
IINQTTNPMLNPDDITRALTQVTDA

SEQ ID NO: 1688942 - protein, 27 aa, Staphylococcus aureus
IIRLKKEYYYNFFGQYLLSRKGKRKIF

SEQ ID NO: 1688943 - protein, 34 aa, Staphylococcus aureus
IIWSIATFYYSRMMKIMNLAILKIKIGGVNMLNI

SEQ ID NO: 1688944 - protein, 21 aa, Staphylococcus aureus
IKDRLLFHPRFEKELRAQGIV

SEQ ID NO: 1688945 - protein, 24 aa, Staphylococcus aureus
IKKLNDVYKNCNGYIAKIKQSIEA

SEQ ID NO: 1688946 - protein, 22 aa, Staphylococcus aureus
IKTKNYAKDVDILFILGGDGTV

SEQ ID NO: 1688947 - protein, 23 aa, Staphylococcus aureus
ILALFCRIFKYKFGMNNKVVIKL

SEQ ID NO: 1688948 - protein, 28 aa, Staphylococcus aureus
ILGPQDSYLLVRGIKTLGLRMEQINRSV

SEQ ID NO: 1688949 - protein, 18 aa, Staphylococcus aureus
ILTIGQYLQPSRKHLKVQ

SEQ ID NO: 1688950 - protein, 23 aa, Staphylococcus aureus
INKETEFAVLLFSTVGVSNGDTT

SEQ ID NO: 1688951 - protein, 18 aa, Staphylococcus aureus
IPISIKVKFPPPTSKFST

SEQ ID NO: 1688952 - protein, 23 aa, Staphylococcus aureus
IPVEWEQVFTIAYVTDQAGEVIF

SEQ ID NO: 1688953 - protein, 19 aa, Staphylococcus aureus
IRMMLKDPIVMLADEPTGA

SEQ ID NO: 1688954 - protein, 18 aa, Staphylococcus aureus
IVPDLIRLSKTFLIESRD

SEQ ID NO: 1688955 - protein, 19 aa, Staphylococcus aureus
IVPDLIRLSKTFLIESREL

SEQ ID NO: 1688956 - protein, 17 aa, Staphylococcus aureus
IVQTVPKSKLDFLANAP

SEQ ID NO: 1688957 - protein, 24 aa, Staphylococcus aureus
IYSEYFFRDLLNIVYGYSLENHNK

SEQ ID NO: 1688958 - protein, 28 aa, Staphylococcus aureus
KAYADVEFKLYLGLKHISPFIEDAVEQM

SEQ ID NO: 1688959 - protein, 26 aa, Staphylococcus aureus
KDTGYYISYPTIYRYIRNGLVKVDVK

SEQ ID NO: 1688960 - protein, 21 aa, Staphylococcus aureus
KEAAIIFATAKFKPFHNRIKN

SEQ ID NO: 1688961 - protein, 24 aa, Staphylococcus aureus
KEKEGLLTVLILDGLEDPHNLGSI

SEQ ID NO: 1688962 - protein, 18 aa, Staphylococcus aureus
KEVKDYLKGLKTVSVDDV

SEQ ID NO: 1688963 - protein, 19 aa, Staphylococcus aureus
KEYRKYYEPLIHKKDKEFK

SEQ ID NO: 1688964 - protein, 27 aa, Staphylococcus aureus
KFKSQNWYWFAYFDGPLKLPKNPRGSV

SEQ ID NO: 1688965 - protein, 21 aa, Staphylococcus aureus
KFMHRPFTKKWIVYDKNIMEM

SEQ ID NO: 1688966 - protein, 23 aa, Staphylococcus aureus
KGADRPLIKLVAFASEIHGESGL

SEQ ID NO: 1688967 - protein, 20 aa, Staphylococcus aureus
KGIIPVPKLIREMLKNMYNE

SEQ ID NO: 1688968 - protein, 33 aa, Staphylococcus aureus
KGSKRQLVLQPWQHFIIGSLFGWVHKETKLRRF

SEQ ID NO: 1688969 - protein, 22 aa, Staphylococcus aureus
KGSNFYWMDYYTIKQIIQRLGV

SEQ ID NO: 1688970 - protein, 20 aa, Staphylococcus aureus
KGSQLPKMFGFQAEGASPIV

SEQ ID NO: 1688971 - protein, 24 aa, Staphylococcus aureus
KHDINGDVPIFINIGEWDGDDEEL

SEQ ID NO: 1688972 - protein, 18 aa, Staphylococcus aureus
KHGIKMIYGMEGMLVDDG

SEQ ID NO: 1688973 - protein, 25 aa, Staphylococcus aureus
KIAYVVEFFEWFNTLETFKNWKKKP

SEQ ID NO: 1688974 - protein, 18 aa, Staphylococcus aureus
KISFLSHSHWHLRSLNVQ

SEQ ID NO: 1688975 - protein, 22 aa, Staphylococcus aureus
KISLQMHAFPKEIRKIVFNEEY

SEQ ID NO: 1688976 - protein, 22 aa, Staphylococcus aureus
KKDIDKTIFPGIQGGPLEHVIA

SEQ ID NO: 1688977 - protein, 17 aa, Staphylococcus aureus
KKEFLSLIPNVTCNYIK

SEQ ID NO: 1688978 - protein, 19 aa, Staphylococcus aureus
KKKEFLSLIPNVTCNYIKT

SEQ ID NO: 1688979 - protein, 19 aa, Staphylococcus aureus
KKQLFNATSIYLEAIYSLC

SEQ ID NO: 1688980 - protein, 27 aa, Staphylococcus aureus
KLVDGFTHLPGWVRKASVGLAIFGASI

SEQ ID NO: 1688981 - protein, 19 aa, Staphylococcus aureus
KNFKYSLLNGWELMEDELK

SEQ ID NO: 1688982 - protein, 20 aa, Staphylococcus aureus
KNKEVWYSKLYFCSNCKNTK

SEQ ID NO: 1688983 - protein, 18 aa, Staphylococcus aureus
KQILGVDPAFRTGCKLAV

SEQ ID NO: 1688984 - protein, 22 aa, Staphylococcus aureus
KQTIDQLTHLNADQIATAKQNI

SEQ ID NO: 1688985 - protein, 17 aa, Staphylococcus aureus
KSFSYAFDLLPEDQRKA

SEQ ID NO: 1688986 - protein, 17 aa, Staphylococcus aureus
KSVFPNLKIHHLRHSYA

SEQ ID NO: 1688987 - protein, 23 aa, Staphylococcus aureus
KTVIDYYHRFVERFPTVEVLSQA

SEQ ID NO: 1688988 - protein, 19 aa, Staphylococcus aureus
KVNDLEYPLFFMVTKNLSK

SEQ ID NO: 1688989 - protein, 24 aa, Staphylococcus aureus
KYDKLYSLYSLLYTMKKISANLQG

SEQ ID NO: 1688990 - protein, 26 aa, Staphylococcus aureus
KYLDELYQKIMLFGQAVDFSSDKFGS

SEQ ID NO: 1688991 - protein, 27 aa, Staphylococcus aureus
LAILDYALRRRFAFYNMQPAFHTTKFK

SEQ ID NO: 1688992 - protein, 26 aa, Staphylococcus aureus
LDDDSYLNLIFKFTRNIPVNKLEESQ

SEQ ID NO: 1688993 - protein, 20 aa, Staphylococcus aureus
LDFHKLKEILMQWQRGIYDG

SEQ ID NO: 1688994 - protein, 17 aa, Staphylococcus aureus
LEPPIKEWEKMGLLTIV

SEQ ID NO: 1688995 - protein, 26 aa, Staphylococcus aureus
LEVKTPYKKWFERMSDYGFEENIDYV

SEQ ID NO: 1688996 - protein, 18 aa, Staphylococcus aureus
LFTYFVKHNPMTACYFVT

SEQ ID NO: 1688997 - protein, 18 aa, Staphylococcus aureus
LGINYYMSDWMRGYDGES

SEQ ID NO: 1688998 - protein, 26 aa, Staphylococcus aureus
LGPQDSYLLVRGIKTLGLRMEQINRS

SEQ ID NO: 1688999 - protein, 38 aa, Staphylococcus aureus
LHYLARLIEAGDLPTIVRRLLVISYEDIGLASPNAGQR

SEQ ID NO: 1689000 - protein, 30 aa, Staphylococcus aureus
LILSGTGMYPLWKGLPTVKVLQLITKIYGA

SEQ ID NO: 1689001 - protein, 26 aa, Staphylococcus aureus
LKSITFTHEFMFARPIHRTPDMIKQH

SEQ ID NO: 1689002 - protein, 25 aa, Staphylococcus aureus
LKSNMYSYKLISLMIEYLRFANCTQ

SEQ ID NO: 1689003 - protein, 20 aa, Staphylococcus aureus
LLLDEGYIYSRPRSGYFVSK

SEQ ID NO: 1689004 - protein, 18 aa, Staphylococcus aureus
LLQPILKGKIAYSNPNTT

SEQ ID NO: 1689005 - protein, 18 aa, Staphylococcus aureus
LLVKTLFIDEIKRQLTYY

SEQ ID NO: 1689006 - protein, 17 aa, Staphylococcus aureus
LMQHESIPYVIDPVMLA

SEQ ID NO: 1689007 - protein, 28 aa, Staphylococcus aureus
LNEIKLHREFIIEVPYMNSRKFELLIAN

SEQ ID NO: 1689008 - protein, 17 aa, Staphylococcus aureus
LNELLREKMSTGNLILS

SEQ ID NO: 1689009 - protein, 17 aa, Staphylococcus aureus
LSCPVGYQFQPGGYCDY

SEQ ID NO: 1689010 - protein, 18 aa, Staphylococcus aureus
LSIFPNMNLRMWENPVTQ

SEQ ID NO: 1689011 - protein, 18 aa, Staphylococcus aureus
LSNNIMFELFKKDTQDYS

SEQ ID NO: 1689012 - protein, 24 aa, Staphylococcus aureus
LSQQLLLHLTPAFYRIKYNLTDRD

SEQ ID NO: 1689013 - protein, 25 aa, Staphylococcus aureus
LTEAQALDQLMDALQQSIADKDATR

SEQ ID NO: 1689014 - protein, 28 aa, Staphylococcus aureus
LTSILTLSDLFNWSRFKVKTFLDLLESD

SEQ ID NO: 1689015 - protein, 18 aa, Staphylococcus aureus
LVFMKDGRMILTEQKDIL

SEQ ID NO: 1689016 - protein, 18 aa, Staphylococcus aureus
LVSLFLLLQMENVQLIGV

SEQ ID NO: 1689017 - protein, 35 aa, Staphylococcus aureus
MREGKLTVAGLLLFSNHINVYLPGARIRFMRYEGT

SEQ ID NO: 1689018 - protein, 35 aa, Staphylococcus aureus
MTFERKMTAMLRYQFKVILSALKRKGYNLDDDSYL

SEQ ID NO: 1689019 - protein, 17 aa, Staphylococcus aureus
NAKDLINQTNNPTLDKA

SEQ ID NO: 1689020 - protein, 25 aa, Staphylococcus aureus
NAQTLNTAMKGLRDSIANEATIKAE

SEQ ID NO: 1689021 - protein, 18 aa, Staphylococcus aureus
NDPVLYFEHKKAYRFLKE

SEQ ID NO: 1689022 - protein, 23 aa, Staphylococcus aureus
NEHELRAMLRMMPSLIDTGDDND

SEQ ID NO: 1689023 - protein, 24 aa, Staphylococcus aureus
NEIDNFDLVLVYKLDRLTRSVKDL

SEQ ID NO: 1689024 - protein, 24 aa, Staphylococcus aureus
NERDAWFVLYPPSKASSCFTLIVD

SEQ ID NO: 1689025 - protein, 17 aa, Staphylococcus aureus
NEYFIKKWQRELEALYH

SEQ ID NO: 1689026 - protein, 23 aa, Staphylococcus aureus
NGTYYFHGHIVPGWQGVKKTFDT

SEQ ID NO: 1689027 - protein, 24 aa, Staphylococcus aureus
NIGDKELIHMWSGQSPRLATTHPA

SEQ ID NO: 1689028 - protein, 25 aa, Staphylococcus aureus
NIPTQKAPKLLLKGSGNLKGSSVGY

SEQ ID NO: 1689029 - protein, 24 aa, Staphylococcus aureus
NKKHYLPLQNIVFKTSLSILNKTV

SEQ ID NO: 1689030 - protein, 20 aa, Staphylococcus aureus
NLPDYVQIWPGHGAGSPCGK

SEQ ID NO: 1689031 - protein, 25 aa, Staphylococcus aureus
NMINLENLAFFLDITTNYYSIEEFR

SEQ ID NO: 1689032 - protein, 19 aa, Staphylococcus aureus
NNLISRYRKVDEDFFEALE

SEQ ID NO: 1689033 - protein, 25 aa, Staphylococcus aureus
NNQMFDLFHLYIEQFDNIIEKFYEI

SEQ ID NO: 1689034 - protein, 23 aa, Staphylococcus aureus
NQEIIDYIDTLNYIDQYSSAGSF

SEQ ID NO: 1689035 - protein, 18 aa, Staphylococcus aureus
NRPFKEKGHWYNLEKEWQ

SEQ ID NO: 1689036 - protein, 20 aa, Staphylococcus aureus
NSIFVGDYLITGGQPNQLDY

SEQ ID NO: 1689037 - protein, 23 aa, Staphylococcus aureus
NVKKLREVYPITTKKSPVLKLHI

SEQ ID NO: 1689038 - protein, 26 aa, Staphylococcus aureus
NVVTRPLMEEWLFNTVAFVGGPSEIK

SEQ ID NO: 1689039 - protein, 18 aa, Staphylococcus aureus
NYVLMTYYNIICHYGEQA

SEQ ID NO: 1689040 - protein, 25 aa, Staphylococcus aureus
PADFRMLTPIVLEQAFRKAGTELLE

SEQ ID NO: 1689041 - protein, 21 aa, Staphylococcus aureus
PCLRYHQTFYTMTGKPFDSSD

SEQ ID NO: 1689042 - protein, 25 aa, Staphylococcus aureus
PDQDRIYLLSKTLNVGEAWLMGYDV

SEQ ID NO: 1689043 - protein, 21 aa, Staphylococcus aureus
PEFKRLLRYYGAIKVSDNGGV

SEQ ID NO: 1689044 - protein, 20 aa, Staphylococcus aureus
PERIVKFMHRPFTKKWIVYD

SEQ ID NO: 1689045 - protein, 26 aa, Staphylococcus aureus
PGSLNPKFLNVSSLIQYIQAAYHEPL

SEQ ID NO: 1689046 - protein, 19 aa, Staphylococcus aureus
PGVDILSIIYQHGIEIEFP

SEQ ID NO: 1689047 - protein, 17 aa, Staphylococcus aureus
PILYQIWKKKHKKAYYK

SEQ ID NO: 1689048 - protein, 17 aa, Staphylococcus aureus
PKSKLPDIPHHKFLEMI

SEQ ID NO: 1689049 - protein, 25 aa, Staphylococcus aureus
PLDDIMKMIPGMNKMKGLDKLNMSE

SEQ ID NO: 1689050 - protein, 19 aa, Staphylococcus aureus
PLLDKFMKDLIIQILAMIS

SEQ ID NO: 1689051 - protein, 25 aa, Staphylococcus aureus
PPQLAFAIGNAIKYLSRAPLKNGHE

SEQ ID NO: 1689052 - protein, 23 aa, Staphylococcus aureus
PQGSKLMGYYQNELYDYASQLDS

SEQ ID NO: 1689053 - protein, 29 aa, Staphylococcus aureus
PSPDCLMLFQHHNLLPWKTINDNIRIGLQ

SEQ ID NO: 1689054 - protein, 19 aa, Staphylococcus aureus
PTVIYMERPLKNAEYTIHI

SEQ ID NO: 1689055 - protein, 22 aa, Staphylococcus aureus
PTYKKFLIQLKGRKFAHRTKSM

SEQ ID NO: 1689056 - protein, 18 aa, Staphylococcus aureus
PVSLFERDMFALRATMHI

SEQ ID NO: 1689057 - protein, 23 aa, Staphylococcus aureus
QAIDNLTHLNTPQKTALKQQVNA

SEQ ID NO: 1689058 - protein, 30 aa, Staphylococcus aureus
QAQTRILFHALRKMGIPTIFFINKIDQNGI

SEQ ID NO: 1689059 - protein, 23 aa, Staphylococcus aureus
QDEVKELNRLLGKVIHAFDETKE

SEQ ID NO: 1689060 - protein, 20 aa, Staphylococcus aureus
QEEIFGPVLTVIKVKDDQEA

SEQ ID NO: 1689061 - protein, 20 aa, Staphylococcus aureus
QELRELLKLLTEQGTSIIIS

SEQ ID NO: 1689062 - protein, 23 aa, Staphylococcus aureus
QEYQKSLNTLKKPINVPYEQETE

SEQ ID NO: 1689063 - protein, 24 aa, Staphylococcus aureus
QFKSLRRFFKIYVRGIRALANFDI

SEQ ID NO: 1689064 - protein, 17 aa, Staphylococcus aureus
QHAIDQLPNLNQAQRDE

SEQ ID NO: 1689065 - protein, 23 aa, Staphylococcus aureus
QHSQFPYKNIEWLIKEGYGKLTL

SEQ ID NO: 1689066 - protein, 18 aa, Staphylococcus aureus
QIAEKRFIAKKAASLIED

SEQ ID NO: 1689067 - protein, 20 aa, Staphylococcus aureus
QIAEKRFIAKKAASLIEDGD

SEQ ID NO: 1689068 - protein, 18 aa, Staphylococcus aureus
QIDQIIDEAKAYNFKSVC

SEQ ID NO: 1689069 - protein, 17 aa, Staphylococcus aureus
QKYLDFFVEKGHMVEPS

SEQ ID NO: 1689070 - protein, 17 aa, Staphylococcus aureus
QKYNIIKPFILGEQSLS

SEQ ID NO: 1689071 - protein, 23 aa, Staphylococcus aureus
QLLKMFVSTMETRLNDHNKAKHS

SEQ ID NO: 1689072 - protein, 17 aa, Staphylococcus aureus
QLLMKLLKDDIVEEKTI

SEQ ID NO: 1689073 - protein, 18 aa, Staphylococcus aureus
QMRPLVVMSPKSLLRNKT

SEQ ID NO: 1689074 - protein, 21 aa, Staphylococcus aureus
QQEYPQFLYENVMSKISSRDG

SEQ ID NO: 1689075 - protein, 26 aa, Staphylococcus aureus
QQIANGTPTPVLTPDAVTQAVTTMNQ

SEQ ID NO: 1689076 - protein, 22 aa, Staphylococcus aureus
QSVFHIHFHLIPRYENDIDGFG

SEQ ID NO: 1689077 - protein, 18 aa, Staphylococcus aureus
QTTIFIDEGWAFSASRQG

SEQ ID NO: 1689078 - protein, 25 aa, Staphylococcus aureus
QVANDKEFYIFDSLIQGRSYKDISS

SEQ ID NO: 1689079 - protein, 18 aa, Staphylococcus aureus
RAISKNMLFIPFEGENVD

SEQ ID NO: 1689080 - protein, 17 aa, Staphylococcus aureus
RAKRYNRWLQFDYVIHS

SEQ ID NO: 1689081 - protein, 24 aa, Staphylococcus aureus
RDHDTVRIYKPWLTAHQLSLPKYV

SEQ ID NO: 1689082 - protein, 24 aa, Staphylococcus aureus
RDRQEWWYNVFYDDGKYNKKIIKN

SEQ ID NO: 1689083 - protein, 27 aa, Staphylococcus aureus
RENEQSYDAFLYLKNKMNYSEESNAKV

SEQ ID NO: 1689084 - protein, 18 aa, Staphylococcus aureus
RENYGTLGLAFIKQYESK

SEQ ID NO: 1689085 - protein, 17 aa, Staphylococcus aureus
RFTDFPKDFKGIAGWIL

SEQ ID NO: 1689086 - protein, 20 aa, Staphylococcus aureus
RFTDFPKDFKGIAGWILEVK

SEQ ID NO: 1689087 - protein, 17 aa, Staphylococcus aureus
RLYGIFLLDQLNGKEIV

SEQ ID NO: 1689088 - protein, 19 aa, Staphylococcus aureus
RNMTMYVTAPVVAGFAVAA

SEQ ID NO: 1689089 - protein, 17 aa, Staphylococcus aureus
RPSIEALNYYATRFMLT

SEQ ID NO: 1689090 - protein, 30 aa, Staphylococcus aureus
RQKVSMIFQHFNLLWSRTVLKNIMFPLEIA

SEQ ID NO: 1689091 - protein, 21 aa, Staphylococcus aureus
RRPVHLHLPIDVAISEIEIPT

SEQ ID NO: 1689092 - protein, 17 aa, Staphylococcus aureus
RVLNSYGLSSKIMKEDK

SEQ ID NO: 1689093 - protein, 21 aa, Staphylococcus aureus
RYGCALAIEVLKRLKDENIGI

SEQ ID NO: 1689094 - protein, 19 aa, Staphylococcus aureus
RYWNGRWIEATPNDVEKLG

SEQ ID NO: 1689095 - protein, 17 aa, Staphylococcus aureus
RYWNGRWIEETPNDVEK

SEQ ID NO: 1689096 - protein, 24 aa, Staphylococcus aureus
SAEPFIKSNRLKGLSLKDVELSVL

SEQ ID NO: 1689097 - protein, 22 aa, Staphylococcus aureus
SANLGLKALYQIATIPVEHREE

SEQ ID NO: 1689098 - protein, 19 aa, Staphylococcus aureus
SEQSVRLWYETLLDKIVEV

SEQ ID NO: 1689099 - protein, 30 aa, Staphylococcus aureus
SFSDKYEWLLEFFPFLDPQHFVFCGRKNIV

SEQ ID NO: 1689100 - protein, 31 aa, Staphylococcus aureus
SMVNIELLYVEPQFRKLGIATQLKIALEKWA

SEQ ID NO: 1689101 - protein, 29 aa, Staphylococcus aureus
SNFYRDKLGYLFQNYGLIVNLTVNENLDI

SEQ ID NO: 1689102 - protein, 24 aa, Staphylococcus aureus
SQLFEDEYFMYGLQTYAESNNSDV

SEQ ID NO: 1689103 - protein, 30 aa, Staphylococcus aureus
SQMMLYELRNLFPEIIFLDAISLRTFENYT

SEQ ID NO: 1689104 - protein, 23 aa, Staphylococcus aureus
SQQKLLETLVAFSVAEGLSKMVD

SEQ ID NO: 1689105 - protein, 18 aa, Staphylococcus aureus
SRNKLEPIMLIIVNDVDH

SEQ ID NO: 1689106 - protein, 27 aa, Staphylococcus aureus
SSFVYKRRLPFHAKRFNDWLESMPNNV

SEQ ID NO: 1689107 - protein, 28 aa, Staphylococcus aureus
SSIAYKVMLDIFYPELITIGSNSVIGYN

SEQ ID NO: 1689108 - protein, 27 aa, Staphylococcus aureus
SSNERWLRRVINSLVYDYGYPIGCSYK

SEQ ID NO: 1689109 - protein, 21 aa, Staphylococcus aureus
STFEIKPKYDLNIMKSGQTLS

SEQ ID NO: 1689110 - protein, 23 aa, Staphylococcus aureus
STLINLLIEQDILPSSPVPTTSN

SEQ ID NO: 1689111 - protein, 25 aa, Staphylococcus aureus
STYRKQFCKLLLKSAKVSVIKGNAS

SEQ ID NO: 1689112 - protein, 18 aa, Staphylococcus aureus
SVFGFKVVDADKAAREAV

SEQ ID NO: 1689113 - protein, 27 aa, Staphylococcus aureus
SVKQFKQLRVWIWETKKRDGKHHGVFA

SEQ ID NO: 1689114 - protein, 20 aa, Staphylococcus aureus
TAEQVIKLNDAVTAAKKALN

SEQ ID NO: 1689115 - protein, 19 aa, Staphylococcus aureus
TDKVPGLNRFAFTLSNADN

SEQ ID NO: 1689116 - protein, 27 aa, Staphylococcus aureus
TDSNGKMIPMRKLLDQLREKFKHLSKD

SEQ ID NO: 1689117 - protein, 22 aa, Staphylococcus aureus
TDYIDLYYIHFPDNNTPKDQAV

SEQ ID NO: 1689118 - protein, 18 aa, Staphylococcus aureus
TFSPLLLDTLYHLNETTY

SEQ ID NO: 1689119 - protein, 24 aa, Staphylococcus aureus
TGHYISYPTIYRYIRNGLVKVDVK

SEQ ID NO: 1689120 - protein, 17 aa, Staphylococcus aureus
TGQKILFRGLDDPLKIT

SEQ ID NO: 1689121 - protein, 18 aa, Staphylococcus aureus
TGQKILFRGLDDPLKITS

SEQ ID NO: 1689122 - protein, 22 aa, Staphylococcus aureus
TIEEAISTFIPDLYEKHSTNRY

SEQ ID NO: 1689123 - protein, 31 aa, Staphylococcus aureus
TIHIEVPPNPFWASIGLSVSPLPLGSGMQYE

SEQ ID NO: 1689124 - protein, 22 aa, Staphylococcus aureus
TIKYMISMFIPDNDFMASLISD

SEQ ID NO: 1689125 - protein, 25 aa, Staphylococcus aureus
TINDLPKEWLNPSALAPVVEFEDMN

SEQ ID NO: 1689126 - protein, 50 aa, Staphylococcus aureus
TINKPYLLEAPFWTVDTLFYCTPKKETDILFILSLFRKINWKVYDESTGV

SEQ ID NO: 1689127 - protein, 29 aa, Staphylococcus aureus
TIPTSKLIQPIMQLFIDNAILNNVQNDAL

SEQ ID NO: 1689128 - protein, 22 aa, Staphylococcus aureus
TKKRQRLAYIRLYSGVLHLRDS

SEQ ID NO: 1689129 - protein, 31 aa, Staphylococcus aureus
TLDYDIVFSPMFVLTHKKLFITKVALSENEQ

SEQ ID NO: 1689130 - protein, 22 aa, Staphylococcus aureus
TLRMNYLFDFYQSLLTNKQRNY

SEQ ID NO: 1689131 - protein, 30 aa, Staphylococcus aureus
TMNGSYVFDLLISLCLFLNKHDYIKLMKNM

SEQ ID NO: 1689132 - protein, 19 aa, Staphylococcus aureus
TMTLIREMRLMWKEMMVIL

SEQ ID NO: 1689133 - protein, 23 aa, Staphylococcus aureus
TMYHSPIRLLVVVQAPDFVVARL

SEQ ID NO: 1689134 - protein, 18 aa, Staphylococcus aureus
TNLNLKADKLARKAKVAI

SEQ ID NO: 1689135 - protein, 20 aa, Staphylococcus aureus
TRQKAFEEYEWLKNVAKNDI

SEQ ID NO: 1689136 - protein, 22 aa, Staphylococcus aureus
TRYNDWFERMINYGFEENIDYT

SEQ ID NO: 1689137 - protein, 29 aa, Staphylococcus aureus
TSHYKQIDYEFLYLLSMDKLFGNKRNRLT

SEQ ID NO: 1689138 - protein, 17 aa, Staphylococcus aureus
TSRQLTKLLFYSGLRIG

SEQ ID NO: 1689139 - protein, 20 aa, Staphylococcus aureus
VALEFLYTNLNLKADKLARK

SEQ ID NO: 1689140 - protein, 17 aa, Staphylococcus aureus
VAYGHYIEDFPRQCIFI

SEQ ID NO: 1689141 - protein, 23 aa, Staphylococcus aureus
VEDIRWLRCDIKSLNLLGNVLAK

SEQ ID NO: 1689142 - protein, 22 aa, Staphylococcus aureus
VELKIRYKVPKIAYASHLKSDV

SEQ ID NO: 1689143 - protein, 17 aa, Staphylococcus aureus
VGPKGIIRRMVDTKKLT

SEQ ID NO: 1689144 - protein, 26 aa, Staphylococcus aureus
VHKTAMSMLILQEPIYMSDGTAIHII

SEQ ID NO: 1689145 - protein, 34 aa, Staphylococcus aureus
VKILFVAATAPFTPFYRALDWIVTDPLESIKEEI

SEQ ID NO: 1689146 - protein, 17 aa, Staphylococcus aureus
VLNKKLIVMDSEYAPAI

SEQ ID NO: 1689147 - protein, 20 aa, Staphylococcus aureus
VMGQLDFLIAKARCSRSIKG

SEQ ID NO: 1689148 - protein, 18 aa, Staphylococcus aureus
VRCKLFLEKEEEKIHVAN

SEQ ID NO: 1689149 - protein, 29 aa, Staphylococcus aureus
VSFKLVATELLWFIKGDTNIQYLLKYNNN

SEQ ID NO: 1689150 - protein, 26 aa, Staphylococcus aureus
VTDCKICFKYGLYYSPVSTPADFRML

SEQ ID NO: 1689151 - protein, 32 aa, Staphylococcus aureus
VTEKPKPWDVYAFPYYYVYNDFSDHYPIKAYS

SEQ ID NO: 1689152 - protein, 19 aa, Staphylococcus aureus
VVIVVSRFNDFITGRLLEG

SEQ ID NO: 1689153 - protein, 18 aa, Staphylococcus aureus
WEVLLKPAKRIKVGNKLN

SEQ ID NO: 1689154 - protein, 25 aa, Staphylococcus aureus
WKGTSKWFSNAYKSAKGWLTDMANK

SEQ ID NO: 1689155 - protein, 27 aa, Staphylococcus aureus
WVNREENVLLLRKYYAFIKLDHNDIIK

SEQ ID NO: 1689156 - protein, 22 aa, Staphylococcus aureus
YAHFIHQYMKQAAPFIEADIFN

SEQ ID NO: 1689157 - protein, 17 aa, Staphylococcus aureus
YANLGYQRASMYDIYPP

SEQ ID NO: 1689158 - protein, 26 aa, Staphylococcus aureus
YDIVFSPMFVLTHKKLFITKVALSEN

SEQ ID NO: 1689159 - protein, 22 aa, Staphylococcus aureus
YDLIQLSYRLLPEVSLDCIIDD

SEQ ID NO: 1689160 - protein, 27 aa, Staphylococcus aureus
YDTSNPDVAVLRRYWNGRWIEETPNDV

SEQ ID NO: 1689161 - protein, 19 aa, Staphylococcus aureus
YENFVFTNDKKKSIILAFK

SEQ ID NO: 1689162 - protein, 17 aa, Staphylococcus aureus
YFYIMHRFDEEARIPFI

SEQ ID NO: 1689163 - protein, 27 aa, Staphylococcus aureus
YHDIKSPMVGTFFLQDSKELTEPIVKV

SEQ ID NO: 1689164 - protein, 18 aa, Staphylococcus aureus
YHKLFTDKHDINGDVPIF

SEQ ID NO: 1689165 - protein, 18 aa, Staphylococcus aureus
YIKRILNEEVRADNYFVY

SEQ ID NO: 1689166 - protein, 20 aa, Staphylococcus aureus
YIRDIDPTLLLLEIDKESKI

SEQ ID NO: 1689167 - protein, 25 aa, Staphylococcus aureus
YKARYDVTILINGLPLVQVELKRRG

SEQ ID NO: 1689168 - protein, 26 aa, Staphylococcus aureus
YKVFTSFYRKWRPYLRHRDVYHYDLK

SEQ ID NO: 1689169 - protein, 19 aa, Staphylococcus aureus
YLDFFVEKGHMVEPSAPLV

SEQ ID NO: 1689170 - protein, 29 aa, Staphylococcus aureus
YNKTLEQPVLYPGWNHFKANRLMKKIVFR

SEQ ID NO: 1689171 - protein, 17 aa, Staphylococcus aureus
YNTIYQNLKNVSLTGMR

SEQ ID NO: 1689172 - protein, 18 aa, Staphylococcus aureus
YQNKPIMYNLDRIVVYMR

SEQ ID NO: 1689173 - protein, 17 aa, Staphylococcus aureus
YRDLVEEKIIPEIKEDG

SEQ ID NO: 1689174 - protein, 18 aa, Staphylococcus aureus
YRGWNKEIFILQGKNMNV

SEQ ID NO: 1689175 - protein, 21 aa, Staphylococcus aureus
YRYGNRKFWCKGFYVDTVGRN

SEQ ID NO: 1689176 - protein, 19 aa, Staphylococcus aureus
YTNAVAHAEGILSKANGSN

SEQ ID NO: 1689177 - protein, 25 aa, Staphylococcus aureus
AEVIERLRPFLLRDGGDCSLIDVED

SEQ ID NO: 1689178 - protein, 32 aa, Staphylococcus aureus
AFPLHPEFRTMPMVWYCPPLSPIMSYFEGKNT

SEQ ID NO: 1689179 - protein, 19 aa, Staphylococcus aureus
AGKIDWVTKFPEGEYSKIY

SEQ ID NO: 1689180 - protein, 18 aa, Staphylococcus aureus
AIAVGHELGLIYNTIYQN

SEQ ID NO: 1689181 - protein, 17 aa, Staphylococcus aureus
AIKTPTMTSYTLAEYKT

SEQ ID NO: 1689182 - protein, 18 aa, Staphylococcus aureus
AIYNCKTPIISAVGHETD

SEQ ID NO: 1689183 - protein, 25 aa, Staphylococcus aureus
AKKPNWPVTPWPTAYSEIYDYQWNE

SEQ ID NO: 1689184 - protein, 18 aa, Staphylococcus aureus
AKLFILLVGERPEEVTDL

SEQ ID NO: 1689185 - protein, 17 aa, Staphylococcus aureus
ALHWHEDMFQIPQQAEL

SEQ ID NO: 1689186 - protein, 18 aa, Staphylococcus aureus
ALQDIVNLLLDDVQVTLD

SEQ ID NO: 1689187 - protein, 27 aa, Staphylococcus aureus
ALVTGYDIIFFWVARMIFQGLEFTDRR

SEQ ID NO: 1689188 - protein, 20 aa, Staphylococcus aureus
AMGRLFVTLVGAMAEWERTT

SEQ ID NO: 1689189 - protein, 23 aa, Staphylococcus aureus
APLKALIFDSEYDPYRGVISSIR

SEQ ID NO: 1689190 - protein, 20 aa, Staphylococcus aureus
APLYTLNIQTTVSTTGKTGV

SEQ ID NO: 1689191 - protein, 17 aa, Staphylococcus aureus
AQILKYFNIEHINLLSN

SEQ ID NO: 1689192 - protein, 22 aa, Staphylococcus aureus
AQKNNLISQISSATRVSSVDTV

SEQ ID NO: 1689193 - protein, 19 aa, Staphylococcus aureus
ARRLGESLQLINILRDVGE

SEQ ID NO: 1689194 - protein, 20 aa, Staphylococcus aureus
ASLVLILSDHSEFKNLSDSH

SEQ ID NO: 1689195 - protein, 24 aa, Staphylococcus aureus
ASQIIQFLGFVLNNEIEIDYYSFI

SEQ ID NO: 1689196 - protein, 21 aa, Staphylococcus aureus
ATTSKPFFLEFMAKDVSKGNA

SEQ ID NO: 1689197 - protein, 20 aa, Staphylococcus aureus
AVEQALQRVNTAKTALNGDA

SEQ ID NO: 1689198 - protein, 24 aa, Staphylococcus aureus
CINGYRWITYIANSGQRRYIATGE

SEQ ID NO: 1689199 - protein, 18 aa, Staphylococcus aureus
CLGKVIGGGLPVGAFGGK

SEQ ID NO: 1689200 - protein, 20 aa, Staphylococcus aureus
CLRYHQTFYTMTGKPFDSSD

SEQ ID NO: 1689201 - protein, 19 aa, Staphylococcus aureus
CVDATYRTFYQHILVYEVE

SEQ ID NO: 1689202 - protein, 24 aa, Staphylococcus aureus
DALNLNKEELLKAKPDLILAHESQ

SEQ ID NO: 1689203 - protein, 24 aa, Staphylococcus aureus
DEDLEPMVLFVNPLDAGKLRGDAS

SEQ ID NO: 1689204 - protein, 27 aa, Staphylococcus aureus
DGAYCINGYRWITYIANSGQCRYIATG

SEQ ID NO: 1689205 - protein, 17 aa, Staphylococcus aureus
DILLNHPLIDEEVANSL

SEQ ID NO: 1689206 - protein, 17 aa, Staphylococcus aureus
DILLYGEEMIDLPKLSV

SEQ ID NO: 1689207 - protein, 20 aa, Staphylococcus aureus
DILTIGQYLQPSRKHLKVQK

SEQ ID NO: 1689208 - protein, 24 aa, Staphylococcus aureus
DKDSEHYGLWAFKKVWGTYLSEKI

SEQ ID NO: 1689209 - protein, 26 aa, Staphylococcus aureus
DKQYFPATHWKAINGVPYAGSSDIDG

SEQ ID NO: 1689210 - protein, 17 aa, Staphylococcus aureus
DLVRQFKEIPLVDYIFC

SEQ ID NO: 1689211 - protein, 17 aa, Staphylococcus aureus
DNKFSVITVVNWAIYQS

SEQ ID NO: 1689212 - protein, 26 aa, Staphylococcus aureus
DNLKANYDNAIANAAHELDKVQGNAI

SEQ ID NO: 1689213 - protein, 18 aa, Staphylococcus aureus
DVEFVYTPYLLKCVTSEQ

SEQ ID NO: 1689214 - protein, 22 aa, Staphylococcus aureus
DVHTVYKMMTLFNNQSYIDDKG

SEQ ID NO: 1689215 - protein, 26 aa, Staphylococcus aureus
EAKRKGLEPLAIWMKARKHEVSIEEK

SEQ ID NO: 1689216 - protein, 26 aa, Staphylococcus aureus
EAVQSLLHYLAFYTGKNKQQMERIFL

SEQ ID NO: 1689217 - protein, 17 aa, Staphylococcus aureus
ECYEIYHPLESVGIYVP

SEQ ID NO: 1689218 - protein, 25 aa, Staphylococcus aureus
EDEVRKEFQFLDYAQIAFVSAKERT

SEQ ID NO: 1689219 - protein, 20 aa, Staphylococcus aureus
EDFLLVKREIFSSGKSLCKI

SEQ ID NO: 1689220 - protein, 17 aa, Staphylococcus aureus
EDNYRLILLTRHQNDIP

SEQ ID NO: 1689221 - protein, 17 aa, Staphylococcus aureus
EDVEKRLFLARKQLEFY

SEQ ID NO: 1689222 - protein, 17 aa, Staphylococcus aureus
EEIKKEVLYLLKCVGLS

SEQ ID NO: 1689223 - protein, 22 aa, Staphylococcus aureus
EEINFFIGGYVKGDIPDYQASS

SEQ ID NO: 1689224 - protein, 19 aa, Staphylococcus aureus
EEMKPMIAEAFYKKFDEAG

SEQ ID NO: 1689225 - protein, 17 aa, Staphylococcus aureus
EESKVIAPFNGLISMIV

SEQ ID NO: 1689226 - protein, 21 aa, Staphylococcus aureus
EEYLMLHKKFIKPINKNFIVK

SEQ ID NO: 1689227 - protein, 19 aa, Staphylococcus aureus
EFDVLLFSNVGISNGDFTP

SEQ ID NO: 1689228 - protein, 23 aa, Staphylococcus aureus
EFLEQEYGKDNLLYATVHMDEKT

SEQ ID NO: 1689229 - protein, 18 aa, Staphylococcus aureus
EGAQLLIDFLSNNNLMRI

SEQ ID NO: 1689230 - protein, 28 aa, Staphylococcus aureus
EISNIFYDIDLCLDFLLDHNFSLTMHLD

SEQ ID NO: 1689231 - protein, 28 aa, Staphylococcus aureus
EKGTSYHKILIKNFNLWQAQREDSLLDI

SEQ ID NO: 1689232 - protein, 22 aa, Staphylococcus aureus
EKHAVSRLVGAPPGYVGHDDGG

SEQ ID NO: 1689233 - protein, 21 aa, Staphylococcus aureus
EKVCDILGRQPNFTETGIFSV

SEQ ID NO: 1689234 - protein, 22 aa, Staphylococcus aureus
ELLGRYEHYCFKFRELHPESKA

SEQ ID NO: 1689235 - protein, 17 aa, Staphylococcus aureus
ELSLLNLLGSGITDITV

SEQ ID NO: 1689236 - protein, 18 aa, Staphylococcus aureus
ELSSYWVYQDINKDNDFT

SEQ ID NO: 1689237 - protein, 18 aa, Staphylococcus aureus
ENIKKWFGNAWDGVKTKT

SEQ ID NO: 1689238 - protein, 24 aa, Staphylococcus aureus
ENKMLKRWNSSYVDRGFIFTTKKG

SEQ ID NO: 1689239 - protein, 19 aa, Staphylococcus aureus
EPGSTFKSYGLAAAIQEGA

SEQ ID NO: 1689240 - protein, 17 aa, Staphylococcus aureus
EPKIKLYVSLKCPNFDD

SEQ ID NO: 1689241 - protein, 18 aa, Staphylococcus aureus
EQFRDEFHFAKRRSTEAL

SEQ ID NO: 1689242 - protein, 21 aa, Staphylococcus aureus
EQPIEFIRLMPTLQKHRDEVL

SEQ ID NO: 1689243 - protein, 21 aa, Staphylococcus aureus
EREFIQEYYFNKKTLIVVCYD

SEQ ID NO: 1689244 - protein, 27 aa, Staphylococcus aureus
ERLADSEVLVCTVIGFPLGASTTATKA

SEQ ID NO: 1689245 - protein, 19 aa, Staphylococcus aureus
ESAWGLFSGVFGKSTNINQ

SEQ ID NO: 1689246 - protein, 25 aa, Staphylococcus aureus
ETDDKYVYLLKESIAKYKMVVASSN

SEQ ID NO: 1689247 - protein, 20 aa, Staphylococcus aureus
ETHRTNFVAVRFGNVLGSRG

SEQ ID NO: 1689248 - protein, 17 aa, Staphylococcus aureus
ETLIKASNHQYLNSFWS

SEQ ID NO: 1689249 - protein, 17 aa, Staphylococcus aureus
EVRRFFIKLIDQRLNHD

SEQ ID NO: 1689250 - protein, 20 aa, Staphylococcus aureus
EYENFVFTNDKKKSIILAFK

SEQ ID NO: 1689251 - protein, 25 aa, Staphylococcus aureus
EYNKRLKEELSRRMKQKEKEKQEAV

SEQ ID NO: 1689252 - protein, 29 aa, Staphylococcus aureus
EYTKYKISGTWYPFYKKNDGDLTKQFVEE

SEQ ID NO: 1689253 - protein, 21 aa, Staphylococcus aureus
FDVAPFLHLNINDEKYDMKIA

SEQ ID NO: 1689254 - protein, 19 aa, Staphylococcus aureus
FELAGLWIALNEEKDIPRN

SEQ ID NO: 1689255 - protein, 18 aa, Staphylococcus aureus
FGHYVAIEYVKDSDLPQP

SEQ ID NO: 1689256 - protein, 18 aa, Staphylococcus aureus
FIDCKVQQWVRDQMPIVL

SEQ ID NO: 1689257 - protein, 21 aa, Staphylococcus aureus
FKKDHMVFPGMVYISHPTEYG

SEQ ID NO: 1689258 - protein, 17 aa, Staphylococcus aureus
FKVYRMFDELRETFKEE

SEQ ID NO: 1689259 - protein, 17 aa, Staphylococcus aureus
FNFTPSNSKKVYTRSIT

SEQ ID NO: 1689260 - protein, 18 aa, Staphylococcus aureus
FNIWVDAEAAKRVFESGI

SEQ ID NO: 1689261 - protein, 18 aa, Staphylococcus aureus
FNLSYLFIAHDLSVVKHI

SEQ ID NO: 1689262 - protein, 19 aa, Staphylococcus aureus
FNSGYILISTGYKSFDEVK

SEQ ID NO: 1689263 - protein, 31 aa, Staphylococcus aureus
FSKPEWINGKRTITVYWRGSKDRYKIVHLIE

SEQ ID NO: 1689264 - protein, 19 aa, Staphylococcus aureus
FTDKYGVRWMLHGQDYTAI

SEQ ID NO: 1689265 - protein, 18 aa, Staphylococcus aureus
FTIKVVLTDPYKYSVTGN

SEQ ID NO: 1689266 - protein, 20 aa, Staphylococcus aureus
FTKANPFTRFIRAKATLTSA

SEQ ID NO: 1689267 - protein, 18 aa, Staphylococcus aureus
FTLVKWEISGTLNYMKPR

SEQ ID NO: 1689268 - protein, 27 aa, Staphylococcus aureus
FVKAYIVQLISMLDMIGGKKLKIVNYI

SEQ ID NO: 1689269 - protein, 25 aa, Staphylococcus aureus
FYGQQLAPAYFVFIGTRNEDKGFVT

SEQ ID NO: 1689270 - protein, 20 aa, Staphylococcus aureus
FYIISIEIVFFHLSKNFMSR

SEQ ID NO: 1689271 - protein, 20 aa, Staphylococcus aureus
GDAFYAIKTPTMTSYTLAEY

SEQ ID NO: 1689272 - protein, 22 aa, Staphylococcus aureus
GGLYDNRLLVKATKSARHQFQD

SEQ ID NO: 1689273 - protein, 17 aa, Staphylococcus aureus
GIFDLFGYDLKDYDELF

SEQ ID NO: 1689274 - protein, 22 aa, Staphylococcus aureus
GKKAIVYFYPRDNTPTCTTEAC

SEQ ID NO: 1689275 - protein, 17 aa, Staphylococcus aureus
GLIIAQYISSPDALNNY

SEQ ID NO: 1689276 - protein, 17 aa, Staphylococcus aureus
GLQLEGLNFDRQGQLFL

SEQ ID NO: 1689277 - protein, 18 aa, Staphylococcus aureus
GMFGALQDAAIYALNHYD

SEQ ID NO: 1689278 - protein, 33 aa, Staphylococcus aureus
GNFGASLKADQFKYEVTLPQGVTYVNDSLTTTF

SEQ ID NO: 1689279 - protein, 21 aa, Staphylococcus aureus
GQFFVALVEYKMENKSKFIQY

SEQ ID NO: 1689280 - protein, 18 aa, Staphylococcus aureus
GRQLLQIINEPLAAPSAN

SEQ ID NO: 1689281 - protein, 22 aa, Staphylococcus aureus
GTEHLLLGLMKEPEGIAAKVLE

SEQ ID NO: 1689282 - protein, 20 aa, Staphylococcus aureus
GTFSPLLLDTLYHLNETTYQ

SEQ ID NO: 1689283 - protein, 19 aa, Staphylococcus aureus
GVAHLPGHLSPLLKKLLLK

SEQ ID NO: 1689284 - protein, 29 aa, Staphylococcus aureus
GVAKRAQSFGMKILAFDPYLTDEKAKSLS

SEQ ID NO: 1689285 - protein, 17 aa, Staphylococcus aureus
GYQDLLQPILKGKIAYS

SEQ ID NO: 1689286 - protein, 25 aa, Staphylococcus aureus
HDAHTAYMLVLAETLAEMKDSFTGK

SEQ ID NO: 1689287 - protein, 25 aa, Staphylococcus aureus
HDIANVIEMYKLKKLLGLADNKEDE

SEQ ID NO: 1689288 - protein, 32 aa, Staphylococcus aureus
HIIQNIIQKRFTLNILYPYIETIHITKDKNLI

SEQ ID NO: 1689289 - protein, 19 aa, Staphylococcus aureus
HITLLVEMNVSLKAIMKRV

SEQ ID NO: 1689290 - protein, 33 aa, Staphylococcus aureus
HLDLETTKWLEDYLRYFKGAIVIISHDRYFLDK

SEQ ID NO: 1689291 - protein, 28 aa, Staphylococcus aureus
HLKSDIQTLFYGRFYLRELATPDNTIKF

SEQ ID NO: 1689292 - protein, 28 aa, Staphylococcus aureus
HLKVQKYYTPLEFGKLRKVAMDKGFKHC

SEQ ID NO: 1689293 - protein, 17 aa, Staphylococcus aureus
HMHYGVVPITDDGRLSA

SEQ ID NO: 1689294 - protein, 17 aa, Staphylococcus aureus
HNRIIPTKPIADDKLRK

SEQ ID NO: 1689295 - protein, 21 aa, Staphylococcus aureus
HPIEWQLQVDLWLKNGKSKLV

SEQ ID NO: 1689296 - protein, 27 aa, Staphylococcus aureus
HPYLDEEGEFKLFRVPAEQGIPIWTDK

SEQ ID NO: 1689297 - protein, 17 aa, Staphylococcus aureus
HQFPLKHINLGGGIGVN

SEQ ID NO: 1689298 - protein, 23 aa, Staphylococcus aureus
HSDGQQVIFIDYLQLMDTDAKVD

SEQ ID NO: 1689299 - protein, 21 aa, Staphylococcus aureus
HTSFQLHYLAVHQDVLLTRYV

SEQ ID NO: 1689300 - protein, 18 aa, Staphylococcus aureus
HTYKLLQKNVIPHTKIGG

SEQ ID NO: 1689301 - protein, 25 aa, Staphylococcus aureus
IAEKSIEMIIAMIGVLKAGGAYVPI

SEQ ID NO: 1689302 - protein, 30 aa, Staphylococcus aureus
ICDNLLLTICHTAFEKLSIFPNMNLRMWEN

SEQ ID NO: 1689303 - protein, 21 aa, Staphylococcus aureus
IDETFVPYVEKALGLITEENG

SEQ ID NO: 1689304 - protein, 18 aa, Staphylococcus aureus
IDGTINWVTDVVTGAFGV

SEQ ID NO: 1689305 - protein, 25 aa, Staphylococcus aureus
IEHPYPLNVFTLNIATYIFRHREET

SEQ ID NO: 1689306 - protein, 20 aa, Staphylococcus aureus
IFNYFVKKYSNIIFSAHCHN

SEQ ID NO: 1689307 - protein, 38 aa, Staphylococcus aureus
IGVNFYPMHINCRSDCALLPKSMWPKKPSKKRKTKYFG

SEQ ID NO: 1689308 - protein, 26 aa, Staphylococcus aureus
IHRKRGLLDQLAKYQIKPNIHETNFT

SEQ ID NO: 1689309 - protein, 18 aa, Staphylococcus aureus
IHTDTYHHIFKIIQKYEL

SEQ ID NO: 1689310 - protein, 18 aa, Staphylococcus aureus
IIQKYELDYIIDDDWNYA

SEQ ID NO: 1689311 - protein, 17 aa, Staphylococcus aureus
IKEFWNGDIPWIQSSDV

SEQ ID NO: 1689312 - protein, 17 aa, Staphylococcus aureus
IKMIYGMEGMLVDDGVP

SEQ ID NO: 1689313 - protein, 30 aa, Staphylococcus aureus
ILAKKGAVKLILKRDFFLEVARDASTKTTA

SEQ ID NO: 1689314 - protein, 18 aa, Staphylococcus aureus
ILEQNWLGGAYWSPPEVT

SEQ ID NO: 1689315 - protein, 25 aa, Staphylococcus aureus
INEQTKFYINPTGRFVIGGPQGDAG

SEQ ID NO: 1689316 - protein, 34 aa, Staphylococcus aureus
INMPSMLNKYFNKLSVFRKLFGNLIYSNTLYENN

SEQ ID NO: 1689317 - protein, 25 aa, Staphylococcus aureus
IPEVLAPMMQAQLEKKLRFASFAEV

SEQ ID NO: 1689318 - protein, 17 aa, Staphylococcus aureus
IQAQVVNLLLKLQRERG

SEQ ID NO: 1689319 - protein, 23 aa, Staphylococcus aureus
IQLKHSISEIPNIKALLNSMNQN

SEQ ID NO: 1689320 - protein, 39 aa, Staphylococcus aureus
IRGKGVMVVAPLEILDPFKGVLKFQLPNDVIKRDGSYQA

SEQ ID NO: 1689321 - protein, 25 aa, Staphylococcus aureus
ISPIKCAYILNEHLTFILFDDEENT

SEQ ID NO: 1689322 - protein, 24 aa, Staphylococcus aureus
ITGLIKANIPTRIAFMVSSSVDSR

SEQ ID NO: 1689323 - protein, 23 aa, Staphylococcus aureus
ITGQILTNIFGLEVFAEYQPFDN

SEQ ID NO: 1689324 - protein, 26 aa, Staphylococcus aureus
ITSGALHAILLLSIGFLGQDAIIISN

SEQ ID NO: 1689325 - protein, 25 aa, Staphylococcus aureus
IYPHHHPKFNISEKSLLISAEAVGT

SEQ ID NO: 1689326 - protein, 20 aa, Staphylococcus aureus
KALNRVMDQLSQEITGNEGR

SEQ ID NO: 1689327 - protein, 28 aa, Staphylococcus aureus
KANLVIWDAPNHEYIPYHFGINHAEKVI

SEQ ID NO: 1689328 - protein, 25 aa, Staphylococcus aureus
KAQALDHAMELLRNSVADNQATLAS

SEQ ID NO: 1689329 - protein, 24 aa, Staphylococcus aureus
KASVGLAIFGASIGPAVLAGGLLI

SEQ ID NO: 1689330 - protein, 24 aa, Staphylococcus aureus
KDARRRREILSRKLRIGHSNGKQL

SEQ ID NO: 1689331 - protein, 20 aa, Staphylococcus aureus
KDLINQTNNPTLDKAQVEQL

SEQ ID NO: 1689332 - protein, 21 aa, Staphylococcus aureus
KECLYGRRLPTKAFYILNDDM

SEQ ID NO: 1689333 - protein, 20 aa, Staphylococcus aureus
KELICQFKYLSAFEKDVMYL

SEQ ID NO: 1689334 - protein, 21 aa, Staphylococcus aureus
KELICQFKYLSAFEKDVMYLM

SEQ ID NO: 1689335 - protein, 18 aa, Staphylococcus aureus
KELKVVIVVSRFNDFITG

SEQ ID NO: 1689336 - protein, 23 aa, Staphylococcus aureus
KFCENIISVPLPPIFKYTLALTN

SEQ ID NO: 1689337 - protein, 17 aa, Staphylococcus aureus
KFVRFQYRTGEITYGNE

SEQ ID NO: 1689338 - protein, 22 aa, Staphylococcus aureus
KIDILIVVNMFLTGFDSKVLNT

SEQ ID NO: 1689339 - protein, 18 aa, Staphylococcus aureus
KKKEFLSLIPNVTCNYIK

SEQ ID NO: 1689340 - protein, 22 aa, Staphylococcus aureus
KLAPPNFYRQCKLGWGPNIEKL

SEQ ID NO: 1689341 - protein, 19 aa, Staphylococcus aureus
KLINSFMKLPGIGPKTAQR

SEQ ID NO: 1689342 - protein, 19 aa, Staphylococcus aureus
KLSIFPNMNLRMWENPVTQ

SEQ ID NO: 1689343 - protein, 20 aa, Staphylococcus aureus
KPIMYNLDRIVVYMRLRRVG

SEQ ID NO: 1689344 - protein, 18 aa, Staphylococcus aureus
KPSYPVINGIYFALELTP

SEQ ID NO: 1689345 - protein, 18 aa, Staphylococcus aureus
KQAVAKAEALISGTPDVV

SEQ ID NO: 1689346 - protein, 17 aa, Staphylococcus aureus
KQGAYTDAYNAAKNIVN

SEQ ID NO: 1689347 - protein, 26 aa, Staphylococcus aureus
KQGYNVIMDIPLLFENELENTLDEVW

SEQ ID NO: 1689348 - protein, 24 aa, Staphylococcus aureus
KQQEVWNCFINDKPKVLIASGAKR

SEQ ID NO: 1689349 - protein, 17 aa, Staphylococcus aureus
KSFPFEITELPKDTKYL

SEQ ID NO: 1689350 - protein, 26 aa, Staphylococcus aureus
KSKHNLLQCLIFVNDMYLLSNPKSQN

SEQ ID NO: 1689351 - protein, 20 aa, Staphylococcus aureus
KTFHLYDELSKFANYYIKAG

SEQ ID NO: 1689352 - protein, 18 aa, Staphylococcus aureus
KTFSKLIERLTGETYSNI

SEQ ID NO: 1689353 - protein, 23 aa, Staphylococcus aureus
KTPYKKWFERMSDYGFEENIDYI

SEQ ID NO: 1689354 - protein, 18 aa, Staphylococcus aureus
KTYQFDYVIHLAALVSVA

SEQ ID NO: 1689355 - protein, 19 aa, Staphylococcus aureus
KTYQFDYVIHLAALVSVAE

SEQ ID NO: 1689356 - protein, 30 aa, Staphylococcus aureus
KVARELIELIIAFMFHHQIPMSIETSKLLS

SEQ ID NO: 1689357 - protein, 27 aa, Staphylococcus aureus
KVFTSFYKKWRPYLRHRDVYHYDLKSF

SEQ ID NO: 1689358 - protein, 21 aa, Staphylococcus aureus
KYDHYRIGLNKAIQYLSYKKR

SEQ ID NO: 1689359 - protein, 25 aa, Staphylococcus aureus
KYIDWIKYHLFYNKFVPLDYLSIKP

SEQ ID NO: 1689360 - protein, 21 aa, Staphylococcus aureus
LAIQLMYNAPSSIKITYGGDL

SEQ ID NO: 1689361 - protein, 32 aa, Staphylococcus aureus
LDQRVINHYGSLIPLTPLDSSLLRKEQNDTTD

SEQ ID NO: 1689362 - protein, 19 aa, Staphylococcus aureus
LDTASHFVLIFARKNVTSR

SEQ ID NO: 1689363 - protein, 17 aa, Staphylococcus aureus
LENDKQYFPATHWKAIN

SEQ ID NO: 1689364 - protein, 28 aa, Staphylococcus aureus
LEVKTAYKDWFPRMLKYGFEENTDYTAI

SEQ ID NO: 1689365 - protein, 18 aa, Staphylococcus aureus
LFIDCKVPQWVRDQMPIV

SEQ ID NO: 1689366 - protein, 18 aa, Staphylococcus aureus
LGRQPNFTETGIFSVMWS

SEQ ID NO: 1689367 - protein, 27 aa, Staphylococcus aureus
LGYQRASMYDIYPPYDGIPDEAFLIKE

SEQ ID NO: 1689368 - protein, 29 aa, Staphylococcus aureus
LIIDDVVKGFITYKIPKKVIKHAGYVRCK

SEQ ID NO: 1689369 - protein, 19 aa, Staphylococcus aureus
LLHVYLKEFGELIQKFHEI

SEQ ID NO: 1689370 - protein, 17 aa, Staphylococcus aureus
LLQNGKWGYFNREFFDL

SEQ ID NO: 1689371 - protein, 18 aa, Staphylococcus aureus
LNAKVIIIELNDDRIKYL

SEQ ID NO: 1689372 - protein, 28 aa, Staphylococcus aureus
LNCTLHSLYEIPYFVKYLADTYTNGKVI

SEQ ID NO: 1689373 - protein, 20 aa, Staphylococcus aureus
LNDFIRIYADTLPNNEICLS

SEQ ID NO: 1689374 - protein, 23 aa, Staphylococcus aureus
LNDIEFELPLIIRNEVLAPGGQK

SEQ ID NO: 1689375 - protein, 19 aa, Staphylococcus aureus
LNVNEAWLMGFDISKNRKI

SEQ ID NO: 1689376 - protein, 28 aa, Staphylococcus aureus
LQRVKTAKNALNGDAKLIAAQNAAKQHL

SEQ ID NO: 1689377 - protein, 29 aa, Staphylococcus aureus
LRLYGLGAYELLSLMYDIHTIRMTIIQPR

SEQ ID NO: 1689378 - protein, 19 aa, Staphylococcus aureus
LSAWLLIESLSPGEVNFTA

SEQ ID NO: 1689379 - protein, 24 aa, Staphylococcus aureus
LSTLTGRRILILGDVLELGENSKE

SEQ ID NO: 1689380 - protein, 17 aa, Staphylococcus aureus
LTELSSYWVYQDINKDN

SEQ ID NO: 1689381 - protein, 17 aa, Staphylococcus aureus
LTHREFELFHYLSKHMG

SEQ ID NO: 1689382 - protein, 18 aa, Staphylococcus aureus
MDLYDLFEELRNLFKEEG

SEQ ID NO: 1689383 - protein, 28 aa, Staphylococcus aureus
MGREHYYMYKKFGIWPEKEYAINWVKKI

SEQ ID NO: 1689384 - protein, 18 aa, Staphylococcus aureus
MKEAIKYAVKFYNYPNEH

SEQ ID NO: 1689385 - protein, 17 aa, Staphylococcus aureus
MLILQEPIYMSDGTAIH

SEQ ID NO: 1689386 - protein, 18 aa, Staphylococcus aureus
MMIIFVTNGKKWPQKNAV

SEQ ID NO: 1689387 - protein, 26 aa, Staphylococcus aureus
MPSNTEILYELGLGKYIVGVSTVDDY

SEQ ID NO: 1689388 - protein, 20 aa, Staphylococcus aureus
MQGIAYDAGILYWYTGDSNP

SEQ ID NO: 1689389 - protein, 25 aa, Staphylococcus aureus
MVKLALELYNNPWIAWYHQQMQDKK

SEQ ID NO: 1689390 - protein, 20 aa, Staphylococcus aureus
MVPYAAWQKFARPRFDNMIS

SEQ ID NO: 1689391 - protein, 22 aa, Staphylococcus aureus
NAQDKVLMIFGPEGGLSENEIS

SEQ ID NO: 1689392 - protein, 18 aa, Staphylococcus aureus
NAYRYIDGELWIYSDVLD

SEQ ID NO: 1689393 - protein, 21 aa, Staphylococcus aureus
NCIYCYNYVIWLIQHDLPRNY

SEQ ID NO: 1689394 - protein, 24 aa, Staphylococcus aureus
NDANDILAFINKDELELVDDGTVK

SEQ ID NO: 1689395 - protein, 35 aa, Staphylococcus aureus
NDLDYRLIVLNHAPNLRTFLHRYDLYETKYWSVFD

SEQ ID NO: 1689396 - protein, 25 aa, Staphylococcus aureus
NEKDIRAVLGRFLFVQDDVKKIIND

SEQ ID NO: 1689397 - protein, 25 aa, Staphylococcus aureus
NFEEKLRYFLIEDYNQKEHSAIHTT

SEQ ID NO: 1689398 - protein, 25 aa, Staphylococcus aureus
NFEEKLRYFLIEDYNQKEHSTIHTT

SEQ ID NO: 1689399 - protein, 21 aa, Staphylococcus aureus
NFYIISIEIVFFHLSKNFMSR

SEQ ID NO: 1689400 - protein, 25 aa, Staphylococcus aureus
NGTYYFHGHIVPGWQGVKKTFDTAE

SEQ ID NO: 1689401 - protein, 23 aa, Staphylococcus aureus
NKAEWVLRKMTISRKHLAIVLDE

SEQ ID NO: 1689402 - protein, 32 aa, Staphylococcus aureus; identical to SEQ ID NO: 1589560

SEQ ID NO: 1689403 - protein, 24 aa, Staphylococcus aureus
NLPAKYIIHTVGPQIRRLPVSKMN

SEQ ID NO: 1689404 - protein, 26 aa, Staphylococcus aureus
NMINLENLAFFLDITTNYYSIEEFRE

SEQ ID NO: 1689405 - protein, 29 aa, Staphylococcus aureus
NNSGFFKQKSRLFWTQMNQAPSLAKEDEK

SEQ ID NO: 1689406 - protein, 20 aa, Staphylococcus aureus
NPKMHHLIDTEQFKMMKSTV

SEQ ID NO: 1689407 - protein, 18 aa, Staphylococcus aureus
NRFRPDSQFLYKSAQRGD

SEQ ID NO: 1689408 - protein, 24 aa, Staphylococcus aureus
NSGDIFIINHRDLYRFQLQQDGII

SEQ ID NO: 1689409 - protein, 18 aa, Staphylococcus aureus
NSGYILISTGYKSFNEVK

SEQ ID NO: 1689410 - protein, 25 aa, Staphylococcus aureus
NSNGPMIRALAEKLGLEVGIYKTQQ

SEQ ID NO: 1689411 - protein, 28 aa, Staphylococcus aureus
NSPIYKLAIEYKLAFPLHPEFRTMPMVW

SEQ ID NO: 1689412 - protein, 39 aa, Staphylococcus aureus
NVDLWYGFQCFDYANAGWKVLFGLLLKGLGAKDIPFANN

SEQ ID NO: 1689413 - protein, 25 aa, Staphylococcus aureus
NVGYKNEYFYITYSSRSLKEYRKYY

SEQ ID NO: 1689414 - protein, 22 aa, Staphylococcus aureus
NYQPKHLVIVGGGYIALEFASM

SEQ ID NO: 1689415 - protein, 29 aa, Staphylococcus aureus
PHPTGSSLKPFLAYGPAIENMKWATNHAI

SEQ ID NO: 1689416 - protein, 20 aa, Staphylococcus aureus
PNPYFVSFMGDAPKKNPKVI

SEQ ID NO: 1689417 - protein, 17 aa, Staphylococcus aureus
PQYTMSVWMGFSKVKQY

SEQ ID NO: 1689418 - protein, 17 aa, Staphylococcus aureus
PRGLFRKKKFSPVVGDI

SEQ ID NO: 1689419 - protein, 17 aa, Staphylococcus aureus
PSNFKLISMIDFGMIVL

SEQ ID NO: 1689420 - protein, 17 aa, Staphylococcus aureus
PTQLLAWLKDDQGLDIP

SEQ ID NO: 1689421 - protein, 18 aa, Staphylococcus aureus
PTQLLAWLKDDQGLDIPN

SEQ ID NO: 1689422 - protein, 17 aa, Staphylococcus aureus
PVAVGASTYRKQFCKLL

SEQ ID NO: 1689423 - protein, 24 aa, Staphylococcus aureus
QAQSAFFNDGNMLKPWFVNSVENP

SEQ ID NO: 1689424 - protein, 29 aa, Staphylococcus aureus
QEYSKDDIFQVYLNKIYYSDGVTGIKAAA

SEQ ID NO: 1689425 - protein, 22 aa, Staphylococcus aureus
QFNPNAIYINCPLFNEMPEILE

SEQ ID NO: 1689426 - protein, 17 aa, Staphylococcus aureus
QGALNLKAQLSEGTIVV

SEQ ID NO: 1689427 - protein, 25 aa, Staphylococcus aureus
QGIFKKPVITPIKPYKNFYPAEDYH

SEQ ID NO: 1689428 - protein, 18 aa, Staphylococcus aureus
QIAKKMANLIPNSKCKLI

SEQ ID NO: 1689429 - protein, 26 aa, Staphylococcus aureus
QIIEATLDWTFYNDIPLSYKTSNLLK

SEQ ID NO: 1689430 - protein, 23 aa, Staphylococcus aureus
QKLSFNQLILMFDQLTEAHKKLN

SEQ ID NO: 1689431 - protein, 23 aa, Staphylococcus aureus
QKQSFESQITQAPLVTDVTTINQ

SEQ ID NO: 1689432 - protein, 22 aa, Staphylococcus aureus
QLQRRYIFDDRGYLSAIRYFDD

SEQ ID NO: 1689433 - protein, 21 aa, Staphylococcus aureus
QPGDTLTFPAFVYSGDAQVVA

SEQ ID NO: 1689434 - protein, 23 aa, Staphylococcus aureus
QQEDYCIILAYFYEGKPMLSYVY

SEQ ID NO: 1689435 - protein, 17 aa, Staphylococcus aureus
QQELFPVKEGILQFWIS

SEQ ID NO: 1689436 - protein, 22 aa, Staphylococcus aureus
QQPERGKIYDRNGKVLAEDVER

SEQ ID NO: 1689437 - protein, 17 aa, Staphylococcus aureus
QSGIVITQLFAIEPARL

SEQ ID NO: 1689438 - protein, 19 aa, Staphylococcus aureus
QVEFCDVLIINKIDLISEE

SEQ ID NO: 1689439 - protein, 25 aa, Staphylococcus aureus
RATNQPLYNRFKRYAKLLLKPEEDL

SEQ ID NO: 1689440 - protein, 20 aa, Staphylococcus aureus
RDNMIKHPMILITVLEEPLT

SEQ ID NO: 1689441 - protein, 17 aa, Staphylococcus aureus
RFNVMRSLLAQPRVLIC

SEQ ID NO: 1689442 - protein, 18 aa, Staphylococcus aureus
RGGWALLEALNAPYGMRL

SEQ ID NO: 1689443 - protein, 19 aa, Staphylococcus aureus
RKCLNWKFPYEVLCDELLH

SEQ ID NO: 1689444 - protein, 17 aa, Staphylococcus aureus
RKNWVFPIQTHENKVAC

SEQ ID NO: 1689445 - protein, 23 aa, Staphylococcus aureus
RMNEYFNWLKQNYIFKELDSSTE

SEQ ID NO: 1689446 - protein, 25 aa, Staphylococcus aureus
RPLKTQLGMYRFFVQADSAITTDIK

SEQ ID NO: 1689447 - protein, 26 aa, Staphylococcus aureus
RRLSELKKYFYRFSLKARKRVKTVSI

SEQ ID NO: 1689448 - protein, 22 aa, Staphylococcus aureus
RSQQLITTDLFLNVFGISNIED

SEQ ID NO: 1689449 - protein, 26 aa, Staphylococcus aureus
RTAKGYYFVRTFYRKDKLPDRKNYKV

SEQ ID NO: 1689450 - protein, 18 aa, Staphylococcus aureus
RTEQARIRLYIPLNERIS

SEQ ID NO: 1689451 - protein, 26 aa, Staphylococcus aureus
RVYLDQIHQRLFLEQSLITERIKKYF

SEQ ID NO: 1689452 - protein, 17 aa, Staphylococcus aureus
RYVVLKKKNSLFKGKEI

SEQ ID NO: 1689453 - protein, 30 aa, Staphylococcus aureus
SAWSNAKSVFNGFRKWLSKTYDWIRDIGKD

SEQ ID NO: 1689454 - protein, 22 aa, Staphylococcus aureus
SDEEIAELLYKLPDIKKWADEV

SEQ ID NO: 1689455 - protein, 26 aa, Staphylococcus aureus
SDLSKGFPRIPILKDVYGFVEIGREL

SEQ ID NO: 1689456 - protein, 19 aa, Staphylococcus aureus
SEFPRIVTLKDLNKIEVLD

SEQ ID NO: 1689457 - protein, 27 aa, Staphylococcus aureus
SETGELIFKFYRHCFRYNEINLKIQDI

SEQ ID NO: 1689458 - protein, 18 aa, Staphylococcus aureus
SFVMRYLLDGRVPNLPLA

SEQ ID NO: 1689459 - protein, 19 aa, Staphylococcus aureus
SHFVLIFARKNVTSRSPYV

SEQ ID NO: 1689460 - protein, 17 aa, Staphylococcus aureus
SHYALSDIPLPKKTKFE

SEQ ID NO: 1689461 - protein, 33 aa, Staphylococcus aureus
SIIASTNMIFKYAYDMKLIRIMPSEGIKRPKKK

SEQ ID NO: 1689462 - protein, 24 aa, Staphylococcus aureus
SITGYLLRRYVDPNLVYGLVSAWA

SEQ ID NO: 1689463 - protein, 21 aa, Staphylococcus aureus
SKCYTFIKGYGDFDGQQTFAE

SEQ ID NO: 1689464 - protein, 23 aa, Staphylococcus aureus
SKEKFKQLFRVLEDTFARPLSPY

SEQ ID NO: 1689465 - protein, 26 aa, Staphylococcus aureus
SKGSLRYIHDIWGYIAPNTKKEKQPK

SEQ ID NO: 1689466 - protein, 17 aa, Staphylococcus aureus
SKYTADYLADKGVVPFL

SEQ ID NO: 1689467 - protein, 18 aa, Staphylococcus aureus
SNDFFTLVKWEISGTLNY

SEQ ID NO: 1689468 - protein, 21 aa, Staphylococcus aureus
SPDKILGAILFEQTMDREVES

SEQ ID NO: 1689469 - protein, 26 aa, Staphylococcus aureus
SPIFQNEKLFKVFAYCLMKASHKDHT

SEQ ID NO: 1689470 - protein, 29 aa, Staphylococcus aureus
SRISDWNRVGWGEIPMSLGFTYSSNTLMM

SEQ ID NO: 1689471 - protein, 27 aa, Staphylococcus aureus
SSFVYKRRLPFHAKRFNDWLESMSNNV

SEQ ID NO: 1689472 - protein, 31 aa, Staphylococcus aureus
SSKTILDYVWDQYPLMNEKDIRAVLGRFLFV

SEQ ID NO: 1689473 - protein, 25 aa, Staphylococcus aureus
STSNDAEFFFTYEDLPLLDPDTILN

SEQ ID NO: 1689474 - protein, 27 aa, Staphylococcus aureus
SVFTAMKLRQRVWRRLAKDLMPENLHE

SEQ ID NO: 1689475 - protein, 17 aa, Staphylococcus aureus
SVNYTDADQPKQQAYDT

SEQ ID NO: 1689476 - protein, 18 aa, Staphylococcus aureus
SYYKFKKPTLLYDQQIQR

SEQ ID NO: 1689477 - protein, 23 aa, Staphylococcus aureus
TADRAIVFMLLSDEEEWGKLHRN

SEQ ID NO: 1689478 - protein, 24 aa, Staphylococcus aureus
TDMHPYVHPFNPAIDPLWESRSDW

SEQ ID NO: 1689479 - protein, 26 aa, Staphylococcus aureus
TENGLDKGFFFEPTLIAVPDNHHKLA

SEQ ID NO: 1689480 - protein, 21 aa, Staphylococcus aureus
TFTEAGLQFEFTHPLAQLIGK

SEQ ID NO: 1689481 - protein, 17 aa, Staphylococcus aureus
TFTGPIDRQLFYQFIMK

SEQ ID NO: 1689482 - protein, 19 aa, Staphylococcus aureus
TIEWLVVQRGFEIPSFNFV

SEQ ID NO: 1689483 - protein, 23 aa, Staphylococcus aureus
TKIATVCKFDLPKLAQMKPKDTI

SEQ ID NO: 1689484 - protein, 22 aa, Staphylococcus aureus
TKWTELYDIWFSIYSTPSESLT

SEQ ID NO: 1689485 - protein, 22 aa, Staphylococcus aureus
TLNEAMNQLRQSIASKDATKAS

SEQ ID NO: 1689486 - protein, 27 aa, Staphylococcus aureus
TNERMPIKSLNLLASQVLEIIKIVARH

SEQ ID NO: 1689487 - protein, 26 aa, Staphylococcus aureus
TNHNTKLIQFLYNQFDFYEIPVNRFI

SEQ ID NO: 1689488 - protein, 25 aa, Staphylococcus aureus
TNISEAAYLLWLLSRNNIGFTDLKV

SEQ ID NO: 1689489 - protein, 24 aa, Staphylococcus aureus
TQGKAAIDAIQVDATVKPKANQAI

SEQ ID NO: 1689490 - protein, 24 aa, Staphylococcus aureus
TQQTFEHIFPYDIASTTTPLLRER

SEQ ID NO: 1689491 - protein, 20 aa, Staphylococcus aureus
TRYNDWFERMINYGFEENID

SEQ ID NO: 1689492 - protein, 24 aa, Staphylococcus aureus
TVEQLVNFGRFPYSKGRLTKEDHD

SEQ ID NO: 1689493 - protein, 26 aa, Staphylococcus aureus
VAQKLAEAKALDQAMQALRNSIQDQQ

SEQ ID NO: 1689494 - protein, 19 aa, Staphylococcus aureus
VCEILSQQQLRYFFSHNHS

SEQ ID NO: 1689495 - protein, 18 aa, Staphylococcus aureus
VDSIHIPMIMSALKEIEK

SEQ ID NO: 1689496 - protein, 17 aa, Staphylococcus aureus
VFANLDLNITKARAQVV

SEQ ID NO: 1689497 - protein, 17 aa, Staphylococcus aureus
VFCTLAYTGMRAGELLA

SEQ ID NO: 1689498 - protein, 28 aa, Staphylococcus aureus
VFDDLWMDLYDLFEELRDLFKEEDLEPW

SEQ ID NO: 1689499 - protein, 36 aa, Staphylococcus aureus
VFTDVNGYPLVIKKLQLWIKAILKKTDITNKQISTH

SEQ ID NO: 1689500 - protein, 18 aa, Staphylococcus aureus
VGRELREMMPFIKSKSIE

SEQ ID NO: 1689501 - protein, 20 aa, Staphylococcus aureus
VIMFTICMDVIDSAFAPGVS

SEQ ID NO: 1689502 - protein, 17 aa, Staphylococcus aureus
VLSLDLTTVLILNQLAN

SEQ ID NO: 1689503 - protein, 18 aa, Staphylococcus aureus
VLWLKQNIISYLDDVSFT

SEQ ID NO: 1689504 - protein, 25 aa, Staphylococcus aureus
VMQSFWVDPRTKIIYMTQARPGNHY

SEQ ID NO: 1689505 - protein, 30 aa, Staphylococcus aureus
VNIGQRRLFEWLRQNGFLIKRKGVDYNMPT

SEQ ID NO: 1689506 - protein, 28 aa, Staphylococcus aureus
VNNWSYEALVKIFYRYGEEKFSKQIARR

SEQ ID NO: 1689507 - protein, 23 aa, Staphylococcus aureus
VRQFKEIPLVDYIFCTYNTDLYY

SEQ ID NO: 1689508 - protein, 18 aa, Staphylococcus aureus
VSRTTIYRYLNKLNNQEN

SEQ ID NO: 1689509 - protein, 23 aa, Staphylococcus aureus
VTDKEKILVLGSGPIRIGQGVEF

SEQ ID NO: 1689510 - protein, 31 aa, Staphylococcus aureus
VTIDMYEPYVRLFRDLFPNAAIIFDRFHIVQ

SEQ ID NO: 1689511 - protein, 23 aa, Staphylococcus aureus
VVDIANLLKRRAVYRDIADVIKM

SEQ ID NO: 1689512 - protein, 23 aa, Staphylococcus aureus
YAGLSFRTLVPKYPAMSPHIKLS

SEQ ID NO: 1689513 - protein, 18 aa, Staphylococcus aureus
YAIYVEYGTGIYATGPGG

SEQ ID NO: 1689514 - protein, 19 aa, Staphylococcus aureus
YARLPVTDKILCMNGSYVI

SEQ ID NO: 1689515 - protein, 17 aa, Staphylococcus aureus
YCTASNGYFATLYNVVK

SEQ ID NO: 1689516 - protein, 20 aa, Staphylococcus aureus
YFEGAQKYLSYLKSTVDVNF

SEQ ID NO: 1689517 - protein, 17 aa, Staphylococcus aureus
YGFQCYDYANMFFMLAT

SEQ ID NO: 1689518 - protein, 20 aa, Staphylococcus aureus
YIDEQTFVPCTPLGIMEILK

SEQ ID NO: 1689519 - protein, 27 aa, Staphylococcus aureus
YKKVELRLRYEVPKIAYASHLKSDIQT

SEQ ID NO: 1689520 - protein, 26 aa, Staphylococcus aureus
YKPSPDGIIYILQKYDLHNKDTIYVG

SEQ ID NO: 1689521 - protein, 19 aa, Staphylococcus aureus
YKSYSRGTVVYVKLGSNIG

SEQ ID NO: 1689522 - protein, 19 aa, Staphylococcus aureus
YNHYLFNAELFKHFKKDAV

SEQ ID NO: 1689523 - protein, 27 aa, Staphylococcus aureus
YNVNNLLNMPFGACHFAVAAKPETTNY

SEQ ID NO: 1689524 - protein, 20 aa, Staphylococcus aureus
YPVAIPHLRDNMIKHPMILI

SEQ ID NO: 1689525 - protein, 33 aa, Staphylococcus aureus
YQDKLKIEKMNLPGISLLPETERFYPNGNFASH

SEQ ID NO: 1689526 - protein, 21 aa, Staphylococcus aureus
YQGKMAFRVYPKWCNQLNKTA

SEQ ID NO: 1689527 - protein, 17 aa, Staphylococcus aureus
YSNKLILFEKHFEPVLG

SEQ ID NO: 1689528 - protein, 19 aa, Staphylococcus aureus
YTVIQSIGLVQWYEEQKRY

SEQ ID NO: 1689529 - protein, 19 aa, Staphylococcus aureus
YVAVWFRQERKDGTFRTVL

SEQ ID NO: 1689530 - protein, 19 aa, Staphylococcus aureus
YVIVMLDKSTIGNKIKLSI

SEQ ID NO: 1689531 - protein, 19 aa, Staphylococcus aureus
AAHLPGMVASLTTLPVIGV

SEQ ID NO: 1689532 - protein, 25 aa, Staphylococcus aureus
AAISTTLLINKFKPDIIINTGSAGA

SEQ ID NO: 1689533 - protein, 18 aa, Staphylococcus aureus
AAKAILTKASGQNVDKAA

SEQ ID NO: 1689534 - protein, 18 aa, Staphylococcus aureus
ADLVVMAVGIRPYTEVAK

SEQ ID NO: 1689535 - protein, 25 aa, Staphylococcus aureus
AEDLRQTIHTFLPLAHIVKVSDEEL

SEQ ID NO: 1689536 - protein, 17 aa, Staphylococcus aureus
AENDYFYIMHRFDEEAR

SEQ ID NO: 1689537 - protein, 22 aa, Staphylococcus aureus
AFLTAIADKMKALNGYFVIDEA

SEQ ID NO: 1689538 - protein, 30 aa, Staphylococcus aureus
AIELGEKIDFLIKIPKYILNAIAFACQEIV

SEQ ID NO: 1689539 - protein, 23 aa, Staphylococcus aureus
AKENINCRCKLMYYIDENDLPST

SEQ ID NO: 1689540 - protein, 18 aa, Staphylococcus aureus
ALFGDSMNVALLTGSVKG

SEQ ID NO: 1689541 - protein, 23 aa, Staphylococcus aureus
ALHAPYGMRLAEYKEIVLARIMQ

SEQ ID NO: 1689542 - protein, 22 aa, Staphylococcus aureus
ALPNRTKLLGVGLWLVPKPVRN

SEQ ID NO: 1689543 - protein, 21 aa, Staphylococcus aureus
AQDKVLMIFGPEGGLSENEIS

SEQ ID NO: 1689544 - protein, 19 aa, Staphylococcus aureus
AQEKLIPEYITIDIAHGHS

SEQ ID NO: 1689545 - protein, 21 aa, Staphylococcus aureus
AQHCEAFKANFKGAAQGDWVK

SEQ ID NO: 1689546 - protein, 24 aa, Staphylococcus aureus
AQLTDLKEDLRRLKDASKKLDTAG

SEQ ID NO: 1689547 - protein, 19 aa, Staphylococcus aureus
ARFRTIIKLYSYYVSLKEH

SEQ ID NO: 1689548 - protein, 20 aa, Staphylococcus aureus
ASMVMIGSLFAAHEESPGET

SEQ ID NO: 1689549 - protein, 32 aa, Staphylococcus aureus
ATEFEIITAMMFLYFGEIHPVDFVIVEAGLGI

SEQ ID NO: 1689550 - protein, 26 aa, Staphylococcus aureus
AVASSRDIILFSLLLAAKGIKGAVSD

SEQ ID NO: 1689551 - protein, 28 aa, Staphylococcus aureus
AVEGIPAGLLTYPPLMAADIVLYNTNIV

SEQ ID NO: 1689552 - protein, 18 aa, Staphylococcus aureus
AVRRNPYSVILLDEVEKA

SEQ ID NO: 1689553 - protein, 18 aa, Staphylococcus aureus
CHNDFSCNHLLLDGNNRL

SEQ ID NO: 1689554 - protein, 18 aa, Staphylococcus aureus
CIDIKPRMLGQQAGAAIL

SEQ ID NO: 1689555 - protein, 19 aa, Staphylococcus aureus
CLRYHQTFYTMTGKPFDSS

SEQ ID NO: 1689556 - protein, 29 aa, Staphylococcus aureus
CMEIPHDLFTPIFAVSRSAGWIAHILEQY

SEQ ID NO: 1689557 - protein, 17 aa, Staphylococcus aureus
CNYLDDIYLIEEMLLKQ

SEQ ID NO: 1689558 - protein, 18 aa, Staphylococcus aureus
DANKLFNFTPSNSKKVYT

SEQ ID NO: 1689559 - protein, 25 aa, Staphylococcus aureus
DAYYGLFYEDVYTQSLFTALTNLHS

SEQ ID NO: 1689560 - protein, 29 aa, Staphylococcus aureus
DDIVKNMKPLIVQMLFEPSHYDDMFISRK

SEQ ID NO: 1689561 - protein, 19 aa, Staphylococcus aureus
DDVLLIPAQSDILPKDVDL

SEQ ID NO: 1689562 - protein, 31 aa, Staphylococcus aureus
DEAQSQFNLPMRYIWGIYEPQSDDQNMNETR

SEQ ID NO: 1689563 - protein, 17 aa, Staphylococcus aureus
DEIVLLEGFMDVIKSDT

SEQ ID NO: 1689564 - protein, 25 aa, Staphylococcus aureus
DETDDFTYYKGYKKGWNTLCTYLKI

SEQ ID NO: 1689565 - protein, 17 aa, Staphylococcus aureus
DEYCDFIYLLEDSEEEI

SEQ ID NO: 1689566 - protein, 19 aa, Staphylococcus aureus
DGLAILNELIKKAKATTNE

SEQ ID NO: 1689567 - protein, 19 aa, Staphylococcus aureus
DGRPKLMGIRQIIDSYLNH

SEQ ID NO: 1689568 - protein, 23 aa, Staphylococcus aureus
DHLKLKTKFYPTQYIRFEEATIE

SEQ ID NO: 1689569 - protein, 29 aa, Staphylococcus aureus
DICVLAPQHYPLFSLGEYLKKELPYCNFD

SEQ ID NO: 1689570 - protein, 28 aa, Staphylococcus aureus
DIINTLSKHFKVTAPIFIDNAESVTELI

SEQ ID NO: 1689571 - protein, 24 aa, Staphylococcus aureus
DIIVNERIQFVLTSRLESFIMLEL

SEQ ID NO: 1689572 - protein, 17 aa, Staphylococcus aureus
DIRIIPLGGVGEIAKNM

SEQ ID NO: 1689573 - protein, 26 aa, Staphylococcus aureus
DKKDILPLRIILGSVNLYGILSTNHL

SEQ ID NO: 1689574 - protein, 17 aa, Staphylococcus aureus
DLAVFTINNSIKTMTIV

SEQ ID NO: 1689575 - protein, 25 aa, Staphylococcus aureus
DLEISDIFMYKTLIDAYNRRLSDLS

SEQ ID NO: 1689576 - protein, 17 aa, Staphylococcus aureus
DLFTSHGVYRYLTSRTN

SEQ ID NO: 1689577 - protein, 21 aa, Staphylococcus aureus
DLNVYSFFEKVLIKLTDNIEE

SEQ ID NO: 1689578 - protein, 17 aa, Staphylococcus aureus
DLPGIVESYEGYLSVFV

SEQ ID NO: 1689579 - protein, 18 aa, Staphylococcus aureus
DLSIYKKILLHTIDLYEE

SEQ ID NO: 1689580 - protein, 19 aa, Staphylococcus aureus
DMLHVTPPMGPLDVVKEST

SEQ ID NO: 1689581 - protein, 24 aa, Staphylococcus aureus
DMLNGIYYYHPSVESIQKYANLLR

SEQ ID NO: 1689582 - protein, 18 aa, Staphylococcus aureus
DMRIGELLAIKRVNINYE

SEQ ID NO: 1689583 - protein, 24 aa, Staphylococcus aureus
DNTTLLSTFIYKIANERLFSREEY

SEQ ID NO: 1689584 - protein, 28 aa, Staphylococcus aureus
DNVHFVVLGHYQLLDALLDKSLQTPDIL

SEQ ID NO: 1689585 - protein, 17 aa, Staphylococcus aureus
DQLYQHLGERYYSSNMA

SEQ ID NO: 1689586 - protein, 24 aa, Staphylococcus aureus
DQMDGKLFGIPMGIKDNIITNGLE

SEQ ID NO: 1689587 - protein, 26 aa, Staphylococcus aureus
DRNLYTPYHIPITNKTLFNYEGKTYE

SEQ ID NO: 1689588 - protein, 19 aa, Staphylococcus aureus
DRNLYVPYDLPISKNNLFE

SEQ ID NO: 1689589 - protein, 24 aa, Staphylococcus aureus
DRNSILSTLFRRVGYSEKAGSGGP

SEQ ID NO: 1689590 - protein, 21 aa, Staphylococcus aureus
DRQEWWYNVFYDDGKYNKKII

SEQ ID NO: 1689591 - protein, 28 aa, Staphylococcus aureus
DSKRQFLLNQIQALIRGVWLLSGIDKNL

SEQ ID NO: 1689592 - protein, 21 aa, Staphylococcus aureus
DSVEDYLTYLNGRFSNMILGH

SEQ ID NO: 1689593 - protein, 21 aa, Staphylococcus aureus
DTGYFFNQAYKKDGAINKGDY

SEQ ID NO: 1689594 - protein, 28 aa, Staphylococcus aureus
DTQHMALPMLFSDILIYCTERNVMLVDH

SEQ ID NO: 1689595 - protein, 25 aa, Staphylococcus aureus
DTYVTDFQLFKLFGLRINVESDLLS

SEQ ID NO: 1689596 - protein, 25 aa, Staphylococcus aureus
DVEPVFGFMKAILGFTRMSVRGLNK

SEQ ID NO: 1689597 - protein, 17 aa, Staphylococcus aureus
DVRQLGRFLQKKGYTSY

SEQ ID NO: 1689598 - protein, 20 aa, Staphylococcus aureus
DYEIRNEIAQIKVIFKTVLK

SEQ ID NO: 1689599 - protein, 20 aa, Staphylococcus aureus
DYMDIIKKRGGFNKINAVKN

SEQ ID NO: 1689600 - protein, 18 aa, Staphylococcus aureus
EACSTLLTTFFKNLRANK

SEQ ID NO: 1689601 - protein, 30 aa, Staphylococcus aureus
EAQSQFNLPMRYIWGIYEPQSDDQNMNETR

SEQ ID NO: 1689602 - protein, 22 aa, Staphylococcus aureus
EAVIGFLYLEKREERLEALLNK

SEQ ID NO: 1689603 - protein, 17 aa, Staphylococcus aureus
EAWLMGFDISKNRKIEN

SEQ ID NO: 1689604 - protein, 26 aa, Staphylococcus aureus
EDSKFGLSIQYGLAIKAINKVQQSKY

SEQ ID NO: 1689605 - protein, 24 aa, Staphylococcus aureus
EEILIPQIVKKLFGINLDELGIGL

SEQ ID NO: 1689606 - protein, 18 aa, Staphylococcus aureus
EELKLLNNNLRVLNTELS

SEQ ID NO: 1689607 - protein, 18 aa, Staphylococcus aureus
EEMKPMIAEAFYKKFDEA

SEQ ID NO: 1689608 - protein, 20 aa, Staphylococcus aureus
EEMRLVYVALTRAKEQLYLI

SEQ ID NO: 1689609 - protein, 18 aa, Staphylococcus aureus
EEYYPIETIVYGIKNIKQ

SEQ ID NO: 1689610 - protein, 17 aa, Staphylococcus aureus
EFHFAKRRSTEALYEQQ

SEQ ID NO: 1689611 - protein, 23 aa, Staphylococcus aureus
EIDFDMILLVAYKILTVNSNVAR

SEQ ID NO: 1689612 - protein, 18 aa, Staphylococcus aureus
EITGIRHIVGIETKNWRN

SEQ ID NO: 1689613 - protein, 17 aa, Staphylococcus aureus
EKDQTFGTLKFSALRRE

SEQ ID NO: 1689614 - protein, 18 aa, Staphylococcus aureus
EKNFDALYSKLNDLGLTG

SEQ ID NO: 1689615 - protein, 28 aa, Staphylococcus aureus
ELENGLRLFIIPKPGFQKTFVTYTTQFG

SEQ ID NO: 1689616 - protein, 19 aa, Staphylococcus aureus
ELINFIINYARQNNYESLL

SEQ ID NO: 1689617 - protein, 23 aa, Staphylococcus aureus
ELKHQFTHLTWKIKVYAASGAIN

SEQ ID NO: 1689618 - protein, 19 aa, Staphylococcus aureus
ELTVTITLNEYRKLIEIKA

SEQ ID NO: 1689619 - protein, 25 aa, Staphylococcus aureus
ELVKKSLMLTIFVLSESYVSSLIVS

SEQ ID NO: 1689620 - protein, 34 aa, Staphylococcus aureus
ENVLKICGLYAFRNWPIVALSYGQKKRVTIASVL

SEQ ID NO: 1689621 - protein, 22 aa, Staphylococcus aureus
EPGYKSVLIALDRFVTATIEET

SEQ ID NO: 1689622 - protein, 32 aa, Staphylococcus aureus
EQEYAWAFLNELFYLIELYLKAFKGQKKTDYE

SEQ ID NO: 1689623 - protein, 17 aa, Staphylococcus aureus
EQYFRNLEFTCLQECIN

SEQ ID NO: 1689624 - protein, 23 aa, Staphylococcus aureus
ERPFLNKTLERKAVWDKWMEQDK

SEQ ID NO: 1689625 - protein, 18 aa, Staphylococcus aureus
ETIMSQFNLIDNRPESLL

SEQ ID NO: 1689626 - protein, 29 aa, Staphylococcus aureus
ETISRRISNLTKFGYLKIEIIKEGNEVKQ

SEQ ID NO: 1689627 - protein, 17 aa, Staphylococcus aureus
ETTAIDIPFAARHFHYF

SEQ ID NO: 1689628 - protein, 23 aa, Staphylococcus aureus
EVEHVFATQTLWQTKPKNLKIDI

SEQ ID NO: 1689629 - protein, 23 aa, Staphylococcus aureus
EVKQRKMYPLTQSSIPIDAKINT

SEQ ID NO: 1689630 - protein, 20 aa, Staphylococcus aureus
EVLWLKQNIISYLDDVSFTR

SEQ ID NO: 1689631 - protein, 18 aa, Staphylococcus aureus
EYVLPDAVTRFRQGLGRL

SEQ ID NO: 1689632 - protein, 19 aa, Staphylococcus aureus
FALNMMLNIAQNGYKTSFF

SEQ ID NO: 1689633 - protein, 17 aa, Staphylococcus aureus
FDYVIHLAALVSVAESV

SEQ ID NO: 1689634 - protein, 34 aa, Staphylococcus aureus
FEKLQLINFDNFLTIHFYYYYDFEYDCLILPNDV

SEQ ID NO: 1689635 - protein, 21 aa, Staphylococcus aureus
FGAPFFPLHPTVYADLLGELI

SEQ ID NO: 1689636 - protein, 22 aa, Staphylococcus aureus
FGASMVMIGSLFAAHEESPGET

SEQ ID NO: 1689637 - protein, 17 aa, Staphylococcus aureus
FGTLKFSALRREVRIQN

SEQ ID NO: 1689638 - protein, 27 aa, Staphylococcus aureus
FIDAQFEPLRKMEAPMFKKILKKHQLL

SEQ ID NO: 1689639 - protein, 17 aa, Staphylococcus aureus
FKGFEYLVYEKPTEMPF

SEQ ID NO: 1689640 - protein, 18 aa, Staphylococcus aureus
FKKRWPINIGFIGNVRFN

SEQ ID NO: 1689641 - protein, 18 aa, Staphylococcus aureus
FKLALPYLMTAAELDKDK

SEQ ID NO: 1689642 - protein, 17 aa, Staphylococcus aureus
FMVNEGHISTSLIQRHF

SEQ ID NO: 1689643 - protein, 25 aa, Staphylococcus aureus
FNPDNPLEMLFDYVRIRFPTNDVAQ

SEQ ID NO: 1689644 - protein, 27 aa, Staphylococcus aureus
FNSTNDLLTWLQDPFIKDMPGKRVNIN

SEQ ID NO: 1689645 - protein, 21 aa, Staphylococcus aureus
FVLSYDLFQNPTDTRTLIPFL

SEQ ID NO: 1689646 - protein, 17 aa, Staphylococcus aureus
FYIPCKEIVDYFSLIQT

SEQ ID NO: 1689647 - protein, 25 aa, Staphylococcus aureus
FYMKKGFLMIELPSGRALAYPKASV

SEQ ID NO: 1689648 - protein, 26 aa, Staphylococcus aureus
GAGSLISYLKRYSLSAIFGITSDQDD

SEQ ID NO: 1689649 - protein, 18 aa, Staphylococcus aureus
GAMTVLKAAIADKERTKA

SEQ ID NO: 1689650 - protein, 18 aa, Staphylococcus aureus
GCPKCRPAINYYLNMVYP

SEQ ID NO: 1689651 - protein, 17 aa, Staphylococcus aureus
GDFFKKMDILISKQKMK

SEQ ID NO: 1689652 - protein, 31 aa, Staphylococcus aureus
GFGKEVKRRIFLGTFALSSGYYDAYYKKSQK

SEQ ID NO: 1689653 - protein, 18 aa, Staphylococcus aureus
GFKRDFKLYECNELYIIK

SEQ ID NO: 1689654 - protein, 22 aa, Staphylococcus aureus
GGGVKYFVRPPYHPDKTTPAPK

SEQ ID NO: 1689655 - protein, 18 aa, Staphylococcus aureus
GGPGTFSPLLLDTLYHLN

SEQ ID NO: 1689656 - protein, 23 aa, Staphylococcus aureus
GGPGTFSPLLLDTLYHLNETTYQ

SEQ ID NO: 1689657 - protein, 21 aa, Staphylococcus aureus
GGQWFTPVINHPEVAILGIGR

SEQ ID NO: 1689658 - protein, 21 aa, Staphylococcus aureus
GGTFRLFEFYEQQYDIKFKYV

SEQ ID NO: 1689659 - protein, 19 aa, Staphylococcus aureus
GHVIGMLEWALDYIAGNIE

SEQ ID NO: 1689660 - protein, 19 aa, Staphylococcus aureus
GIDIDTLVKFNLKKGQQLE

SEQ ID NO: 1689661 - protein, 30 aa, Staphylococcus aureus
GIEVISRLFKLNKIFIIKEKVSLFKEEIYN

SEQ ID NO: 1689662 - protein, 20 aa, Staphylococcus aureus
GIHRIRIHGLRHSHASLLIS

SEQ ID NO: 1689663 - protein, 27 aa, Staphylococcus aureus
GILSTNHLLYLLQRFYDATFSKEELQY

SEQ ID NO: 1689664 - protein, 25 aa, Staphylococcus aureus
GIQNGWQGHWIIISATFEGISEEEF

SEQ ID NO: 1689665 - protein, 27 aa, Staphylococcus aureus
GKRKDFLVHRLVAFAFIPMIEGKICIN

SEQ ID NO: 1689666 - protein, 22 aa, Staphylococcus aureus
GNGKFLYSPFSIFDNESIIDFF

SEQ ID NO: 1689667 - protein, 22 aa, Staphylococcus aureus
GNTVCYMWLRFNMDQQFDDTAI

SEQ ID NO: 1689668 - protein, 24 aa, Staphylococcus aureus
GRRFAYWIKYTPGLPFKIVGTKNG

SEQ ID NO: 1689669 - protein, 28 aa, Staphylococcus aureus
GTEAFIETAKIVLRWLKEQDIQVELLNL

SEQ ID NO: 1689670 - protein, 17 aa, Staphylococcus aureus
GTLYVTISDVYSGSPTL

SEQ ID NO: 1689671 - protein, 18 aa, Staphylococcus aureus
GTLYVTISDVYSGSPTLT

SEQ ID NO: 1689672 - protein, 24 aa, Staphylococcus aureus
GTYYFHGHIVPGWQGVKKTFDTAE

SEQ ID NO: 1689673 - protein, 21 aa, Staphylococcus aureus
GYEARPRFNKPSETNAYNVTT

SEQ ID NO: 1689674 - protein, 23 aa, Staphylococcus aureus
HEQFEEWWKLYDKKKDKKMSFTK

SEQ ID NO: 1689675 - protein, 23 aa, Staphylococcus aureus
HEYQVGDIYPRDGLEVSEERFTE

SEQ ID NO: 1689676 - protein, 26 aa, Staphylococcus aureus
HLSLIAHTFYATEFDFPKALRKEEIV

SEQ ID NO: 1689677 - protein, 22 aa, Staphylococcus aureus
HNAYRYIDGELWIYSAVLDSNK

SEQ ID NO: 1689678 - protein, 24 aa, Staphylococcus aureus
HTAFHGYLIEILKKYEITVPRDEN

SEQ ID NO: 1689679 - protein, 25 aa, Staphylococcus aureus
HTTKGQAPQPFWNPAIDAGRKTFEQ

SEQ ID NO: 1689680 - protein, 17 aa, Staphylococcus aureus
HVTGCRLLKKPHIKQYI

SEQ ID NO: 1689681 - protein, 24 aa, Staphylococcus aureus
IDDYVLFPVHPWQYQHILPNVFAK

SEQ ID NO: 1689682 - protein, 18 aa, Staphylococcus aureus
IEAIKNASFPVLLAGMRS

SEQ ID NO: 1689683 - protein, 19 aa, Staphylococcus aureus
IEAKHTLDYYAGLSFRTLV

SEQ ID NO: 1689684 - protein, 18 aa, Staphylococcus aureus
IELPNAKPGAYVWRDKVC

SEQ ID NO: 1689685 - protein, 21 aa, Staphylococcus aureus
IEPRDSLFFVHELMGYNTELK

SEQ ID NO: 1689686 - protein, 24 aa, Staphylococcus aureus
IFSKNLFRRPAPARLTRIEKSLLQ

SEQ ID NO: 1689687 - protein, 20 aa, Staphylococcus aureus
IIPKVHLKRISKSGFGPFAF

SEQ ID NO: 1689688 - protein, 23 aa, Staphylococcus aureus
IKKLNDVYKNCNGYIAKIKQSIE

SEQ ID NO: 1689689 - protein, 19 aa, Staphylococcus aureus
INGYRWITYIANSGQRRYI

SEQ ID NO: 1689690 - protein, 23 aa, Staphylococcus aureus
IQNIGLPTPNLTYFCSYQLAKRT

SEQ ID NO: 1689691 - protein, 19 aa, Staphylococcus aureus
IQNPSFFQGLSKEPGTIVP

SEQ ID NO: 1689692 - protein, 24 aa, Staphylococcus aureus
IQPKTMMSKLVPGLFLCGEVLDIH

SEQ ID NO: 1689693 - protein, 26 aa, Staphylococcus aureus
IQPPSAHLFFNDPMLSIFLYSEVEHR

SEQ ID NO: 1689694 - protein, 25 aa, Staphylococcus aureus
IRLKKEYYYNFFGQYLLSRKGKRKI

SEQ ID NO: 1689695 - protein, 19 aa, Staphylococcus aureus
ISKLNGLCLKWVAPGTRGV

SEQ ID NO: 1689696 - protein, 20 aa, Staphylococcus aureus
ITEHHFVINSLALPFSVLYN

SEQ ID NO: 1689697 - protein, 24 aa, Staphylococcus aureus
ITKFNILQFILDLSLKDSKLTNRC

SEQ ID NO: 1689698 - protein, 18 aa, Staphylococcus aureus
ITKLNGLCLKWVAPGTRG

SEQ ID NO: 1689699 - protein, 17 aa, Staphylococcus aureus
IVNPIKKLPTRFTINVA

SEQ ID NO: 1689700 - protein, 19 aa, Staphylococcus aureus
IVSLMKPLNRFINRRILHF

SEQ ID NO: 1689701 - protein, 20 aa, Staphylococcus aureus
IYGTHLWSGYPTGTIHSRAG

SEQ ID NO: 1689702 - protein, 35 aa, Staphylococcus aureus
IYIDGFHNFSTIEYLIIKGLIKYAKSVTIILTTDG

SEQ ID NO: 1689703 - protein, 18 aa, Staphylococcus aureus
IYKTLSALYHNFDGFGLN

SEQ ID NO: 1689704 - protein, 23 aa, Staphylococcus aureus
KDADATLALVKKFDTPAAVAVKH

SEQ ID NO: 1689705 - protein, 21 aa, Staphylococcus aureus
KDQKVMPFTATYQLIDQDRGI

SEQ ID NO: 1689706 - protein, 19 aa, Staphylococcus aureus
KDVLNRVTALVSKTPEVNI

SEQ ID NO: 1689707 - protein, 23 aa, Staphylococcus aureus
KENIMMPLILAGAKRKDIEQRVH

SEQ ID NO: 1689708 - protein, 23 aa, Staphylococcus aureus
KEPFNQLGGYPYFDQIDPRTNDQ

SEQ ID NO: 1689709 - protein, 18 aa, Staphylococcus aureus
KFSVITVVNWAIYQSMEE

SEQ ID NO: 1689710 - protein, 24 aa, Staphylococcus aureus
KGIDSLLSIVQMPGGIPVATTAIG

SEQ ID NO: 1689711 - protein, 18 aa, Staphylococcus aureus
KGIGTRYIKLIFEFLKKE

SEQ ID NO: 1689712 - protein, 19 aa, Staphylococcus aureus
KGLDKAIETLKESKPYLFA

SEQ ID NO: 1689713 - protein, 22 aa, Staphylococcus aureus
KGQGRMIQVSIPASVPLKEFDY

SEQ ID NO: 1689714 - protein, 19 aa, Staphylococcus aureus
KGRYVVLKKKNSLFKGKEI

SEQ ID NO: 1689715 - protein, 17 aa, Staphylococcus aureus
KIHMLKQQNIIGIGTHN

SEQ ID NO: 1689716 - protein, 19 aa, Staphylococcus aureus
KKHLKNSGGIALLPEFIVA

SEQ ID NO: 1689717 - protein, 25 aa, Staphylococcus aureus
KKLELNYDVYLERLKYEYKVITNMG

SEQ ID NO: 1689718 - protein, 22 aa, Staphylococcus aureus
KKRNIILLHYFMDMSDVEIAEL

SEQ ID NO: 1689719 - protein, 18 aa, Staphylococcus aureus
KLMGIRQIIDSYLNHQIE

SEQ ID NO: 1689720 - protein, 23 aa, Staphylococcus aureus
KMIEIRRYLHQHPELSFHEDETA

SEQ ID NO: 1689721 - protein, 30 aa, Staphylococcus aureus
KMTFKHYIFEIFLPWYKTQVKLRTYENRLP

SEQ ID NO: 1689722 - protein, 22 aa, Staphylococcus aureus
KNGGYFIEFAYLSDLATIDMKL

SEQ ID NO: 1689723 - protein, 26 aa, Staphylococcus aureus
KNKALRKYDYLINKIAFIDEYEEYIT

SEQ ID NO: 1689724 - protein, 17 aa, Staphylococcus aureus
KNLIKEISPVDLTDLMK

SEQ ID NO: 1689725 - protein, 17 aa, Staphylococcus aureus
KPQQYYTLSLTVKGFDF

SEQ ID NO: 1689726 - protein, 24 aa, Staphylococcus aureus
KQALKDRINQILQQGHNDINNAMT

SEQ ID NO: 1689727 - protein, 20 aa, Staphylococcus aureus
KQFNYRGLQCPGPIVKISQE

SEQ ID NO: 1689728 - protein, 25 aa, Staphylococcus aureus
KQLDVKLFYRKKYGMELTEEGLAYV

SEQ ID NO: 1689729 - protein, 18 aa, Staphylococcus aureus
KQPVILNQQFGLGMDYFD

SEQ ID NO: 1689730 - protein, 30 aa, Staphylococcus aureus
KQYKMTTACLLFFGKYNAISDRFPGFQLDY

SEQ ID NO: 1689731 - protein, 29 aa, Staphylococcus aureus
KRAGKTYVFILLFLMHIATYKDKGLNFII

SEQ ID NO: 1689732 - protein, 17 aa, Staphylococcus aureus
KRGYKMLPHFQIGMFED

SEQ ID NO: 1689733 - protein, 17 aa, Staphylococcus aureus
KRQQMIDFIVVTAALDI

SEQ ID NO: 1689734 - protein, 17 aa, Staphylococcus aureus
KSAILFASLFSNDTTVI

SEQ ID NO: 1689735 - protein, 30 aa, Staphylococcus aureus
KSQEDAYIEKFLMSLYLYETVSQTSMQFDV

SEQ ID NO: 1689736 - protein, 26 aa, Staphylococcus aureus
KTGGTLRRLLIVPFNANFNGIKENFK

SEQ ID NO: 1689737 - protein, 17 aa, Staphylococcus aureus
KVFKYGEKYYAIIGAQN

SEQ ID NO: 1689738 - protein, 21 aa, Staphylococcus aureus
KVIIIELNDDRIKYLQDMYAE

SEQ ID NO: 1689739 - protein, 24 aa, Staphylococcus aureus
KVLYEHLGPQFWWPADNDIEMMLG

SEQ ID NO: 1689740 - protein, 30 aa, Staphylococcus aureus
KWKEKVHIIRWFLAYKKVPKILVDKIIAIM

SEQ ID NO: 1689741 - protein, 25 aa, Staphylococcus aureus
KYQVKGLADDIHYSVKPKLANITLE

SEQ ID NO: 1689742 - protein, 17 aa, Staphylococcus aureus
LAGLVADGKTSVTELTH

SEQ ID NO: 1689743 - protein, 23 aa, Staphylococcus aureus
LDDEGMVLYLNRNAKKATGYYFV

SEQ ID NO: 1689744 - protein, 25 aa, Staphylococcus aureus
LDEKRLNYVGFYRLHHKYNKKVMMA

SEQ ID NO: 1689745 - protein, 28 aa, Staphylococcus aureus
LDLLGLGHLNMIYLALKIVEFEACRSRE

SEQ ID NO: 1689746 - protein, 17 aa, Staphylococcus aureus
LDLNRKWSKLKTYGGKL

SEQ ID NO: 1689747 - protein, 22 aa, Staphylococcus aureus
LEIGATFHIVSLPDSGTRIEVK

SEQ ID NO: 1689748 - protein, 26 aa, Staphylococcus aureus
LENGLRLFVIPKPGFQKTFVTYTTQF

SEQ ID NO: 1689749 - protein, 18 aa, Staphylococcus aureus
LETLTGIDLIIDDTPEAV

SEQ ID NO: 1689750 - protein, 18 aa, Staphylococcus aureus
LGLDIPFGSSKNPFEFYE

SEQ ID NO: 1689751 - protein, 18 aa, Staphylococcus aureus
LHETFKAYGVLFIDAQFE

SEQ ID NO: 1689752 - protein, 19 aa, Staphylococcus aureus
LHHNFVGTEHILLGLIREN

SEQ ID NO: 1689753 - protein, 19 aa, Staphylococcus aureus
LIGLHHRICYTTSASVLTE

SEQ ID NO: 1689754 - protein, 17 aa, Staphylococcus aureus
LIISIDDMNYYSYMRHH

SEQ ID NO: 1689755 - protein, 18 aa, Staphylococcus aureus
LIQKLMLIMPEGPALTLN

SEQ ID NO: 1689756 - protein, 17 aa, Staphylococcus aureus
LIVTAAFGQLLPESLLA

SEQ ID NO: 1689757 - protein, 33 aa, Staphylococcus aureus
LIYKEDYYQHFLFISLWFLFMTGMRIGEATAIQ

SEQ ID NO: 1689758 - protein, 17 aa, Staphylococcus aureus
LKAIKLIKTLDDAKLLD

SEQ ID NO: 1689759 - protein, 19 aa, Staphylococcus aureus
LKLQFFAEESDGDNGKSKD

SEQ ID NO: 1689760 - protein, 24 aa, Staphylococcus aureus
LKQCNLGKRDFLWTQYISINNEKV

SEQ ID NO: 1689761 - protein, 26 aa, Staphylococcus aureus
LKSAQMIIIDNYYLLLGGYNKTSNQH

SEQ ID NO: 1689762 - protein, 19 aa, Staphylococcus aureus
LLFAEITSLSNKYGYCTAS

SEQ ID NO: 1689763 - protein, 25 aa, Staphylococcus aureus
LLFSNNINVYLPGARIRFMRYEGTK

SEQ ID NO: 1689764 - protein, 19 aa, Staphylococcus aureus
LMEIRTIYRMILKLHNIML

SEQ ID NO: 1689765 - protein, 33 aa, Staphylococcus aureus
LNEFIQSYVIILLIDIRLPVVRLYIIRDIVDTC

SEQ ID NO: 1689766 - protein, 22 aa, Staphylococcus aureus
LNPDFFMYQAYAAQVNREIAFV

SEQ ID NO: 1689767 - protein, 18 aa, Staphylococcus aureus
LNSRIIYTLSPTKIYRTA

SEQ ID NO: 1689768 - protein, 18 aa, Staphylococcus aureus
LPDYIQIWPGHGAGSPCG

SEQ ID NO: 1689769 - protein, 27 aa, Staphylococcus aureus
LRSLVTTEFIWSVPGRFDIYGPQILIQ

SEQ ID NO: 1689770 - protein, 21 aa, Staphylococcus aureus
LSALTFSYLTSHDVLGSIIVG

SEQ ID NO: 1689771 - protein, 17 aa, Staphylococcus aureus
LSNNIMFELFKKDTQDY

SEQ ID NO: 1689772 - protein, 17 aa, Staphylococcus aureus
LTDHRIGMMLAVASLLS

SEQ ID NO: 1689773 - protein, 17 aa, Staphylococcus aureus
LTIILITHEMHVIRRIC

SEQ ID NO: 1689774 - protein, 17 aa, Staphylococcus aureus
LYTIKKYGPDRIAGFTP

SEQ ID NO: 1689775 - protein, 20 aa, Staphylococcus aureus
MGEYIVYYDGVVIGGLYDNR

SEQ ID NO: 1689776 - protein, 18 aa, Staphylococcus aureus
MLLKNKVGQFIDSFSTRF

SEQ ID NO: 1689777 - protein, 20 aa, Staphylococcus aureus
MLNTILEAITAFLKNEFPQS

SEQ ID NO: 1689778 - protein, 18 aa, Staphylococcus aureus
MVLYMNRNTKTTKGYYYV

SEQ ID NO: 1689779 - protein, 30 aa, Staphylococcus aureus
MVQDSQLEMRALLLHLRPLGLKDKSLGEGI

SEQ ID NO: 1689780 - protein, 20 aa, Staphylococcus aureus
MVQGLVIPSNYLGRKMKILK

SEQ ID NO: 1689781 - protein, 39 aa, Staphylococcus aureus
NADLWYGFQCFDYANAAWKVLFGLLLKGLGAKDIPFANN

SEQ ID NO: 1689782 - protein, 24 aa, Staphylococcus aureus
NAENYELIPTVFAEFEIDGKITTF

SEQ ID NO: 1689783 - protein, 33 aa, Staphylococcus aureus
NAIYEFQYAYGLPDYGIIGMQLPLTIVIIGETL

SEQ ID NO: 1689784 - protein, 25 aa, Staphylococcus aureus
NALTALRILLDDSYYYSSKTLKESD

SEQ ID NO: 1689785 - protein, 23 aa, Staphylococcus aureus
NDDYIWLGHSFVRQGFLDDVKLE

SEQ ID NO: 1689786 - protein, 24 aa, Staphylococcus aureus
NERAKILLGWEPIATQKEAILAAV

SEQ ID NO: 1689787 - protein, 26 aa, Staphylococcus aureus
NERMPIKSLNLLASQVLEIIKIVARH

SEQ ID NO: 1689788 - protein, 17 aa, Staphylococcus aureus
NGEPWFPVNLNYKTINV

SEQ ID NO: 1689789 - protein, 25 aa, Staphylococcus aureus
NGHGTAHYPFFKIDFERLARYCEKN

SEQ ID NO: 1689790 - protein, 24 aa, Staphylococcus aureus
NGRDVRVTLWKNGKRKDFLVHRLV

SEQ ID NO: 1689791 - protein, 23 aa, Staphylococcus aureus
NHLNDFIRIYADTLPNNEICLSD

SEQ ID NO: 1689792 - protein, 22 aa, Staphylococcus aureus
NHPIEWQLQVDLWLKNGKSKLV

SEQ ID NO: 1689793 - protein, 22 aa, Staphylococcus aureus
NHTFYRVNIPTINVLNPVGSGD

SEQ ID NO: 1689794 - protein, 18 aa, Staphylococcus aureus
NILEVKMDLGYQRKDFID

SEQ ID NO: 1689795 - protein, 24 aa, Staphylococcus aureus
NIPLKSFHVVDLSELYFATDAMRD

SEQ ID NO: 1689796 - protein, 26 aa, Staphylococcus aureus
NIPTQKAPKLLLKGSGNLKGSSVGYK

SEQ ID NO: 1689797 - protein, 17 aa, Staphylococcus aureus
NISLPLKTKSIAPYETD

SEQ ID NO: 1689798 - protein, 22 aa, Staphylococcus aureus
NKDGFVFGGYIDWPSFVDYEDF

SEQ ID NO: 1689799 - protein, 19 aa, Staphylococcus aureus
NKLLLSFQQSEKLRRHMSF

SEQ ID NO: 1689800 - protein, 23 aa, Staphylococcus aureus
NKLVEWSLYLKDQRINPIIYMET

SEQ ID NO: 1689801 - protein, 26 aa, Staphylococcus aureus
NLDGVWLGDLILIKRGLSDTEKAGIL

SEQ ID NO: 1689802 - protein, 27 aa, Staphylococcus aureus
NLKREFSYWQFRKLFKSYTRQSDVHEL

SEQ ID NO: 1689803 - protein, 33 aa, Staphylococcus aureus
NMPSMLNKYFNKLSVFRKLFGNLIYSNTLYENN

SEQ ID NO: 1689804 - protein, 23 aa, Staphylococcus aureus
NMVQGLVIPSNYLGRKMKILKDH

SEQ ID NO: 1689805 - protein, 22 aa, Staphylococcus aureus
NNKHDLAALSYLTFVALDDEGK

SEQ ID NO: 1689806 - protein, 25 aa, Staphylococcus aureus
NQLEKWYQIEYLKEMVTFVVVNRDK

SEQ ID NO: 1689807 - protein, 26 aa, Staphylococcus aureus
NRLIHLSEGYIYFKDKPISDCPVYEM

SEQ ID NO: 1689808 - protein, 28 aa, Staphylococcus aureus
NRNMIIINESGLYSLIFDASKQSKNEKI

SEQ ID NO: 1689809 - protein, 19 aa, Staphylococcus aureus
NSAPLIYKTLSALYHNFHG

SEQ ID NO: 1689810 - protein, 24 aa, Staphylococcus aureus
NSPLTGFISILKTYMQLSKNKETI

SEQ ID NO: 1689811 - protein, 23 aa, Staphylococcus aureus
NTLCTYLKIRVPFDDLDFFESHK

SEQ ID NO: 1689812 - protein, 26 aa, Staphylococcus aureus
NVNNLLDMPFGACHFAVAAKPETTNY

SEQ ID NO: 1689813 - protein, 26 aa, Staphylococcus aureus
NVSNDIFMDLWMKVYRMFDELRETFK

SEQ ID NO: 1689814 - protein, 17 aa, Staphylococcus aureus
NYTKYDGTPFLPHEIEE

SEQ ID NO: 1689815 - protein, 17 aa, Staphylococcus aureus
PDKQGAYTDAYNAAKNI

SEQ ID NO: 1689816 - protein, 29 aa, Staphylococcus aureus
PDSLRYFYTDYIHELLLLEDSNKFKGVKA

SEQ ID NO: 1689817 - protein, 25 aa, Staphylococcus aureus
PEEDMPYLPDGRPIDIMLNPLGVPS

SEQ ID NO: 1689818 - protein, 19 aa, Staphylococcus aureus
PEKWKDFEVIKRQKAIEIA

SEQ ID NO: 1689819 - protein, 18 aa, Staphylococcus aureus
PFEYIFFNRLKNENLSAR

SEQ ID NO: 1689820 - protein, 21 aa, Staphylococcus aureus
PFLSCPVAYQFQPGGYCDYTE

SEQ ID NO: 1689821 - protein, 19 aa, Staphylococcus aureus
PIEIPNFKFGKRVIDSTGA

SEQ ID NO: 1689822 - protein, 17 aa, Staphylococcus aureus
PKAYYRDEDSWLASFEV

SEQ ID NO: 1689823 - protein, 21 aa, Staphylococcus aureus
PLIASSIMSKKIAAGADAIVL

SEQ ID NO: 1689824 - protein, 17 aa, Staphylococcus aureus
PNCGFYTATHPLNFHHR

SEQ ID NO: 1689825 - protein, 24 aa, Staphylococcus aureus
PPSAHLFFNDPMLSIFLYSEVEHR

SEQ ID NO: 1689826 - protein, 17 aa, Staphylococcus aureus
PPTVVMMVGLQGAGKTT

SEQ ID NO: 1689827 - protein, 17 aa, Staphylococcus aureus
PSLIISFYPGYAVHPDH

SEQ ID NO: 1689828 - protein, 23 aa, Staphylococcus aureus
PTNKAPKLLLKGTGNLKGSSVGY

SEQ ID NO: 1689829 - protein, 29 aa, Staphylococcus aureus
PVLLKEIYQFPLLLFYKGNIKLINNMHHL

SEQ ID NO: 1689830 - protein, 23 aa, Staphylococcus aureus
QASNFFYCGYFKTSVYRDKQSWE

SEQ ID NO: 1689831 - protein, 18 aa, Staphylococcus aureus
QAVNAAKAILTKASGQNV

SEQ ID NO: 1689832 - protein, 27 aa, Staphylococcus aureus
QDLHDTLGHVFASLSLKSELAYKLIDT

SEQ ID NO: 1689833 - protein, 18 aa, Staphylococcus aureus
QDTIQFKWISFQEAVDKN

SEQ ID NO: 1689834 - protein, 17 aa, Staphylococcus aureus
QEYAPILYQIWKKKHKK

SEQ ID NO: 1689835 - protein, 17 aa, Staphylococcus aureus
QEYKYIKRILNEEVRAD

SEQ ID NO: 1689836 - protein, 20 aa, Staphylococcus aureus
QGFDIEHLAKIKSLVNIPII

SEQ ID NO: 1689837 - protein, 25 aa, Staphylococcus aureus
QKEKEGLLTVLILDGLEDPHNLGSI

SEQ ID NO: 1689838 - protein, 24 aa, Staphylococcus aureus
QNAESIIAGLNNPTINKGNVTSAT

SEQ ID NO: 1689839 - protein, 18 aa, Staphylococcus aureus
QNYYMYKKFGVIPEMEYE

SEQ ID NO: 1689840 - protein, 23 aa, Staphylococcus aureus
QPTHLLIDAMTLDNALPQVSLIK

SEQ ID NO: 1689841 - protein, 38 aa, Staphylococcus aureus
QQKGIVFLMIRFKTLDEVYLLPYSKFEVFWKRYKDNIK

SEQ ID NO: 1689842 - protein, 23 aa, Staphylococcus aureus
QTRHRLHKVETLRANWIQTTGGS

SEQ ID NO: 1689843 - protein, 26 aa, Staphylococcus aureus
QVDYKYNVIWVWHYSDDYLGKVASIN

SEQ ID NO: 1689844 - protein, 18 aa, Staphylococcus aureus
QYLKHLKTVFPERQYITN

SEQ ID NO: 1689845 - protein, 25 aa, Staphylococcus aureus
QYLNSFWSHLKPVMMALVLTSMRQR

SEQ ID NO: 1689846 - protein, 24 aa, Staphylococcus aureus
REDKIPMNIADDIKFHVVIYSENN

SEQ ID NO: 1689847 - protein, 22 aa, Staphylococcus aureus
REIWQYFTVLPNIQSVGVMGDY

SEQ ID NO: 1689848 - protein, 23 aa, Staphylococcus aureus
REKHLELIMKWCAQELKNNFQLE

SEQ ID NO: 1689849 - protein, 17 aa, Staphylococcus aureus
RELGFVLMALNIRKIAA

SEQ ID NO: 1689850 - protein, 19 aa, Staphylococcus aureus
RELGFVLMALNIRKIAAQR

SEQ ID NO: 1689851 - protein, 17 aa, Staphylococcus aureus
RFREALIFMGRKNGKTT

SEQ ID NO: 1689852 - protein, 25 aa, Staphylococcus aureus
RFYMKKGFLMIELPSGRALAYPKAS

SEQ ID NO: 1689853 - protein, 32 aa, Staphylococcus aureus
RGDLIILQGTDDDWLHGYWAGVPIGTDKTDTK

SEQ ID NO: 1689854 - protein, 28 aa, Staphylococcus aureus
RGESFISNPLLIYMEPYASSTAELVTEL

SEQ ID NO: 1689855 - protein, 22 aa, Staphylococcus aureus
RGRKTLLFGPMKPVGLEDPKTG

SEQ ID NO: 1689856 - protein, 28 aa, Staphylococcus aureus
RHDIKVTAWMPLMRNRGLLDNPVIVKIA

SEQ ID NO: 1689857 - protein, 19 aa, Staphylococcus aureus
RHPYVSVTGFVRPPYSKDT

SEQ ID NO: 1689858 - protein, 17 aa, Staphylococcus aureus
RILSPNDDYFYQSIVNY

SEQ ID NO: 1689859 - protein, 27 aa, Staphylococcus aureus
RIMDLVTPIGLGQRGLIVAPPKAGKTS

SEQ ID NO: 1689860 - protein, 28 aa, Staphylococcus aureus
RKAKVAIQELLWFVFEHFDIKGEHNDVD

SEQ ID NO: 1689861 - protein, 21 aa, Staphylococcus aureus
RKRVMTPPPVKKVAMKYDLPV

SEQ ID NO: 1689862 - protein, 20 aa, Staphylococcus aureus
RLARAYNLVIPPSGRTLSGG

SEQ ID NO: 1689863 - protein, 21 aa, Staphylococcus aureus
RLEGVQIFIDQPLSMIDKSLS

SEQ ID NO: 1689864 - protein, 19 aa, Staphylococcus aureus
RLFIDCKVPQWVRDQMPIV

SEQ ID NO: 1689865 - protein, 17 aa, Staphylococcus aureus
RLNSKWISVLYLSTKEQ

SEQ ID NO: 1689866 - protein, 17 aa, Staphylococcus aureus
RMTSFNGYIYASTIIKQ

SEQ ID NO: 1689867 - protein, 18 aa, Staphylococcus aureus
RQADPSLFIEKYQRFTLD

SEQ ID NO: 1689868 - protein, 22 aa, Staphylococcus aureus
RQFKEIPLVDYIFCTYNTDLYY

SEQ ID NO: 1689869 - protein, 19 aa, Staphylococcus aureus
RRKLIANDILIILKNEFGI

SEQ ID NO: 1689870 - protein, 27 aa, Staphylococcus aureus
RRQHAYDFPMWFIRPNFKSETAPRSIQ

SEQ ID NO: 1689871 - protein, 24 aa, Staphylococcus aureus
RSSKINLMIIPKEKINMKNKNRFL

SEQ ID NO: 1689872 - protein, 17 aa, Staphylococcus aureus
RTDIIFLDEPTTYLDIC

SEQ ID NO: 1689873 - protein, 17 aa, Staphylococcus aureus
RTSAARAFITLPSIIFA

SEQ ID NO: 1689874 - protein, 21 aa, Staphylococcus aureus
RVDNYIAFRNTIASIESIVNT

SEQ ID NO: 1689875 - protein, 24 aa, Staphylococcus aureus
RVQVRRLLKKYGYPPDLQKMAVEQ

SEQ ID NO: 1689876 - protein, 22 aa, Staphylococcus aureus
SAKPYLHCVFNKDILNMDKVDI

SEQ ID NO: 1689877 - protein, 18 aa, Staphylococcus aureus
SDILCPFHYFGVTDYVHQ

SEQ ID NO: 1689878 - protein, 19 aa, Staphylococcus aureus
SELYFVIGTDQYNQLEKWY

SEQ ID NO: 1689879 - protein, 25 aa, Staphylococcus aureus
SFERTLNWLHHQVAPTLKIASILDV

SEQ ID NO: 1689880 - protein, 17 aa, Staphylococcus aureus
SGMSVNELLFGQYPKFN

SEQ ID NO: 1689881 - protein, 26 aa, Staphylococcus aureus
SHDAIDPQFYIFHNNYKKFTILTDTG

SEQ ID NO: 1689882 - protein, 27 aa, Staphylococcus aureus
SIEQRKKIFAMCRDIELHWGEPVESTR

SEQ ID NO: 1689883 - protein, 18 aa, Staphylococcus aureus
SISLFIRPNKAIRKQLFD

SEQ ID NO: 1689884 - protein, 26 aa, Staphylococcus aureus
SIYDALRQSFNIPALKAWQSVKQNAG

SEQ ID NO: 1689885 - protein, 19 aa, Staphylococcus aureus
SKDNFIVVHLNKIIYRFLK

SEQ ID NO: 1689886 - protein, 22 aa, Staphylococcus aureus
SKRQFLMNQIQALIRGVWLLSG

SEQ ID NO: 1689887 - protein, 21 aa, Staphylococcus aureus
SKTLHIIYPKDRVVSLDHVLY

SEQ ID NO: 1689888 - protein, 28 aa, Staphylococcus aureus
SKVQPCCFKLYNDPFDMAYVMMNGKLFG

SEQ ID NO: 1689889 - protein, 17 aa, Staphylococcus aureus
SNVAWFWHTSYSHRTEQ

SEQ ID NO: 1689890 - protein, 20 aa, Staphylococcus aureus
SPDKILGAILFEQTMDREVE

SEQ ID NO: 1689891 - protein, 20 aa, Staphylococcus aureus
SPNDLYTWSSGIKSPIYCDN

SEQ ID NO: 1689892 - protein, 27 aa, Staphylococcus aureus
SRKISLSNFKDYWQGKPKLDHITVTYQ

SEQ ID NO: 1689893 - protein, 27 aa, Staphylococcus aureus
SSFSLTDLYLFIFNNSIKTLTIVTNKG

SEQ ID NO: 1689894 - protein, 41 aa, Staphylococcus aureus
SSKTILDYVWDQYPLMNEKDIRAVLGRFLFVQDDVKKIIND

SEQ ID NO: 1689895 - protein, 24 aa, Staphylococcus aureus
STDLTKDYILSVGKEFLKKADTSD

SEQ ID NO: 1689896 - protein, 24 aa, Staphylococcus aureus
STGQLLFHLFAAFAEFERNLILER

SEQ ID NO: 1689897 - protein, 26 aa, Staphylococcus aureus
STGSWGKIPFIPFKNNDLEISDIFMY

SEQ ID NO: 1689898 - protein, 23 aa, Staphylococcus aureus
STTNNRRNLIAIKLVEDDTTEQS

SEQ ID NO: 1689899 - protein, 32 aa, Staphylococcus aureus
SVSQMMLYELRNLFPEIIFLDAISLRTFENYT

SEQ ID NO: 1689900 - protein, 37 aa, Staphylococcus aureus
SVVDNTFMTPYYQNPLDLGIDIVLHSATKYLGGHSDV

SEQ ID NO: 1689901 - protein, 20 aa, Staphylococcus aureus
SYRTYFCLDNMLHGRITSNN

SEQ ID NO: 1689902 - protein, 19 aa, Staphylococcus aureus
TAYDMRKDILVRLADELGI

SEQ ID NO: 1689903 - protein, 23 aa, Staphylococcus aureus
TDKFKLTVLVDMFGRETPVEVEF

SEQ ID NO: 1689904 - protein, 29 aa, Staphylococcus aureus
TDSKRQFLLNQIQALIRGVWLLSGIDKNL

SEQ ID NO: 1689905 - protein, 25 aa, Staphylococcus aureus
TEAVRRNLYSVILLDEVEKAHTDVF

SEQ ID NO: 1689906 - protein, 24 aa, Staphylococcus aureus
TEQPDIILLDLGLPDIDGLSLIQQ

SEQ ID NO: 1689907 - protein, 31 aa, Staphylococcus aureus
TFSQEEVSQLIKERIARERKKSDERIKDAVQ

SEQ ID NO: 1689908 - protein, 21 aa, Staphylococcus aureus
TFTSPFIETFNERISLNGVPI

SEQ ID NO: 1689909 - protein, 18 aa, Staphylococcus aureus
THFDNWFSETSLYEKGEI

SEQ ID NO: 1689910 - protein, 18 aa, Staphylococcus aureus
THKQQVVPVFWIAGEDHD

SEQ ID NO: 1689911 - protein, 27 aa, Staphylococcus aureus
THSKDGVKLLWASCRELFNVIQADEIG

SEQ ID NO: 1689912 - protein, 24 aa, Staphylococcus aureus
TIVSPLPEKSSFTAKFQVLPKVVN

SEQ ID NO: 1689913 - protein, 20 aa, Staphylococcus aureus
TKEHPLKIKLITYDGRPELS

SEQ ID NO: 1689914 - protein, 24 aa, Staphylococcus aureus
TLDLYHTLVPLNQELHKLRLKTQN

SEQ ID NO: 1689915 - protein, 27 aa, Staphylococcus aureus
TLIDDDFPLMLKWLTDERVLEFYGGRD

SEQ ID NO: 1689916 - protein, 32 aa, Staphylococcus aureus
TNDRLLKHDLLFHDMFLNDAWKKDLKVEFENE

SEQ ID NO: 1689917 - protein, 17 aa, Staphylococcus aureus
TNFLINYGYFDITPKNN

SEQ ID NO: 1689918 - protein, 26 aa, Staphylococcus aureus
TNTINGLPHLTQLQKDNLKHQVEQAQ

SEQ ID NO: 1689919 - protein, 18 aa, Staphylococcus aureus
TPAKVGLLEYNYIVDIKP

SEQ ID NO: 1689920 - protein, 24 aa, Staphylococcus aureus
TPKQIMIYEAFGWEPPRFGHMSLI

SEQ ID NO: 1689921 - protein, 18 aa, Staphylococcus aureus
TPLIIKPSVIKGINYKME

SEQ ID NO: 1689922 - protein, 24 aa, Staphylococcus aureus
TRYIKLIFEFLKKERNANAVILDP

SEQ ID NO: 1689923 - protein, 18 aa, Staphylococcus aureus
TTEQARIRLYIPLNERIS

SEQ ID NO: 1689924 - protein, 23 aa, Staphylococcus aureus
TTEQARIRLYIPLNERISADDYR

SEQ ID NO: 1689925 - protein, 26 aa, Staphylococcus aureus
TTMICAAMAGIQFFVTGGIGGVHKGA

SEQ ID NO: 1689926 - protein, 23 aa, Staphylococcus aureus
TTNEATIAAITPDANVKPQAKQA

SEQ ID NO: 1689927 - protein, 18 aa, Staphylococcus aureus
TYEYILTVAKAGMTEKEL

SEQ ID NO: 1689928 - protein, 18 aa, Staphylococcus aureus
TYQHLGLRALSEIASLPV

SEQ ID NO: 1689929 - protein, 17 aa, Staphylococcus aureus
VAGVLWGIQAAHEQFKK

SEQ ID NO: 1689930 - protein, 18 aa, Staphylococcus aureus
VEIYISVIKSMAIKYGVD

SEQ ID NO: 1689931 - protein, 17 aa, Staphylococcus aureus
VGIKNLVYPVLVDQYQT

SEQ ID NO: 1689932 - protein, 20 aa, Staphylococcus aureus
VIDFIVKFITTHDLNVQAVC

SEQ ID NO: 1689933 - protein, 17 aa, Staphylococcus aureus
VIDLQKKVPMKVVHEIQ

SEQ ID NO: 1689934 - protein, 20 aa, Staphylococcus aureus
VIVRELTSGIYFGEPRHFNN

SEQ ID NO: 1689935 - protein, 23 aa, Staphylococcus aureus
VKAKATFMFDKTAKKFATEQEDN

SEQ ID NO: 1689936 - protein, 22 aa, Staphylococcus aureus
VKFTIKVVLTDPYKYSVTGYKN

SEQ ID NO: 1689937 - protein, 19 aa, Staphylococcus aureus
VKKFIAECIKFGTTGNISA

SEQ ID NO: 1689938 - protein, 27 aa, Staphylococcus aureus
VNLIPYARKLEVLYEDAFIIIVTKPNN

SEQ ID NO: 1689939 - protein, 17 aa, Staphylococcus aureus
VPGVYPEDDVEKWFYDT

SEQ ID NO: 1689940 - protein, 19 aa, Staphylococcus aureus
VQSLLETFPVHNKEAALRQ

SEQ ID NO: 1689941 - protein, 17 aa, Staphylococcus aureus
VRLTIYRIDAINYEIDG

SEQ ID NO: 1689942 - protein, 22 aa, Staphylococcus aureus
VSIESLIEFCRLAQLPKNENIQ

SEQ ID NO: 1689943 - protein, 25 aa, Staphylococcus aureus
VSVNDFFTILIKYPSLEEQQKIGKF

SEQ ID NO: 1689944 - protein, 18 aa, Staphylococcus aureus
VTIPAIEAIVPQKDPNAN

SEQ ID NO: 1689945 - protein, 18 aa, Staphylococcus aureus
VVSLDFRMTATPLYSDIV

SEQ ID NO: 1689946 - protein, 21 aa, Staphylococcus aureus
VYEDLLLLRSLSDLNEHQKMD

SEQ ID NO: 1689947 - protein, 24 aa, Staphylococcus aureus
WENKFIKDIFIFENNRRKPITSSL

SEQ ID NO: 1689948 - protein, 19 aa, Staphylococcus aureus
WFMNAHIYLELADDYQALA

SEQ ID NO: 1689949 - protein, 19 aa, Staphylococcus aureus
WLEKWQRLEKKGRKEIKCY

SEQ ID NO: 1689950 - protein, 23 aa, Staphylococcus aureus
YAKDIILHLIKTYGVDFGTGYAL

SEQ ID NO: 1689951 - protein, 18 aa, Staphylococcus aureus
YDELSKFANYYIKAGVNA

SEQ ID NO: 1689952 - protein, 24 aa, Staphylococcus aureus
YDITSLYTFKQPVSPHLAFKMTDQ

SEQ ID NO: 1689953 - protein, 25 aa, Staphylococcus aureus
YDNPVTEIYFIEPDLHFTIIDFNQE

SEQ ID NO: 1689954 - protein, 29 aa, Staphylococcus aureus
YEFQYAYGLPDYGIIGMQLPLTIVIIGET

SEQ ID NO: 1689955 - protein, 17 aa, Staphylococcus aureus
YEKIEPRDSLFFVHELM

SEQ ID NO: 1689956 - protein, 20 aa, Staphylococcus aureus
YEMINQNFVLIEMLDEHLKN

SEQ ID NO: 1689957 - protein, 25 aa, Staphylococcus aureus
YENSKPIIATLFLDNYDEITQNMND

SEQ ID NO: 1689958 - protein, 20 aa, Staphylococcus aureus
YEYALKLVHNGLFNILAELD

SEQ ID NO: 1689959 - protein, 23 aa, Staphylococcus aureus
YIKIKGKWSYLYRAIDTEGHTLD

SEQ ID NO: 1689960 - protein, 25 aa, Staphylococcus aureus
YKQFEHYLENYWKTDAQRRYDNEEL

SEQ ID NO: 1689961 - protein, 18 aa, Staphylococcus aureus
YLHPHLEPILKNTYGVII

SEQ ID NO: 1689962 - protein, 20 aa, Staphylococcus aureus
YLPIKNLIALVLDSLDISIF

SEQ ID NO: 1689963 - protein, 17 aa, Staphylococcus aureus
YLRTALVENGYEVGTFT

SEQ ID NO: 1689964 - protein, 25 aa, Staphylococcus aureus
YNELKEIQGMWFSSLEELLENKEDI

SEQ ID NO: 1689965 - protein, 30 aa, Staphylococcus aureus
YNVSEKVFYDLWTDLYRLFKKLRNAFKEED

SEQ ID NO: 1689966 - protein, 17 aa, Staphylococcus aureus
YQVYAVEALIQQATETG

SEQ ID NO: 1689967 - protein, 24 aa, Staphylococcus aureus
YSENDHCLYFFDITEQVQTNELYE

SEQ ID NO: 1689968 - protein, 19 aa, Staphylococcus aureus
YSIPYKEIIEYLNKKTGKH

SEQ ID NO: 1689969 - protein, 24 aa, Staphylococcus aureus
YTTYGQAPQPFWNPAIDAGRKTFE

SEQ ID NO: 1689970 - protein, 24 aa, Staphylococcus aureus
ACPELLGGLLIPREPAEIIGGDGF

SEQ ID NO: 1689971 - protein, 26 aa, Staphylococcus aureus
ADAKPEHLLQYAQLGDIYAQKIRGID

SEQ ID NO: 1689972 - protein, 26 aa, Staphylococcus aureus
ADFETFKIALFDPAVKKYAFNANFER

SEQ ID NO: 1689973 - protein, 17 aa, Staphylococcus aureus
ADKGLIYKGKKPVYWSP

SEQ ID NO: 1689974 - protein, 17 aa, Staphylococcus aureus
ADLAIGVGLVNYKGKHF

SEQ ID NO: 1689975 - protein, 23 aa, Staphylococcus aureus
AEALNYMALAGWDSKQMMEGLSG

SEQ ID NO: 1689976 - protein, 22 aa, Staphylococcus aureus
AFNFLKNQKNIIWLDCNIDIIY

SEQ ID NO: 1689977 - protein, 27 aa, Staphylococcus aureus
AIDGLNLFEFKYKLKPFFNPENVYSKQ

SEQ ID NO: 1689978 - protein, 27 aa, Staphylococcus aureus
AKAHELKPDLILMDLLMDDMDGVEATT

SEQ ID NO: 1689979 - protein, 21 aa, Staphylococcus aureus
AKAQGLEAFDNIQIDSTEKQK

SEQ ID NO: 1689980 - protein, 23 aa, Staphylococcus aureus
AKELRAKLDLILGDTDNPHKITN

SEQ ID NO: 1689981 - protein, 17 aa, Staphylococcus aureus
AKFVKLFTDIDLNDDEV

SEQ ID NO: 1689982 - protein, 17 aa, Staphylococcus aureus
AKLFILLVGERPEEVTD

SEQ ID NO: 1689983 - protein, 35 aa, Staphylococcus aureus
AKNTSTIIPMCHPLPLTGIDVHFNWDETNAPLYTL

SEQ ID NO: 1689984 - protein, 23 aa, Staphylococcus aureus
AKQFIDYLNVKGIPHLYVTNNST

SEQ ID NO: 1689985 - protein, 18 aa, Staphylococcus aureus
AMKQAWLQISQDNKLMSC

SEQ ID NO: 1689986 - protein, 24 aa, Staphylococcus aureus
AQNETLHQFPIDNLFPIMGQTVTT

SEQ ID NO: 1689987 - protein, 24 aa, Staphylococcus aureus
AQSKFINRPFKEKGHWYNLEKEWQ

SEQ ID NO: 1689988 - protein, 24 aa, Staphylococcus aureus
ARMILHIIDQMNGIPFTERADRIL

SEQ ID NO: 1689989 - protein, 19 aa, Staphylococcus aureus
ARPTNFDDPRHPNWLVIEV

SEQ ID NO: 1689990 - protein, 17 aa, Staphylococcus aureus
ARRHGFTSAVPLHEIVE

SEQ ID NO: 1689991 - protein, 27 aa, Staphylococcus aureus
ASEEIGYYLIYNPFLEKAKDELYEYLQ

SEQ ID NO: 1689992 - protein, 26 aa, Staphylococcus aureus
ASNTIPVYMPYITSYFMTRAIGDRPL

SEQ ID NO: 1689993 - protein, 32 aa, Staphylococcus aureus
ASQYGPRPQFNKTPKYVKYRDAGTGIREYNDG

SEQ ID NO: 1689994 - protein, 20 aa, Staphylococcus aureus
ASYPSFLEIAPEPFTNEALT

SEQ ID NO: 1689995 - protein, 17 aa, Staphylococcus aureus
ATKILPASQFYKAEDYH

SEQ ID NO: 1689996 - protein, 24 aa, Staphylococcus aureus
AVPTTDCYEIFWGGDNELYNYHYL

SEQ ID NO: 1689997 - protein, 22 aa, Staphylococcus aureus
AYDLALYKNNTFIGQPLWGSIG

SEQ ID NO: 1689998 - protein, 23 aa, Staphylococcus aureus
CPELLGGLLIPREPAEIIGGDGF

SEQ ID NO: 1689999 - protein, 24 aa, Staphylococcus aureus
CQTHPFSQLLHDAIQLAFDNDITC

SEQ ID NO: 1690000 - protein, 29 aa, Staphylococcus aureus
CYELNTFFKAYLQQKGFNPALMSATIHTP

SEQ ID NO: 1690001 - protein, 32 aa, Staphylococcus aureus
DACYQLNVLQLIRLCRYFVDVLRQSDNGRIIV

SEQ ID NO: 1690002 - protein, 19 aa, Staphylococcus aureus
DAKRLITQLATLYGLTADG

SEQ ID NO: 1690003 - protein, 19 aa, Staphylococcus aureus
DALRQMTHLSDAQKQSITV

SEQ ID NO: 1690004 - protein, 17 aa, Staphylococcus aureus
DDFETLIEGYPVTYFSL

SEQ ID NO: 1690005 - protein, 29 aa, Staphylococcus aureus
DEKEKYSHNLYILKEFTTTKVKMLTENIN

SEQ ID NO: 1690006 - protein, 24 aa, Staphylococcus aureus
DEKPQLETIPVKKIPVVSKISAGM

SEQ ID NO: 1690007 - protein, 29 aa, Staphylococcus aureus
DERITLPEFINPNIKFTMISSIDIAKIAS

SEQ ID NO: 1690008 - protein, 22 aa, Staphylococcus aureus
DFEILIIAYSIDGGAISAIDMT

SEQ ID NO: 1690009 - protein, 24 aa, Staphylococcus aureus
DHASVLDEFYWLNKEDPNYSRCRV

SEQ ID NO: 1690010 - protein, 20 aa, Staphylococcus aureus
DIEQLNALNNAQQDGFKGRI

SEQ ID NO: 1690011 - protein, 22 aa, Staphylococcus aureus
DIFIINHRDLYRFQLQQDGIIC

SEQ ID NO: 1690012 - protein, 28 aa, Staphylococcus aureus
DIKAIYKRDYLCILGQTVHDKLGHEMQT

SEQ ID NO: 1690013 - protein, 23 aa, Staphylococcus aureus
DIMNYLFEIIDPYSVNQQGNDIG

SEQ ID NO: 1690014 - protein, 20 aa, Staphylococcus aureus
DKCGIFFTYIVSEMSTEQKQ

SEQ ID NO: 1690015 - protein, 23 aa, Staphylococcus aureus
DKMKSWYERFGFGKSTKGMFDGE

SEQ ID NO: 1690016 - protein, 30 aa, Staphylococcus aureus
DKQVQALIDEIDRNPILTDKEKQALKDRIN

SEQ ID NO: 1690017 - protein, 26 aa, Staphylococcus aureus
DLDDIVVNMFLYLPNFFQNQNSEDNM

SEQ ID NO: 1690018 - protein, 23 aa, Staphylococcus aureus
DLIKVHELIYLITAYSKRSKQFK

SEQ ID NO: 1690019 - protein, 24 aa, Staphylococcus aureus
DLLKQDKSFLYWSTVNRNCVICGK

SEQ ID NO: 1690020 - protein, 19 aa, Staphylococcus aureus
DLLLLDEPTNHLDFESISW

SEQ ID NO: 1690021 - protein, 17 aa, Staphylococcus aureus
DLNLYLLKDIKSRFGLY

SEQ ID NO: 1690022 - protein, 18 aa, Staphylococcus aureus
DLYYIHFPDDNTPKDQAV

SEQ ID NO: 1690023 - protein, 25 aa, Staphylococcus aureus
DNLKANYDNAIANAAHELDKVQGNA

SEQ ID NO: 1690024 - protein, 20 aa, Staphylococcus aureus
DNLSVIKPVIMPVAYKHCAL

SEQ ID NO: 1690025 - protein, 22 aa, Staphylococcus aureus
DRLINYNFLHKCFIDKEIRLCV

SEQ ID NO: 1690026 - protein, 20 aa, Staphylococcus aureus
DRNLYVPYDLPISKNNLFEY

SEQ ID NO: 1690027 - protein, 36 aa, Staphylococcus aureus
DSFKKYNLPLPSNQYFCTYRLSKDLYNLPSYRLQDL

SEQ ID NO: 1690028 - protein, 25 aa, Staphylococcus aureus
DSKFGLSIQYGLAIKAINKVQQSKY

SEQ ID NO: 1690029 - protein, 24 aa, Staphylococcus aureus
DSLKKAMELLIKKSVTASISLDFV

SEQ ID NO: 1690030 - protein, 25 aa, Staphylococcus aureus
DSYLPIKHPFEQALYQTYLIDDMTS

SEQ ID NO: 1690031 - protein, 24 aa, Staphylococcus aureus
DTELNLFSFVKQLSDIPLGGIIYT

SEQ ID NO: 1690032 - protein, 30 aa, Staphylococcus aureus
DTLDLLNEAYILRKHYFGKKVKLNMILNAK

SEQ ID NO: 1690033 - protein, 21 aa, Staphylococcus aureus
DTLVIYKLDRLGRTTKQLIDL

SEQ ID NO: 1690034 - protein, 19 aa, Staphylococcus aureus
DVLVQTFLKTHPPGPSKRI

SEQ ID NO: 1690035 - protein, 19 aa, Staphylococcus aureus
DYIDAFKIFIHHVALHVSH

SEQ ID NO: 1690036 - protein, 20 aa, Staphylococcus aureus
EAAHIIPIVRVTAVIDRDII

SEQ ID NO: 1690037 - protein, 17 aa, Staphylococcus aureus
EAIKNASFPVLLAGMRS

SEQ ID NO: 1690038 - protein, 26 aa, Staphylococcus aureus
EAISSALINVAWFWHTSYSHRTEQAR

SEQ ID NO: 1690039 - protein, 19 aa, Staphylococcus aureus
EAPMFKKILKKHQLLDDAF

SEQ ID NO: 1690040 - protein, 17 aa, Staphylococcus aureus
ECLKDAFEYTEGVPKEI

SEQ ID NO: 1690041 - protein, 22 aa, Staphylococcus aureus
EDDRLTLVSLNKEYRDLHFYRN

SEQ ID NO: 1690042 - protein, 17 aa, Staphylococcus aureus
EDIELFKDIADKVKQTN

SEQ ID NO: 1690043 - protein, 31 aa, Staphylococcus aureus
EDNRFYEHGALDYKRLFGAIGKNLTGGFGSE

SEQ ID NO: 1690044 - protein, 20 aa, Staphylococcus aureus
EDTVLQTRWTQKGRLKIHEI

SEQ ID NO: 1690045 - protein, 20 aa, Staphylococcus aureus
EDVLALWNKVNPSFALKSMF

SEQ ID NO: 1690046 - protein, 17 aa, Staphylococcus aureus
EEIAWYKLMTNLNDYFS

SEQ ID NO: 1690047 - protein, 19 aa, Staphylococcus aureus
EEINFFIGGYVKGDIPDYQ

SEQ ID NO: 1690048 - protein, 30 aa, Staphylococcus aureus
EEKNYLEAVIGLPVNIFYGTSIPTCILVFK

SEQ ID NO: 1690049 - protein, 18 aa, Staphylococcus aureus
EELPVRTLEVDGEPYFIG

SEQ ID NO: 1690050 - protein, 25 aa, Staphylococcus aureus
EEMPQLESSFYKLTPGRQHQYIYHI

SEQ ID NO: 1690051 - protein, 17 aa, Staphylococcus aureus
EENKYVFVLKHSETCPI

SEQ ID NO: 1690052 - protein, 27 aa, Staphylococcus aureus
EEQYVELFFDLLGIKPDWEKIKYYILL

SEQ ID NO: 1690053 - protein, 25 aa, Staphylococcus aureus
EEVIKFLHQLNIPVLIDEAHGAHFG

SEQ ID NO: 1690054 - protein, 18 aa, Staphylococcus aureus
EGFKNLGFNTYFAVPKTP

SEQ ID NO: 1690055 - protein, 29 aa, Staphylococcus aureus
EGTEAFIETAKIVLRWLKEQDIQVELLNL

SEQ ID NO: 1690056 - protein, 20 aa, Staphylococcus aureus
EGTLTGRVKFIFQPAEELGH

SEQ ID NO: 1690057 - protein, 22 aa, Staphylococcus aureus
EHELRAMLRMMPSLIDTGDGND

SEQ ID NO: 1690058 - protein, 19 aa, Staphylococcus aureus
EIARKQYKYGLNNYIFTIK

SEQ ID NO: 1690059 - protein, 17 aa, Staphylococcus aureus
EIFFSVIDPLDTGGQYQ

SEQ ID NO: 1690060 - protein, 22 aa, Staphylococcus aureus
EKKVPINLWIDGKQNTVPLGTV

SEQ ID NO: 1690061 - protein, 22 aa, Staphylococcus aureus
EKLKVPPFAFNGRKPSECIALK

SEQ ID NO: 1690062 - protein, 26 aa, Staphylococcus aureus
EKLSDKLFIPIYLYDTNLKDELYYQD

SEQ ID NO: 1690063 - protein, 23 aa, Staphylococcus aureus
EKRCPSCHMTLKDIAHVGKFGCA

SEQ ID NO: 1690064 - protein, 21 aa, Staphylococcus aureus
EKVLRNIFISIASYIKDAAKS

SEQ ID NO: 1690065 - protein, 25 aa, Staphylococcus aureus
ELFGRYEFYRFRLSELQIESRANKE

SEQ ID NO: 1690066 - protein, 21 aa, Staphylococcus aureus
ELFPVKEGILQFWISSEDQMY

SEQ ID NO: 1690067 - protein, 24 aa, Staphylococcus aureus
ELGFTLMLAIARRIVEAEKYVEAD

SEQ ID NO: 1690068 - protein, 24 aa, Staphylococcus aureus
ELIQKLMLIMPKGPALTLNPDFFM

SEQ ID NO: 1690069 - protein, 26 aa, Staphylococcus aureus
ELLGRYEFYRFRLNELQIESRANKAV

SEQ ID NO: 1690070 - protein, 23 aa, Staphylococcus aureus
ELSALIKLLISKINGCHYCVDIH

SEQ ID NO: 1690071 - protein, 34 aa, Staphylococcus aureus
ELTTIGLDLPFPIKINQMLGYQTSFLTYEGLVDQ

SEQ ID NO: 1690072 - protein, 26 aa, Staphylococcus aureus
EMIFSQNLFRRPTPARLTRIEKSLLQ

SEQ ID NO: 1690073 - protein, 26 aa, Staphylococcus aureus
EMRRYLMRFVHHIGGLADFSALKFTK

SEQ ID NO: 1690074 - protein, 24 aa, Staphylococcus aureus
ENENWTFTELLYEAPYLKSYQDEE

SEQ ID NO: 1690075 - protein, 17 aa, Staphylococcus aureus
EPRLVEIYISVIKSMAI

SEQ ID NO: 1690076 - protein, 18 aa, Staphylococcus aureus
EPVGPLSKIFLFKSNNAF

SEQ ID NO: 1690077 - protein, 22 aa, Staphylococcus aureus
EQTKLNVEAFSNAVKKAVNEAV

SEQ ID NO: 1690078 - protein, 24 aa, Staphylococcus aureus
ESQQQWFSGFLLANSNNTTSDINQ

SEQ ID NO: 1690079 - protein, 27 aa, Staphylococcus aureus
ETKVKNGDLFLLLAKENWHEGVLGIVA

SEQ ID NO: 1690080 - protein, 28 aa, Staphylococcus aureus
ETYSKALLGLVIPLVTKYGIALEAHLQN

SEQ ID NO: 1690081 - protein, 31 aa, Staphylococcus aureus
EVCNSGKFKFKYLDDWLFTKSIIFKNETTLT

SEQ ID NO: 1690082 - protein, 25 aa, Staphylococcus aureus
EVFDELYLAILKYLNTVSIENISHS

SEQ ID NO: 1690083 - protein, 29 aa, Staphylococcus aureus
EVIGNPLLDKFMKDLIIQILAMVSEQERN

SEQ ID NO: 1690084 - protein, 17 aa, Staphylococcus aureus
EVKDYFIDLDLLQLINS

SEQ ID NO: 1690085 - protein, 17 aa, Staphylococcus aureus
EVLVCTVIGFPLGASTT

SEQ ID NO: 1690086 - protein, 19 aa, Staphylococcus aureus
EVLWLKQNIISYLDDVSFT

SEQ ID NO: 1690087 - protein, 21 aa, Staphylococcus aureus
EVQKIIVYYANKQYFFNNETE

SEQ ID NO: 1690088 - protein, 24 aa, Staphylococcus aureus
EYKGRKCFFYYAKLIYTPEVCPNC

SEQ ID NO: 1690089 - protein, 22 aa, Staphylococcus aureus
EYKKKIIELIESNLTGYEISKK

SEQ ID NO: 1690090 - protein, 21 aa, Staphylococcus aureus
EYYVGFVIDRATDQVTLMASE

SEQ ID NO: 1690091 - protein, 22 aa, Staphylococcus aureus
FAENDYFYIMHRFDEEARIPFI

SEQ ID NO: 1690092 - protein, 24 aa, Staphylococcus aureus
FANIRDFASVGLLFRKNDDYIWLG

SEQ ID NO: 1690093 - protein, 19 aa, Staphylococcus aureus
FAVKTGLQKTMQQAVSRIS

SEQ ID NO: 1690094 - protein, 19 aa, Staphylococcus aureus
FEDLYREKLKDTNKLREYN

SEQ ID NO: 1690095 - protein, 20 aa, Staphylococcus aureus
FEDLYREKLKDTNKLREYNY

SEQ ID NO: 1690096 - protein, 18 aa, Staphylococcus aureus
FFGAYDLALYKNNTFIGQ

SEQ ID NO: 1690097 - protein, 27 aa, Staphylococcus aureus
FFNEVKPLIAEAFYKAFDQAVIFGTKS

SEQ ID NO: 1690098 - protein, 18 aa, Staphylococcus aureus
FIASSLKAPIYVLSNIAG

SEQ ID NO: 1690099 - protein, 20 aa, Staphylococcus aureus
FIKRLACLPSHIYRLKGFMT

SEQ ID NO: 1690100 - protein, 18 aa, Staphylococcus aureus
FIQFHNKMHIKKADFYQI

SEQ ID NO: 1690101 - protein, 24 aa, Staphylococcus aureus
FKHMHVRMMPAQQPPYTRLIDSAR

SEQ ID NO: 1690102 - protein, 20 aa, Staphylococcus aureus
FKKSQLIEQFIRSLEVSIAN

SEQ ID NO: 1690103 - protein, 24 aa, Staphylococcus aureus
FKVYPRGTIVYAKLGVNIGSEFSG

SEQ ID NO: 1690104 - protein, 19 aa, Staphylococcus aureus
FLSCPVGYQFQPGGYCDYT

SEQ ID NO: 1690105 - protein, 18 aa, Staphylococcus aureus
FPVEIQLMSRFRTPKEIK

SEQ ID NO: 1690106 - protein, 17 aa, Staphylococcus aureus
FRKLGIATQLKIALEKW

SEQ ID NO: 1690107 - protein, 18 aa, Staphylococcus aureus
FRKLGIATQLKIALEKWA

SEQ ID NO: 1690108 - protein, 19 aa, Staphylococcus aureus
FRYKQQNYIVLVKLFEKEE

SEQ ID NO: 1690109 - protein, 19 aa, Staphylococcus aureus
FSLKLQENLILKALEKMKT

SEQ ID NO: 1690110 - protein, 19 aa, Staphylococcus aureus
FTDVRFQPGQVLTVVHNNN

SEQ ID NO: 1690111 - protein, 19 aa, Staphylococcus aureus
FVDHRTLIYFPAYSFHKKK

SEQ ID NO: 1690112 - protein, 17 aa, Staphylococcus aureus
FVTHGLGSITALKYIEM

SEQ ID NO: 1690113 - protein, 18 aa, Staphylococcus aureus
FYGAMFKDLDGHHFNFLV

SEQ ID NO: 1690114 - protein, 25 aa, Staphylococcus aureus
GAKEMILIPHFVKVTNLTDLFELIK

SEQ ID NO: 1690115 - protein, 18 aa, Staphylococcus aureus
GDLISAHFYTLLAEINDL

SEQ ID NO: 1690116 - protein, 18 aa, Staphylococcus aureus
GDWDYARYGILQGIEYAI

SEQ ID NO: 1690117 - protein, 18 aa, Staphylococcus aureus
GETLFTEMVKAPIPPHDL

SEQ ID NO: 1690118 - protein, 18 aa, Staphylococcus aureus
GETSQFDNLKWLGLDWDE

SEQ ID NO: 1690119 - protein, 22 aa, Staphylococcus aureus
GETVYFMLTETPFYAVSGGQVA

SEQ ID NO: 1690120 - protein, 23 aa, Staphylococcus aureus
GGQLFRNTTFPDEKYLKELMDNY

SEQ ID NO: 1690121 - protein, 19 aa, Staphylococcus aureus
GGRVRDLPGVRYHIVRGAL

SEQ ID NO: 1690122 - protein, 37 aa, Staphylococcus aureus
GGVEHAVLHLLYARFWHKVLYDLAIVPTKEPFQKLFN

SEQ ID NO: 1690123 - protein, 27 aa, Staphylococcus aureus
GIVESYEGYLSVFVKDDANKLFNFTPS

SEQ ID NO: 1690124 - protein, 19 aa, Staphylococcus aureus
GKQNNYVAIWFRQERRDGT

SEQ ID NO: 1690125 - protein, 31 aa, Staphylococcus aureus
GKTTTATALQWLLFDKGLDGSTKSFNPVPLN

SEQ ID NO: 1690126 - protein, 18 aa, Staphylococcus aureus
GLCLKWVAPGTRGVPDRI

SEQ ID NO: 1690127 - protein, 17 aa, Staphylococcus aureus
GLLKEIEDVYKKAQAFD

SEQ ID NO: 1690128 - protein, 26 aa, Staphylococcus aureus
GMIKSDFFIINKTDLAPYVGASLEQM

SEQ ID NO: 1690129 - protein, 24 aa, Staphylococcus aureus
GNDIGPVRAAYEEGLNNINAATTT

SEQ ID NO: 1690130 - protein, 33 aa, Staphylococcus aureus
GNDKNRKRWPLYRPWALFIKDTEKLNLTTRPTL

SEQ ID NO: 1690131 - protein, 24 aa, Staphylococcus aureus
GNLGVIDYLIYRYNITGNEILLEK

SEQ ID NO: 1690132 - protein, 24 aa, Staphylococcus aureus
GNQDNWTYPPFQLTEKAGKLYGRG

SEQ ID NO: 1690133 - protein, 29 aa, Staphylococcus aureus
GNSLNANILPFILRGIKLIGIDSVCVDHN

SEQ ID NO: 1690134 - protein, 18 aa, Staphylococcus aureus
GQFPRDFNIASSDDLLVC

SEQ ID NO: 1690135 - protein, 20 aa, Staphylococcus aureus
GRMFRYLYPLTKEAKKLLGH

SEQ ID NO: 1690136 - protein, 25 aa, Staphylococcus aureus
GRNLYTSGQCTYYVFDRVGGKIGST

SEQ ID NO: 1690137 - protein, 19 aa, Staphylococcus aureus
GRQYGFGINLISYYQGLKS

SEQ ID NO: 1690138 - protein, 22 aa, Staphylococcus aureus
GSIISLIDFVVKPIHLIKEEQE

SEQ ID NO: 1690139 - protein, 25 aa, Staphylococcus aureus
GTEFLMDHRHLWLRSKKQHAVMKIR

SEQ ID NO: 1690140 - protein, 20 aa, Staphylococcus aureus
GTHPLMRRLIEQRICDALAG

SEQ ID NO: 1690141 - protein, 29 aa, Staphylococcus aureus
GTIHQFCLEFIIYPFKMNLSRVSKGFTII

SEQ ID NO: 1690142 - protein, 25 aa, Staphylococcus aureus
GTLFRKNIYQMIPQEVTPLIPSSLV

SEQ ID NO: 1690143 - protein, 18 aa, Staphylococcus aureus
GTRVLVPNKIKDAFLAEL

SEQ ID NO: 1690144 - protein, 19 aa, Staphylococcus aureus
GTVNNKLIFSIPGSTGAVK

SEQ ID NO: 1690145 - protein, 18 aa, Staphylococcus aureus
GVMDARLKKMRKQRDEYK

SEQ ID NO: 1690146 - protein, 30 aa, Staphylococcus aureus
GVMSQNLWYFRYFIYYLIKENVISKKEINS

SEQ ID NO: 1690147 - protein, 31 aa, Staphylococcus aureus
HAAPPDEILKSSPFVWFKDALDGYDYLVEQG

SEQ ID NO: 1690148 - protein, 30 aa, Staphylococcus aureus
HEINHYIQYLIQLGYPLDMITDLDFETLYE

SEQ ID NO: 1690149 - protein, 17 aa, Staphylococcus aureus
HFYVDRHNIWAPRRAVF

SEQ ID NO: 1690150 - protein, 22 aa, Staphylococcus aureus
HHLKKRLQEQLFLVVEEGNDIV

SEQ ID NO: 1690151 - protein, 18 aa, Staphylococcus aureus
HILYGKHVCFTGALKGFT

SEQ ID NO: 1690152 - protein, 20 aa, Staphylococcus aureus
HLFEDEYFMYGLQTYAESNN

SEQ ID NO: 1690153 - protein, 19 aa, Staphylococcus aureus
HLPIGIIVLDENDHIEWVN

SEQ ID NO: 1690154 - protein, 21 aa, Staphylococcus aureus
HNAYRYIDGELWIYSAVLDSN

SEQ ID NO: 1690155 - protein, 26 aa, Staphylococcus aureus
HNNPFHMSPYFGYASRLLATSGIDYT

SEQ ID NO: 1690156 - protein, 20 aa, Staphylococcus aureus
HSGLTLLQIPEGVDWDGEVV

SEQ ID NO: 1690157 - protein, 22 aa, Staphylococcus aureus
HVIDLETLFFNVIPRVGMSDDV

SEQ ID NO: 1690158 - protein, 25 aa, Staphylococcus aureus
IAGIPSNKIWLDPGIGFAKTRNEEA

SEQ ID NO: 1690159 - protein, 17 aa, Staphylococcus aureus
IAIKLPQISDLANLLIH

SEQ ID NO: 1690160 - protein, 19 aa, Staphylococcus aureus
IALGNMMTTAALLGIDSCP

SEQ ID NO: 1690161 - protein, 17 aa, Staphylococcus aureus
IALQLVRRFPDIERRVQ

SEQ ID NO: 1690162 - protein, 25 aa, Staphylococcus aureus
IDDLNSIIDDFFMETKQNRPNSITK

SEQ ID NO: 1690163 - protein, 17 aa, Staphylococcus aureus
IDEAKAYHFKSVCVNPT

SEQ ID NO: 1690164 - protein, 21 aa, Staphylococcus aureus
IDFNSGYILISTGYKSFDEVK

SEQ ID NO: 1690165 - protein, 18 aa, Staphylococcus aureus
IDIAEAFQIQCAREINNQ

SEQ ID NO: 1690166 - protein, 17 aa, Staphylococcus aureus
IDIKPRMLGQQAGSAIL

SEQ ID NO: 1690167 - protein, 25 aa, Staphylococcus aureus
IDNIIGVFHSKYLLAWSNKKEDQIT

SEQ ID NO: 1690168 - protein, 38 aa, Staphylococcus aureus
IDNLKPKKLKFKSQNWYWFAYFDGPLKLPKNPRGSVKF

SEQ ID NO: 1690169 - protein, 18 aa, Staphylococcus aureus
IDQLNALNNAQQDGFKGR

SEQ ID NO: 1690170 - protein, 21 aa, Staphylococcus aureus
IDRFHIVQLLNRALNGIRVTV

SEQ ID NO: 1690171 - protein, 18 aa, Staphylococcus aureus
IEEFYTIVKELEKFDTFT

SEQ ID NO: 1690172 - protein, 35 aa, Staphylococcus aureus
IEESKFEFDPLVKKLKPFGFFDYNALQKDAFVVLS

SEQ ID NO: 1690173 - protein, 18 aa, Staphylococcus aureus
IEIPNFKFGKRVIDSTGA

SEQ ID NO: 1690174 - protein, 18 aa, Staphylococcus aureus
IENLKNIPLIPKSKLPDI

SEQ ID NO: 1690175 - protein, 24 aa, Staphylococcus aureus
IENVNGLLRQYYPKGTDFANITQK

SEQ ID NO: 1690176 - protein, 22 aa, Staphylococcus aureus
IEQPIEFIRLMPTLQKHRDEVL

SEQ ID NO: 1690177 - protein, 17 aa, Staphylococcus aureus
IEWVFMFVIKSDDYRDC

SEQ ID NO: 1690178 - protein, 23 aa, Staphylococcus aureus
IGDKELIHMWSGQSPRLATTHPA

SEQ ID NO: 1690179 - protein, 17 aa, Staphylococcus aureus
IGDLNLYLLKDIKSRFG

SEQ ID NO: 1690180 - protein, 24 aa, Staphylococcus aureus
IGTDDLKEEGYIAHILGVNAEEGD

SEQ ID NO: 1690181 - protein, 19 aa, Staphylococcus aureus
IHTDTYHHIFKIIQKYELD

SEQ ID NO: 1690182 - protein, 19 aa, Staphylococcus aureus
IHVANFSFNIIDSGIESAV

SEQ ID NO: 1690183 - protein, 26 aa, Staphylococcus aureus
IIDNSIFYALSVLKMFKKSVIDKNKI

SEQ ID NO: 1690184 - protein, 22 aa, Staphylococcus aureus
IIKFFNKYPVLCRKLYQVYKTQ

SEQ ID NO: 1690185 - protein, 17 aa, Staphylococcus aureus
IINLVELGKGMTLLPMA

SEQ ID NO: 1690186 - protein, 28 aa, Staphylococcus aureus
IIQKRFTLNMLYPYIDEILITKSKTLMG

SEQ ID NO: 1690187 - protein, 23 aa, Staphylococcus aureus
IIQKYELDYIIDDDWNYAAQLDA

SEQ ID NO: 1690188 - protein, 17 aa, Staphylococcus aureus
IIVDIRDKQLRYQDIAI

SEQ ID NO: 1690189 - protein, 37 aa, Staphylococcus aureus
IKDLPMVMVMLYASLGSVLLREFGLQPFIVEISGSTS

SEQ ID NO: 1690190 - protein, 22 aa, Staphylococcus aureus
IKDRLLFHPRFEKELRAQGIVH

SEQ ID NO: 1690191 - protein, 22 aa, Staphylococcus aureus
IKDVDAFFKGKKGIKRKVIETH

SEQ ID NO: 1690192 - protein, 25 aa, Staphylococcus aureus
IKKAIAYYRFRPYAMKILKENRYDF

SEQ ID NO: 1690193 - protein, 28 aa, Staphylococcus aureus
IKKGLVEPFIVFYNQENIFYISNAVIDI

SEQ ID NO: 1690194 - protein, 26 aa, Staphylococcus aureus
IKLPEKLLCAWLNSIRFLRNRIAHTD

SEQ ID NO: 1690195 - protein, 20 aa, Staphylococcus aureus
IKNMMYVLADNRHISLIADV

SEQ ID NO: 1690196 - protein, 17 aa, Staphylococcus aureus
IKRILNEEVRADNYFVY

SEQ ID NO: 1690197 - protein, 29 aa, Staphylococcus aureus
ILEGYHTLLTIGRFPICYINIEMDPILVD

SEQ ID NO: 1690198 - protein, 20 aa, Staphylococcus aureus
ILNIHPSLLPKYKGIDAIGQ

SEQ ID NO: 1690199 - protein, 17 aa, Staphylococcus aureus
ILPSEVAHTCAYLYHPN

SEQ ID NO: 1690200 - protein, 19 aa, Staphylococcus aureus
INESGLYSLIFSSKLENAK

SEQ ID NO: 1690201 - protein, 17 aa, Staphylococcus aureus
IPYKVDIYPYYGSDASA

SEQ ID NO: 1690202 - protein, 23 aa, Staphylococcus aureus
IQSEVPAHVQAGWMLTTIASVGE

SEQ ID NO: 1690203 - protein, 25 aa, Staphylococcus aureus
IQTSINHIISEGKKIKLIIEKLEDD

SEQ ID NO: 1690204 - protein, 18 aa, Staphylococcus aureus
ISFIYYISRNIKVRVKRF

SEQ ID NO: 1690205 - protein, 21 aa, Staphylococcus aureus
ISFYIPCKEIVDYFSLIQTEE

SEQ ID NO: 1690206 - protein, 28 aa, Staphylococcus aureus
ISHQMDMLFTHFGISGPAALRCSQFVYK

SEQ ID NO: 1690207 - protein, 23 aa, Staphylococcus aureus
ISKNILTDLDYWKDGYIYSIQCY

SEQ ID NO: 1690208 - protein, 20 aa, Staphylococcus aureus
ISRFLELSNMILLLDDMLDV

SEQ ID NO: 1690209 - protein, 17 aa, Staphylococcus aureus
ISSFQDILPLLEQVVQS

SEQ ID NO: 1690210 - protein, 24 aa, Staphylococcus aureus
ITALPNRTKLLGVGLWLVPKPVRN

SEQ ID NO: 1690211 - protein, 22 aa, Staphylococcus aureus
ITGQILTNIFGLEVFAEYQPFD

SEQ ID NO: 1690212 - protein, 20 aa, Staphylococcus aureus
IVIDLLLNLLDENKTMIVVT

SEQ ID NO: 1690213 - protein, 25 aa, Staphylococcus aureus
IYAEENLIDYIYFATKNLSSNKEEF

SEQ ID NO: 1690214 - protein, 26 aa, Staphylococcus aureus
IYTEENLIDYIYFATKNLNSNKEEFG

SEQ ID NO: 1690215 - protein, 18 aa, Staphylococcus aureus
KAISILEQALFQHQLHFK

SEQ ID NO: 1690216 - protein, 24 aa, Staphylococcus aureus
KAISILEQALFQHQLHFKTEVQSS

SEQ ID NO: 1690217 - protein, 23 aa, Staphylococcus aureus
KANERVAIVGYPAPYKNKHHMYQ

SEQ ID NO: 1690218 - protein, 25 aa, Staphylococcus aureus
KAQTLDHAMELLRNSVADNQTTLAS

SEQ ID NO: 1690219 - protein, 18 aa, Staphylococcus aureus
KDENSVPLVIYKGGELKS

SEQ ID NO: 1690220 - protein, 21 aa, Staphylococcus aureus
KDIDKTIFPGIQGGPLEHVIA

SEQ ID NO: 1690221 - protein, 17 aa, Staphylococcus aureus
KDKGNTLNTAMGALRTS

SEQ ID NO: 1690222 - protein, 24 aa, Staphylococcus aureus
KDKHGVEWVLRLPRRPDVYKRTKP

SEQ ID NO: 1690223 - protein, 21 aa, Staphylococcus aureus
KDLNLAEEAYLAGLPQVPNNY

SEQ ID NO: 1690224 - protein, 19 aa, Staphylococcus aureus
KDPDYIQGYLYLQSLYENE

SEQ ID NO: 1690225 - protein, 25 aa, Staphylococcus aureus
KEDMLNEYYYLPKTLYNTLASPEFE

SEQ ID NO: 1690226 - protein, 18 aa, Staphylococcus aureus
KEELNYRFTQPISDDYVK

SEQ ID NO: 1690227 - protein, 25 aa, Staphylococcus aureus
KEIENFKFFVQYGNFKDLSKYKDGD

SEQ ID NO: 1690228 - protein, 30 aa, Staphylococcus aureus
KEKYDTAKYYYNTYYKYKGAIDQTVLTVLG

SEQ ID NO: 1690229 - protein, 20 aa, Staphylococcus aureus
KELLDLLRLHLSLFNKYEKD

SEQ ID NO: 1690230 - protein, 22 aa, Staphylococcus aureus
KELLQCFDYLIKHKRHATRKRN

SEQ ID NO: 1690231 - protein, 18 aa, Staphylococcus aureus
KFISAQYFYSNNGFREIK

SEQ ID NO: 1690232 - protein, 25 aa, Staphylococcus aureus
KFLTLKEFLYYKKKGKFPKRSVWIN

SEQ ID NO: 1690233 - protein, 18 aa, Staphylococcus aureus
KGEFFIARAITPQDKRLK

SEQ ID NO: 1690234 - protein, 19 aa, Staphylococcus aureus
KGEFFIARAITPQDKRLKS

SEQ ID NO: 1690235 - protein, 24 aa, Staphylococcus aureus
KGFTVAIPNYTSLAPMLEQLNRSF

SEQ ID NO: 1690236 - protein, 28 aa, Staphylococcus aureus
KGNIAVPLDLPALFKGYYKEPERTAKAQ

SEQ ID NO: 1690237 - protein, 24 aa, Staphylococcus aureus
KGPKIYQQKLYQLGIEPNIIEIFT

SEQ ID NO: 1690238 - protein, 22 aa, Staphylococcus aureus
KGWVIDSFYFRYKQQNYIVLVK

SEQ ID NO: 1690239 - protein, 17 aa, Staphylococcus aureus
KHELDVAPMFKSLIGKE

SEQ ID NO: 1690240 - protein, 17 aa, Staphylococcus aureus
KHKLKMITIDDLIEYRK

SEQ ID NO: 1690241 - protein, 22 aa, Staphylococcus aureus
KIELESWGIWRVVEPQLHLTVV

SEQ ID NO: 1690242 - protein, 31 aa, Staphylococcus aureus
KIGKDYLKNILKYYYGTLIIVSHDRALIDQI

SEQ ID NO: 1690243 - protein, 25 aa, Staphylococcus aureus
KKEIENFKFFVQYGNFKDFKDYKNG

SEQ ID NO: 1690244 - protein, 17 aa, Staphylococcus aureus
KKHDQLYLIKQQKFVLK

SEQ ID NO: 1690245 - protein, 18 aa, Staphylococcus aureus
KKITVFTYKRRKNSKRKK

SEQ ID NO: 1690246 - protein, 20 aa, Staphylococcus aureus
KKQLFNATSIYLEAIYSLCV

SEQ ID NO: 1690247 - protein, 25 aa, Staphylococcus aureus
KKSDDMLINLYLETYEFYCRLRDEL

SEQ ID NO: 1690248 - protein, 25 aa, Staphylococcus aureus
KKVALSSMSPLLFPPSKQDMKDVRG

SEQ ID NO: 1690249 - protein, 20 aa, Staphylococcus aureus
KKYCFSVRRNPLKGNGELGK

SEQ ID NO: 1690250 - protein, 17 aa, Staphylococcus aureus
KKYNIIPAWVLFQNFSF

SEQ ID NO: 1690251 - protein, 25 aa, Staphylococcus aureus
KLDTKYMQMFINKLSSIYSTNQLRY

SEQ ID NO: 1690252 - protein, 19 aa, Staphylococcus aureus
KLIQNILNQFNLKLVDKEI

SEQ ID NO: 1690253 - protein, 20 aa, Staphylococcus aureus
KLLHDSIRMMWLAQDQTPSY

SEQ ID NO: 1690254 - protein, 19 aa, Staphylococcus aureus
KLLHDSIRMMWLAQNQTPS

SEQ ID NO: 1690255 - protein, 23 aa, Staphylococcus aureus
KLLTQVRFQIPYGKNIALVGANG

SEQ ID NO: 1690256 - protein, 27 aa, Staphylococcus aureus
KLQFKSKDWYWNAYFEGPIKLHKEFAI

SEQ ID NO: 1690257 - protein, 19 aa, Staphylococcus aureus
KLVHNGLFNILAELDFEDE

SEQ ID NO: 1690258 - protein, 22 aa, Staphylococcus aureus
KMPTRQIILNFGHYRFTDLKES

SEQ ID NO: 1690259 - protein, 22 aa, Staphylococcus aureus
KMYQMHEAIIRFLDNHIIVAHN

SEQ ID NO: 1690260 - protein, 24 aa, Staphylococcus aureus
KNADNIHVIPNWYDMRQLQDNRIY

SEQ ID NO: 1690261 - protein, 25 aa, Staphylococcus aureus
KNKYDKVYIVPLDKLTKQELLELCE

SEQ ID NO: 1690262 - protein, 24 aa, Staphylococcus aureus
KNMKPLIVQMIFEPSHYDDMFISR

SEQ ID NO: 1690263 - protein, 26 aa, Staphylococcus aureus
KNNINEIYLIAHAFLESGYGTSNFAN

SEQ ID NO: 1690264 - protein, 21 aa, Staphylococcus aureus
KNVDMPITNALYRVLFENISV

SEQ ID NO: 1690265 - protein, 20 aa, Staphylococcus aureus
KPIVNPIKKLPTRFTINVAI

SEQ ID NO: 1690266 - protein, 21 aa, Staphylococcus aureus
KPKIGAYHFTTIKPNLGVVST

SEQ ID NO: 1690267 - protein, 25 aa, Staphylococcus aureus
KQAPVYLYPNTDKVPGLNRFAFTLS

SEQ ID NO: 1690268 - protein, 17 aa, Staphylococcus aureus
KQEFLFVTELAPLTNAV

SEQ ID NO: 1690269 - protein, 21 aa, Staphylococcus aureus
KQTIDQLTHLNADQIATAKQN

SEQ ID NO: 1690270 - protein, 19 aa, Staphylococcus aureus
KRIENFKFFGQYANLKELK

SEQ ID NO: 1690271 - protein, 32 aa, Staphylococcus aureus
KRQKVNMIFQHFNLLWSRTVLKNIMFPLEIAG

SEQ ID NO: 1690272 - protein, 18 aa, Staphylococcus aureus
KRVVKFLWVTRNGNYEGG

SEQ ID NO: 1690273 - protein, 17 aa, Staphylococcus aureus
KSRIAVWVLNYIKVNEA

SEQ ID NO: 1690274 - protein, 18 aa, Staphylococcus aureus
KTFHLYDELSKVANYYIK

SEQ ID NO: 1690275 - protein, 17 aa, Staphylococcus aureus
KTGFGTGGWQLAALNIC

SEQ ID NO: 1690276 - protein, 18 aa, Staphylococcus aureus
KTPYVIGGLTFANTIGAT

SEQ ID NO: 1690277 - protein, 23 aa, Staphylococcus aureus
KTTLLRMINALEIPTEGTVFVNG

SEQ ID NO: 1690278 - protein, 37 aa, Staphylococcus aureus
KVEVPQSKLLGYYQSLKDSFNYGYKYLTDTYKSYKEK

SEQ ID NO: 1690279 - protein, 22 aa, Staphylococcus aureus
KVLAEALINEGFRIVSGGTDNH

SEQ ID NO: 1690280 - protein, 26 aa, Staphylococcus aureus
KWGERSGLTLFLPHAYEGQGPEHSSA

SEQ ID NO: 1690281 - protein, 26 aa, Staphylococcus aureus
KWKVHAKDLIAYPKLTGKPAATIDPE

SEQ ID NO: 1690282 - protein, 26 aa, Staphylococcus aureus
KWTNAKLDFHKLKKILMQWQRGIYDG

SEQ ID NO: 1690283 - protein, 20 aa, Staphylococcus aureus
LAIPTFKNQLLFTKHNLRGI

SEQ ID NO: 1690284 - protein, 21 aa, Staphylococcus aureus
LARPTNFDDPRHPNWLVIEVC

SEQ ID NO: 1690285 - protein, 33 aa, Staphylococcus aureus
LDEVLSLCLKFDKKLLIELKSPNLYPGIECKLL

SEQ ID NO: 1690286 - protein, 21 aa, Staphylococcus aureus
LEAIREVVNKQIEIIENADAS

SEQ ID NO: 1690287 - protein, 30 aa, Staphylococcus aureus
LEEKERLLPGGYLFLSDLVGNPSLLNKVGK

SEQ ID NO: 1690288 - protein, 18 aa, Staphylococcus aureus
LEIIMRYNDNGYETRYLA

SEQ ID NO: 1690289 - protein, 19 aa, Staphylococcus aureus
LEKILYKYSFSTKQMVEFL

SEQ ID NO: 1690290 - protein, 33 aa, Staphylococcus aureus
LENNKRKFPTTRTLFLLLLGFKNSKINDQSKSI

SEQ ID NO: 1690291 - protein, 17 aa, Staphylococcus aureus
LEPWTSCEFDFTRDGKL

SEQ ID NO: 1690292 - protein, 20 aa, Staphylococcus aureus
LEPWTSCEFDFTRDGKLNVS

SEQ ID NO: 1690293 - protein, 18 aa, Staphylococcus aureus
LEQALFQHQLHFKTEVHS

SEQ ID NO: 1690294 - protein, 17 aa, Staphylococcus aureus
LETLTGIDLIIDDTPEA

SEQ ID NO: 1690295 - protein, 18 aa, Staphylococcus aureus
LFDAVLMTIKYVMRESKV

SEQ ID NO: 1690296 - protein, 17 aa, Staphylococcus aureus
LFTEMVKAPIPPHDLAL

SEQ ID NO: 1690297 - protein, 17 aa, Staphylococcus aureus
LGDDRGKIYRHLSASLA

SEQ ID NO: 1690298 - protein, 17 aa, Staphylococcus aureus
LGFVLMALNIRKIAAQR

SEQ ID NO: 1690299 - protein, 17 aa, Staphylococcus aureus
LGFVLMALNIRKIVARR

SEQ ID NO: 1690300 - protein, 21 aa, Staphylococcus aureus
LGITILINLHFVDLAKEYGTR

SEQ ID NO: 1690301 - protein, 26 aa, Staphylococcus aureus
LIEYIENVYIMLNKPKDYISATEDHH

SEQ ID NO: 1690302 - protein, 26 aa, Staphylococcus aureus
LINKDEFCPLRKLILNNKLDSQRVME

SEQ ID NO: 1690303 - protein, 18 aa, Staphylococcus aureus
LKEFYEHIAQLMFNISNK

SEQ ID NO: 1690304 - protein, 22 aa, Staphylococcus aureus
LKNIPLIPKSKLPDIPHHKFLE

SEQ ID NO: 1690305 - protein, 25 aa, Staphylococcus aureus
LKVEGLYPYHIYTYIINELMGKPIE

SEQ ID NO: 1690306 - protein, 25 aa, Staphylococcus aureus
LLDDYETLYEFKSLTDYPAKINSND

SEQ ID NO: 1690307 - protein, 17 aa, Staphylococcus aureus
LLKKYSMTGKILVDKFG

SEQ ID NO: 1690308 - protein, 23 aa, Staphylococcus aureus
LLPDHNWGNYKLVFNTRNGANLQ

SEQ ID NO: 1690309 - protein, 20 aa, Staphylococcus aureus
LLQLYSIYLGRIDEGMSKHS

SEQ ID NO: 1690310 - protein, 27 aa, Staphylococcus aureus
LLVNVLVRIFLKNFSIVSPFFNKEERA

SEQ ID NO: 1690311 - protein, 17 aa, Staphylococcus aureus
LNKLAIKELIRQFKYLS

SEQ ID NO: 1690312 - protein, 21 aa, Staphylococcus aureus
LNLFEHWFRSVFNRRHPYYVI

SEQ ID NO: 1690313 - protein, 20 aa, Staphylococcus aureus
LNSRIIYTLSPTKIYRTTLL

SEQ ID NO: 1690314 - protein, 29 aa, Staphylococcus aureus
LPERDTIITIWVKLLTLSGKYNEQGYIML

SEQ ID NO: 1690315 - protein, 17 aa, Staphylococcus aureus
LPNDRKFHPLEKLGRYL

SEQ ID NO: 1690316 - protein, 28 aa, Staphylococcus aureus
LQEEVPEGLIPLLKIQGLGSKKIAKLYK

SEQ ID NO: 1690317 - protein, 18 aa, Staphylococcus aureus
LQENLILKALEKMKTDHK

SEQ ID NO: 1690318 - protein, 24 aa, Staphylococcus aureus
LQKLFDRLEEFDLVLVYKLDRLTR

SEQ ID NO: 1690319 - protein, 26 aa, Staphylococcus aureus
LRNSDTVAVLLPATTLYLGKEDYADA

SEQ ID NO: 1690320 - protein, 20 aa, Staphylococcus aureus
LRPETLFGSKFEGYLNQKIQ

SEQ ID NO: 1690321 - protein, 37 aa, Staphylococcus aureus
LRVEAPLIQAQLIETILLNIVNFHTLITTKASRIRQI

SEQ ID NO: 1690322 - protein, 23 aa, Staphylococcus aureus
LSLSLLTIIYLRKSWKIENLLKK

SEQ ID NO: 1690323 - protein, 17 aa, Staphylococcus aureus
LSMMSFDGKLFSAKFAE

SEQ ID NO: 1690324 - protein, 30 aa, Staphylococcus aureus
LTDLRSLNIGHLYAYQFEKIALIGGNGTGK

SEQ ID NO: 1690325 - protein, 21 aa, Staphylococcus aureus
LTDYFIRIQQWCQKFNIALTI

SEQ ID NO: 1690326 - protein, 18 aa, Staphylococcus aureus
LTSILTLSDLFNWSRFKV

SEQ ID NO: 1690327 - protein, 23 aa, Staphylococcus aureus
LVEKLISMLGWDPQSPVPINDRG

SEQ ID NO: 1690328 - protein, 20 aa, Staphylococcus aureus
LVELKIWERWLHTQGYNDIH

SEQ ID NO: 1690329 - protein, 17 aa, Staphylococcus aureus
LVKYNIIGGFDLGVVSD

SEQ ID NO: 1690330 - protein, 18 aa, Staphylococcus aureus
LVNDYQLEWVIGAPLEST

SEQ ID NO: 1690331 - protein, 24 aa, Staphylococcus aureus
LVNGGTLAIYMGVKRLGKIITQIQ

SEQ ID NO: 1690332 - protein, 19 aa, Staphylococcus aureus
LWDILQTKFKAKALQEKVY

SEQ ID NO: 1690333 - protein, 18 aa, Staphylococcus aureus
LWDLFRSIPSLEIDHASV

SEQ ID NO: 1690334 - protein, 17 aa, Staphylococcus aureus
LYDNRLLVKATKSARHQ

SEQ ID NO: 1690335 - protein, 19 aa, Staphylococcus aureus
LYECNELYIIKYISKKLIS

SEQ ID NO: 1690336 - protein, 19 aa, Staphylococcus aureus
LYEHDIIYTTNGRLGFDYL

SEQ ID NO: 1690337 - protein, 17 aa, Staphylococcus aureus
MAEIRVFYRDEFLCTAI

SEQ ID NO: 1690338 - protein, 17 aa, Staphylococcus aureus
MCAGTIVMSRIPRVVYG

SEQ ID NO: 1690339 - protein, 22 aa, Staphylococcus aureus
MENHFECLWDLFRSIPSLEIDH

SEQ ID NO: 1690340 - protein, 17 aa, Staphylococcus aureus
MGIYFKNEPLNIVNQTT

SEQ ID NO: 1690341 - protein, 19 aa, Staphylococcus aureus
MGYRFPTQYGQSGYAAFVV

SEQ ID NO: 1690342 - protein, 17 aa, Staphylococcus aureus
MIIFVTNGKKWPQKNAV

SEQ ID NO: 1690343 - protein, 27 aa, Staphylococcus aureus
MKEYKQKYLILRIFNVSGKEPQFYFID

SEQ ID NO: 1690344 - protein, 22 aa, Staphylococcus aureus
MLAECVIFLNESFNISENENKN

SEQ ID NO: 1690345 - protein, 23 aa, Staphylococcus aureus
MLNGIYYYHPSVESIQKYANLLR

SEQ ID NO: 1690346 - protein, 22 aa, Staphylococcus aureus
MPIEVVYGFAQLKRAAAIANFD

SEQ ID NO: 1690347 - protein, 32 aa, Staphylococcus aureus
MPSVLNKYFNKLSVFRKLFGNLIYSNTLYENN

SEQ ID NO: 1690348 - protein, 35 aa, Staphylococcus aureus
MQYYRETGIYAERTAPWLRRLGFENVKEVLLDPER

SEQ ID NO: 1690349 - protein, 19 aa, Staphylococcus aureus
MSKAEYVFFLDSDDLLHER

SEQ ID NO: 1690350 - protein, 17 aa, Staphylococcus aureus
MVINPTSIVLPGKLDRL

SEQ ID NO: 1690351 - protein, 30 aa, Staphylococcus aureus
MVNIELLYVEPQFRKLGIATQLKIALEKWA

SEQ ID NO: 1690352 - protein, 26 aa, Staphylococcus aureus
NAFVNIHLIKPFLNTLKQSIAKHEKK

SEQ ID NO: 1690353 - protein, 30 aa, Staphylococcus aureus
NALEAIREVVNKQIEIIKNADADASAKEIA

SEQ ID NO: 1690354 - protein, 19 aa, Staphylococcus aureus
NALMDMVVQGLNPAKNQGY

SEQ ID NO: 1690355 - protein, 17 aa, Staphylococcus aureus
NAQWVEYPEDWASEVLR

SEQ ID NO: 1690356 - protein, 17 aa, Staphylococcus aureus
NCIFVAQFIGSPAMNML

SEQ ID NO: 1690357 - protein, 24 aa, Staphylococcus aureus
NDGDTVIFYNFRPDRAAQLSEIFA

SEQ ID NO: 1690358 - protein, 20 aa, Staphylococcus aureus
NDIWKHFKAVKNNHVYDLEE

SEQ ID NO: 1690359 - protein, 25 aa, Staphylococcus aureus
NDLDNINDYTIPTGKKESATTDLYA

SEQ ID NO: 1690360 - protein, 18 aa, Staphylococcus aureus
NDLKYHLRRENEQSYDAF

SEQ ID NO: 1690361 - protein, 25 aa, Staphylococcus aureus
NDNRKITFYFVTNSPLTGFISILKT

SEQ ID NO: 1690362 - protein, 23 aa, Staphylococcus aureus
NDVTQLLRLLHDKYPHAFIHMVG

SEQ ID NO: 1690363 - protein, 18 aa, Staphylococcus aureus
NEFDIAEFKLFNTLVNGE

SEQ ID NO: 1690364 - protein, 21 aa, Staphylococcus aureus
NEIIMLLRTIPTSKLIQPIMQ

SEQ ID NO: 1690365 - protein, 36 aa, Staphylococcus aureus
NEMLMANYLFNKSDNPRFKRWVIGSILSRTYYHNMV

SEQ ID NO: 1690366 - protein, 23 aa, Staphylococcus aureus
NEYGTKWYTYYDDDYNNFIMISY

SEQ ID NO: 1690367 - protein, 18 aa, Staphylococcus aureus
NFSIIKHGDISTPQGFTA

SEQ ID NO: 1690368 - protein, 29 aa, Staphylococcus aureus
NFSYYDRFRNRIMFPLKNAQGRIVGYSGR

SEQ ID NO: 1690369 - protein, 24 aa, Staphylococcus aureus
NFYNTDLPAIPHTKLRDALAHEIN

SEQ ID NO: 1690370 - protein, 18 aa, Staphylococcus aureus
NGFGFITPYNLDDLNYYL

SEQ ID NO: 1690371 - protein, 22 aa, Staphylococcus aureus
NHAPFANYWMHNGFINIDNEKM

SEQ ID NO: 1690372 - protein, 30 aa, Staphylococcus aureus
NIDEKNYPSIFKHYLFFINEVEDRIKNNSL

SEQ ID NO: 1690373 - protein, 39 aa, Staphylococcus aureus
NIDLWYAFQCFDYANAGWKALFGLLLKGVGAKDIPFANN

SEQ ID NO: 1690374 - protein, 24 aa, Staphylococcus aureus
NIDTPIKIILLNIEPTQITTILDE

SEQ ID NO: 1690375 - protein, 18 aa, Staphylococcus aureus
NIGDIFIINHRDLYRFQL

SEQ ID NO: 1690376 - protein, 27 aa, Staphylococcus aureus
NIHEKMAVFDLYFRKMPFNSGYAVFNG

SEQ ID NO: 1690377 - protein, 19 aa, Staphylococcus aureus
NIKVRVKRFLVVYATLITI

SEQ ID NO: 1690378 - protein, 17 aa, Staphylococcus aureus
NIRLLKDYGVSIYPANI

SEQ ID NO: 1690379 - protein, 17 aa, Staphylococcus aureus
NIYPIIVHGGGPFINEA

SEQ ID NO: 1690380 - protein, 27 aa, Staphylococcus aureus
NKIFECIHAGLPVILSPVKEHIYLNEK

SEQ ID NO: 1690381 - protein, 27 aa, Staphylococcus aureus
NKIIGFAYCYTLLRPDGKTMFYLHSIG

SEQ ID NO: 1690382 - protein, 30 aa, Staphylococcus aureus
NKKMKQWKPSYIDRGFLFTTSKGNPLQIDK

SEQ ID NO: 1690383 - protein, 22 aa, Staphylococcus aureus
NKKTIWVWTGFLYEYLANDCAE

SEQ ID NO: 1690384 - protein, 25 aa, Staphylococcus aureus
NLGKMETLLLCARQFLWSTAKGYQQ

SEQ ID NO: 1690385 - protein, 26 aa, Staphylococcus aureus
NNAMDQLKQAIADHDTIVAGGNYTNT

SEQ ID NO: 1690386 - protein, 19 aa, Staphylococcus aureus
NNLFLFSEVGYFTSKGDLL

SEQ ID NO: 1690387 - protein, 17 aa, Staphylococcus aureus
NNLRGTVNLDEKCILSL

SEQ ID NO: 1690388 - protein, 20 aa, Staphylococcus aureus
NPHIPKGRGIVKWNAFKTIP

SEQ ID NO: 1690389 - protein, 22 aa, Staphylococcus aureus
NPKYRTKILKDMYHQGVLTTSK

SEQ ID NO: 1690390 - protein, 21 aa, Staphylococcus aureus
NPRAQAFYKRHGFKVVGEHHF

SEQ ID NO: 1690391 - protein, 24 aa, Staphylococcus aureus
NQDAATHLPYIYLSAGVSAELFQE

SEQ ID NO: 1690392 - protein, 21 aa, Staphylococcus aureus
NQHNHVLLLYAAKDTKHNQAV

SEQ ID NO: 1690393 - protein, 24 aa, Staphylococcus aureus
NQMFDLFHLYIEQFDNIIEKFYEI

SEQ ID NO: 1690394 - protein, 22 aa, Staphylococcus aureus
NQYAVFQYPPYDITLSTKIAEV

SEQ ID NO: 1690395 - protein, 19 aa, Staphylococcus aureus
NRIGALYIGGKSTADIIMS

SEQ ID NO: 1690396 - protein, 18 aa, Staphylococcus aureus
NSDFTDVRFQPGQVLTVV

SEQ ID NO: 1690397 - protein, 20 aa, Staphylococcus aureus
NSPTQLLAWLKDDQGLDIPN

SEQ ID NO: 1690398 - protein, 18 aa, Staphylococcus aureus
NTMSILCSELLFNYLSES

SEQ ID NO: 1690399 - protein, 23 aa, Staphylococcus aureus
NTNDRLLKHDLLFHDMFVNDDWK

SEQ ID NO: 1690400 - protein, 25 aa, Staphylococcus aureus
NTNHPMLRPRKITRSGYLVITSDKG

SEQ ID NO: 1690401 - protein, 24 aa, Staphylococcus aureus
NVGYKNEYFYITYSSRSLKEYRKY

SEQ ID NO: 1690402 - protein, 35 aa, Staphylococcus aureus
NVSGDIKILIDRLSYWGHIFKLLGKSGLTVTVADS

SEQ ID NO: 1690403 - protein, 17 aa, Staphylococcus aureus
NYTKYDGTPFLPHEIEV

SEQ ID NO: 1690404 - protein, 25 aa, Staphylococcus aureus
PAGSVYFIIIFYNKNGTKLSTEIVK

SEQ ID NO: 1690405 - protein, 17 aa, Staphylococcus aureus
PAVLAGGLLIRAVGSAA

SEQ ID NO: 1690406 - protein, 21 aa, Staphylococcus aureus
PDTWGKRYLLSGYSYDMKELA

SEQ ID NO: 1690407 - protein, 25 aa, Staphylococcus aureus
PEDKDMEDIFIPPTKINRALDGDTV

SEQ ID NO: 1690408 - protein, 24 aa, Staphylococcus aureus
PENNKVLVFFVRYGGEFQLKQGFS

SEQ ID NO: 1690409 - protein, 21 aa, Staphylococcus aureus
PFFICQILVFLFPTSSHVNLL

SEQ ID NO: 1690410 - protein, 17 aa, Staphylococcus aureus
PFSVLYNLPSNGSDVLV

SEQ ID NO: 1690411 - protein, 30 aa, Staphylococcus aureus
PGQKKLYVLAKILNVSEAWLLGYDVESKRI

SEQ ID NO: 1690412 - protein, 17 aa, Staphylococcus aureus
PIEAVFGIHVNPFADEG

SEQ ID NO: 1690413 - protein, 18 aa, Staphylococcus aureus
PIIEKQFAEQLYNGLWFS

SEQ ID NO: 1690414 - protein, 18 aa, Staphylococcus aureus
PKLFGAFKEKYEKELRDQ

SEQ ID NO: 1690415 - protein, 20 aa, Staphylococcus aureus
PKMMLKITLYAYTQSVFSGR

SEQ ID NO: 1690416 - protein, 31 aa, Staphylococcus aureus
PKNFDEVYILYKFDRYLLKQLFSLVNMLETH

SEQ ID NO: 1690417 - protein, 23 aa, Staphylococcus aureus
PKQLLEELLQYLDANRNNIVGDG

SEQ ID NO: 1690418 - protein, 23 aa, Staphylococcus aureus
PKTIRTLITRLYKKGFIDRKKDN

SEQ ID NO: 1690419 - protein, 24 aa, Staphylococcus aureus
PLKKGIFDYFLDTVGNNVTLYGLK

SEQ ID NO: 1690420 - protein, 21 aa, Staphylococcus aureus
PLYSDIVLPAATWYEKHDLSS

SEQ ID NO: 1690421 - protein, 18 aa, Staphylococcus aureus
PMENIFKAVRRLIDEYTD

SEQ ID NO: 1690422 - protein, 21 aa, Staphylococcus aureus
PMVGTISLVPQIVDVVSIPVI

SEQ ID NO: 1690423 - protein, 20 aa, Staphylococcus aureus
PQDKCGIFFTYRVSEMSTEQ

SEQ ID NO: 1690424 - protein, 26 aa, Staphylococcus aureus
PRMKEHIIELNAVFPMFIAEFAMESG

SEQ ID NO: 1690425 - protein, 20 aa, Staphylococcus aureus
PSIPLKIMFPQLKVTIVDSL

SEQ ID NO: 1690426 - protein, 18 aa, Staphylococcus aureus
PSLTYIKDKLATNGIELS

SEQ ID NO: 1690427 - protein, 20 aa, Staphylococcus aureus
PTKPVIREKMSRRKKTAAKK

SEQ ID NO: 1690428 - protein, 19 aa, Staphylococcus aureus
PTQMLISAKIFGKTAHAST

SEQ ID NO: 1690429 - protein, 19 aa, Staphylococcus aureus
PVAIPHLRDNMIKHPMVLI

SEQ ID NO: 1690430 - protein, 17 aa, Staphylococcus aureus
PVEIQLMSRFRTPKEIK

SEQ ID NO: 1690431 - protein, 19 aa, Staphylococcus aureus
PVFGFMKAILGFTRMSVRG

SEQ ID NO: 1690432 - protein, 23 aa, Staphylococcus aureus
PVGSIDALLYPTLSRKPYAMISA

SEQ ID NO: 1690433 - protein, 26 aa, Staphylococcus aureus
PWRQHDVKLVFFLAISHKDKAFTKQM

SEQ ID NO: 1690434 - protein, 19 aa, Staphylococcus aureus
PYMIVGMIGAIKAGCGYVP

SEQ ID NO: 1690435 - protein, 23 aa, Staphylococcus aureus
QATPTIASPFTPYAIEISIGATV

SEQ ID NO: 1690436 - protein, 24 aa, Staphylococcus aureus
QDMETLISFLKLNKDQPQTLTILC

SEQ ID NO: 1690437 - protein, 36 aa, Staphylococcus aureus
QDTQNALDFPLPKAFRDAGWFFDVLPGHYNGALRQV

SEQ ID NO: 1690438 - protein, 20 aa, Staphylococcus aureus
QFDNLKWLGLDWDESVDKDN

SEQ ID NO: 1690439 - protein, 29 aa, Staphylococcus aureus
QFLAVAIRPMIHMLYYHGIAFESHAQNMM

SEQ ID NO: 1690440 - protein, 20 aa, Staphylococcus aureus
QGDTLVITGSLYFISEVKSK

SEQ ID NO: 1690441 - protein, 17 aa, Staphylococcus aureus
QGLLEGFKNLGFNTYFA

SEQ ID NO: 1690442 - protein, 17 aa, Staphylococcus aureus
QHDVTVPIYLKLTSDMD

SEQ ID NO: 1690443 - protein, 17 aa, Staphylococcus aureus
QIISGTHAITIALQSLL

SEQ ID NO: 1690444 - protein, 17 aa, Staphylococcus aureus
QISRFFTGIEIHPGAKI

SEQ ID NO: 1690445 - protein, 17 aa, Staphylococcus aureus
QIVTKCGIILPSKQFDF

SEQ ID NO: 1690446 - protein, 24 aa, Staphylococcus aureus
QKQSFESQITQAPLVTDVTTINQK

SEQ ID NO: 1690447 - protein, 24 aa, Staphylococcus aureus
QLDTASHFVLIFARKNVTSRSPYV

SEQ ID NO: 1690448 - protein, 23 aa, Staphylococcus aureus
QLFEDEYFMYGLQTYAESNNSDV

SEQ ID NO: 1690449 - protein, 19 aa, Staphylococcus aureus
QLPQNVVFIFQPAEETGGG

SEQ ID NO: 1690450 - protein, 17 aa, Staphylococcus aureus
QMELEFFCKPGEEIEWQ

SEQ ID NO: 1690451 - protein, 17 aa, Staphylococcus aureus
QPQTLTILCGHGKKFAD

SEQ ID NO: 1690452 - protein, 30 aa, Staphylococcus aureus
QPSPDCLMLFQHHNLLPWKTINDNIRIGLQ

SEQ ID NO: 1690453 - protein, 24 aa, Staphylococcus aureus
QQRLVTFLLAMKKIFMSMPENNII

SEQ ID NO: 1690454 - protein, 18 aa, Staphylococcus aureus
QRFKGLKEWHFGIFEGES

SEQ ID NO: 1690455 - protein, 25 aa, Staphylococcus aureus
QSTSKLYDFSPWKNKSFWGVINNTL

SEQ ID NO: 1690456 - protein, 17 aa, Staphylococcus aureus
QTKKPVIIYFYGGSFEN

SEQ ID NO: 1690457 - protein, 18 aa, Staphylococcus aureus
QVIQIRDFILNYNSLHYR

SEQ ID NO: 1690458 - protein, 18 aa, Staphylococcus aureus
QVYDEAVDKAKQALDKST

SEQ ID NO: 1690459 - protein, 21 aa, Staphylococcus aureus
RDFIRKYITPNIAKYLRHAGH

SEQ ID NO: 1690460 - protein, 30 aa, Staphylococcus aureus
RDNVHFVVLGHYQLLDALLDKSLQTPDILS

SEQ ID NO: 1690461 - protein, 23 aa, Staphylococcus aureus
REIKNYYLYIYEKRVSELTIDDF

SEQ ID NO: 1690462 - protein, 18 aa, Staphylococcus aureus
REIRRKEELNYRFTQPIS

SEQ ID NO: 1690463 - protein, 19 aa, Staphylococcus aureus
RENIKKWFGNAWDGVKTKT

SEQ ID NO: 1690464 - protein, 22 aa, Staphylococcus aureus
REVYNHYALSDIPLPKKTKFET

SEQ ID NO: 1690465 - protein, 18 aa, Staphylococcus aureus
REYLNPHIPKGRGIVKWN

SEQ ID NO: 1690466 - protein, 17 aa, Staphylococcus aureus
RFEDLFSKEEWLSMSLA

SEQ ID NO: 1690467 - protein, 18 aa, Staphylococcus aureus
RFTDFPKDFKGIAGWILE

SEQ ID NO: 1690468 - protein, 26 aa, Staphylococcus aureus
RFYMKKGFLMIELPSGRALAYPKALV

SEQ ID NO: 1690469 - protein, 25 aa, Staphylococcus aureus
RGAIVGFFTPELFHGVGSAGFHIHF

SEQ ID NO: 1690470 - protein, 20 aa, Staphylococcus aureus
RGMIELFEHTFGLQKELVKY

SEQ ID NO: 1690471 - protein, 17 aa, Staphylococcus aureus
RKEYPNALLHWEDFGRG

SEQ ID NO: 1690472 - protein, 18 aa, Staphylococcus aureus
RKFHPLEKLGRYLMDSFV

SEQ ID NO: 1690473 - protein, 26 aa, Staphylococcus aureus
RKMMGEYIIYYDSVVIGGLYDNRLLV

SEQ ID NO: 1690474 - protein, 26 aa, Staphylococcus aureus
RKNNHFFKLAYFRKNFEKKNGGYFIE

SEQ ID NO: 1690475 - protein, 17 aa, Staphylococcus aureus
RKRGQFINMDYLDDIRV

SEQ ID NO: 1690476 - protein, 17 aa, Staphylococcus aureus
RLVEIYISVIKSMAIKY

SEQ ID NO: 1690477 - protein, 23 aa, Staphylococcus aureus
RMPIEVVYGFAQLKRAAAIANFD

SEQ ID NO: 1690478 - protein, 17 aa, Staphylococcus aureus
RNNFLDVLLIKMPQKNH

SEQ ID NO: 1690479 - protein, 19 aa, Staphylococcus aureus
RNNNRVCIPFRTNAQKVPN

SEQ ID NO: 1690480 - protein, 18 aa, Staphylococcus aureus
RPEAIKMAPLVKALEQEK

SEQ ID NO: 1690481 - protein, 25 aa, Staphylococcus aureus
RPEQGLLKLRKSLNLFANIRPTTVV

SEQ ID NO: 1690482 - protein, 18 aa, Staphylococcus aureus
RPETLFGSKFEGYLNQKI

SEQ ID NO: 1690483 - protein, 23 aa, Staphylococcus aureus
RRKVKRELYDGRGFLSCSRILGE

SEQ ID NO: 1690484 - protein, 28 aa, Staphylococcus aureus
RRLSELKKYFYRFSLKARKRVKTVSIDM

SEQ ID NO: 1690485 - protein, 17 aa, Staphylococcus aureus
RRVHQYLMVGQIVVPGE

SEQ ID NO: 1690486 - protein, 19 aa, Staphylococcus aureus
RSEEILIKTLKRRVMELKK

SEQ ID NO: 1690487 - protein, 26 aa, Staphylococcus aureus
RSLVTTEFIWSVPGRFDIYGPQILIQ

SEQ ID NO: 1690488 - protein, 24 aa, Staphylococcus aureus
RSMYIFKKDLLPKMYWYGMLKGLI

SEQ ID NO: 1690489 - protein, 24 aa, Staphylococcus aureus
RTKLSLAVLFSTKANMLILDEPTN

SEQ ID NO: 1690490 - protein, 25 aa, Staphylococcus aureus
RVANDKEFYIFDSLIQGRSFKDISN

SEQ ID NO: 1690491 - protein, 27 aa, Staphylococcus aureus
RVASILAHTLFDYPSHQLVTFGVTGTN

SEQ ID NO: 1690492 - protein, 25 aa, Staphylococcus aureus
RVYLDQIHQRLFLEQSLITERIKKY

SEQ ID NO: 1690493 - protein, 32 aa, Staphylococcus aureus
SAKEIARTDLGRYFDRFADKLDKTQTNAEVAE

SEQ ID NO: 1690494 - protein, 21 aa, Staphylococcus aureus
SAYAFIKRLIKQFGKPQKVIT

SEQ ID NO: 1690495 - protein, 22 aa, Staphylococcus aureus
SAYAFIKRLIKQFGKPQKVITD

SEQ ID NO: 1690496 - protein, 17 aa, Staphylococcus aureus
SCNAYINGGKYKTLDYL

SEQ ID NO: 1690497 - protein, 20 aa, Staphylococcus aureus
SDAVIHFIGSLQSRKVKGVI

SEQ ID NO: 1690498 - protein, 20 aa, Staphylococcus aureus
SDELFYYTSVIKKYNISRSG

SEQ ID NO: 1690499 - protein, 21 aa, Staphylococcus aureus
SDLRKIKHSYLKKSFLEIVET

SEQ ID NO: 1690500 - protein, 25 aa, Staphylococcus aureus
SDLSKGFPRIPILKDVYGFVEIGRE

SEQ ID NO: 1690501 - protein, 30 aa, Staphylococcus aureus
SDSKNLKVIYMPHWLEFYSIAIHSDVTSNK

SEQ ID NO: 1690502 - protein, 20 aa, Staphylococcus aureus
SEGTIRMWESGRTEPRMGMV

SEQ ID NO: 1690503 - protein, 25 aa, Staphylococcus aureus
SEYLVLASELLMIKSKMLLPQSTSD

SEQ ID NO: 1690504 - protein, 17 aa, Staphylococcus aureus
SFLPQKLDIVVFPSKYG

SEQ ID NO: 1690505 - protein, 25 aa, Staphylococcus aureus
SFTNRIEMPYLRSPIVHHVHPQPFH

SEQ ID NO: 1690506 - protein, 20 aa, Staphylococcus aureus
SFYIPCKEIVDYFSLIQTEE

SEQ ID NO: 1690507 - protein, 22 aa, Staphylococcus aureus
SGFSLNGLKMFIGNKSIQTTTI

SEQ ID NO: 1690508 - protein, 25 aa, Staphylococcus aureus
SGGQFQRVWIAKALILEPEILILDE

SEQ ID NO: 1690509 - protein, 22 aa, Staphylococcus aureus
SGRPLFERNLKLIKYAYQQTNG

SEQ ID NO: 1690510 - protein, 17 aa, Staphylococcus aureus
SGTIQWWDKTYSDSGMN

SEQ ID NO: 1690511 - protein, 17 aa, Staphylococcus aureus
SHDINELYLFLKNYLDK

SEQ ID NO: 1690512 - protein, 20 aa, Staphylococcus aureus
SHLLSISEIYYELLNLIKAS

SEQ ID NO: 1690513 - protein, 33 aa, Staphylococcus aureus
SHNDDLPYAELALGAGMAFLIRRFTKKDQQTEE

SEQ ID NO: 1690514 - protein, 21 aa, Staphylococcus aureus
SIANQHYLIHASNFDEACYVM

SEQ ID NO: 1690515 - protein, 27 aa, Staphylococcus aureus
SINTGKVLYTFYQNPTLVKTAIKAQET

SEQ ID NO: 1690516 - protein, 18 aa, Staphylococcus aureus
SIRMMWLAQDQTPSYKTI

SEQ ID NO: 1690517 - protein, 22 aa, Staphylococcus aureus
SKDLYNLPSYRLQDLAEHFDIK

SEQ ID NO: 1690518 - protein, 22 aa, Staphylococcus aureus
SKGILFTATYVDAFHKMDEYIK

SEQ ID NO: 1690519 - protein, 24 aa, Staphylococcus aureus
SKLIQPIMQLFIDNAILNIVQNDA

SEQ ID NO: 1690520 - protein, 24 aa, Staphylococcus aureus
SKSDAQIVEILKKQIDTLNNQIEK

SEQ ID NO: 1690521 - protein, 19 aa, Staphylococcus aureus
SLTDHRIGMMLAVASLLSS

SEQ ID NO: 1690522 - protein, 35 aa, Staphylococcus aureus
SNDQFLKNTILFNDFFTGHQWYNDLLVDLGSKDTA

SEQ ID NO: 1690523 - protein, 20 aa, Staphylococcus aureus
SNSAPLIYKTLSALYHNFDG

SEQ ID NO: 1690524 - protein, 20 aa, Staphylococcus aureus
SQERRNLLKAYGAELVLTPG

SEQ ID NO: 1690525 - protein, 21 aa, Staphylococcus aureus
SRAFANLYDTLLMNYNFVIID

SEQ ID NO: 1690526 - protein, 23 aa, Staphylococcus aureus
SSKCVYVKWNPYSYTYAKQHQIE

SEQ ID NO: 1690527 - protein, 42 aa, Staphylococcus aureus
SSKTILDYVWDQYPLMNEKDIRAVLGRFLFVQDDVKKIINDL

SEQ ID NO: 1690528 - protein, 26 aa, Staphylococcus aureus
STIVVVPDYQLSLAIGKRGQNARLAA

SEQ ID NO: 1690529 - protein, 17 aa, Staphylococcus aureus
STLTGRRILILGDVLEL

SEQ ID NO: 1690530 - protein, 19 aa, Staphylococcus aureus
STVAYLRTALVENGYEVGT

SEQ ID NO: 1690531 - protein, 23 aa, Staphylococcus aureus
SVAEHAVMDLLILLRNYEEGHRQ

SEQ ID NO: 1690532 - protein, 19 aa, Staphylococcus aureus
SVEDYLTYLNGRFSNMILG

SEQ ID NO: 1690533 - protein, 29 aa, Staphylococcus aureus
SVMATITFQNLFKLFGSFSGMTATGKLGE

SEQ ID NO: 1690534 - protein, 17 aa, Staphylococcus aureus
SYALLTHLIAKECGLEV

SEQ ID NO: 1690535 - protein, 25 aa, Staphylococcus aureus
SYGVHALTKILAAAVPLLDEFDIEL

SEQ ID NO: 1690536 - protein, 27 aa, Staphylococcus aureus
SYHPKMMLKIILYAYTQSVFSGRRIEK

SEQ ID NO: 1690537 - protein, 22 aa, Staphylococcus aureus
SYISDFINGYFLGNPIQYQDDD

SEQ ID NO: 1690538 - protein, 22 aa, Staphylococcus aureus
SYKVTYQLLDKLGFGGNDLGSD

SEQ ID NO: 1690539 - protein, 17 aa, Staphylococcus aureus
SYSQLLEFAYPTDRTEV

SEQ ID NO: 1690540 - protein, 28 aa, Staphylococcus aureus
TADVLLVYIFGRIEFIPDSYTRKIYNKL

SEQ ID NO: 1690541 - protein, 23 aa, Staphylococcus aureus
TAKKLSLFFNTSIESIFIFEEED

SEQ ID NO: 1690542 - protein, 28 aa, Staphylococcus aureus
TDGRFLNVGENLWGLRDWYSVDDIEEKI

SEQ ID NO: 1690543 - protein, 19 aa, Staphylococcus aureus
TDNLLQRQFKASCPMEVLT

SEQ ID NO: 1690544 - protein, 21 aa, Staphylococcus aureus
TDQLLRYYSMYPTAATKVVYT

SEQ ID NO: 1690545 - protein, 23 aa, Staphylococcus aureus
TDQQKAFYQVLHLKGITEEQRNQ

SEQ ID NO: 1690546 - protein, 23 aa, Staphylococcus aureus
TEGLLKEIEDVYKKARAFDEILD

SEQ ID NO: 1690547 - protein, 18 aa, Staphylococcus aureus
TEMVKAPIPPHDLALKVN

SEQ ID NO: 1690548 - protein, 23 aa, Staphylococcus aureus
TEVKQWQTYIADYLYQCDAINDP

SEQ ID NO: 1690549 - protein, 17 aa, Staphylococcus aureus
TFIIKRSLSFEGCPYDN

SEQ ID NO: 1690550 - protein, 25 aa, Staphylococcus aureus
TGGYYKVKKVIPYAGSADLAIVEVE

SEQ ID NO: 1690551 - protein, 23 aa, Staphylococcus aureus
THSDIDTMLLKLAKQYHASIITT

SEQ ID NO: 1690552 - protein, 17 aa, Staphylococcus aureus
TIFFINKIDQNGIDLST

SEQ ID NO: 1690553 - protein, 17 aa, Staphylococcus aureus
TINEIYKAIYKSPIYKN

SEQ ID NO: 1690554 - protein, 18 aa, Staphylococcus aureus
TIPWLYVERGFEIPSFNY

SEQ ID NO: 1690555 - protein, 17 aa, Staphylococcus aureus
TIYNHLHLKHIFESMPY

SEQ ID NO: 1690556 - protein, 19 aa, Staphylococcus aureus
TKDNCFISIMAGIPIDYIK

SEQ ID NO: 1690557 - protein, 31 aa, Staphylococcus aureus
TLEALEMFMNKYPGIILFTSHDTRFVKHVSD

SEQ ID NO: 1690558 - protein, 26 aa, Staphylococcus aureus
TLKGKKAIIYFYPRYNTPTCTTEACD

SEQ ID NO: 1690559 - protein, 17 aa, Staphylococcus aureus
TLKRPINLLKDNKTVGI

SEQ ID NO: 1690560 - protein, 22 aa, Staphylococcus aureus
TLNVIKKYKGLVRFKQLKKNSG

SEQ ID NO: 1690561 - protein, 17 aa, Staphylococcus aureus
TMSLLCSELLFNYLSES

SEQ ID NO: 1690562 - protein, 19 aa, Staphylococcus aureus
TMTLIREMRLMWKEMMAIL

SEQ ID NO: 1690563 - protein, 22 aa, Staphylococcus aureus
TMYSFGTIPRGDTGYFFNQAYK

SEQ ID NO: 1690564 - protein, 26 aa, Staphylococcus aureus
TNERMPIKSLNLLASQVLEIIKIVAR

SEQ ID NO: 1690565 - protein, 27 aa, Staphylococcus aureus
TNHNTKLIQFLYNQFDFYEIPVNRFIN

SEQ ID NO: 1690566 - protein, 22 aa, Staphylococcus aureus
TNKAPKLLLKGSGNLKGSSVGY

SEQ ID NO: 1690567 - protein, 22 aa, Staphylococcus aureus
TNQSLYNKFKRYAKLLLKPGDD

SEQ ID NO: 1690568 - protein, 29 aa, Staphylococcus aureus
TPHITLNQIFPYLKYQIIAMTTDSLKNIY

SEQ ID NO: 1690569 - protein, 20 aa, Staphylococcus aureus
TQKLTESQLTIMCKLAGPQH

SEQ ID NO: 1690570 - protein, 25 aa, Staphylococcus aureus
TSISPYKGILRVGAATGFVVGKNTI

SEQ ID NO: 1690571 - protein, 29 aa, Staphylococcus aureus
TTETQKLMELYYFKKPRTLNLTGVAQEIN

SEQ ID NO: 1690572 - protein, 20 aa, Staphylococcus aureus
TTIGKLAYRYKMEGKKVMLA

SEQ ID NO: 1690573 - protein, 23 aa, Staphylococcus aureus
TTKQLIDLAQWLENNNIELQIID

SEQ ID NO: 1690574 - protein, 23 aa, Staphylococcus aureus
TTNQPLYNKFKRYAKLLLKPEED

SEQ ID NO: 1690575 - protein, 22 aa, Staphylococcus aureus
TTTPEAIRYIKPADFHVPGDIS

SEQ ID NO: 1690576 - protein, 17 aa, Staphylococcus aureus
TVIDWYIGEYNPKPAWM

SEQ ID NO: 1690577 - protein, 18 aa, Staphylococcus aureus
TVLQTRWTQKGRLKIHEI

SEQ ID NO: 1690578 - protein, 19 aa, Staphylococcus aureus
TYDIPRFDKSPYDGFAIRS

SEQ ID NO: 1690579 - protein, 21 aa, Staphylococcus aureus
VDDDGYFWFEGRRDDIIISSG

SEQ ID NO: 1690580 - protein, 27 aa, Staphylococcus aureus
VDSVKNEFELLWQKSTPLTQQWIKSYK

SEQ ID NO: 1690581 - protein, 28 aa, Staphylococcus aureus
VEISIAQRLLIQTFFSTFSNKRTDHYGA

SEQ ID NO: 1690582 - protein, 19 aa, Staphylococcus aureus
VELGKGMTLLPMAFENKSD

SEQ ID NO: 1690583 - protein, 24 aa, Staphylococcus aureus
VERLKGIFAWGFRFNSDEPEEGLP

SEQ ID NO: 1690584 - protein, 33 aa, Staphylococcus aureus; identical to SEQ ID NO: 1589224

SEQ ID NO: 1690585 - protein, 17 aa, Staphylococcus aureus
VGAKFVKLFTDIDLNDD

SEQ ID NO: 1690586 - protein, 26 aa, Staphylococcus aureus
VGGHCLAVDPYFIIAKDPENAKLIQT

SEQ ID NO: 1690587 - protein, 25 aa, Staphylococcus aureus
VGGRLPGGIKIKRAKLRGERSEGMI

SEQ ID NO: 1690588 - protein, 25 aa, Staphylococcus aureus
VGINRPTYKRFLIQLKGRKFAHRTK

SEQ ID NO: 1690589 - protein, 26 aa, Staphylococcus aureus
VGINRPTYKRFLIQLKGRKFAHRTKS

SEQ ID NO: 1690590 - protein, 17 aa, Staphylococcus aureus
VGLFFSKERILGSEHEV

SEQ ID NO: 1690591 - protein, 19 aa, Staphylococcus aureus
VGVMLQRMKAHGVINDDFS

SEQ ID NO: 1690592 - protein, 19 aa, Staphylococcus aureus
VHLFLINPSKHLSSDEIAE

SEQ ID NO: 1690593 - protein, 25 aa, Staphylococcus aureus
VHQGDQLHILLTKMGKEPGQAVGYL

SEQ ID NO: 1690594 - protein, 17 aa, Staphylococcus aureus
VHQYLMVGQIVVPGEPK

SEQ ID NO: 1690595 - protein, 26 aa, Staphylococcus aureus
VIEMIANWFPSQATLYRIKQIEMKFE

SEQ ID NO: 1690596 - protein, 19 aa, Staphylococcus aureus
VIGGLTFANTIGATTVSIS

SEQ ID NO: 1690597 - protein, 24 aa, Staphylococcus aureus
VINMFSFFIGYHFNKLDLGIERIF

SEQ ID NO: 1690598 - protein, 25 aa, Staphylococcus aureus
VKNMKPLIVQMIFEPSHYDDMFISR

SEQ ID NO: 1690599 - protein, 22 aa, Staphylococcus aureus
VKNPGFLTVKKICDALQVDIAN

SEQ ID NO: 1690600 - protein, 17 aa, Staphylococcus aureus
VLIRLPKHETDRLVNIC

SEQ ID NO: 1690601 - protein, 27 aa, Staphylococcus aureus
VMASRGSVIPLFIDKIKAGEPLTITDP

SEQ ID NO: 1690602 - protein, 17 aa, Staphylococcus aureus
VPVIIKEVGFGMSKELM

SEQ ID NO: 1690603 - protein, 23 aa, Staphylococcus aureus
VQFQYGLVLCQLEMFNEAITQLK

SEQ ID NO: 1690604 - protein, 33 aa, Staphylococcus aureus
VQPCCFKLYNDPFDMVYVMMNSKLFGHVYIKDC

SEQ ID NO: 1690605 - protein, 25 aa, Staphylococcus aureus
VQQYQLPGHFAPIASYQLLEKAVGT

SEQ ID NO: 1690606 - protein, 24 aa, Staphylococcus aureus
VSEIDTLVVTYYADKDYGEHAKEL

SEQ ID NO: 1690607 - protein, 17 aa, Staphylococcus aureus
VSLFERDMFALRATMHI

SEQ ID NO: 1690608 - protein, 32 aa, Staphylococcus aureus
VWATAAPGWQKWVWSPFLSVLGSGATAFVFNG

SEQ ID NO: 1690609 - protein, 20 aa, Staphylococcus aureus
VYELPLAEVVFDFFDQLKSN

SEQ ID NO: 1690610 - protein, 25 aa, Staphylococcus aureus
VYREIKNYYLYIYKKRVSELTIDDF

SEQ ID NO: 1690611 - protein, 18 aa, Staphylococcus aureus
VYTLNQFKAAPLIVTEDT

SEQ ID NO: 1690612 - protein, 40 aa, Staphylococcus aureus
WANKLIIIDKGELLYYGSIDQFFSKFYHYALIEIENQELD

SEQ ID NO: 1690613 - protein, 18 aa, Staphylococcus aureus
WFNTLETFKNWKKKPGKP

SEQ ID NO: 1690614 - protein, 20 aa, Staphylococcus aureus
WGNASNWANAAARAGYTVNN

SEQ ID NO: 1690615 - protein, 21 aa, Staphylococcus aureus
WQVSRTTIYRYLNKLEAKENK

SEQ ID NO: 1690616 - protein, 26 aa, Staphylococcus aureus
WRQHDVRLVFFLAISQKDTAFTKQMM

SEQ ID NO: 1690617 - protein, 31 aa, Staphylococcus aureus
WTVAYTKLHNFHWYVKGPNFFSLHVKFEELY

SEQ ID NO: 1690618 - protein, 17 aa, Staphylococcus aureus
WVWTGFLYEYLANDCAE

SEQ ID NO: 1690619 - protein, 23 aa, Staphylococcus aureus
YARRHGFISAVPLREIVEAYNYG

SEQ ID NO: 1690620 - protein, 21 aa, Staphylococcus aureus
YATISFLNWFLDEQVEEESMF

SEQ ID NO: 1690621 - protein, 26 aa, Staphylococcus aureus
YAVPTTDCYEIFWGGDNELYNYHYLY

SEQ ID NO: 1690622 - protein, 19 aa, Staphylococcus aureus
YDDQRWWQDTTVPYYQTQN

SEQ ID NO: 1690623 - protein, 20 aa, Staphylococcus aureus
YDGISGISLVLVYIKKIYPE

SEQ ID NO: 1690624 - protein, 26 aa, Staphylococcus aureus
YDITSLYTFKQPVSPHLAFKMADQIF

SEQ ID NO: 1690625 - protein, 22 aa, Staphylococcus aureus
YDNIDVFIVLEDNKYQLKKYSV

SEQ ID NO: 1690626 - protein, 18 aa, Staphylococcus aureus
YDTLLMNYNFVIIDTPPV

SEQ ID NO: 1690627 - protein, 25 aa, Staphylococcus aureus
YDYRYYKYVISQKYNYLLATSLNNK

SEQ ID NO: 1690628 - protein, 28 aa, Staphylococcus aureus
YFENKVAGWLWAWKAVPFKLLGINTSLP

SEQ ID NO: 1690629 - protein, 18 aa, Staphylococcus aureus
YFIDLDLLQLINSVKRMY

SEQ ID NO: 1690630 - protein, 17 aa, Staphylococcus aureus
YGKFNMLKRRDGNRYIH

SEQ ID NO: 1690631 - protein, 18 aa, Staphylococcus aureus
YHQAYKKGVPQFDLKEVG

SEQ ID NO: 1690632 - protein, 20 aa, Staphylococcus aureus
YIPSLKTAKKLSLFFNTSIE

SEQ ID NO: 1690633 - protein, 23 aa, Staphylococcus aureus
YKDYELLNYTIKNQTLYMNDYEV

SEQ ID NO: 1690634 - protein, 18 aa, Staphylococcus aureus
YKGLVRFKQLKKNSGNAS

SEQ ID NO: 1690635 - protein, 20 aa, Staphylococcus aureus
YKLAFAIRDAAATKNVGTEN

SEQ ID NO: 1690636 - protein, 20 aa, Staphylococcus aureus
YLNLESILENLYALPFKERK

SEQ ID NO: 1690637 - protein, 20 aa, Staphylococcus aureus
YLREGDTLVIYKLDRLGRTT

SEQ ID NO: 1690638 - protein, 22 aa, Staphylococcus aureus
YNEGELVGAWFTPPIDEEEMAE

SEQ ID NO: 1690639 - protein, 18 aa, Staphylococcus aureus
YNHYLFNAELFKHFKKDA

SEQ ID NO: 1690640 - protein, 30 aa, Staphylococcus aureus
YNLAAKFYRDIKNYYLYIYEKRVSELTIDD

SEQ ID NO: 1690641 - protein, 22 aa, Staphylococcus aureus
YQGKMAFRVYPKWCNQLNKTAG

SEQ ID NO: 1690642 - protein, 19 aa, Staphylococcus aureus
YRGWNKEIFILQGKNMNVI

SEQ ID NO: 1690643 - protein, 34 aa, Staphylococcus aureus
YRSCDISLVMRALDSILPFLKKGNTIIVESTIAP

SEQ ID NO: 1690644 - protein, 18 aa, Staphylococcus aureus
YRYIGNELWIYSAVLDAN

SEQ ID NO: 1690645 - protein, 18 aa, Staphylococcus aureus
YSIPYKEIIEYLNKKTGK

SEQ ID NO: 1690646 - protein, 28 aa, Staphylococcus aureus
YSKDFLKYRFNLTFLDLSILYVISSRKN

SEQ ID NO: 1690647 - protein, 25 aa, Staphylococcus aureus
YTEMKLVFLEGLFKTLLNKNSQVVF

SEQ ID NO: 1690648 - protein, 23 aa, Staphylococcus aureus
YTIEEAISTFIPDLYEKHSTNRY

SEQ ID NO: 1690649 - protein, 18 aa, Staphylococcus aureus
YVAIWFRQERRDGTFRTV

SEQ ID NO: 1690650 - protein, 18 aa, Staphylococcus aureus
YVAVWFRQERKDGTFRTV

SEQ ID NO: 1690651 - protein, 29 aa, Staphylococcus aureus
YVEIKTKYKLLPIFKINFHKNNLPHLLGL

SEQ ID NO: 1690652 - protein, 25 aa, Staphylococcus aureus
YVEPVFGFMKVILGFTRMSVRGINK

SEQ ID NO: 1690653 - protein, 19 aa, Staphylococcus aureus
YVMSLQEQLELEDCEKYTD

SEQ ID NO: 1690654 - protein, 20 aa, Staphylococcus aureus
YYVGFVIDRATDQVTLMASE

SEQ ID NO: 1690655 - protein, 22 aa, Staphylococcus aureus
YYYRYGQIMGICYLLNASDIHF

SEQ ID NO: 1690656 - protein, 17 aa, Staphylococcus aureus
AAQLYLLEHNHLPFSQS

SEQ ID NO: 1690657 - protein, 29 aa, Staphylococcus aureus
AARATIVMALYQMFHVLPSFSVAYGATVS

SEQ ID NO: 1690658 - protein, 33 aa, Staphylococcus aureus
ADDAKRTAYSQAVNAAATILNKTAGGNTPKADV

SEQ ID NO: 1690659 - protein, 25 aa, Staphylococcus aureus
ADEEYHLRKDQFTVPFVCGCRNLGE

SEQ ID NO: 1690660 - protein, 17 aa, Staphylococcus aureus
AEALNYMALAGWDSKQM

SEQ ID NO: 1690661 - protein, 29 aa, Staphylococcus aureus
AEFSKLLNVIETYLFQWNLYIHEVDEDEE

SEQ ID NO: 1690662 - protein, 17 aa, Staphylococcus aureus
AEILTKYKDGKLIYASV

SEQ ID NO: 1690663 - protein, 29 aa, Staphylococcus aureus
AEISEETLKLLRIVKFAFGSYTSQYLSEL

SEQ ID NO: 1690664 - protein, 18 aa, Staphylococcus aureus
AEKGYSCALLTLDDKNYD

SEQ ID NO: 1690665 - protein, 24 aa, Staphylococcus aureus
AEKYLQMAHEFCPYSKATQGNINV

SEQ ID NO: 1690666 - protein, 20 aa, Staphylococcus aureus
AELLTFKGIPYQIKLTSADQ

SEQ ID NO: 1690667 - protein, 17 aa, Staphylococcus aureus
AELLYKLPDIKKWADEV

SEQ ID NO: 1690668 - protein, 17 aa, Staphylococcus aureus
AEPKPQEEKKGFFARLF

SEQ ID NO: 1690669 - protein, 20 aa, Staphylococcus aureus
AESLNTAMGNLINAIADHQA

SEQ ID NO: 1690670 - protein, 24 aa, Staphylococcus aureus
AESSAYVVANYYGLDTSDYSLGYL

SEQ ID NO: 1690671 - protein, 27 aa, Staphylococcus aureus
AEVAELQNVTIPAIEAIVPQNDPDAND

SEQ ID NO: 1690672 - protein, 17 aa, Staphylococcus aureus
AFKYQYMHLINEIYIED

SEQ ID NO: 1690673 - protein, 20 aa, Staphylococcus aureus
AFLTAIADKMKALNGYFVID

SEQ ID NO: 1690674 - protein, 19 aa, Staphylococcus aureus
AFQELLPVLTAHQARVMNR

SEQ ID NO: 1690675 - protein, 24 aa, Staphylococcus aureus
AGAKSILDLPKTMEYLETKGVPVI

SEQ ID NO: 1690676 - protein, 20 aa, Staphylococcus aureus
AGQIIGEWIGQQGYQQIEVF

SEQ ID NO: 1690677 - protein, 18 aa, Staphylococcus aureus
AGTRVLVPKKIKDAFLAE

SEQ ID NO: 1690678 - protein, 17 aa, Staphylococcus aureus
AHIIPIVRVTAVIDRDI

SEQ ID NO: 1690679 - protein, 17 aa, Staphylococcus aureus
AIAVGHELGLIYNTIYQ

SEQ ID NO: 1690680 - protein, 18 aa, Staphylococcus aureus
AIELLKKVADFEPTIESA

SEQ ID NO: 1690681 - protein, 18 aa, Staphylococcus aureus
AIEYYFGLRTDKPDEFVP

SEQ ID NO: 1690682 - protein, 28 aa, Staphylococcus aureus
AILEELGLPYRCVILCTGDIGFSASKTY

SEQ ID NO: 1690683 - protein, 19 aa, Staphylococcus aureus
AIQEKRIDLFFKHNLNNYK

SEQ ID NO: 1690684 - protein, 26 aa, Staphylococcus aureus
AIQFADIYLMALPTKAMREVATQIND

SEQ ID NO: 1690685 - protein, 24 aa, Staphylococcus aureus
AITDKNLIKPIPTLSTGTLAGKGV

SEQ ID NO: 1690686 - protein, 27 aa, Staphylococcus aureus
AKESLLKYLIRMSTRPTPFGLLSGINL

SEQ ID NO: 1690687 - protein, 23 aa, Staphylococcus aureus
AKKYKIPVIYSTHPRSWKKIEES

SEQ ID NO: 1690688 - protein, 29 aa, Staphylococcus aureus
AKLRYHQVGQGPVLIFIPGANGTGDIFLP

SEQ ID NO: 1690689 - protein, 24 aa, Staphylococcus aureus
AKQLAIDLFGNKDALIRLDMSEYS

SEQ ID NO: 1690690 - protein, 23 aa, Staphylococcus aureus
AKVLAEALINEGFRIVSGGTDNH

SEQ ID NO: 1690691 - protein, 23 aa, Staphylococcus aureus
ALEPQQLIDIKAFMGDTADGYAG

SEQ ID NO: 1690692 - protein, 24 aa, Staphylococcus aureus
ALEVKKRFSAWAEINLKHFKENRD

SEQ ID NO: 1690693 - protein, 20 aa, Staphylococcus aureus
ALNNQLAFNLYNEPLNNMFR

SEQ ID NO: 1690694 - protein, 21 aa, Staphylococcus aureus
ALNYMALAGWDSKQMMEGLSG

SEQ ID NO: 1690695 - protein, 20 aa, Staphylococcus aureus
ALSIGGPGLIHLLNGMYDAK

SEQ ID NO: 1690696 - protein, 24 aa, Staphylococcus aureus
AMDTMTSFWIPQLGGQKYAMTGMT

SEQ ID NO: 1690697 - protein, 27 aa, Staphylococcus aureus
AMLNEGYQFFGVLYIGAILTKNGPKVI

SEQ ID NO: 1690698 - protein, 23 aa, Staphylococcus aureus
ANFLNNFIYFFSSSKEIKNYSVS

SEQ ID NO: 1690699 - protein, 17 aa, Staphylococcus aureus
ANRIGALYIGGKSTADI

SEQ ID NO: 1690700 - protein, 25 aa, Staphylococcus aureus
ANTAIDQLPNLNQPQKTALKDQVSH

SEQ ID NO: 1690701 - protein, 17 aa, Staphylococcus aureus
APAFTEAKLQDPIPAKI

SEQ ID NO: 1690702 - protein, 27 aa, Staphylococcus aureus
APTKRNWIPNFYRQCKLGWDNEINFVK

SEQ ID NO: 1690703 - protein, 25 aa, Staphylococcus aureus
APYQDIRFLIYPQDLPKHEKKNSSQ

SEQ ID NO: 1690704 - protein, 25 aa, Staphylococcus aureus
AQEKYEVNVIYLVSHALVETGNGKS

SEQ ID NO: 1690705 - protein, 23 aa, Staphylococcus aureus
AQQDMLIPWEMIPRCPKCDAPME

SEQ ID NO: 1690706 - protein, 18 aa, Staphylococcus aureus
AQSGLLIPTLDGSQLSVF

SEQ ID NO: 1690707 - protein, 18 aa, Staphylococcus aureus
ARLPVTDKILCMNGSYVI

SEQ ID NO: 1690708 - protein, 23 aa, Staphylococcus aureus
ASALHGLGLYIYNGEELPSASDN

SEQ ID NO: 1690709 - protein, 17 aa, Staphylococcus aureus
ASFPAYHRPTSPDYTVG

SEQ ID NO: 1690710 - protein, 24 aa, Staphylococcus aureus
ASIYHFHFNYIDNAYDLAYYHYWQ

SEQ ID NO: 1690711 - protein, 32 aa, Staphylococcus aureus
ATEDNRFYEHGALDYKRLFGAIGKNLTGGFGS

SEQ ID NO: 1690712 - protein, 27 aa, Staphylococcus aureus
ATQQQKLFFKLLFYSGARKGEIRALTW

SEQ ID NO: 1690713 - protein, 19 aa, Staphylococcus aureus
AVEQALQRVNTAKTALNGD

SEQ ID NO: 1690714 - protein, 17 aa, Staphylococcus aureus
AVKLVDKAAQSNLIHSN

SEQ ID NO: 1690715 - protein, 19 aa, Staphylococcus aureus
AVLLLIMEKDMAYELGFEH

SEQ ID NO: 1690716 - protein, 26 aa, Staphylococcus aureus
AVMVGIIYQFIVANALFDSKHEINHY

SEQ ID NO: 1690717 - protein, 18 aa, Staphylococcus aureus
AVSTSVLYLIEDIPQHAK

SEQ ID NO: 1690718 - protein, 18 aa, Staphylococcus aureus
AWMINTRTPDWLYKSPRT

SEQ ID NO: 1690719 - protein, 17 aa, Staphylococcus aureus
AYRTQIIEKILGIIQSY

SEQ ID NO: 1690720 - protein, 22 aa, Staphylococcus aureus
AYSYIVQIDVFVKFNEKYNARI

SEQ ID NO: 1690721 - protein, 25 aa, Staphylococcus aureus
AYVEGHLLALPGWAGMLYYRSQQHY

SEQ ID NO: 1690722 - protein, 25 aa, Staphylococcus aureus
CEADDWKPFYETYGSQFEDIEIEMD

SEQ ID NO: 1690723 - protein, 28 aa, Staphylococcus aureus
CINDNVEVWLIKKGFNIYNRYTLHRFNE

SEQ ID NO: 1690724 - protein, 17 aa, Staphylococcus aureus
CIYALYKKNRRSLQIYG

SEQ ID NO: 1690725 - protein, 20 aa, Staphylococcus aureus
CKYVLSVASPVFFGKTDDAE

SEQ ID NO: 1690726 - protein, 17 aa, Staphylococcus aureus
CLASQNYISIVKGLVHH

SEQ ID NO: 1690727 - protein, 17 aa, Staphylococcus aureus
CLKAIETYVLPQHSVID

SEQ ID NO: 1690728 - protein, 21 aa, Staphylococcus aureus
CQKYESQLILNYTGLNIEAEI

SEQ ID NO: 1690729 - protein, 20 aa, Staphylococcus aureus
CSTKFAVRGLTQVAAQDLAS

SEQ ID NO: 1690730 - protein, 18 aa, Staphylococcus aureus
CTVITMYLHLDGVLSLDL

SEQ ID NO: 1690731 - protein, 24 aa, Staphylococcus aureus
CVPLNLIHILSIPQYVTYLKKHSN

SEQ ID NO: 1690732 - protein, 26 aa, Staphylococcus aureus
DAKKSTPIKVYLNGNFEGITYPESFK

SEQ ID NO: 1690733 - protein, 25 aa, Staphylococcus aureus
DDIYYKLNVSFPQAALGDEIKIPTL

SEQ ID NO: 1690734 - protein, 25 aa, Staphylococcus aureus
DDNLTMILHEFLPFIEIKQVPSSSV

SEQ ID NO: 1690735 - protein, 26 aa, Staphylococcus aureus
DDNYRGYGLGQMLLKYGINYASHTCD

SEQ ID NO: 1690736 - protein, 25 aa, Staphylococcus aureus
DDTFSNIQLPFYTLSDYSELIEVAE

SEQ ID NO: 1690737 - protein, 25 aa, Staphylococcus aureus
DEAIAFIHQRPKPLSLYLFSEDENA

SEQ ID NO: 1690738 - protein, 25 aa, Staphylococcus aureus
DEANRFYVLELIKKVLKSKFNQIFI

SEQ ID NO: 1690739 - protein, 21 aa, Staphylococcus aureus
DEDFLLVKREIFSSGKSLCKI

SEQ ID NO: 1690740 - protein, 19 aa, Staphylococcus aureus
DEEQFIMYAHFLDKQYHHL

SEQ ID NO: 1690741 - protein, 22 aa, Staphylococcus aureus
DEFFVNNFFLRYINSEVLDNAY

SEQ ID NO: 1690742 - protein, 18 aa, Staphylococcus aureus
DEFLIAGFNYEGQLAAAL

SEQ ID NO: 1690743 - protein, 18 aa, Staphylococcus aureus
DEILYNTELGYYRGSNHL

SEQ ID NO: 1690744 - protein, 17 aa, Staphylococcus aureus
DEITAYLNEAGFSVIRY

SEQ ID NO: 1690745 - protein, 24 aa, Staphylococcus aureus
DEIYLIVEYGFAKRLLNTKRSLAL

SEQ ID NO: 1690746 - protein, 25 aa, Staphylococcus aureus
DEIYLIVEYGFAKRLLNTKRSLALL

SEQ ID NO: 1690747 - protein, 20 aa, Staphylococcus aureus
DELVRLLSDIDLLVLDDMGV

SEQ ID NO: 1690748 - protein, 28 aa, Staphylococcus aureus
DEMQPFYKQLNMKGYFYDFDSLKGMQKS

SEQ ID NO: 1690749 - protein, 22 aa, Staphylococcus aureus
DENIFPMNFIFNETPAPYEICT

SEQ ID NO: 1690750 - protein, 23 aa, Staphylococcus aureus
DENISFYKLVNKFSPEVAPEDTV

SEQ ID NO: 1690751 - protein, 18 aa, Staphylococcus aureus
DEPKLNGLAGNLDKKMNP

SEQ ID NO: 1690752 - protein, 23 aa, Staphylococcus aureus
DEQNIIINFYKEKTIKDVIEDIQ

SEQ ID NO: 1690753 - protein, 25 aa, Staphylococcus aureus
DEQPLKLFHPVHTYKMKFIKSFEAI

SEQ ID NO: 1690754 - protein, 24 aa, Staphylococcus aureus
DEYSNDWYTNTFVDLVLSMKGYSY

SEQ ID NO: 1690755 - protein, 19 aa, Staphylococcus aureus
DFLEDLLIDGKIKELRRYN

SEQ ID NO: 1690756 - protein, 17 aa, Staphylococcus aureus
DFMVVQDEFLTFTATFA

SEQ ID NO: 1690757 - protein, 17 aa, Staphylococcus aureus
DGLAQLNNAQKAKLKEQ

SEQ ID NO: 1690758 - protein, 18 aa, Staphylococcus aureus
DGWYGFQCYDYANMFFML

SEQ ID NO: 1690759 - protein, 17 aa, Staphylococcus aureus
DIAKILYSTRAGVAYMA

SEQ ID NO: 1690760 - protein, 26 aa, Staphylococcus aureus
DIGTHALDLTLWMMDNYEPESVMSST

SEQ ID NO: 1690761 - protein, 18 aa, Staphylococcus aureus
DIILRLPHGMPEEVKKMF

SEQ ID NO: 1690762 - protein, 35 aa, Staphylococcus aureus
DIMQEMKKFFRPEFLNRFNGIVEFLHLDKESLQEI

SEQ ID NO: 1690763 - protein, 19 aa, Staphylococcus aureus
DINNYDWLSGIGSLPSLIN

SEQ ID NO: 1690764 - protein, 26 aa, Staphylococcus aureus
DITYLPFGHSMLYLSSIMDIYNGEIV

SEQ ID NO: 1690765 - protein, 19 aa, Staphylococcus aureus
DIVAVTSLYRPGPMEEIPT

SEQ ID NO: 1690766 - protein, 26 aa, Staphylococcus aureus
DKDAVQIVPLIIKYASELKLYGKTLK

SEQ ID NO: 1690767 - protein, 22 aa, Staphylococcus aureus
DKDGVPFIEKWIKQYGSEAWTK

SEQ ID NO: 1690768 - protein, 18 aa, Staphylococcus aureus
DKDWLIGMGRVIGDGGTA

SEQ ID NO: 1690769 - protein, 20 aa, Staphylococcus aureus
DKWFERMTEYGFENGIDFIS

SEQ ID NO: 1690770 - protein, 18 aa, Staphylococcus aureus
DLFIFRRPTNLSQIAQQF

SEQ ID NO: 1690771 - protein, 20 aa, Staphylococcus aureus
DLFYGFQCYDYANMFFMIAT

SEQ ID NO: 1690772 - protein, 23 aa, Staphylococcus aureus
DLKVIVYARFLCDSLKNEMKQYD

SEQ ID NO: 1690773 - protein, 21 aa, Staphylococcus aureus
DLQLSRQIALQTAPQIRMIQN

SEQ ID NO: 1690774 - protein, 25 aa, Staphylococcus aureus
DLTQEHFVILLLNSKNVVIKESCVF

SEQ ID NO: 1690775 - protein, 20 aa, Staphylococcus aureus
DMHGYGYDKGLYSLNLIINR

SEQ ID NO: 1690776 - protein, 24 aa, Staphylococcus aureus
DMNVKGMVLYMNRNSRTTNGYYYV

SEQ ID NO: 1690777 - protein, 27 aa, Staphylococcus aureus
DNGTIHATLLQLSWFSHIQVFGPESWG

SEQ ID NO: 1690778 - protein, 29 aa, Staphylococcus aureus
DNVIHLMSKIRRYPLPLVLEISNIESVMP

SEQ ID NO: 1690779 - protein, 24 aa, Staphylococcus aureus
DPEKLNWDLKRLLSKTNYSIHTDA

SEQ ID NO: 1690780 - protein, 17 aa, Staphylococcus aureus
DPFDMVYVVMNNKLFGH

SEQ ID NO: 1690781 - protein, 23 aa, Staphylococcus aureus
DPMGKMFFTMMSAFAELEANLLS

SEQ ID NO: 1690782 - protein, 23 aa, Staphylococcus aureus
DRFPGFQLDYFKKTNYLDTDWKD

SEQ ID NO: 1690783 - protein, 23 aa, Staphylococcus aureus
DRQEWWYNVFYDDGKYNKKIIKN

SEQ ID NO: 1690784 - protein, 33 aa, Staphylococcus aureus
DRSDDQFRMIIKQLYFFSVANPNPKNWLDQLVT

SEQ ID NO: 1690785 - protein, 19 aa, Staphylococcus aureus
DSFLPQKLDIVVFPSKYGG

SEQ ID NO: 1690786 - protein, 24 aa, Staphylococcus aureus
DSPEFVNESPYEKAWMVKVEISDE

SEQ ID NO: 1690787 - protein, 24 aa, Staphylococcus aureus
DSVEDYLTYLNGRFSNMVLGHNGD

SEQ ID NO: 1690788 - protein, 20 aa, Staphylococcus aureus
DTLLEFYNQFKEKYSELKKH

SEQ ID NO: 1690789 - protein, 17 aa, Staphylococcus aureus
DTTSAIGKLFITMVGAM

SEQ ID NO: 1690790 - protein, 24 aa, Staphylococcus aureus
DVIGKTVILPIVGRELPILADEYV

SEQ ID NO: 1690791 - protein, 19 aa, Staphylococcus aureus
DVMSFRHIIRAKGSILSMK

SEQ ID NO: 1690792 - protein, 24 aa, Staphylococcus aureus
DVQQLLKSYGFLIYFKNAEDMYEM

SEQ ID NO: 1690793 - protein, 19 aa, Staphylococcus aureus
DVTQLLRLLHDKYPQAFIH

SEQ ID NO: 1690794 - protein, 21 aa, Staphylococcus aureus
DWEGQFANKVKDVLLIMAKFQ

SEQ ID NO: 1690795 - protein, 30 aa, Staphylococcus aureus
DYHKKRWGLFGYCRYIPYLKKRLNNKIVIM

SEQ ID NO: 1690796 - protein, 21 aa, Staphylococcus aureus
DYIFVDDFHPLIYTVRFRPSQ

SEQ ID NO: 1690797 - protein, 24 aa, Staphylococcus aureus
DYIRASINLFPFNTNGNKGIAVGL

SEQ ID NO: 1690798 - protein, 19 aa, Staphylococcus aureus
DYKVRNYLLKHKNLYEFNS

SEQ ID NO: 1690799 - protein, 18 aa, Staphylococcus aureus
EALNAPYGMRLAEYKEIV

SEQ ID NO: 1690800 - protein, 30 aa, Staphylococcus aureus
EANSFASCLLFPLHIRYKYIDNFNIEQISY

SEQ ID NO: 1690801 - protein, 17 aa, Staphylococcus aureus
EAWLMGYDVNSYRVPDE

SEQ ID NO: 1690802 - protein, 24 aa, Staphylococcus aureus
EDFEILIIAYSIDGGPISAIDMTK

SEQ ID NO: 1690803 - protein, 26 aa, Staphylococcus aureus
EDIDEELLLVLKRFKGYLVKKQEKVA

SEQ ID NO: 1690804 - protein, 23 aa, Staphylococcus aureus
EDPEKMIEDFWNALYGRSKVSQN

SEQ ID NO: 1690805 - protein, 26 aa, Staphylococcus aureus
EDTYSFPRVWLDKDSYDFSFSGLKSA

SEQ ID NO: 1690806 - protein, 24 aa, Staphylococcus aureus
EDVDKLRDLYKRFGFRELTDYRTQ

SEQ ID NO: 1690807 - protein, 25 aa, Staphylococcus aureus
EEEFYTFIGQFYSLNQHILPKEVHV

SEQ ID NO: 1690808 - protein, 22 aa, Staphylococcus aureus
EEFLKFYEKFLFEELDLGEQKK

SEQ ID NO: 1690809 - protein, 18 aa, Staphylococcus aureus
EEINFFIGGYVKGDIPDY

SEQ ID NO: 1690810 - protein, 39 aa, Staphylococcus aureus
EEIYNKLYRIFYYDCPPIDKIVYHPLLKKNVNFSNTDTK

SEQ ID NO: 1690811 - protein, 35 aa, Staphylococcus aureus
EELKRFVEAYRLLAKIILRLKAFDEFEFTIDEIGM

SEQ ID NO: 1690812 - protein, 24 aa, Staphylococcus aureus
EFHHPIFAVSPILKCLILKGLVKK

SEQ ID NO: 1690813 - protein, 17 aa, Staphylococcus aureus
EFKLFNTLVNGELEETC

SEQ ID NO: 1690814 - protein, 20 aa, Staphylococcus aureus
EFTRFYVNNFKFTNIQIRNF

SEQ ID NO: 1690815 - protein, 17 aa, Staphylococcus aureus
EFVEWINTLEFFKNWKK

SEQ ID NO: 1690816 - protein, 27 aa, Staphylococcus aureus
EGMDLPLKEFALITGAALLARRRTKNE

SEQ ID NO: 1690817 - protein, 20 aa, Staphylococcus aureus
EGMVLYLNRNAKKATGYYFV

SEQ ID NO: 1690818 - protein, 24 aa, Staphylococcus aureus
EGTQLWFEFFENNRTFFMKIFNIN

SEQ ID NO: 1690819 - protein, 24 aa, Staphylococcus aureus
EGYQDIYFLNKNGEWYYFEVRSVW

SEQ ID NO: 1690820 - protein, 18 aa, Staphylococcus aureus
EHIKRMESLIKEETDCLS

SEQ ID NO: 1690821 - protein, 29 aa, Staphylococcus aureus
EHPDPHIIGLVALPYLNASRDFGNAHYSV

SEQ ID NO: 1690822 - protein, 23 aa, Staphylococcus aureus
EHVELIEVPIKPSDRLKAREMLG

SEQ ID NO: 1690823 - protein, 26 aa, Staphylococcus aureus
EIAALAGMVVLSCINPVAGAVAIGTY

SEQ ID NO: 1690824 - protein, 20 aa, Staphylococcus aureus
EIEYIVDWFLKAREKYGLEK

SEQ ID NO: 1690825 - protein, 17 aa, Staphylococcus aureus
EIGLGEWITITGANGSG

SEQ ID NO: 1690826 - protein, 21 aa, Staphylococcus aureus
EIIAAQLLYTIKKYGPDRIAG

SEQ ID NO: 1690827 - protein, 20 aa, Staphylococcus aureus
EIIMLLRTIPTSKLIQPIMQ

SEQ ID NO: 1690828 - protein, 32 aa, Staphylococcus aureus
EILLDLQERGLKNVLLFITDGLKGMVGAISRF

SEQ ID NO: 1690829 - protein, 27 aa, Staphylococcus aureus
EKAKEKLTVSPSMRLGFEEFKNASGQI

SEQ ID NO: 1690830 - protein, 27 aa, Staphylococcus aureus
EKARLQLALLMLQRDNVLILDEPTNHL

SEQ ID NO: 1690831 - protein, 17 aa, Staphylococcus aureus
EKEHLLNPLFKDWHKYN

SEQ ID NO: 1690832 - protein, 21 aa, Staphylococcus aureus
EKEKHLNYPFDTSTNARQNVD

SEQ ID NO: 1690833 - protein, 22 aa, Staphylococcus aureus
EKEKHLNYPFDTSTNTRQNVDA

SEQ ID NO: 1690834 - protein, 27 aa, Staphylococcus aureus
EKLGADPMTFLGLGGIGDLIVTCISTH

SEQ ID NO: 1690835 - protein, 21 aa, Staphylococcus aureus
EKLKKELDLKDISKFDPISTT

SEQ ID NO: 1690836 - protein, 25 aa, Staphylococcus aureus
EKLLHDSIRLMWLAQNQTPSYKTIN

SEQ ID NO: 1690837 - protein, 34 aa, Staphylococcus aureus
EKLRRHMSFLMRKGSLYLPYNGNLLIHGCIPVDE

SEQ ID NO: 1690838 - protein, 28 aa, Staphylococcus aureus
EKNAAKDLVLKAKEKAYQDILNAQTTND

SEQ ID NO: 1690839 - protein, 23 aa, Staphylococcus aureus
EKSFRKYFAKGYSYNSTGLSFLK

SEQ ID NO: 1690840 - protein, 25 aa, Staphylococcus aureus
EKVRRNPYSVILFDEIEKANPQILT

SEQ ID NO: 1690841 - protein, 27 aa, Staphylococcus aureus
EKVTKLKRLPYWRSKGDANYYWADIDT

SEQ ID NO: 1690842 - protein, 19 aa, Staphylococcus aureus
EKWNIIRPPFNVTRISEYA

SEQ ID NO: 1690843 - protein, 24 aa, Staphylococcus aureus
EKYFKDSVLFKQINYYIDTPDFKL

SEQ ID NO: 1690844 - protein, 23 aa, Staphylococcus aureus
ELECPSIISQVKFYHVPDGITIE

SEQ ID NO: 1690845 - protein, 17 aa, Staphylococcus aureus
ELENILIALDRLSNYAE

SEQ ID NO: 1690846 - protein, 24 aa, Staphylococcus aureus
ELGCTAMAIFKYIEKKSYEGKYTI

SEQ ID NO: 1690847 - protein, 20 aa, Staphylococcus aureus
ELTVTITLNEYRKLIEIKAV

SEQ ID NO: 1690848 - protein, 29 aa, Staphylococcus aureus
ELVRKYKIKKIIIAIPTIGQERLKEINNI

SEQ ID NO: 1690849 - protein, 20 aa, Staphylococcus aureus
ELVSLAVKLVDKAAQSNLIH

SEQ ID NO: 1690850 - protein, 20 aa, Staphylococcus aureus
EMEFLLNLSEDLKRAKYAGI

SEQ ID NO: 1690851 - protein, 23 aa, Staphylococcus aureus
EMSEIILMLYREYAGMFFKSQKL

SEQ ID NO: 1690852 - protein, 20 aa, Staphylococcus aureus
ENFKFFGQYADFKSLKSYNH

SEQ ID NO: 1690853 - protein, 37 aa, Staphylococcus aureus
ENIKKFMHYLLRAQERYQMTIVFITHDINLVKDCATH

SEQ ID NO: 1690854 - protein, 20 aa, Staphylococcus aureus
ENILIALDRLSNYAELRLSV

SEQ ID NO: 1690855 - protein, 17 aa, Staphylococcus aureus
ENLYALPFKERKIIKSE

SEQ ID NO: 1690856 - protein, 23 aa, Staphylococcus aureus
ENNQLNLYQMRWNPENPAQHQYA

SEQ ID NO: 1690857 - protein, 24 aa, Staphylococcus aureus
ENRFGTQAMLKVQDRALIAGAKVI

SEQ ID NO: 1690858 - protein, 23 aa, Staphylococcus aureus
ENYIDIAWLARKKGYQVALKDDG

SEQ ID NO: 1690859 - protein, 24 aa, Staphylococcus aureus
ENYIDIAWLARKKGYQVTLKDDGL

SEQ ID NO: 1690860 - protein, 21 aa, Staphylococcus aureus
ENYTKLIKKLKLQDNVFIHDY

SEQ ID NO: 1690861 - protein, 17 aa, Staphylococcus aureus
ENYYMYKKFGVIPEMEY

SEQ ID NO: 1690862 - protein, 24 aa, Staphylococcus aureus
EPDEVWEKRIKLLEPYRVTKELMK

SEQ ID NO: 1690863 - protein, 22 aa, Staphylococcus aureus
EPFNQLGGYPYFDQIDPRTNDQ

SEQ ID NO: 1690864 - protein, 31 aa, Staphylococcus aureus
EPLIIDDVVKGFLTYNIPKKVIKHAGYVRCK

SEQ ID NO: 1690865 - protein, 25 aa, Staphylococcus aureus
EPVAFLLQSTLGYKILYVTDTKYLK

SEQ ID NO: 1690866 - protein, 23 aa, Staphylococcus aureus
EQGFTILRSYEPEMYGEKLDLAL

SEQ ID NO: 1690867 - protein, 18 aa, Staphylococcus aureus
EQIIRPTGLLDPKIEVRP

SEQ ID NO: 1690868 - protein, 21 aa, Staphylococcus aureus
EQPIEFIRLVPTLQKHRDEVL

SEQ ID NO: 1690869 - protein, 17 aa, Staphylococcus aureus
EQSVRLWYETLLDKIVE

SEQ ID NO: 1690870 - protein, 26 aa, Staphylococcus aureus
EQVKGLYLYGPFGTGKSFILGAIANQ

SEQ ID NO: 1690871 - protein, 17 aa, Staphylococcus aureus
EREAILKGYNFISVLGW

SEQ ID NO: 1690872 - protein, 22 aa, Staphylococcus aureus
ERHKNCVFLVDTFHTLKSGVPN

SEQ ID NO: 1690873 - protein, 19 aa, Staphylococcus aureus
ERLYIKLSTTERTPYPYRL

SEQ ID NO: 1690874 - protein, 24 aa, Staphylococcus aureus
ERVYIASVLMLEPKLIIADEPVAS

SEQ ID NO: 1690875 - protein, 19 aa, Staphylococcus aureus
ESIIKKPVVINDMIAIRNM

SEQ ID NO: 1690876 - protein, 31 aa, Staphylococcus aureus
ESILSNDHLLTFYDFPLAIRKSIYSTNLIES

SEQ ID NO: 1690877 - protein, 27 aa, Staphylococcus aureus
ESSRETHFAFKIYNDPFDMVYVMMKGK

SEQ ID NO: 1690878 - protein, 25 aa, Staphylococcus aureus
ESTKKLHLNFENTKIFLQLAKSTIS

SEQ ID NO: 1690879 - protein, 17 aa, Staphylococcus aureus
ETEGVFFHERKALSHFE

SEQ ID NO: 1690880 - protein, 17 aa, Staphylococcus aureus
ETLAEVLEVEKVDFIPT

SEQ ID NO: 1690881 - protein, 28 aa, Staphylococcus aureus
EVIGNPLLDKFMKDIIIQILAMVSEQER

SEQ ID NO: 1690882 - protein, 20 aa, Staphylococcus aureus
EVIVDYRTYKELVIATETFV

SEQ ID NO: 1690883 - protein, 17 aa, Staphylococcus aureus
EVLKYIDFNAGNIAKQL

SEQ ID NO: 1690884 - protein, 29 aa, Staphylococcus aureus
EVLTFAPFTYIDELLTQPFLAIAGTEADT

SEQ ID NO: 1690885 - protein, 31 aa, Staphylococcus aureus
EVLTTDITYLPFGHSMLYLSSIMDIYNGEIV

SEQ ID NO: 1690886 - protein, 25 aa, Staphylococcus aureus
EVQKDIAIYTPLTGEFVKIEDIPDP

SEQ ID NO: 1690887 - protein, 18 aa, Staphylococcus aureus
EWETGAGTRIRFLKEIEV

SEQ ID NO: 1690888 - protein, 21 aa, Staphylococcus aureus
EWQKQFPFWSERTIKRTFGSL

SEQ ID NO: 1690889 - protein, 26 aa, Staphylococcus aureus
EYIIEMLKNVKTPVFLVLNKIDLVHP

SEQ ID NO: 1690890 - protein, 17 aa, Staphylococcus aureus
EYNFYNLNGEYGYEVLK

SEQ ID NO: 1690891 - protein, 19 aa, Staphylococcus aureus
EYVLPDAVTRFRQGLGRLI

SEQ ID NO: 1690892 - protein, 24 aa, Staphylococcus aureus
EYYVEHLVRDAVGTPLKRCAIVNR

SEQ ID NO: 1690893 - protein, 23 aa, Staphylococcus aureus
FDFVTPFGTYSVKSPYVGKFNIS

SEQ ID NO: 1690894 - protein, 18 aa, Staphylococcus aureus
FDILLNHPLIDEEVANSL

SEQ ID NO: 1690895 - protein, 17 aa, Staphylococcus aureus
FDSNWMFENGIPLDFTP

SEQ ID NO: 1690896 - protein, 20 aa, Staphylococcus aureus
FDVAPFLHLNINDEKYDMKI

SEQ ID NO: 1690897 - protein, 19 aa, Staphylococcus aureus
FEELPVRTLEVDGEPYFIG

SEQ ID NO: 1690898 - protein, 45 aa, Staphylococcus aureus
FEFEKQFGFLLKPWTTVRFMNVIPNRFIYKIALVGKDEKKYKDGP

SEQ ID NO: 1690899 - protein, 17 aa, Staphylococcus aureus
FEFIVTSSETESLLLEL

SEQ ID NO: 1690900 - protein, 18 aa, Staphylococcus aureus
FEGKTIDAFLAGVGTGGT

SEQ ID NO: 1690901 - protein, 17 aa, Staphylococcus aureus
FELRERARFHLEIENEQ

SEQ ID NO: 1690902 - protein, 18 aa, Staphylococcus aureus
FFEYFLRIVNKTHDYAIL

SEQ ID NO: 1690903 - protein, 19 aa, Staphylococcus aureus
FFNSKSNILFIFEGVLMYF

SEQ ID NO: 1690904 - protein, 22 aa, Staphylococcus aureus
FGESLPVYKPTLPPMVFGNRDK

SEQ ID NO: 1690905 - protein, 31 aa, Staphylococcus aureus
FHGDQLKRVALSSMSPLLFPPSKQDMKDVRG

SEQ ID NO: 1690906 - protein, 18 aa, Staphylococcus aureus
FHSIQNEVLHLRRIKIAD

SEQ ID NO: 1690907 - protein, 19 aa, Staphylococcus aureus
FIGNYKTNYLIPIALSGDQ

SEQ ID NO: 1690908 - protein, 28 aa, Staphylococcus aureus
FINQRYIQSLEKIGFIDLLKSKKSYERI

SEQ ID NO: 1690909 - protein, 25 aa, Staphylococcus aureus
FKEAYAKFYGLLPEQIIAGNGSDEL

SEQ ID NO: 1690910 - protein, 18 aa, Staphylococcus aureus
FKFFVQYGNFKDINDYKN

SEQ ID NO: 1690911 - protein, 17 aa, Staphylococcus aureus
FKGIPYQIKLTSADQEL

SEQ ID NO: 1690912 - protein, 20 aa, Staphylococcus aureus
FKNQLLFTKHNLRGIEFPGG

SEQ ID NO: 1690913 - protein, 19 aa, Staphylococcus aureus
FKQINYYIDTPDFKLKEHR

SEQ ID NO: 1690914 - protein, 23 aa, Staphylococcus aureus
FKRALTRVLNSYGLSSKIMKEEK

SEQ ID NO: 1690915 - protein, 19 aa, Staphylococcus aureus
FKSLRRFFKIYVRGIRALA

SEQ ID NO: 1690916 - protein, 18 aa, Staphylococcus aureus
FLTLLDFTQKEMEFLLNL

SEQ ID NO: 1690917 - protein, 18 aa, Staphylococcus aureus
FMDAYRELKMIVPTPHMV

SEQ ID NO: 1690918 - protein, 28 aa, Staphylococcus aureus
FMSVEPQIRLWDILQTKFKAKALQEKVY

SEQ ID NO: 1690919 - protein, 19 aa, Staphylococcus aureus
FNEIVFVLDDFRNDDDYLT

SEQ ID NO: 1690920 - protein, 24 aa, Staphylococcus aureus
FNKVYFARVPLLESTTIITSEKAL

SEQ ID NO: 1690921 - protein, 21 aa, Staphylococcus aureus
FNYYPDILLISNIAVGVIFQI

SEQ ID NO: 1690922 - protein, 21 aa, Staphylococcus aureus
FQQCVWNELRQIPYGTLTTYG

SEQ ID NO: 1690923 - protein, 17 aa, Staphylococcus aureus
FQQLYRLGDENGARLPV

SEQ ID NO: 1690924 - protein, 26 aa, Staphylococcus aureus
FQYAYGLPDYGIIGMQLPLTIVIIGE

SEQ ID NO: 1690925 - protein, 17 aa, Staphylococcus aureus
FREPLVEFFYKNDALND

SEQ ID NO: 1690926 - protein, 29 aa, Staphylococcus aureus
FRKESLGFIFQDYSILPTLTVKENIMLPL

SEQ ID NO: 1690927 - protein, 18 aa, Staphylococcus aureus
FSMYPKLWENMGLSYPEL

SEQ ID NO: 1690928 - protein, 20 aa, Staphylococcus aureus
FSNILKNFRKAEDLTLDTLS

SEQ ID NO: 1690929 - protein, 24 aa, Staphylococcus aureus
FVAKQYLTIFKLSNAQNYKPILVQ

SEQ ID NO: 1690930 - protein, 19 aa, Staphylococcus aureus
FVLIDHSKFNKVYFARVPL

SEQ ID NO: 1690931 - protein, 17 aa, Staphylococcus aureus
FVTPFGTYQVKSPYVGK

SEQ ID NO: 1690932 - protein, 25 aa, Staphylococcus aureus
FYMKKGFLMIELPSGRALAYPKALV

SEQ ID NO: 1690933 - protein, 26 aa, Staphylococcus aureus
GAGAAGIAIVKLLYAYGVRNMVMCDS

SEQ ID NO: 1690934 - protein, 25 aa, Staphylococcus aureus
GAKIAFYVAQWPMSRLQHWHSLLKA

SEQ ID NO: 1690935 - protein, 21 aa, Staphylococcus aureus
GAKVLVGYYAIGINSLRFTKR

SEQ ID NO: 1690936 - protein, 17 aa, Staphylococcus aureus
GAPVNFSGKFYNFVEYG

SEQ ID NO: 1690937 - protein, 21 aa, Staphylococcus aureus
GASMVMIGSLFAAHEESPGET

SEQ ID NO: 1690938 - protein, 25 aa, Staphylococcus aureus
GAVVGFFTPELFHGIGSAGFHVHFA

SEQ ID NO: 1690939 - protein, 31 aa, Staphylococcus aureus
GCQSYCGPGRRKTFTFVNNRPLAALTEEELI

SEQ ID NO: 1690940 - protein, 24 aa, Staphylococcus aureus
GDFDKLIYGIPQLIEYKIDETAQL

SEQ ID NO: 1690941 - protein, 20 aa, Staphylococcus aureus
GDFSLYDHILDTSLLFNIIP

SEQ ID NO: 1690942 - protein, 25 aa, Staphylococcus aureus
GDIEKYFLMRYIKQGDILKLRLFRN

SEQ ID NO: 1690943 - protein, 21 aa, Staphylococcus aureus
GDIIGYVEAMKVLNEVTTDVA

SEQ ID NO: 1690944 - protein, 22 aa, Staphylococcus aureus
GDILKIGAITKGARGYLTFGHS

SEQ ID NO: 1690945 - protein, 22 aa, Staphylococcus aureus
GDILKIGAITKGARGYLTFGHT

SEQ ID NO: 1690946 - protein, 30 aa, Staphylococcus aureus
GDPVLVEFKNKPLYRATFKCTVIQSTNGMP

SEQ ID NO: 1690947 - protein, 23 aa, Staphylococcus aureus
GFIIYKGVRIINTEDLVLPGEHN

SEQ ID NO: 1690948 - protein, 25 aa, Staphylococcus aureus
GFRGNIFGGYILYNLGYIHSTGRYY

SEQ ID NO: 1690949 - protein, 24 aa, Staphylococcus aureus
GFSEYDLFTFFKHPSIKSMTIVTN

SEQ ID NO: 1690950 - protein, 29 aa, Staphylococcus aureus
GGEEQLNDIAYLKATFKTNKKINGDTKDV

SEQ ID NO: 1690951 - protein, 27 aa, Staphylococcus aureus
GGEMLSFYDWYADLPPASPQIWGEQTD

SEQ ID NO: 1690952 - protein, 18 aa, Staphylococcus aureus
GGIIAGFLFRETEPDIEA

SEQ ID NO: 1690953 - protein, 28 aa, Staphylococcus aureus
GGQLPGTKVYPWIAKTRGSTPGIGLISP

SEQ ID NO: 1690954 - protein, 29 aa, Staphylococcus aureus
GHFQGELHLRFQLAFYLFTNRGVICDPNQ

SEQ ID NO: 1690955 - protein, 19 aa, Staphylococcus aureus
GIIIGFNVRPDSGAKRAAE

SEQ ID NO: 1690956 - protein, 17 aa, Staphylococcus aureus
GIKDLVIDLQKKVPMKV

SEQ ID NO: 1690957 - protein, 24 aa, Staphylococcus aureus
GKFRGDTFFPPYTFEDWEVASSVE

SEQ ID NO: 1690958 - protein, 25 aa, Staphylococcus aureus
GKGDFIPEAMVYKLAFKAGNSTAEK

SEQ ID NO: 1690959 - protein, 17 aa, Staphylococcus aureus
GKIDWVTKFPEGEYSKI

SEQ ID NO: 1690960 - protein, 22 aa, Staphylococcus aureus
GKKYYNFYGVGALDKDPIKTGA

SEQ ID NO: 1690961 - protein, 25 aa, Staphylococcus aureus
GKTTTIRMLLGLIKPTKGNIKIFEK

SEQ ID NO: 1690962 - protein, 18 aa, Staphylococcus aureus
GKTWLFFGDQHRSSDFLY

SEQ ID NO: 1690963 - protein, 17 aa, Staphylococcus aureus
GLEAAFKSYFKQFEENY

SEQ ID NO: 1690964 - protein, 19 aa, Staphylococcus aureus
GLEQGLIHALTAYSKLIHI

SEQ ID NO: 1690965 - protein, 18 aa, Staphylococcus aureus
GLINYRVAKGLTGDALIA

SEQ ID NO: 1690966 - protein, 19 aa, Staphylococcus aureus
GLLLKKHGQELYDAGLRRI

SEQ ID NO: 1690967 - protein, 18 aa, Staphylococcus aureus
GLYSLIFSSKLESAKRFK

SEQ ID NO: 1690968 - protein, 20 aa, Staphylococcus aureus
GNIHGMPLRILTGEGPKELL

SEQ ID NO: 1690969 - protein, 22 aa, Staphylococcus aureus
GNYYFHGHIVPGWQGVKKTFDT

SEQ ID NO: 1690970 - protein, 17 aa, Staphylococcus aureus
GPNFFSLHVKFEELYNE

SEQ ID NO: 1690971 - protein, 20 aa, Staphylococcus aureus
GQEISGWRYMLDRCEIMLSE

SEQ ID NO: 1690972 - protein, 18 aa, Staphylococcus aureus
GQFIAKKLDHAGIKHAFY

SEQ ID NO: 1690973 - protein, 22 aa, Staphylococcus aureus
GRLMDSLINYLDVIEYTTLSET

SEQ ID NO: 1690974 - protein, 19 aa, Staphylococcus aureus
GSFVMRYLLDGRVPNLPLA

SEQ ID NO: 1690975 - protein, 24 aa, Staphylococcus aureus
GTEKKFTFWADKPGAYWVGEGQKS

SEQ ID NO: 1690976 - protein, 29 aa, Staphylococcus aureus
GTKSLVKLFKTFPTKIIGLLKLFENNNDP

SEQ ID NO: 1690977 - protein, 29 aa, Staphylococcus aureus
GTQLSDEHITFIRKLTLNITLMFDGDFAG

SEQ ID NO: 1690978 - protein, 24 aa, Staphylococcus aureus
GTSIPTCILVFKKCRQQEDYVLFI

SEQ ID NO: 1690979 - protein, 24 aa, Staphylococcus aureus
GTSVPIVPKLLKSLNFNQFNLVEA

SEQ ID NO: 1690980 - protein, 49 aa, Staphylococcus aureus
GTVKRKFTLDFYLKPFVKTKIKAWVRQLLWMSIYQYVYLDKVPNHAIIN

SEQ ID NO: 1690981 - protein, 38 aa, Staphylococcus aureus
GVAPNNKFTMYRVFGSKKTELLWVSKAIVQAANDGNQV

SEQ ID NO: 1690982 - protein, 25 aa, Staphylococcus aureus
GVGFLNHMLTLFTFHSGLSLNIEAQ

SEQ ID NO: 1690983 - protein, 36 aa, Staphylococcus aureus
GVKNAFDFPGFVPAYIRPLFCEGKGQFRFAALSGDP

SEQ ID NO: 1690984 - protein, 36 aa, Staphylococcus aureus
GVNFYPMHINCRSDCALLPKSMWPKKPNKKRKTKYF

SEQ ID NO: 1690985 - protein, 37 aa, Staphylococcus aureus
GVNFYPMHINCRSDCALLPKSMWPKKPSKKRKTKYFG

SEQ ID NO: 1690986 - protein, 17 aa, Staphylococcus aureus
GWYGFQCYDYANMFFML

SEQ ID NO: 1690987 - protein, 18 aa, Staphylococcus aureus
GYAKFAFEKAIIYAFNIL

SEQ ID NO: 1690988 - protein, 18 aa, Staphylococcus aureus
GYFIYPYQEVMKDSNIKL

SEQ ID NO: 1690989 - protein, 21 aa, Staphylococcus aureus
GYKWFFAYPDEHIETVNTLTI

SEQ ID NO: 1690990 - protein, 24 aa, Staphylococcus aureus
GYYNGITFHRVINDFMIQGGDPTA

SEQ ID NO: 1690991 - protein, 23 aa, Staphylococcus aureus
HAPNIRTFLHRYDLYETKYWSVF

SEQ ID NO: 1690992 - protein, 18 aa, Staphylococcus aureus
HDINGNVPIFINIGEWDG

SEQ ID NO: 1690993 - protein, 22 aa, Staphylococcus aureus
HEDYLLFIHAIEQEFKDIANVT

SEQ ID NO: 1690994 - protein, 27 aa, Staphylococcus aureus
HFAIDIDKLLFQLNLKVKYIKMEGNTS

SEQ ID NO: 1690995 - protein, 25 aa, Staphylococcus aureus
HFEFTKLTLPLLKNADIYFDNEELS

SEQ ID NO: 1690996 - protein, 19 aa, Staphylococcus aureus
HFVTELYVETIKFMSPKSQ

SEQ ID NO: 1690997 - protein, 25 aa, Staphylococcus aureus
HGQVYHVFYHPLITDPKVAFTGDTH

SEQ ID NO: 1690998 - protein, 24 aa, Staphylococcus aureus
HGSKNIFGLIDRYDEKNSELVISD

SEQ ID NO: 1690999 - protein, 23 aa, Staphylococcus aureus
HHLKKMIGDLPLKEKRKARKAIE

SEQ ID NO: 1691000 - protein, 29 aa, Staphylococcus aureus
HISLVPQTLNWLMQQGLHEPYDLQKILLG

SEQ ID NO: 1691001 - protein, 38 aa, Staphylococcus aureus
HISLVPQTLNWLMQQGLHEPYNLQKILLGGAKLSATLI

SEQ ID NO: 1691002 - protein, 39 aa, Staphylococcus aureus
HISLVPQTLNWLMQQGLHEPYNLQKILLGGAKLSATMIE

SEQ ID NO: 1691003 - protein, 21 aa, Staphylococcus aureus
HITLSLPSNCQMYYAMKANSE

SEQ ID NO: 1691004 - protein, 18 aa, Staphylococcus aureus
HIYYQSRKLDRVPREAVE

SEQ ID NO: 1691005 - protein, 21 aa, Staphylococcus aureus
HLPKYMIPKTITHIDYMPLTT

SEQ ID NO: 1691006 - protein, 21 aa, Staphylococcus aureus
HLRNRILLCSKLYAPKSKKEV

SEQ ID NO: 1691007 - protein, 22 aa, Staphylococcus aureus
HNPRAQAFYKRHGFKVVGEHHF

SEQ ID NO: 1691008 - protein, 24 aa, Staphylococcus aureus
HPVDKMFVAKQYLTIFKLSNAQNN

SEQ ID NO: 1691009 - protein, 23 aa, Staphylococcus aureus
HREFQKKFYRQCKLGINEINFMR

SEQ ID NO: 1691010 - protein, 22 aa, Staphylococcus aureus
HSYSHYLLIEQAINVLKDAGYA

SEQ ID NO: 1691011 - protein, 23 aa, Staphylococcus aureus
HTPIAKYRFPERNRIISGLSKGV

SEQ ID NO: 1691012 - protein, 18 aa, Staphylococcus aureus
HTPKDLTFILANDIHSLG

SEQ ID NO: 1691013 - protein, 18 aa, Staphylococcus aureus
HVFLSLIDQPIQSGYLPL

SEQ ID NO: 1691014 - protein, 28 aa, Staphylococcus aureus
HVHYYDNPMYFIRLNFPNNLSVGNKAKG

SEQ ID NO: 1691015 - protein, 24 aa, Staphylococcus aureus
HVNEVYLISHALLETGAVKSELAN

SEQ ID NO: 1691016 - protein, 18 aa, Staphylococcus aureus
HVTGCRLLKKPHIKQYIQ

SEQ ID NO: 1691017 - protein, 33 aa, Staphylococcus aureus
HYADDYLRRSGLNYTILHPGALTNAAGSGKIEA

SEQ ID NO: 1691018 - protein, 17 aa, Staphylococcus aureus
IAEAFYKKFDEAGILNQ

SEQ ID NO: 1691019 - protein, 25 aa, Staphylococcus aureus
ICQSTLELLQPQMGLLRQQLELYVK

SEQ ID NO: 1691020 - protein, 23 aa, Staphylococcus aureus
IDEFLTTISNKYFDLLEYIDDYR

SEQ ID NO: 1691021 - protein, 17 aa, Staphylococcus aureus
IDFNSGYILISTGYKSF

SEQ ID NO: 1691022 - protein, 24 aa, Staphylococcus aureus
IDKNRIKRMLVDRPTLLKHTDDFL

SEQ ID NO: 1691023 - protein, 18 aa, Staphylococcus aureus
IDLNIYRPLFGNGSSPDE

SEQ ID NO: 1691024 - protein, 24 aa, Staphylococcus aureus
IDRTSNESLFSRQWDMNKITKNGA

SEQ ID NO: 1691025 - protein, 23 aa, Staphylococcus aureus
IEDKLIQLSQRKLIEQNNLNHYE

SEQ ID NO: 1691026 - protein, 22 aa, Staphylococcus aureus
IEDVINYKFFNSKSNILFIFEG

SEQ ID NO: 1691027 - protein, 25 aa, Staphylococcus aureus
IEEPLTFPLIALIVSGGHTELVYMK

SEQ ID NO: 1691028 - protein, 20 aa, Staphylococcus aureus
IEFNFDKYNSFMLFGVQVVQ

SEQ ID NO: 1691029 - protein, 22 aa, Staphylococcus aureus
IEGYLKDRSAWDATMYSFGTIP

SEQ ID NO: 1691030 - protein, 25 aa, Staphylococcus aureus
IENLKNIPLIPKSKLPDIPHHKFLE

SEQ ID NO: 1691031 - protein, 23 aa, Staphylococcus aureus
IESERLSELLKPAQKLKSPDDIK

SEQ ID NO: 1691032 - protein, 20 aa, Staphylococcus aureus
IGNAIKYLSRAPLKNGHEDL

SEQ ID NO: 1691033 - protein, 23 aa, Staphylococcus aureus
IHTDTYHHILKIIQKYELDYIID

SEQ ID NO: 1691034 - protein, 25 aa, Staphylococcus aureus
IHVNGFDFKLFILKGHMGISIQVKD

SEQ ID NO: 1691035 - protein, 26 aa, Staphylococcus aureus
IIEINCHGGILTINRVLELTMTYGAR

SEQ ID NO: 1691036 - protein, 17 aa, Staphylococcus aureus
IIIYLNFKDVNYQLISE

SEQ ID NO: 1691037 - protein, 30 aa, Staphylococcus aureus
IISNMEVIPTYKYLLHLGTQRLNKLEREFE

SEQ ID NO: 1691038 - protein, 23 aa, Staphylococcus aureus
IKDAKFKTIIKLYEYQKSSENNS

SEQ ID NO: 1691039 - protein, 21 aa, Staphylococcus aureus
IKGFEMLPQMKAVDLRIEYDG

SEQ ID NO: 1691040 - protein, 17 aa, Staphylococcus aureus
IKKDIGMIFQHFNLLNS

SEQ ID NO: 1691041 - protein, 26 aa, Staphylococcus aureus
IKKEDYPQIFDFLENVPRGTKTAHIR

SEQ ID NO: 1691042 - protein, 23 aa, Staphylococcus aureus
IKNWEFPFVIKPGDDLPTAGGYG

SEQ ID NO: 1691043 - protein, 27 aa, Staphylococcus aureus
IKQKPTVRWLFLTLTVKNVYDGEELNK

SEQ ID NO: 1691044 - protein, 27 aa, Staphylococcus aureus
IKRETEFDILFFSAIGVGDGDFIKSSS

SEQ ID NO: 1691045 - protein, 17 aa, Staphylococcus aureus
IKSLRRLTTKDIEVGGG

SEQ ID NO: 1691046 - protein, 20 aa, Staphylococcus aureus
ILALFCRIFKYKFGMNNKVV

SEQ ID NO: 1691047 - protein, 21 aa, Staphylococcus aureus
ILALFCRIFKYKFGMVNKVEI

SEQ ID NO: 1691048 - protein, 18 aa, Staphylococcus aureus
ILIYLDNAATTKAFEEVL

SEQ ID NO: 1691049 - protein, 21 aa, Staphylococcus aureus
ILKKEVISFTKLIKGTDKEAP

SEQ ID NO: 1691050 - protein, 20 aa, Staphylococcus aureus
ILVQVPLPKQVSEQKILEAI

SEQ ID NO: 1691051 - protein, 20 aa, Staphylococcus aureus
IMCLDISYHKLKFKHNLFIV

SEQ ID NO: 1691052 - protein, 24 aa, Staphylococcus aureus
IMKKYQFEYIIHLAALVSVAESVE

SEQ ID NO: 1691053 - protein, 17 aa, Staphylococcus aureus
IMRPRAKYIGETNRKYI

SEQ ID NO: 1691054 - protein, 25 aa, Staphylococcus aureus
INARLITNKAAYFKKSQLIEQFIRS

SEQ ID NO: 1691055 - protein, 27 aa, Staphylococcus aureus
INEITYRLSKIFGIKSISPVLKVEKTL

SEQ ID NO: 1691056 - protein, 25 aa, Staphylococcus aureus
INGGDKWILYGLNGAGKTTLLNILN

SEQ ID NO: 1691057 - protein, 39 aa, Staphylococcus aureus
INKTNYFIDLIHRHNLKRPLILLNWNTLTGDTFITNGEY

SEQ ID NO: 1691058 - protein, 21 aa, Staphylococcus aureus
INNIPYKVDIYPYYGSDASAA

SEQ ID NO: 1691059 - protein, 23 aa, Staphylococcus aureus
INNYLLKTFSTVQKSYVFKGAKN

SEQ ID NO: 1691060 - protein, 27 aa, Staphylococcus aureus
IPAVQRQTMLFSATMPKAIQALVQQFM

SEQ ID NO: 1691061 - protein, 24 aa, Staphylococcus aureus
IPTNKAPKLLLKGTGNLKGSSVGY

SEQ ID NO: 1691062 - protein, 24 aa, Staphylococcus aureus
IPTQKAPKLLLKGSGNLKGSSVGY

SEQ ID NO: 1691063 - protein, 24 aa, Staphylococcus aureus
IPVEWEQVFTIAYVTDQAGEVIFN

SEQ ID NO: 1691064 - protein, 17 aa, Staphylococcus aureus
IPWLYVERGFEIPSFNY

SEQ ID NO: 1691065 - protein, 18 aa, Staphylococcus aureus
IPYTVLRDNIYTHPTMAE

SEQ ID NO: 1691066 - protein, 25 aa, Staphylococcus aureus
IQQRFTLNMLYPYIDEINISKNKSL

SEQ ID NO: 1691067 - protein, 20 aa, Staphylococcus aureus
IQSPFLYMKALIESIHLNIK

SEQ ID NO: 1691068 - protein, 18 aa, Staphylococcus aureus
IRDIDPTLLLLEIDKESK

SEQ ID NO: 1691069 - protein, 25 aa, Staphylococcus aureus
IRELIFREFYYVLMTQYPESAHQSF

SEQ ID NO: 1691070 - protein, 19 aa, Staphylococcus aureus
IRFQNCSLFPLYHGSAKSN

SEQ ID NO: 1691071 - protein, 20 aa, Staphylococcus aureus
IRFQNCSLFPLYHGSAKSNI

SEQ ID NO: 1691072 - protein, 29 aa, Staphylococcus aureus
IRNRTQVKNWWRWYRNGESYRFSQHVGKQ

SEQ ID NO: 1691073 - protein, 19 aa, Staphylococcus aureus
IRQFKYLSVFEKDVMYLMC

SEQ ID NO: 1691074 - protein, 20 aa, Staphylococcus aureus
IRYAKYLNELSDETQFIVIT

SEQ ID NO: 1691075 - protein, 26 aa, Staphylococcus aureus
ISAGRIPLDVKTLRILHFVSGDGGKL

SEQ ID NO: 1691076 - protein, 28 aa, Staphylococcus aureus
ISSFVYKRRLPFHAKRFNDWLETMPNNV

SEQ ID NO: 1691077 - protein, 18 aa, Staphylococcus aureus
ISVIGYPNPNGNKLQMYE

SEQ ID NO: 1691078 - protein, 17 aa, Staphylococcus aureus
ITACTWTSKKWPFTTPE

SEQ ID NO: 1691079 - protein, 24 aa, Staphylococcus aureus
ITDKEKILVLGSGPIRIGQGVEFD

SEQ ID NO: 1691080 - protein, 21 aa, Staphylococcus aureus
ITMTLIREMRLMWKEMMVILQ

SEQ ID NO: 1691081 - protein, 21 aa, Staphylococcus aureus
IVEELFEYAGKWRNIRVQGPT

SEQ ID NO: 1691082 - protein, 18 aa, Staphylococcus aureus
IVGKTDMFVFPHGAQDRH

SEQ ID NO: 1691083 - protein, 19 aa, Staphylococcus aureus
IVPDLIRLNKTFLIESREL

SEQ ID NO: 1691084 - protein, 17 aa, Staphylococcus aureus
IVTLIKRYQSAASLSNF

SEQ ID NO: 1691085 - protein, 35 aa, Staphylococcus aureus
IVTSTNMIFKYAYDMKLIRILPSEGIKRPKKKVSV

SEQ ID NO: 1691086 - protein, 25 aa, Staphylococcus aureus
IVVGIAFIIELKYLNGIEKIKDYDV

SEQ ID NO: 1691087 - protein, 18 aa, Staphylococcus aureus
IYAPLAHHLGINTIKWEL

SEQ ID NO: 1691088 - protein, 20 aa, Staphylococcus aureus
IYKFKYAILEAVRKVFDYKS

SEQ ID NO: 1691089 - protein, 21 aa, Staphylococcus aureus
IYYFHGHIVPGWQGVKKTFDT

SEQ ID NO: 1691090 - protein, 19 aa, Staphylococcus aureus
KAAAKYYFNKDLKDLNLAE

SEQ ID NO: 1691091 - protein, 24 aa, Staphylococcus aureus
KADAAPKRFIREFRNVDVDAYEVG

SEQ ID NO: 1691092 - protein, 20 aa, Staphylococcus aureus
KAFNYMPYFEQLDMNQINVT

SEQ ID NO: 1691093 - protein, 28 aa, Staphylococcus aureus
KAIETLKESKPYLFASSKPVGKTPQGGG

SEQ ID NO: 1691094 - protein, 17 aa, Staphylococcus aureus
KAIPYYAKLHFTSASIL

SEQ ID NO: 1691095 - protein, 18 aa, Staphylococcus aureus
KAIYYKEQQARITLYLKH

SEQ ID NO: 1691096 - protein, 22 aa, Staphylococcus aureus
KAKAQGLEAFDNIQIDSTEKQK

SEQ ID NO: 1691097 - protein, 25 aa, Staphylococcus aureus
KAKASLSKIPLVKYSTMQYFHKELN

SEQ ID NO: 1691098 - protein, 32 aa, Staphylococcus aureus
KAKINAVKTFSEYKKDALAKIEDAYNAKVNEA

SEQ ID NO: 1691099 - protein, 22 aa, Staphylococcus aureus
KALYIKTYLPVLNQIDAKYLHD

SEQ ID NO: 1691100 - protein, 20 aa, Staphylococcus aureus
KANIIIAHGVAEHLDRYDEI

SEQ ID NO: 1691101 - protein, 23 aa, Staphylococcus aureus
KAQFIKRLACLPSHIYRLKGFMT

SEQ ID NO: 1691102 - protein, 17 aa, Staphylococcus aureus
KAQINRLKLFKQHGISS

SEQ ID NO: 1691103 - protein, 20 aa, Staphylococcus aureus
KAQRINPEVKKNALEAIREV

SEQ ID NO: 1691104 - protein, 28 aa, Staphylococcus aureus
KATARNEITAILNNKLQEIQATPDATDE

SEQ ID NO: 1691105 - protein, 31 aa, Staphylococcus aureus
KDANIYVYDKDKIIILAYKPLSNDDEVHYYA

SEQ ID NO: 1691106 - protein, 21 aa, Staphylococcus aureus
KDGEHLDLLSKIAITFSEEEN

SEQ ID NO: 1691107 - protein, 27 aa, Staphylococcus aureus
KDGKKRYYNFFGIGAFDSSAVRSGKSY

SEQ ID NO: 1691108 - protein, 18 aa, Staphylococcus aureus
KDLMLHQSGLYKYKSSKD

SEQ ID NO: 1691109 - protein, 20 aa, Staphylococcus aureus
KDLNLAEEAYLAGLPQVPNN

SEQ ID NO: 1691110 - protein, 18 aa, Staphylococcus aureus
KDNVDLAIFGPGNPLMAH

SEQ ID NO: 1691111 - protein, 22 aa, Staphylococcus aureus
KEAFTNALEDILSKATEDISDQ

SEQ ID NO: 1691112 - protein, 24 aa, Staphylococcus aureus
KEAQIDLFKQFKAIADKKKSVSDR

SEQ ID NO: 1691113 - protein, 25 aa, Staphylococcus aureus
KEFLNYTYSQFFEEMKPMIAEAFYK

SEQ ID NO: 1691114 - protein, 19 aa, Staphylococcus aureus
KEIENFKFFVQYGNFKDIN

SEQ ID NO: 1691115 - protein, 19 aa, Staphylococcus aureus
KEILTETKMFSKLSNRKID

SEQ ID NO: 1691116 - protein, 17 aa, Staphylococcus aureus
KEQVGQATTLPNVQTVR

SEQ ID NO: 1691117 - protein, 22 aa, Staphylococcus aureus
KESLQEIINLLLDDVQVTLDKK

SEQ ID NO: 1691118 - protein, 19 aa, Staphylococcus aureus
KEVAIYRRAEINLSVILCR

SEQ ID NO: 1691119 - protein, 23 aa, Staphylococcus aureus
KEYRKYYEPLIHKNDKEFKEGMQ

SEQ ID NO: 1691120 - protein, 26 aa, Staphylococcus aureus
KFKTTTIVFKFMAPLEYDTTTARSLL

SEQ ID NO: 1691121 - protein, 17 aa, Staphylococcus aureus
KFLWSYVNCKPKDLQYE

SEQ ID NO: 1691122 - protein, 22 aa, Staphylococcus aureus
KGDVALFFGLSGTGKTTLSADP

SEQ ID NO: 1691123 - protein, 23 aa, Staphylococcus aureus
KGKNIALLFEKDSTRTRCAFETA

SEQ ID NO: 1691124 - protein, 23 aa, Staphylococcus aureus
KGPKIYQQKLYQLGIEPNIIEIF

SEQ ID NO: 1691125 - protein, 21 aa, Staphylococcus aureus
KGSQLPKMFGFQAEGASPIVQ

SEQ ID NO: 1691126 - protein, 23 aa, Staphylococcus aureus
KGTLYTVQAALPTMLEQSSGHLI

SEQ ID NO: 1691127 - protein, 28 aa, Staphylococcus aureus
KHHVFTSYLRYPTVTKPMLRISLSYFHT

SEQ ID NO: 1691128 - protein, 17 aa, Staphylococcus aureus
KHLELIMKWCAQELKNN

SEQ ID NO: 1691129 - protein, 18 aa, Staphylococcus aureus
KHQILQHSLTIRQYEMQK

SEQ ID NO: 1691130 - protein, 26 aa, Staphylococcus aureus
KHSINEIYLIAHAFLESGYGTSNFAN

SEQ ID NO: 1691131 - protein, 17 aa, Staphylococcus aureus
KHSYLKKSFLEIVETLK

SEQ ID NO: 1691132 - protein, 20 aa, Staphylococcus aureus
KIHVANFSFNIIDSGIESAV

SEQ ID NO: 1691133 - protein, 18 aa, Staphylococcus aureus
KIKLIKRTSFGYGSYNHL

SEQ ID NO: 1691134 - protein, 20 aa, Staphylococcus aureus
KIKTGFGTGGWQLAALNICS

SEQ ID NO: 1691135 - protein, 17 aa, Staphylococcus aureus
KINWSKLVNKLSVPIEA

SEQ ID NO: 1691136 - protein, 25 aa, Staphylococcus aureus
KIPSFEVIDWLRNGLELHNVEESIC

SEQ ID NO: 1691137 - protein, 22 aa, Staphylococcus aureus
KIQTDGRMKALVSITLDEAFVI

SEQ ID NO: 1691138 - protein, 18 aa, Staphylococcus aureus
KIREGDLFIFRRPTNLSQ

SEQ ID NO: 1691139 - protein, 20 aa, Staphylococcus aureus
KIRFLKLKVGKIINVAKVDI

SEQ ID NO: 1691140 - protein, 25 aa, Staphylococcus aureus
KIVKLKIHNLVVKILLPISDLHIKE

SEQ ID NO: 1691141 - protein, 31 aa, Staphylococcus aureus
KKDKELNYTLKLFNQVFKIIKSMMKEERYHT

SEQ ID NO: 1691142 - protein, 25 aa, Staphylococcus aureus
KKEIENFKFFVQYGSFKGIENYENG

SEQ ID NO: 1691143 - protein, 27 aa, Staphylococcus aureus
KKESATTDLYAYADQKKNNISADTNAT

SEQ ID NO: 1691144 - protein, 23 aa, Staphylococcus aureus
KKESIIYFKFIEVKHLKLNTSNS

SEQ ID NO: 1691145 - protein, 22 aa, Staphylococcus aureus
KKESPEILAFIKSFKKYIANEQ

SEQ ID NO: 1691146 - protein, 20 aa, Staphylococcus aureus
KKGFAFLRPEDKDMEDIFIP

SEQ ID NO: 1691147 - protein, 21 aa, Staphylococcus aureus
KKIMVIFGTRPEAIKMAPLVK

SEQ ID NO: 1691148 - protein, 17 aa, Staphylococcus aureus
KKQPPLKAKLKLYEQMI

SEQ ID NO: 1691149 - protein, 23 aa, Staphylococcus aureus
KKVNYLTETLGFDAGIDYKKEDF

SEQ ID NO: 1691150 - protein, 46 aa, Staphylococcus aureus
KKVVKQINVPGFRKGKVPRPIFEQRFGVEALYQDAIDILLPDAYGE

SEQ ID NO: 1691151 - protein, 17 aa, Staphylococcus aureus
KKVYVIREDGVDAFYYV

SEQ ID NO: 1691152 - protein, 20 aa, Staphylococcus aureus
KLEPPIKEWEKMGLLTIVDD

SEQ ID NO: 1691153 - protein, 23 aa, Staphylococcus aureus
KLGNISVHQLIYGDFLGLLESIA

SEQ ID NO: 1691154 - protein, 18 aa, Staphylococcus aureus
KLILHLVTSKLTNIEENP

SEQ ID NO: 1691155 - protein, 28 aa, Staphylococcus aureus
KLKGKKLTFIISPQWFTNHGLTNQNFDA

SEQ ID NO: 1691156 - protein, 22 aa, Staphylococcus aureus
KLKTYRMVFNTISVEKMNAILF

SEQ ID NO: 1691157 - protein, 17 aa, Staphylococcus aureus
KLLHTIIKKFGDHNLTF

SEQ ID NO: 1691158 - protein, 21 aa, Staphylococcus aureus
KLSEYQLLTQFNPTFINKKIR

SEQ ID NO: 1691159 - protein, 22 aa, Staphylococcus aureus
KLTRDEMIWLKQNIISYMEDDG

SEQ ID NO: 1691160 - protein, 27 aa, Staphylococcus aureus
KLVNDNLNYFKLKKFIVALESKTAIIE

SEQ ID NO: 1691161 - protein, 26 aa, Staphylococcus aureus
KLVNDNLNYFKLKKFIVGLESKTAII

SEQ ID NO: 1691162 - protein, 21 aa, Staphylococcus aureus
KLYTKFGFIPTEPDSGGMYIK

SEQ ID NO: 1691163 - protein, 17 aa, Staphylococcus aureus
KMFVSTMETRLNDHNKA

SEQ ID NO: 1691164 - protein, 26 aa, Staphylococcus aureus
KMKTNDAFFFLYSDLKGNELKEELLY

SEQ ID NO: 1691165 - protein, 23 aa, Staphylococcus aureus
KNFNPLYEISVNKGLYPITKKIF

SEQ ID NO: 1691166 - protein, 26 aa, Staphylococcus aureus
KNFYNTDLPAIPHTKLRDALAHEINK

SEQ ID NO: 1691167 - protein, 25 aa, Staphylococcus aureus
KNGSRPYYYSFKRNNNRVCIPFRTN

SEQ ID NO: 1691168 - protein, 30 aa, Staphylococcus aureus
KNKIYITKNGILACLLLEGHLLSKPDLTGQ

SEQ ID NO: 1691169 - protein, 18 aa, Staphylococcus aureus
KNLPRFIDVLATVLEEME

SEQ ID NO: 1691170 - protein, 18 aa, Staphylococcus aureus
KNMMYVLADNRHISLIAD

SEQ ID NO: 1691171 - protein, 30 aa, Staphylococcus aureus
KNRTWEFHITLPQFLAHEDYLLFIHAIEQE

SEQ ID NO: 1691172 - protein, 30 aa, Staphylococcus aureus
KNTSTIIPMCHPLPLTGIDVHFSWDETNAP

SEQ ID NO: 1691173 - protein, 18 aa, Staphylococcus aureus
KPIPLKDLMLHQSGLYKY

SEQ ID NO: 1691174 - protein, 17 aa, Staphylococcus aureus
KPLIPVHHIAGHIYANH

SEQ ID NO: 1691175 - protein, 32 aa, Staphylococcus aureus
KPLKENIEIALKLLKILLKELERVLGRNTFAE

SEQ ID NO: 1691176 - protein, 17 aa, Staphylococcus aureus
KPSYPVINGIYFALELT

SEQ ID NO: 1691177 - protein, 23 aa, Staphylococcus aureus
KPYIDYQDVFNWIIKMNEHYVVE

SEQ ID NO: 1691178 - protein, 24 aa, Staphylococcus aureus
KQAPVYLYPNTDKVPGLNRFAFTL

SEQ ID NO: 1691179 - protein, 24 aa, Staphylococcus aureus
KQISMGLVFSIMDGVRYLKDNAQQ

SEQ ID NO: 1691180 - protein, 24 aa, Staphylococcus aureus
KQLNAFIHQSKFKPGDKLPSVTQL

SEQ ID NO: 1691181 - protein, 24 aa, Staphylococcus aureus
KQLSEYILAFILDDYKKMKLSYDN

SEQ ID NO: 1691182 - protein, 25 aa, Staphylococcus aureus
KQRMVDAFILLYSKENDPIKQMLID

SEQ ID NO: 1691183 - protein, 17 aa, Staphylococcus aureus
KQVFAIPGNEAMTPIAE

SEQ ID NO: 1691184 - protein, 19 aa, Staphylococcus aureus
KQVQALIDEIDRNPILTDK

SEQ ID NO: 1691185 - protein, 17 aa, Staphylococcus aureus
KQYLTIFKLSNAQNNKP

SEQ ID NO: 1691186 - protein, 34 aa, Staphylococcus aureus
KQYYQAMYLSNLTNYLFSFVKIPDNIILSLINNL

SEQ ID NO: 1691187 - protein, 22 aa, Staphylococcus aureus
KRELGFVLMALNIRKIAAQRAV

SEQ ID NO: 1691188 - protein, 22 aa, Staphylococcus aureus
KRGYKMLPHFQIGMFEDQLFVM

SEQ ID NO: 1691189 - protein, 23 aa, Staphylococcus aureus
KRKINILVGLLGQPQILILDEPT

SEQ ID NO: 1691190 - protein, 26 aa, Staphylococcus aureus
KRWVTSDVLPAIRKYGIYATDNVIEQ

SEQ ID NO: 1691191 - protein, 17 aa, Staphylococcus aureus
KSDAQIVEILKNQINTL

SEQ ID NO: 1691192 - protein, 21 aa, Staphylococcus aureus
KSKYDIDFITGHSLGGRDAVV

SEQ ID NO: 1691193 - protein, 17 aa, Staphylococcus aureus
KSNYILKYVFANGIARE

SEQ ID NO: 1691194 - protein, 18 aa, Staphylococcus aureus
KSRFIDKSLSSLPYVLCV

SEQ ID NO: 1691195 - protein, 31 aa, Staphylococcus aureus
KSSKRKYDDTLPPLFDELPKEEPKSKPVVEP

SEQ ID NO: 1691196 - protein, 24 aa, Staphylococcus aureus
KSTMINLLIEQDILPSSPVPTTSN

SEQ ID NO: 1691197 - protein, 18 aa, Staphylococcus aureus
KTAYDRVEWFRNGINGLG

SEQ ID NO: 1691198 - protein, 25 aa, Staphylococcus aureus
KTEIKNFKFFVQYGNFKDLKNYKDG

SEQ ID NO: 1691199 - protein, 29 aa, Staphylococcus aureus
KTFEEIFREYYYNNPQYQNLFYTGSNANP

SEQ ID NO: 1691200 - protein, 23 aa, Staphylococcus aureus
KTFHLYDELSKFANYYIKAGVNA

SEQ ID NO: 1691201 - protein, 17 aa, Staphylococcus aureus
KTFLNKLYGGDMKSLVL

SEQ ID NO: 1691202 - protein, 24 aa, Staphylococcus aureus
KTIRTLITRLYKKEIIKRYKYNNI

SEQ ID NO: 1691203 - protein, 24 aa, Staphylococcus aureus
KTPYKKWFERMSDYGFEENIDYIV

SEQ ID NO: 1691204 - protein, 20 aa, Staphylococcus aureus
KTVLGWMRNPILRGHTKHGD

SEQ ID NO: 1691205 - protein, 17 aa, Staphylococcus aureus
KTYLVIETGKIDAGYHG

SEQ ID NO: 1691206 - protein, 25 aa, Staphylococcus aureus
KVFVKRKEVGSWSDWSELALNDYNT

SEQ ID NO: 1691207 - protein, 17 aa, Staphylococcus aureus
KVGMFDDSKIKYIEALP

SEQ ID NO: 1691208 - protein, 18 aa, Staphylococcus aureus
KVKTLLPLYKEVFESLID

SEQ ID NO: 1691209 - protein, 21 aa, Staphylococcus aureus
KVRRDYEFNVNSPEFQDLELL

SEQ ID NO: 1691210 - protein, 18 aa, Staphylococcus aureus
KWNRKTVLGWMRNPILRG

SEQ ID NO: 1691211 - protein, 26 aa, Staphylococcus aureus
KYDGKTWIFNSYPEWQKQFPFWSERT

SEQ ID NO: 1691212 - protein, 22 aa, Staphylococcus aureus
KYGLFLDMGLGKTVSTLTAFSE

SEQ ID NO: 1691213 - protein, 19 aa, Staphylococcus aureus
LASPNNILGISYLKAIAKN

SEQ ID NO: 1691214 - protein, 17 aa, Staphylococcus aureus
LCKINNIPYKVDIYPYY

SEQ ID NO: 1691215 - protein, 28 aa, Staphylococcus aureus
LDDALYDGFIFKNPAYKVNYKAGKPTKS

SEQ ID NO: 1691216 - protein, 18 aa, Staphylococcus aureus
LDDEGMVLYLNRNAKKAT

SEQ ID NO: 1691217 - protein, 27 aa, Staphylococcus aureus
LDEKTGFMYMYMYITLNGDSYEKIQAL

SEQ ID NO: 1691218 - protein, 20 aa, Staphylococcus aureus
LDELYLSKRLAEIHTQVPID

SEQ ID NO: 1691219 - protein, 19 aa, Staphylococcus aureus
LDPSNGICLSLFLAKAFKK

SEQ ID NO: 1691220 - protein, 31 aa, Staphylococcus aureus
LDQRVINHYGSLIPLTPLDNSLLRKEQNDTT

SEQ ID NO: 1691221 - protein, 24 aa, Staphylococcus aureus
LDVQLRNYLNEKYKLYEQGGDIVK

SEQ ID NO: 1691222 - protein, 21 aa, Staphylococcus aureus
LDYEHIFSRKLYKLHKGNAII

SEQ ID NO: 1691223 - protein, 17 aa, Staphylococcus aureus
LEEYVNVRSVPLRLVDT

SEQ ID NO: 1691224 - protein, 25 aa, Staphylococcus aureus
LEKGLYRKRMLSYGGLLKQKHKILN

SEQ ID NO: 1691225 - protein, 27 aa, Staphylococcus aureus
LELADDYQVLAVLPLWHHDDTYLFDSL

SEQ ID NO: 1691226 - protein, 17 aa, Staphylococcus aureus
LELIMKWCAQELKNNFQ

SEQ ID NO: 1691227 - protein, 22 aa, Staphylococcus aureus
LERLLEIKSLLEKGFNIKGIKQ

SEQ ID NO: 1691228 - protein, 25 aa, Staphylococcus aureus
LERTLGFSNGQIRRWEKTKPGIDKV

SEQ ID NO: 1691229 - protein, 17 aa, Staphylococcus aureus
LEWINKWKHYSSELLPK

SEQ ID NO: 1691230 - protein, 21 aa, Staphylococcus aureus
LFWRIYRKYLGGKSFNKKPTL

SEQ ID NO: 1691231 - protein, 18 aa, Staphylococcus aureus
LGGIGLNAIIGAKLAGAN

SEQ ID NO: 1691232 - protein, 18 aa, Staphylococcus aureus
LGHTLYRRHYYPKEKNLR

SEQ ID NO: 1691233 - protein, 17 aa, Staphylococcus aureus
LGMTGKTWLFFGDQHRS

SEQ ID NO: 1691234 - protein, 31 aa, Staphylococcus aureus
LGSGQQWYSWIHINDLIQAILFLINNESASG

SEQ ID NO: 1691235 - protein, 23 aa, Staphylococcus aureus
LGTYYFRITYYDKSNTRKYITRK

SEQ ID NO: 1691236 - protein, 17 aa, Staphylococcus aureus
LHNNLRFISPPKGGNDK

SEQ ID NO: 1691237 - protein, 17 aa, Staphylococcus aureus
LHTIIKKFGDHNLTFAI

SEQ ID NO: 1691238 - protein, 25 aa, Staphylococcus aureus
LIPEYQHLNIFTVGRLDKDTEGLLL

SEQ ID NO: 1691239 - protein, 17 aa, Staphylococcus aureus
LIQWAWDNPKLSGNKRF

SEQ ID NO: 1691240 - protein, 25 aa, Staphylococcus aureus
LKEIYQFPLLLFYKGNIKLIKIICI

SEQ ID NO: 1691241 - protein, 17 aa, Staphylococcus aureus
LKIKGMVLYMNRNTKTT

SEQ ID NO: 1691242 - protein, 28 aa, Staphylococcus aureus
LKKKVDFYRYTLGYLFQNFALLENQTIS

SEQ ID NO: 1691243 - protein, 22 aa, Staphylococcus aureus
LKYKVYIIDEVHMLTTGAFNAL

SEQ ID NO: 1691244 - protein, 18 aa, Staphylococcus aureus
LLKIKKEDYPQIFDFLEN

SEQ ID NO: 1691245 - protein, 26 aa, Staphylococcus aureus
LLNFLNTKKLSIGWKIYLEKISLRDR

SEQ ID NO: 1691246 - protein, 20 aa, Staphylococcus aureus
LLNINPDIILRLPHGMPEEV

SEQ ID NO: 1691247 - protein, 19 aa, Staphylococcus aureus
LLPNQFVLIATGSSPAELP

SEQ ID NO: 1691248 - protein, 20 aa, Staphylococcus aureus
LLQYTFILSSFLKSINIIEE

SEQ ID NO: 1691249 - protein, 21 aa, Staphylococcus aureus
LLRKYYAFIKLDHNDIIKELQ

SEQ ID NO: 1691250 - protein, 39 aa, Staphylococcus aureus
LLRVEAPLIQAQLIETILLNIVNFHTLITTKASRIRQIA

SEQ ID NO: 1691251 - protein, 18 aa, Staphylococcus aureus
LMLMAKLKQSRGPSKGLD

SEQ ID NO: 1691252 - protein, 26 aa, Staphylococcus aureus
LNDDSYLNLIFKFTRNIPVNKLEESQ

SEQ ID NO: 1691253 - protein, 31 aa, Staphylococcus aureus
LNFKFMKHINDVGIPVVFIINQIDKHQDDEL

SEQ ID NO: 1691254 - protein, 19 aa, Staphylococcus aureus
LNFLIQHDLARLKSHYNIE

SEQ ID NO: 1691255 - protein, 22 aa, Staphylococcus aureus
LNGNFEGITYPESFKVFGSEQS

SEQ ID NO: 1691256 - protein, 31 aa, Staphylococcus aureus
LNINKLVPIYLNPKTILFPIKQKRAPIQTYI

SEQ ID NO: 1691257 - protein, 27 aa, Staphylococcus aureus
LNKYHELLDKYFLHNISFYEEDKNNER

SEQ ID NO: 1691258 - protein, 28 aa, Staphylococcus aureus
LNQSKIGGMPFLKYFKDIPLDENNVPMV

SEQ ID NO: 1691259 - protein, 18 aa, Staphylococcus aureus
LNVFYATQVAIEPPTFVV

SEQ ID NO: 1691260 - protein, 18 aa, Staphylococcus aureus
LPGKYFIFKDLQIEEYQS

SEQ ID NO: 1691261 - protein, 19 aa, Staphylococcus aureus
LPTFQRALVWSNNQKQEFF

SEQ ID NO: 1691262 - protein, 17 aa, Staphylococcus aureus
LQAMQVGVWAPTQKLTK

SEQ ID NO: 1691263 - protein, 23 aa, Staphylococcus aureus
LQKINVDIYPGEKVLVVGASGSG

SEQ ID NO: 1691264 - protein, 19 aa, Staphylococcus aureus
LRDKLPLRRDDESEVYLSF

SEQ ID NO: 1691265 - protein, 19 aa, Staphylococcus aureus
LREAIQIRQLVPDATIFLM

SEQ ID NO: 1691266 - protein, 19 aa, Staphylococcus aureus
LREGLPLRSEYHEQYLKDA

SEQ ID NO: 1691267 - protein, 20 aa, Staphylococcus aureus
LRFEAIFTELRNRDITFIAA

SEQ ID NO: 1691268 - protein, 17 aa, Staphylococcus aureus
LRGTVNLDEKCILSLTY

SEQ ID NO: 1691269 - protein, 21 aa, Staphylococcus aureus
LRKRYHIPTKQAPELKLKGSG

SEQ ID NO: 1691270 - protein, 28 aa, Staphylococcus aureus
LRLYGLGAYELLSLMYDIHTVRMTIIQP

SEQ ID NO: 1691271 - protein, 18 aa, Staphylococcus aureus
LSCPVGYQFQPGGYCDYT

SEQ ID NO: 1691272 - protein, 17 aa, Staphylococcus aureus
LSFIVHRDFAYERGKAL

SEQ ID NO: 1691273 - protein, 20 aa, Staphylococcus aureus
LSKTEMIILEILITKKNQIV

SEQ ID NO: 1691274 - protein, 24 aa, Staphylococcus aureus
LSSKRNYWYKKPNFSRIAQIASYV

SEQ ID NO: 1691275 - protein, 17 aa, Staphylococcus aureus
LTELSSYRVYQDINKDN

SEQ ID NO: 1691276 - protein, 26 aa, Staphylococcus aureus
LTKKKKGEALLLYGTQRAFIRIDLDR

SEQ ID NO: 1691277 - protein, 17 aa, Staphylococcus aureus
LTSKVESSIRKAFKNIL

SEQ ID NO: 1691278 - protein, 17 aa, Staphylococcus aureus
LTTDITYLPFGHSMLYL

SEQ ID NO: 1691279 - protein, 30 aa, Staphylococcus aureus
LVDQLKVKYSIKLLLKVLNIPKSTYYRWKN

SEQ ID NO: 1691280 - protein, 32 aa, Staphylococcus aureus
LVEYMDDRYPFYLDPMPNLYFTRDPQASIGRG

SEQ ID NO: 1691281 - protein, 19 aa, Staphylococcus aureus
LVLEAIPNDLAEEISKHLT

SEQ ID NO: 1691282 - protein, 17 aa, Staphylococcus aureus
LVNVLDLEDRFIDGINI

SEQ ID NO: 1691283 - protein, 25 aa, Staphylococcus aureus
LVPIYINAKTILFPLKHKRAPIQIY

SEQ ID NO: 1691284 - protein, 17 aa, Staphylococcus aureus
LVSLLEDLNIKASLNGM

SEQ ID NO: 1691285 - protein, 18 aa, Staphylococcus aureus
LYDYVNWYNNFRPHSSSQ

SEQ ID NO: 1691286 - protein, 19 aa, Staphylococcus aureus
LYFEHKKAYRFLKEEVPEE

SEQ ID NO: 1691287 - protein, 18 aa, Staphylococcus aureus
LYHEYNLEFPITKAIPYY

SEQ ID NO: 1691288 - protein, 18 aa, Staphylococcus aureus
LYKERENFYEGMKQATLP

SEQ ID NO: 1691289 - protein, 25 aa, Staphylococcus aureus
LYKMFRERGFEIKPEIAGLMLSAII

SEQ ID NO: 1691290 - protein, 20 aa, Staphylococcus aureus
LYNYHYLYPHQRYAIDLVIK

SEQ ID NO: 1691291 - protein, 17 aa, Staphylococcus aureus
LYYIHFPDDNTPKDQAV

SEQ ID NO: 1691292 - protein, 32 aa, Staphylococcus aureus
MACVSEAIHLLPYNVFFVPARGGLGENVVFQA

SEQ ID NO: 1691293 - protein, 27 aa, Staphylococcus aureus
MAQRVAFIMSLIRRPNYLFLDEPTSAL

SEQ ID NO: 1691294 - protein, 17 aa, Staphylococcus aureus
MAYVMMNSKLFGHVYIK

SEQ ID NO: 1691295 - protein, 24 aa, Staphylococcus aureus
MDTVVFIPSIIHPSFKRIPEVENL

SEQ ID NO: 1691296 - protein, 27 aa, Staphylococcus aureus
MFNDLTPDEIFPYAPPQGIEELRDLWQ

SEQ ID NO: 1691297 - protein, 21 aa, Staphylococcus aureus
MGGYFIVGYINDDKKYKFQAS

SEQ ID NO: 1691298 - protein, 21 aa, Staphylococcus aureus
MGVVPPIEGFLQGLRNITTEY

SEQ ID NO: 1691299 - protein, 17 aa, Staphylococcus aureus
MHQIRVLRELEFHFQLV

SEQ ID NO: 1691300 - protein, 18 aa, Staphylococcus aureus
MHVLLCVENAYFRKKENY

SEQ ID NO: 1691301 - protein, 25 aa, Staphylococcus aureus
MIESKEILPYLYKGLRDKSPVVRRT

SEQ ID NO: 1691302 - protein, 24 aa, Staphylococcus aureus
MIFSQNLFRRPTPARLTRIEKSLL

SEQ ID NO: 1691303 - protein, 19 aa, Staphylococcus aureus
MKEAIKYAVKFYNYPNEHI

SEQ ID NO: 1691304 - protein, 19 aa, Staphylococcus aureus
MKHKVIFDTKNVVKSSFED

SEQ ID NO: 1691305 - protein, 20 aa, Staphylococcus aureus
MKIALTIALSHDVKLLILDE

SEQ ID NO: 1691306 - protein, 25 aa, Staphylococcus aureus
MKIRQRVMEMLLLPEQRLLYSDMVD

SEQ ID NO: 1691307 - protein, 23 aa, Staphylococcus aureus
MKLRIGFSDIFFNVDKLTSSEAS

SEQ ID NO: 1691308 - protein, 20 aa, Staphylococcus aureus
MLEAIFFGHEEIQRLVDFQQ

SEQ ID NO: 1691309 - protein, 20 aa, Staphylococcus aureus
MMAILQAFRVPSVNLLQFMV

SEQ ID NO: 1691310 - protein, 17 aa, Staphylococcus aureus
MMNEVIGNPLLDKFMKD

SEQ ID NO: 1691311 - protein, 20 aa, Staphylococcus aureus
MMYDIKDYLIWYKENNIYKD

SEQ ID NO: 1691312 - protein, 19 aa, Staphylococcus aureus
MPNSYVQSIFQIDLDKLVD

SEQ ID NO: 1691313 - protein, 24 aa, Staphylococcus aureus
MQICPPMYYLIDGKGLKLPIVKNK

SEQ ID NO: 1691314 - protein, 26 aa, Staphylococcus aureus
MQICPPMYYLIDGKGLRLPIVKNKNI

SEQ ID NO: 1691315 - protein, 17 aa, Staphylococcus aureus
MRDVYYVFHAAALKQVP

SEQ ID NO: 1691316 - protein, 22 aa, Staphylococcus aureus
MRLMWKEMMAILQAFRVPSVNL

SEQ ID NO: 1691317 - protein, 34 aa, Staphylococcus aureus
MSHNDDLPYAELALGAGMAFLIRRFTKKDQQTEE

SEQ ID NO: 1691318 - protein, 18 aa, Staphylococcus aureus
MSILTLLKIPDIEPYFHK

SEQ ID NO: 1691319 - protein, 35 aa, Staphylococcus aureus
MTFERKMTAMLRYQFKVILSALKRKGYNLNDDSYL

SEQ ID NO: 1691320 - protein, 17 aa, Staphylococcus aureus
MTKLLHTIIKKFGDHNL

SEQ ID NO: 1691321 - protein, 17 aa, Staphylococcus aureus
MVEQIIRPTGLLDPKIE

SEQ ID NO: 1691322 - protein, 20 aa, Staphylococcus aureus
MVQGLALPSNYLGRKMKILK

SEQ ID NO: 1691323 - protein, 19 aa, Staphylococcus aureus
MYLHLDGVLSLDLTTVLIL

SEQ ID NO: 1691324 - protein, 18 aa, Staphylococcus aureus
NAEAAINAVTPKVVKKQA

SEQ ID NO: 1691325 - protein, 21 aa, Staphylococcus aureus
NAFFLDFNFEDYIDAVLELKH

SEQ ID NO: 1691326 - protein, 24 aa, Staphylococcus aureus
NAIGTFYPFIKDDVALYGVEAAGQ

SEQ ID NO: 1691327 - protein, 18 aa, Staphylococcus aureus
NAIQKRKLQKFLVIDNNK

SEQ ID NO: 1691328 - protein, 25 aa, Staphylococcus aureus
NAKKIAETLNLLYQLTGNQNGVKVV

SEQ ID NO: 1691329 - protein, 24 aa, Staphylococcus aureus
NAKRVITPLSPISIFAARNPWEGL

SEQ ID NO: 1691330 - protein, 31 aa, Staphylococcus aureus
NALEAIREVVNKQIEIIKNADADASAKEIAR

SEQ ID NO: 1691331 - protein, 22 aa, Staphylococcus aureus
NAMHQFTIWTALATKGIGASLQ

SEQ ID NO: 1691332 - protein, 26 aa, Staphylococcus aureus
NAPNKLLLRSFSEVLTFAPFTYIDEL

SEQ ID NO: 1691333 - protein, 26 aa, Staphylococcus aureus
NAQTLNTAMKGLRDSIANEATIKAGQ

SEQ ID NO: 1691334 - protein, 18 aa, Staphylococcus aureus
NAQWVEYPEDWASEVLRE

SEQ ID NO: 1691335 - protein, 21 aa, Staphylococcus aureus
NAYDLAYYHYWQSLEISQFNN

SEQ ID NO: 1691336 - protein, 22 aa, Staphylococcus aureus
NCKKKLTLFGKGKEAVYRCVCG

SEQ ID NO: 1691337 - protein, 26 aa, Staphylococcus aureus
NDHRRIDLAVTKNLPRFIDVLATVLE

SEQ ID NO: 1691338 - protein, 18 aa, Staphylococcus aureus
NDLYTALDILKQSVYEWI

SEQ ID NO: 1691339 - protein, 27 aa, Staphylococcus aureus
NDPVSKYIPWFKTSKPIPLKDLMLHQS

SEQ ID NO: 1691340 - protein, 22 aa, Staphylococcus aureus
NEAMLTMLPITIKEKALREYYR

SEQ ID NO: 1691341 - protein, 24 aa, Staphylococcus aureus
NEEAILQMLISLKMTQLIIISHDT

SEQ ID NO: 1691342 - protein, 17 aa, Staphylococcus aureus
NELYNYHYLYPHQRYAI

SEQ ID NO: 1691343 - protein, 25 aa, Staphylococcus aureus
NENLFRKLLQHYLQLELDLGNRDLE

SEQ ID NO: 1691344 - protein, 18 aa, Staphylococcus aureus
NEYFIKKWQRELEALYHI

SEQ ID NO: 1691345 - protein, 17 aa, Staphylococcus aureus
NFIFVKTKRVNELYEAL

SEQ ID NO: 1691346 - protein, 29 aa, Staphylococcus aureus
NGARLPVPVDFLLDEWPNIGAIPDYEETL

SEQ ID NO: 1691347 - protein, 19 aa, Staphylococcus aureus
NGFGFITPYNLDDLNYYLD

SEQ ID NO: 1691348 - protein, 26 aa, Staphylococcus aureus
NGICLSLFLAKAFKKGFITFSNSYRV

SEQ ID NO: 1691349 - protein, 26 aa, Staphylococcus aureus
NGKNVTLIYFEKDGKLGFYVQKTQKE

SEQ ID NO: 1691350 - protein, 24 aa, Staphylococcus aureus
NGKQLLKKLNAFGYTEADVRQALE

SEQ ID NO: 1691351 - protein, 25 aa, Staphylococcus aureus
NGNYYFHGHIVPGWQGVKKTFDTAE

SEQ ID NO: 1691352 - protein, 17 aa, Staphylococcus aureus
NGRPTILSRSYNLYSTI

SEQ ID NO: 1691353 - protein, 18 aa, Staphylococcus aureus
NHERWLQRYDLISERNHF

SEQ ID NO: 1691354 - protein, 23 aa, Staphylococcus aureus
NHKNIIFWMGWNEEAFNIVADLK

SEQ ID NO: 1691355 - protein, 17 aa, Staphylococcus aureus
NHLGFVYQLNEDEFFVN

SEQ ID NO: 1691356 - protein, 25 aa, Staphylococcus aureus
NHLLDKFMKDLIIQILAMVSEQERN

SEQ ID NO: 1691357 - protein, 22 aa, Staphylococcus aureus
NHNTYYAGQLISLSLNKNGYIN

SEQ ID NO: 1691358 - protein, 23 aa, Staphylococcus aureus
NHSLFFKLAILYFTESGEKVRRR

SEQ ID NO: 1691359 - protein, 22 aa, Staphylococcus aureus
NIKGYTRRDSAYWRDIAFGVSE

SEQ ID NO: 1691360 - protein, 26 aa, Staphylococcus aureus
NIQTDEKMIITFIANKFRSFYSSLND

SEQ ID NO: 1691361 - protein, 17 aa, Staphylococcus aureus
NIRSNCGLGFKAFWEEE

SEQ ID NO: 1691362 - protein, 17 aa, Staphylococcus aureus
NITLMFDGDFAGSEATL

SEQ ID NO: 1691363 - protein, 17 aa, Staphylococcus aureus
NKDSILKAIKLIKVLDD

SEQ ID NO: 1691364 - protein, 22 aa, Staphylococcus aureus
NKIQYLNFYHTQLSNALFAIKF

SEQ ID NO: 1691365 - protein, 20 aa, Staphylococcus aureus
NKKDYGLYWVKSQGYDIVLE

SEQ ID NO: 1691366 - protein, 22 aa, Staphylococcus aureus
NKTIPWLYVERGFEIPSFNYVL

SEQ ID NO: 1691367 - protein, 26 aa, Staphylococcus aureus
NKYHELLDKYFLHNISFYEEDKNNER

SEQ ID NO: 1691368 - protein, 27 aa, Staphylococcus aureus
NLENALKIELAFYFTPPESWSKKKKAQ

SEQ ID NO: 1691369 - protein, 17 aa, Staphylococcus aureus
NLLAANLYTPEQFDESK

SEQ ID NO: 1691370 - protein, 28 aa, Staphylococcus aureus
NLMLRSEAPFKKALLYAPLYPIEVTSTK

SEQ ID NO: 1691371 - protein, 21 aa, Staphylococcus aureus
NLRELGFDIVRFKTGTPPRVN

SEQ ID NO: 1691372 - protein, 29 aa, Staphylococcus aureus
NLTEAYTNYAILFISGTYPGGVIEAFSLT

SEQ ID NO: 1691373 - protein, 25 aa, Staphylococcus aureus
NMKVTDFHKTPMGGYFIVGYINDDK

SEQ ID NO: 1691374 - protein, 25 aa, Staphylococcus aureus
NMLPDGHLLNILNKFADILIRQKTE

SEQ ID NO: 1691375 - protein, 25 aa, Staphylococcus aureus
NNAMDQLKQAIADHDTIVAGGNYTN

SEQ ID NO: 1691376 - protein, 23 aa, Staphylococcus aureus
NNFAKISFLSHSHWHLRSLNVQL

SEQ ID NO: 1691377 - protein, 17 aa, Staphylococcus aureus
NNGGVVLRWLRDELLAS

SEQ ID NO: 1691378 - protein, 18 aa, Staphylococcus aureus
NNHLLPYFKSMDVFKMTT

SEQ ID NO: 1691379 - protein, 26 aa, Staphylococcus aureus
NNIRDKFLIQLLYETGLRIGEVLSLR

SEQ ID NO: 1691380 - protein, 21 aa, Staphylococcus aureus
NNKDYGLYWVKSQGYDIVLEI

SEQ ID NO: 1691381 - protein, 24 aa, Staphylococcus aureus
NNKFIISSWLGTMGCGLPGAIASK

SEQ ID NO: 1691382 - protein, 24 aa, Staphylococcus aureus
NPDHPEHWLLKDYIENTDPKAGIL

SEQ ID NO: 1691383 - protein, 25 aa, Staphylococcus aureus
NPDLDFEFIHWLVSGVKGHEPVLDE

SEQ ID NO: 1691384 - protein, 18 aa, Staphylococcus aureus
NPEVKKNALEAIREVVNK

SEQ ID NO: 1691385 - protein, 22 aa, Staphylococcus aureus
NPHTIFEHCLPSFHDTETIIGK

SEQ ID NO: 1691386 - protein, 23 aa, Staphylococcus aureus
NPYIDYQDVLNWIIKMNEHYVVE

SEQ ID NO: 1691387 - protein, 26 aa, Staphylococcus aureus
NQLHHDAPIQIIPAPENLFVEYIEAD

SEQ ID NO: 1691388 - protein, 17 aa, Staphylococcus aureus
NRIELIEPLDALEFHNF

SEQ ID NO: 1691389 - protein, 31 aa, Staphylococcus aureus
NRNPKIIKKLAYFKMFPNLTETYIAPQNEYK

SEQ ID NO: 1691390 - protein, 20 aa, Staphylococcus aureus
NSALEQLKAQRINPEVKKNA

SEQ ID NO: 1691391 - protein, 18 aa, Staphylococcus aureus
NSAPLIYKTLSALYHNFH

SEQ ID NO: 1691392 - protein, 21 aa, Staphylococcus aureus
NSGVILSQLFRGFCKNIESES

SEQ ID NO: 1691393 - protein, 24 aa, Staphylococcus aureus
NSIRRVFEEFLSFKLKNSDLAQKS

SEQ ID NO: 1691394 - protein, 23 aa, Staphylococcus aureus
NSLDNLIIYALYDQSRDMITLTD

SEQ ID NO: 1691395 - protein, 25 aa, Staphylococcus aureus
NSPLTGFISILKTYMQLSKNKETII

SEQ ID NO: 1691396 - protein, 17 aa, Staphylococcus aureus
NTKRSLALFLMAEVDIS

SEQ ID NO: 1691397 - protein, 18 aa, Staphylococcus aureus
NTLMSDIVYIPYKTPILE

SEQ ID NO: 1691398 - protein, 18 aa, Staphylococcus aureus
NTQLREYTFLGKEGRFVT

SEQ ID NO: 1691399 - protein, 30 aa, Staphylococcus aureus
NTTGQSYIFAKNKLYPIPGGSIMGIPTDIK

SEQ ID NO: 1691400 - protein, 17 aa, Staphylococcus aureus
NVFVFPSLEAGNIGYKI

SEQ ID NO: 1691401 - protein, 24 aa, Staphylococcus aureus
NVGRWFAYFVKHAPRVPFIIIGKD

SEQ ID NO: 1691402 - protein, 20 aa, Staphylococcus aureus
NVHIEEDLLPLVLEKMDVTG

SEQ ID NO: 1691403 - protein, 19 aa, Staphylococcus aureus
NVIFEHCLPSFHNADTKIG

SEQ ID NO: 1691404 - protein, 20 aa, Staphylococcus aureus
NVLYDRYQLPLFIVENGFGA

SEQ ID NO: 1691405 - protein, 26 aa, Staphylococcus aureus
NVNKFSYRMLLIYSIKTKNFNPLYEI

SEQ ID NO: 1691406 - protein, 20 aa, Staphylococcus aureus
NVPLIGFTGAPFTLASYMIE

SEQ ID NO: 1691407 - protein, 23 aa, Staphylococcus aureus
NVPLKSFHVVDLSELYIAMDAMR

SEQ ID NO: 1691408 - protein, 21 aa, Staphylococcus aureus
NVPMVLLAQINLDNLPEQQEL

SEQ ID NO: 1691409 - protein, 32 aa, Staphylococcus aureus
NYAFAYTLDDGKAYAYLIFVQETWTMLHENMT

SEQ ID NO: 1691410 - protein, 17 aa, Staphylococcus aureus
NYFGDIQLSKHEVLQLA

SEQ ID NO: 1691411 - protein, 19 aa, Staphylococcus aureus
NYIILINHGDIYNINHGEN

SEQ ID NO: 1691412 - protein, 19 aa, Staphylococcus aureus
NYKHFLEKYFGLDITINRI

SEQ ID NO: 1691413 - protein, 17 aa, Staphylococcus aureus
NYRPETRHAFLAINAAR

SEQ ID NO: 1691414 - protein, 20 aa, Staphylococcus aureus
NYTPLIIKPSVIKGINYQME

SEQ ID NO: 1691415 - protein, 24 aa, Staphylococcus aureus
PDEYRYGFYVKPTLNRLNGGFFGQ

SEQ ID NO: 1691416 - protein, 24 aa, Staphylococcus aureus
PDQLKVIEIINLYQSFYENPLPLE

SEQ ID NO: 1691417 - protein, 22 aa, Staphylococcus aureus
PDQWMNTIVIDKGSKSGITSNM

SEQ ID NO: 1691418 - protein, 18 aa, Staphylococcus aureus
PDSIFVQHLLITMPQSFG

SEQ ID NO: 1691419 - protein, 17 aa, Staphylococcus aureus
PEILTSQLSIALAYGLL

SEQ ID NO: 1691420 - protein, 22 aa, Staphylococcus aureus
PELGNIIKYYLKCHWSPEQIVG

SEQ ID NO: 1691421 - protein, 26 aa, Staphylococcus aureus
PERIVKFMHRPFTKKWIVYDKNIMEM

SEQ ID NO: 1691422 - protein, 30 aa, Staphylococcus aureus
PFAENDNKFLWFLMNTDLIRNKIKGMMQGA

SEQ ID NO: 1691423 - protein, 20 aa, Staphylococcus aureus
PFKEIINKKIELGCTAMAIF

SEQ ID NO: 1691424 - protein, 18 aa, Staphylococcus aureus
PFMAIYDTDAKSDVNQTP

SEQ ID NO: 1691425 - protein, 17 aa, Staphylococcus aureus
PIEAELNHKGITKAKKD

SEQ ID NO: 1691426 - protein, 20 aa, Staphylococcus aureus
PIEWQLQVDLWLKNGKSKLL

SEQ ID NO: 1691427 - protein, 17 aa, Staphylococcus aureus
PIYLKKNPNFKFPMKQD

SEQ ID NO: 1691428 - protein, 18 aa, Staphylococcus aureus
PIYVSLSYSYPYIVCVVD

SEQ ID NO: 1691429 - protein, 23 aa, Staphylococcus aureus
PKTKGLINADFFAKAKPSLQIIN

SEQ ID NO: 1691430 - protein, 17 aa, Staphylococcus aureus
PLGHSLGAFLAQYNLIK

SEQ ID NO: 1691431 - protein, 33 aa, Staphylococcus aureus
PLGSTPYTLLDYFGDDWLIMIDESHVTLPQVRG

SEQ ID NO: 1691432 - protein, 17 aa, Staphylococcus aureus
PLKDLMLHQSGLYKYKS

SEQ ID NO: 1691433 - protein, 22 aa, Staphylococcus aureus
PLTGFISILKTYMQLSRNKETI

SEQ ID NO: 1691434 - protein, 28 aa, Staphylococcus aureus
PLVSVVTLQLISYYAALHRDLDVDKPRN

SEQ ID NO: 1691435 - protein, 17 aa, Staphylococcus aureus
PPGITKWNRKTVLGWMR

SEQ ID NO: 1691436 - protein, 26 aa, Staphylococcus aureus
PPHTPIAKYRFPERNRIISGLSKGVL

SEQ ID NO: 1691437 - protein, 19 aa, Staphylococcus aureus
PQLAYLTVSPQLYHDKEHP

SEQ ID NO: 1691438 - protein, 19 aa, Staphylococcus aureus
PRGVLRKFEMSRIAFREHA

SEQ ID NO: 1691439 - protein, 18 aa, Staphylococcus aureus
PRKSLGYRTPLEVFMSFI

SEQ ID NO: 1691440 - protein, 20 aa, Staphylococcus aureus
PSDPMQALRLMFEATEETKQ

SEQ ID NO: 1691441 - protein, 30 aa, Staphylococcus aureus
PSPDCLMLFQHHNLLPWKTINDNIRIGFRQ

SEQ ID NO: 1691442 - protein, 23 aa, Staphylococcus aureus
PTEKAPKLLLKGSGDLKGSSVGY

SEQ ID NO: 1691443 - protein, 17 aa, Staphylococcus aureus
PTQMLISAKIFGKTAHA

SEQ ID NO: 1691444 - protein, 25 aa, Staphylococcus aureus
PTVKAVFNYYLQGYGYKKIAQYLEA

SEQ ID NO: 1691445 - protein, 24 aa, Staphylococcus aureus
PVSHVLVNGIRYKIVDTRIYRHET

SEQ ID NO: 1691446 - protein, 17 aa, Staphylococcus aureus
PVTKEFLNYTYSQFFEE

SEQ ID NO: 1691447 - protein, 21 aa, Staphylococcus aureus
PYDAVFPLLHGPNGEDGTIQG

SEQ ID NO: 1691448 - protein, 26 aa, Staphylococcus aureus
QAIVKIETLFPYITLSHFGINIDESE

SEQ ID NO: 1691449 - protein, 19 aa, Staphylococcus aureus
QAKFVFYDTQLKQNFVSIA

SEQ ID NO: 1691450 - protein, 19 aa, Staphylococcus aureus
QALKDRINQILQQGHNGIN

SEQ ID NO: 1691451 - protein, 20 aa, Staphylococcus aureus
QARIRLYIPLNERISADDYR

SEQ ID NO: 1691452 - protein, 33 aa, Staphylococcus aureus
QDADLLIMVGTNYPYVDYLPKKNIKAIQIDTNP

SEQ ID NO: 1691453 - protein, 24 aa, Staphylococcus aureus
QDEQNIIINFYKGKTIKDVIEDIQ

SEQ ID NO: 1691454 - protein, 19 aa, Staphylococcus aureus
QEINRLLVLNNIDVFQMRV

SEQ ID NO: 1691455 - protein, 17 aa, Staphylococcus aureus
QEKYDLFVLVVTDIINS

SEQ ID NO: 1691456 - protein, 18 aa, Staphylococcus aureus
QELLNNVNYFGTMLVYAG

SEQ ID NO: 1691457 - protein, 17 aa, Staphylococcus aureus
QEYFMKHLLGTKSGLLA

SEQ ID NO: 1691458 - protein, 30 aa, Staphylococcus aureus
QFKCHIDTIIKKQVPVCCFTFGIPNESIIE

SEQ ID NO: 1691459 - protein, 26 aa, Staphylococcus aureus
QFKCHIDTIIKKQVPVCCFTFGIQNE

SEQ ID NO: 1691460 - protein, 26 aa, Staphylococcus aureus
QGIFKKPVITPIKPYKNFYPAEDYHQ

SEQ ID NO: 1691461 - protein, 27 aa, Staphylococcus aureus
QHNNPFHMSPYFGYAARLLATSGIDYT

SEQ ID NO: 1691462 - protein, 20 aa, Staphylococcus aureus
QHTLGDDFVAAKPAAICGCT

SEQ ID NO: 1691463 - protein, 24 aa, Staphylococcus aureus
QIGRKTFYLHYIDKYDLLDQIVSE

SEQ ID NO: 1691464 - protein, 25 aa, Staphylococcus aureus
QIIEATLDWTFYNDIPLSYKTSDLL

SEQ ID NO: 1691465 - protein, 19 aa, Staphylococcus aureus
QIKIRYIEQFGLSNSLKRK

SEQ ID NO: 1691466 - protein, 21 aa, Staphylococcus aureus
QINRLKLFKQHGISSKCVYVK

SEQ ID NO: 1691467 - protein, 18 aa, Staphylococcus aureus
QKAIQTQIAIQTRIATQT

SEQ ID NO: 1691468 - protein, 17 aa, Staphylococcus aureus
QKAITLKAAFELGERMG

SEQ ID NO: 1691469 - protein, 17 aa, Staphylococcus aureus
QKDALTRSIDGATTVAG

SEQ ID NO: 1691470 - protein, 25 aa, Staphylococcus aureus
QKEAKFENGVITRKADEKTTNNTAV

SEQ ID NO: 1691471 - protein, 17 aa, Staphylococcus aureus
QKLFGQKIHVFDIRKHE

SEQ ID NO: 1691472 - protein, 24 aa, Staphylococcus aureus
QKRREKLLHGMWQFPMFESEHARR

SEQ ID NO: 1691473 - protein, 18 aa, Staphylococcus aureus
QKYQFLDLSKYQGIDKNR

SEQ ID NO: 1691474 - protein, 18 aa, Staphylococcus aureus
QLEDWLDYEITTLPYDMT

SEQ ID NO: 1691475 - protein, 23 aa, Staphylococcus aureus
QLPEIKYYPISSGKLRRYISLEN

SEQ ID NO: 1691476 - protein, 28 aa, Staphylococcus aureus
QLPQSEHFLPSQTNFIFVKTKRVNELYE

SEQ ID NO: 1691477 - protein, 21 aa, Staphylococcus aureus
QLVDYLTIKPCETFNLEYGTL

SEQ ID NO: 1691478 - protein, 20 aa, Staphylococcus aureus
QMPKLNLENALKIELEFYFS

SEQ ID NO: 1691479 - protein, 38 aa, Staphylococcus aureus; identical to SEQ ID NO: 1591395

SEQ ID NO: 1691480 - protein, 17 aa, Staphylococcus aureus
QNFNNLIDEKIEQNYTG

SEQ ID NO: 1691481 - protein, 19 aa, Staphylococcus aureus
QNITLAKHFQYIYEANRTH

SEQ ID NO: 1691482 - protein, 23 aa, Staphylococcus aureus
QNKVQPCYLLTKKGCDIVANKMT

SEQ ID NO: 1691483 - protein, 25 aa, Staphylococcus aureus
QNRLKFQILELLHQTFPGLERLFSS

SEQ ID NO: 1691484 - protein, 33 aa, Staphylococcus aureus
QNSEIYKFKYMNSWCLEYSEFLLDEVRLLKENK

SEQ ID NO: 1691485 - protein, 17 aa, Staphylococcus aureus
QNYAEVQLRLDNHSKKL

SEQ ID NO: 1691486 - protein, 20 aa, Staphylococcus aureus
QPIEFIRLVPTLQKHRDEVL

SEQ ID NO: 1691487 - protein, 22 aa, Staphylococcus aureus
QPIKLKIVLIHSKLGRTMSLSK

SEQ ID NO: 1691488 - protein, 21 aa, Staphylococcus aureus
QPKGRKFKDFTSKFNIASEAK

SEQ ID NO: 1691489 - protein, 23 aa, Staphylococcus aureus
QPSDTRAFIKRGLLQFSDGNGFQ

SEQ ID NO: 1691490 - protein, 20 aa, Staphylococcus aureus
QRLLDFVLSLIGQPQLILLD

SEQ ID NO: 1691491 - protein, 26 aa, Staphylococcus aureus
QSAAYLNIFSFLWDEITKDRTTETVL

SEQ ID NO: 1691492 - protein, 20 aa, Staphylococcus aureus
QSKFINRSFKENGQWYKLEK

SEQ ID NO: 1691493 - protein, 33 aa, Staphylococcus aureus
QSLVIVIRSVFKYAFKYYDLHDISVLDKIDIPK

SEQ ID NO: 1691494 - protein, 23 aa, Staphylococcus aureus
QTPDLTMAYPIYINAMTGGSEWT

SEQ ID NO: 1691495 - protein, 21 aa, Staphylococcus aureus
QTPDLTMAYPVYINAMTGGSE

SEQ ID NO: 1691496 - protein, 34 aa, Staphylococcus aureus
QTQTVTQIQIAIQTQIVIQIQKATQIQKAIQTQI

SEQ ID NO: 1691497 - protein, 25 aa, Staphylococcus aureus
QTTNAEIATVKNSALEQLKAQRINP

SEQ ID NO: 1691498 - protein, 42 aa, Staphylococcus aureus
QTTNAEIATVKNSALEQLKAQRINPVVKKNALEAIREVVNKQ

SEQ ID NO: 1691499 - protein, 23 aa, Staphylococcus aureus
QVCNFYPERIILLGHGENSIYLI

SEQ ID NO: 1691500 - protein, 18 aa, Staphylococcus aureus
QVMMRGFLVSEFANAFKE

SEQ ID NO: 1691501 - protein, 18 aa, Staphylococcus aureus
QWHVSRTTIYRYLNKLED

SEQ ID NO: 1691502 - protein, 19 aa, Staphylococcus aureus
QYHQLNYVNYFDHKRRKVK

SEQ ID NO: 1691503 - protein, 21 aa, Staphylococcus aureus
QYTKHGIIRLVFKYRHNTLQR

SEQ ID NO: 1691504 - protein, 20 aa, Staphylococcus aureus
QYYRETGIYAERTAPWLRRL

SEQ ID NO: 1691505 - protein, 25 aa, Staphylococcus aureus
RAARLQPLLIYITTAGYQLDGPLVN

SEQ ID NO: 1691506 - protein, 24 aa, Staphylococcus aureus
RAGLKAIVVIPEGKIALGKLSQAV

SEQ ID NO: 1691507 - protein, 26 aa, Staphylococcus aureus
RARELSDWLVGINLSRHFTKISRELG

SEQ ID NO: 1691508 - protein, 26 aa, Staphylococcus aureus
RARRDIEMLLGSKVYLELWVKVQRDW

SEQ ID NO: 1691509 - protein, 28 aa, Staphylococcus aureus
RARRRESIFMTYILKHHPRFKDKDVPVW

SEQ ID NO: 1691510 - protein, 26 aa, Staphylococcus aureus
RATLKRLPLYYRFVSSLKSKGIDRVN

SEQ ID NO: 1691511 - protein, 21 aa, Staphylococcus aureus
RDLLAISIARLEALGFKIVGH

SEQ ID NO: 1691512 - protein, 20 aa, Staphylococcus aureus
RDYIDAFKIFIHHVALHVSH

SEQ ID NO: 1691513 - protein, 25 aa, Staphylococcus aureus
READFINCVTFRKQAENVNNYLSKG

SEQ ID NO: 1691514 - protein, 18 aa, Staphylococcus aureus
REFRKEILQAMRVGVGAP

SEQ ID NO: 1691515 - protein, 27 aa, Staphylococcus aureus
REIYELWRQTLIQVGINRPTYKRFLIQ

SEQ ID NO: 1691516 - protein, 17 aa, Staphylococcus aureus
RELGFVLMALNIRKIVA

SEQ ID NO: 1691517 - protein, 19 aa, Staphylococcus aureus
REMLGKYHKLFTDKHDING

SEQ ID NO: 1691518 - protein, 20 aa, Staphylococcus aureus
RENIKKWFGNAWDGVKTKTG

SEQ ID NO: 1691519 - protein, 29 aa, Staphylococcus aureus
RFVDGKRSLLFGPFAGFSPKFLKTGSHMD

SEQ ID NO: 1691520 - protein, 17 aa, Staphylococcus aureus
RGELVSCFLLEVDDSLN

SEQ ID NO: 1691521 - protein, 17 aa, Staphylococcus aureus
RGKIYRHLSASLATSKQ

SEQ ID NO: 1691522 - protein, 24 aa, Staphylococcus aureus
RGNKKARKLLFWVIMNIIRGQHHY

SEQ ID NO: 1691523 - protein, 20 aa, Staphylococcus aureus
RGQFINMDYLDDIRVNIVYE

SEQ ID NO: 1691524 - protein, 20 aa, Staphylococcus aureus
RHIRYLKNGGKWMFDEELAH

SEQ ID NO: 1691525 - protein, 27 aa, Staphylococcus aureus
RHLDDKASVAIILQLLKKLKEEQIILP

SEQ ID NO: 1691526 - protein, 18 aa, Staphylococcus aureus
RHNGTIINIFDDMSEKDK

SEQ ID NO: 1691527 - protein, 30 aa, Staphylococcus aureus
RHVHYYDDPMYFIRLNFPDKVSVGDKAKSV

SEQ ID NO: 1691528 - protein, 18 aa, Staphylococcus aureus
RIEEYRKRSIEQKKYESK

SEQ ID NO: 1691529 - protein, 18 aa, Staphylococcus aureus
RIGIPNKGDWTHKSLRYT

SEQ ID NO: 1691530 - protein, 28 aa, Staphylococcus aureus
RIMDLVTPIGLGQRGLIVAPPKAGKTSL

SEQ ID NO: 1691531 - protein, 17 aa, Staphylococcus aureus
RIRLYIPLNERISADDY

SEQ ID NO: 1691532 - protein, 29 aa, Staphylococcus aureus
RKEMQQEVPYPFFVIKMPESNRSKYTFDS

SEQ ID NO: 1691533 - protein, 24 aa, Staphylococcus aureus
RKMMGEYIIYYDGVVIGGLYDNRL

SEQ ID NO: 1691534 - protein, 24 aa, Staphylococcus aureus
RKSYQYDWFYHSKAWKKLREIALD

SEQ ID NO: 1691535 - protein, 23 aa, Staphylococcus aureus
RLESFIMLELQRIKGASVKLYTI

SEQ ID NO: 1691536 - protein, 18 aa, Staphylococcus aureus
RLFAEVYTIPGTECYGNA

SEQ ID NO: 1691537 - protein, 18 aa, Staphylococcus aureus
RLKALYLSVIDRIDIKKD

SEQ ID NO: 1691538 - protein, 18 aa, Staphylococcus aureus
RLLKTIHYLVMNHKLYDY

SEQ ID NO: 1691539 - protein, 17 aa, Staphylococcus aureus
RLLVLNNIDVFQMRVIE

SEQ ID NO: 1691540 - protein, 25 aa, Staphylococcus aureus
RLNIKAFQFTLFDNTFLDEGYIESI

SEQ ID NO: 1691541 - protein, 25 aa, Staphylococcus aureus
RLNNQITSIIFKYLQENGIESHFIK

SEQ ID NO: 1691542 - protein, 18 aa, Staphylococcus aureus
RLRKLNHPIPLKKYQHGF

SEQ ID NO: 1691543 - protein, 18 aa, Staphylococcus aureus
RMHRKTSLGYYLDKQFEG

SEQ ID NO: 1691544 - protein, 24 aa, Staphylococcus aureus
RMPIEVVYGFAQLKRAAAIANFDL

SEQ ID NO: 1691545 - protein, 22 aa, Staphylococcus aureus
RNKYVDIFALKDYETWRTYMLA

SEQ ID NO: 1691546 - protein, 18 aa, Staphylococcus aureus
RNLGLKRILPTKKGKGSV

SEQ ID NO: 1691547 - protein, 20 aa, Staphylococcus aureus
RQNYYMYKKFGVIPEMEYEM

SEQ ID NO: 1691548 - protein, 17 aa, Staphylococcus aureus
RRFFKIYVRGIRALANF

SEQ ID NO: 1691549 - protein, 29 aa, Staphylococcus aureus
RRGESFISNPLLIYMEPYASSTAELVTEL

SEQ ID NO: 1691550 - protein, 24 aa, Staphylococcus aureus
RRREKIIRIFPNQTSANRLIGAVL

SEQ ID NO: 1691551 - protein, 29 aa, Staphylococcus aureus
RRVHYYDNPMYFIRLNFPNNLSVGNKAKG

SEQ ID NO: 1691552 - protein, 21 aa, Staphylococcus aureus
RSIDHILKVYGAYIDKKEITQ

SEQ ID NO: 1691553 - protein, 25 aa, Staphylococcus aureus
RTADRAIVFMLLSDEEEWGKLHRNS

SEQ ID NO: 1691554 - protein, 18 aa, Staphylococcus aureus
RTLEVDGEPYFIGKDVAD

SEQ ID NO: 1691555 - protein, 24 aa, Staphylococcus aureus
RTTVTRWRKGIRSPKLDKLPEIAN

SEQ ID NO: 1691556 - protein, 18 aa, Staphylococcus aureus
RVSWLEKWQRLEKKGRKE

SEQ ID NO: 1691557 - protein, 18 aa, Staphylococcus aureus
RWVTSDVLPAIRKHGIYA

SEQ ID NO: 1691558 - protein, 17 aa, Staphylococcus aureus
RYDKWFERMTEYGFENG

SEQ ID NO: 1691559 - protein, 17 aa, Staphylococcus aureus
RYIFDDRGYLSAIRYFD

SEQ ID NO: 1691560 - protein, 19 aa, Staphylococcus aureus
SADDLCDYFKEKQIKHVYV

SEQ ID NO: 1691561 - protein, 24 aa, Staphylococcus aureus
SAEWEFMNIIWMKKYASANNIIEE

SEQ ID NO: 1691562 - protein, 23 aa, Staphylococcus aureus
SAEWEVMNIIWMKKYASANNIIE

SEQ ID NO: 1691563 - protein, 22 aa, Staphylococcus aureus
SAHGGYLIKVLNNWAKENVKTK

SEQ ID NO: 1691564 - protein, 32 aa, Staphylococcus aureus
SAKEIARTDLGRYFDRFADKLDKTQTNTEVAE

SEQ ID NO: 1691565 - protein, 24 aa, Staphylococcus aureus
SAPPEELIPQFDYVKEISEQFGFV

SEQ ID NO: 1691566 - protein, 27 aa, Staphylococcus aureus
SDEKKPHIMPVWSIKNRALKVRDEDFE

SEQ ID NO: 1691567 - protein, 24 aa, Staphylococcus aureus
SDHAYLPIYAIQNHLCDYGIAGEV

SEQ ID NO: 1691568 - protein, 18 aa, Staphylococcus aureus
SDLKYHLRRENEQSYDAF

SEQ ID NO: 1691569 - protein, 18 aa, Staphylococcus aureus
SDSLLRDIKVLSSNAKGD

SEQ ID NO: 1691570 - protein, 34 aa, Staphylococcus aureus
SDTAVMIAWLVKIPHRIMPILGTSQLKRIDQAIE

SEQ ID NO: 1691571 - protein, 23 aa, Staphylococcus aureus
SEFKLQMVRLYENGKPRNEIIRE

SEQ ID NO: 1691572 - protein, 28 aa, Staphylococcus aureus
SEGEKNLIAFLFFYFELFEDEKQETIKS

SEQ ID NO: 1691573 - protein, 23 aa, Staphylococcus aureus
SEIKAIYTDTFDFTKKAPLYMTY

SEQ ID NO: 1691574 - protein, 20 aa, Staphylococcus aureus
SELANPFMAIYDTDAKSDVN

SEQ ID NO: 1691575 - protein, 27 aa, Staphylococcus aureus
SELGGKMRIYPEKIIWDIGGIAPKPCH

SEQ ID NO: 1691576 - protein, 17 aa, Staphylococcus aureus
SELQLLDTKKMLVIAPK

SEQ ID NO: 1691577 - protein, 30 aa, Staphylococcus aureus
SEYTYFKEGLVLFTYLHLANEEKLTQALID

SEQ ID NO: 1691578 - protein, 23 aa, Staphylococcus aureus
SFDLSVMAIYPCLASGGTLNLVD

SEQ ID NO: 1691579 - protein, 18 aa, Staphylococcus aureus
SFKSFSKPKWSKLVNKLS

SEQ ID NO: 1691580 - protein, 28 aa, Staphylococcus aureus
SGIAIGVSNFYYAPILKDTEKEWETGAG

SEQ ID NO: 1691581 - protein, 22 aa, Staphylococcus aureus
SGKQRPWREKKIDNVRFCCKVK

SEQ ID NO: 1691582 - protein, 18 aa, Staphylococcus aureus
SGLPIHEWLMLKQFSKYK

SEQ ID NO: 1691583 - protein, 18 aa, Staphylococcus aureus
SGLSYHVLTMLRVAKSIC

SEQ ID NO: 1691584 - protein, 19 aa, Staphylococcus aureus
SGLYSLIFSSKLESAKRFK

SEQ ID NO: 1691585 - protein, 19 aa, Staphylococcus aureus
SHQCGDLIPETIPIGKPLS

SEQ ID NO: 1691586 - protein, 18 aa, Staphylococcus aureus
SIAYETVQLPDRSSPLLS

SEQ ID NO: 1691587 - protein, 17 aa, Staphylococcus aureus
SIFGGIVALNRAVTPEL

SEQ ID NO: 1691588 - protein, 24 aa, Staphylococcus aureus
SIISRYAFVTYMDQISKNINMTIP

SEQ ID NO: 1691589 - protein, 35 aa, Staphylococcus aureus
SIMAELEALYPPSYSSYIDFLYTCRQKIKVLDMNH

SEQ ID NO: 1691590 - protein, 19 aa, Staphylococcus aureus
SIPLYEESYILLAPKETFK

SEQ ID NO: 1691591 - protein, 17 aa, Staphylococcus aureus
SIPYVIDPVMLAKSGDS

SEQ ID NO: 1691592 - protein, 25 aa, Staphylococcus aureus
SISIPFDTDYGWNVKLGKNVFVNTN

SEQ ID NO: 1691593 - protein, 23 aa, Staphylococcus aureus
SISLDLMYHLPKQTIEDFEQSLD

SEQ ID NO: 1691594 - protein, 20 aa, Staphylococcus aureus
SKCYTFIKGYGDFDGQQTFA

SEQ ID NO: 1691595 - protein, 21 aa, Staphylococcus aureus
SKFDLFKKYANSELILTKSAI

SEQ ID NO: 1691596 - protein, 23 aa, Staphylococcus aureus
SKWTRQKAFEEYEWLKNVAKNDI

SEQ ID NO: 1691597 - protein, 24 aa, Staphylococcus aureus
SKWTRQKAFEEYEWLKNVAKNDIE

SEQ ID NO: 1691598 - protein, 18 aa, Staphylococcus aureus
SLIHMRCNRIFGVDKDQE

SEQ ID NO: 1691599 - protein, 21 aa, Staphylococcus aureus
SLKPIVILTPVGNGRVIHPTF

SEQ ID NO: 1691600 - protein, 32 aa, Staphylococcus aureus
SLLNEDKVEWIILAGYMRLIGPDLLASFEGKI

SEQ ID NO: 1691601 - protein, 22 aa, Staphylococcus aureus
SMAEWDVMNIIWNKKSVSANEI

SEQ ID NO: 1691602 - protein, 23 aa, Staphylococcus aureus
SMYIFKKDLLPKMYWYGMLKGLI

SEQ ID NO: 1691603 - protein, 23 aa, Staphylococcus aureus
SNNEWQCPLTIRAPFGGGVHGGL

SEQ ID NO: 1691604 - protein, 19 aa, Staphylococcus aureus
SNVAWFWHTSFSHTTEQAR

SEQ ID NO: 1691605 - protein, 23 aa, Staphylococcus aureus
SPFNDKIPYIKEPKLTKQNIEQA

SEQ ID NO: 1691606 - protein, 27 aa, Staphylococcus aureus
SPIFQNEKLFKVFAYCLMKASHKDHTQ

SEQ ID NO: 1691607 - protein, 30 aa, Staphylococcus aureus
SPIRRYPDLTVHRLIRKYLIEKSMDNKEVK

SEQ ID NO: 1691608 - protein, 17 aa, Staphylococcus aureus
SQEINVVATLRLLETIK

SEQ ID NO: 1691609 - protein, 18 aa, Staphylococcus aureus
SQIKWLKSHDAKFLTLKE

SEQ ID NO: 1691610 - protein, 21 aa, Staphylococcus aureus
SQQQWLSGFLLANSNDTTSDS

SEQ ID NO: 1691611 - protein, 18 aa, Staphylococcus aureus
SRFKTGMTLQKNPLTLLV

SEQ ID NO: 1691612 - protein, 21 aa, Staphylococcus aureus
SSLINALLGEQILVSSPNPTT

SEQ ID NO: 1691613 - protein, 24 aa, Staphylococcus aureus
STDQIKFVYFLVNGCILHESSNIT

SEQ ID NO: 1691614 - protein, 18 aa, Staphylococcus aureus
STIYKPLLGEDCRRTMDI

SEQ ID NO: 1691615 - protein, 18 aa, Staphylococcus aureus
STNFLINYGYFDITPKNN

SEQ ID NO: 1691616 - protein, 23 aa, Staphylococcus aureus
SVDSIYPFSWIEKKSHIETGENY

SEQ ID NO: 1691617 - protein, 26 aa, Staphylococcus aureus
SVFVPKIITSTYLYHDFDFATEVIDT

SEQ ID NO: 1691618 - protein, 19 aa, Staphylococcus aureus
SVLIELGLIVGKDARRRRE

SEQ ID NO: 1691619 - protein, 22 aa, Staphylococcus aureus
SVSYKKGLLFGEIIIHHGSSSI

SEQ ID NO: 1691620 - protein, 20 aa, Staphylococcus aureus
SVYTSYAYYQLCEEKGIIRS

SEQ ID NO: 1691621 - protein, 21 aa, Staphylococcus aureus
SYPVNFVAGTIGDFFKKGDSK

SEQ ID NO: 1691622 - protein, 23 aa, Staphylococcus aureus
SYRNEYFYKNTMLNKLLLGRHSV

SEQ ID NO: 1691623 - protein, 24 aa, Staphylococcus aureus
SYSYHLGMMFQIKDDLLDCYGDEA

SEQ ID NO: 1691624 - protein, 21 aa, Staphylococcus aureus
SYVAHAWFNKENLTFIMDDDM

SEQ ID NO: 1691625 - protein, 31 aa, Staphylococcus aureus
TAITGSGPAFLYHVFEQYVKAGTKLGLEKEQ

SEQ ID NO: 1691626 - protein, 22 aa, Staphylococcus aureus
TAKNDIFKFEKELKRLGINATI

SEQ ID NO: 1691627 - protein, 19 aa, Staphylococcus aureus
TALMFNKINFYLHGSDVIL

SEQ ID NO: 1691628 - protein, 27 aa, Staphylococcus aureus
TAMYISRLVKPIGIKVTRLAQGLSVGG

SEQ ID NO: 1691629 - protein, 23 aa, Staphylococcus aureus
TAQAMFIYELRGDGNINLNVHKY

SEQ ID NO: 1691630 - protein, 31 aa, Staphylococcus aureus
TASPLDTEILWKMHFGLYPTPIKRLQNYLLT

SEQ ID NO: 1691631 - protein, 18 aa, Staphylococcus aureus
TDNLLQRQFKASCPMEVL

SEQ ID NO: 1691632 - protein, 36 aa, Staphylococcus aureus
TEDVEKALAMKAPLGIFSHQLQRFIHLVWDVRDVIN

SEQ ID NO: 1691633 - protein, 26 aa, Staphylococcus aureus
TEEKEAFTNALEDILSKATEDISDQT

SEQ ID NO: 1691634 - protein, 17 aa, Staphylococcus aureus
TEGLLKEQFYTKGKYKD

SEQ ID NO: 1691635 - protein, 18 aa, Staphylococcus aureus
TEHASVIYKLALKKLDKK

SEQ ID NO: 1691636 - protein, 18 aa, Staphylococcus aureus
TEHEDCLYLNIWKQHNDQ

SEQ ID NO: 1691637 - protein, 22 aa, Staphylococcus aureus
TEMKMFEFKQDVKLFGANVILS

SEQ ID NO: 1691638 - protein, 27 aa, Staphylococcus aureus
TEVAELQNVTIPAIEAIVPQNDPDAND

SEQ ID NO: 1691639 - protein, 17 aa, Staphylococcus aureus
TEVIMHLIRRSKAPTFE

SEQ ID NO: 1691640 - protein, 18 aa, Staphylococcus aureus
TFGSFRPWPAYQYTIEHS

SEQ ID NO: 1691641 - protein, 23 aa, Staphylococcus aureus
TGFCLWCQLAFSTYLENAAQPHL

SEQ ID NO: 1691642 - protein, 29 aa, Staphylococcus aureus
TGIYAERTAPWLRRLGFENVKEVLLNPER

SEQ ID NO: 1691643 - protein, 17 aa, Staphylococcus aureus
TGKGQQYFVNKFLGEKQ

SEQ ID NO: 1691644 - protein, 18 aa, Staphylococcus aureus
TGMRAGELLALKWSDIDF

SEQ ID NO: 1691645 - protein, 19 aa, Staphylococcus aureus
TGVEFFNTVFKGTSYKYVL

SEQ ID NO: 1691646 - protein, 18 aa, Staphylococcus aureus
THQLKQLDIVYYFSNVTV

SEQ ID NO: 1691647 - protein, 18 aa, Staphylococcus aureus
THVEALLKKGIKTIMLGG

SEQ ID NO: 1691648 - protein, 20 aa, Staphylococcus aureus
TIHWQFGHVLTIFESALAVT

SEQ ID NO: 1691649 - protein, 18 aa, Staphylococcus aureus
TIKRLWLTSKVESSIRKA

SEQ ID NO: 1691650 - protein, 21 aa, Staphylococcus aureus
TINGLQHLTTAQKDKLKQQVQ

SEQ ID NO: 1691651 - protein, 28 aa, Staphylococcus aureus
TINKPYLLEAPFWTVDTLFYCTPKKETD

SEQ ID NO: 1691652 - protein, 29 aa, Staphylococcus aureus
TINLTEPYTNYSILLVSGTYPGGVIEGFG

SEQ ID NO: 1691653 - protein, 18 aa, Staphylococcus aureus
TIPKKLLEKSIPPTVVKA

SEQ ID NO: 1691654 - protein, 25 aa, Staphylococcus aureus
TIYENAYPILKKYKIPATGFIITGH

SEQ ID NO: 1691655 - protein, 25 aa, Staphylococcus aureus
TKARAYLPRILVEKLLIKIDDMLKE

SEQ ID NO: 1691656 - protein, 26 aa, Staphylococcus aureus
TKEFLNYTYSQFFEEMKPMIAEAFYK

SEQ ID NO: 1691657 - protein, 30 aa, Staphylococcus aureus
TLALNNATLPYALMLANKGYREAFKSNQPL

SEQ ID NO: 1691658 - protein, 22 aa, Staphylococcus aureus
TLDQAMNQLRQSIASKDATKSS

SEQ ID NO: 1691659 - protein, 19 aa, Staphylococcus aureus
TLFIITHNLSHVLKYCQYI

SEQ ID NO: 1691660 - protein, 26 aa, Staphylococcus aureus
TLIYVFEIIDGWCRIYWNNHNEWICY

SEQ ID NO: 1691661 - protein, 17 aa, Staphylococcus aureus
TLRILHFVSGDGGKLKI

SEQ ID NO: 1691662 - protein, 19 aa, Staphylococcus aureus
TMICALAQHNYELAGKLMQ

SEQ ID NO: 1691663 - protein, 22 aa, Staphylococcus aureus
TMYHSPIRLLVVVQAPDYVVAR

SEQ ID NO: 1691664 - protein, 18 aa, Staphylococcus aureus
TNIDFMSDYYFYLTEIGQ

SEQ ID NO: 1691665 - protein, 20 aa, Staphylococcus aureus
TNLALNYLKLMNQKTYMVFM

SEQ ID NO: 1691666 - protein, 24 aa, Staphylococcus aureus
TNQTHIEIIYLKSCDLTTILHNLY

SEQ ID NO: 1691667 - protein, 17 aa, Staphylococcus aureus
TPVFLVLNKIDLVHPDE

SEQ ID NO: 1691668 - protein, 38 aa, Staphylococcus aureus
TQDTQNALDFPLPKAFRDAGWFFDVLPGHYNGALRQVL

SEQ ID NO: 1691669 - protein, 25 aa, Staphylococcus aureus
TQQTFEHIFPYDIASTTTPLLRERS

SEQ ID NO: 1691670 - protein, 18 aa, Staphylococcus aureus
TRHLLKKYQERFYTYPAA

SEQ ID NO: 1691671 - protein, 29 aa, Staphylococcus aureus
TRMVKLALELYNSPWIAWYHQQMQDKKAK

SEQ ID NO: 1691672 - protein, 20 aa, Staphylococcus aureus
TRVGYKFVDGKKVRIAKKSG

SEQ ID NO: 1691673 - protein, 23 aa, Staphylococcus aureus
TSFDMYALCDSFKKYNLPLPSNQ

SEQ ID NO: 1691674 - protein, 23 aa, Staphylococcus aureus
TSIPTCILVFKKCCQQDDNVLFI

SEQ ID NO: 1691675 - protein, 26 aa, Staphylococcus aureus
TSLFTGKLGLCYIGLRLLNPKTIDSV

SEQ ID NO: 1691676 - protein, 29 aa, Staphylococcus aureus
TSYHPKMMLKIILYAYTQSVFSGRRIEKL

SEQ ID NO: 1691677 - protein, 28 aa, Staphylococcus aureus
TTARSLLSKLLVRATKKWPTDKSFNNHL

SEQ ID NO: 1691678 - protein, 28 aa, Staphylococcus aureus
TTEEKEAFTNALEDILSKATEDISDQTT

SEQ ID NO: 1691679 - protein, 26 aa, Staphylococcus aureus
TTNENIKALYFYQKNKYRITDVIFDA

SEQ ID NO: 1691680 - protein, 20 aa, Staphylococcus aureus
TTNHPLLADLGIKNAGLRLK

SEQ ID NO: 1691681 - protein, 23 aa, Staphylococcus aureus
TTRRDFIPGVFEENVRRVKALES

SEQ ID NO: 1691682 - protein, 18 aa, Staphylococcus aureus
TVRDYIKLLENLGTIVVK

SEQ ID NO: 1691683 - protein, 28 aa, Staphylococcus aureus
TVTLKTLGLIIVMAQSGLLIPTLDGSQL

SEQ ID NO: 1691684 - protein, 23 aa, Staphylococcus aureus
TVWSTRYLNLGVNNKFIISSWLG

SEQ ID NO: 1691685 - protein, 25 aa, Staphylococcus aureus
TWGEKGVFDYRRSLLRTDVVLNSED

SEQ ID NO: 1691686 - protein, 27 aa, Staphylococcus aureus
TWNSQKFFDLIKYFELPRQTKIKTFSR

SEQ ID NO: 1691687 - protein, 21 aa, Staphylococcus aureus
TYKKFLIQLKGRKFAHRTKSM

SEQ ID NO: 1691688 - protein, 22 aa, Staphylococcus aureus
TYNFKNGIIATGSRPIEIPNFK

SEQ ID NO: 1691689 - protein, 21 aa, Staphylococcus aureus
TYYFHGHIVPGWQGVKKTFDT

SEQ ID NO: 1691690 - protein, 29 aa, Staphylococcus aureus
VAATAPFTPFYRALNWIVTDPLESIKEEI

SEQ ID NO: 1691691 - protein, 26 aa, Staphylococcus aureus
VADELYHLFVLMHALGVDFSEIEAEL

SEQ ID NO: 1691692 - protein, 28 aa, Staphylococcus aureus
VAEQVMGQLDFLIAKARYSRSVKGTKPI

SEQ ID NO: 1691693 - protein, 17 aa, Staphylococcus aureus
VAIRSMLIKKAQATLFA

SEQ ID NO: 1691694 - protein, 24 aa, Staphylococcus aureus
VANDKEFYIFDSLIQGRSFKDISN

SEQ ID NO: 1691695 - protein, 17 aa, Staphylococcus aureus
VDEILAIKLPAEATKVS

SEQ ID NO: 1691696 - protein, 21 aa, Staphylococcus aureus
VDYFELLHILEFKKAERVKDC

SEQ ID NO: 1691697 - protein, 17 aa, Staphylococcus aureus
VEDDFVFHPVLFDVVES

SEQ ID NO: 1691698 - protein, 24 aa, Staphylococcus aureus
VEDNRLTLVSLNKKYKDLHFYDNE

SEQ ID NO: 1691699 - protein, 18 aa, Staphylococcus aureus
VEMLLPLHHLMEAGFDVD

SEQ ID NO: 1691700 - protein, 28 aa, Staphylococcus aureus
VFDDLWMDLYDLFKNLRNLFKEEGLEPW

SEQ ID NO: 1691701 - protein, 19 aa, Staphylococcus aureus
VFKNVAMPLILSKKSKTEI

SEQ ID NO: 1691702 - protein, 36 aa, Staphylococcus aureus
VFTDVNGYPLVIKKLQLWIKAILKKTNITNKQISTH

SEQ ID NO: 1691703 - protein, 17 aa, Staphylococcus aureus
VGAFFRARLGNEVLENL

SEQ ID NO: 1691704 - protein, 26 aa, Staphylococcus aureus
VGLRKTIIYVMLPVLGNTVQSLSSLF

SEQ ID NO: 1691705 - protein, 17 aa, Staphylococcus aureus
VHFVFDLSLMEIRTIYR

SEQ ID NO: 1691706 - protein, 28 aa, Staphylococcus aureus
VIKEKPKARWLFLTLSTKNAIDGDTLEQ

SEQ ID NO: 1691707 - protein, 26 aa, Staphylococcus aureus
VILSNIIIYAIYDVIRKYWSGTGDRK

SEQ ID NO: 1691708 - protein, 18 aa, Staphylococcus aureus
VKLFTDIDLNDDEVISIF

SEQ ID NO: 1691709 - protein, 29 aa, Staphylococcus aureus
VKLQFKSKDWYWNAYFEGPIKLHKEFTIP

SEQ ID NO: 1691710 - protein, 23 aa, Staphylococcus aureus
VKQYILNLIMQNKLEYGDQLPSN

SEQ ID NO: 1691711 - protein, 17 aa, Staphylococcus aureus
VKVIIETVLLDHDEIVK

SEQ ID NO: 1691712 - protein, 20 aa, Staphylococcus aureus
VLCKDFIIDPLQIDVAKQAG

SEQ ID NO: 1691713 - protein, 18 aa, Staphylococcus aureus
VLVPKKIKDAFLAELKEQ

SEQ ID NO: 1691714 - protein, 35 aa, Staphylococcus aureus
VLVTTPHQVFLNWFGQDPAFDYFKTMDSTTVATVV

SEQ ID NO: 1691715 - protein, 17 aa, Staphylococcus aureus
VLYQIWKKKHKKAYYKW

SEQ ID NO: 1691716 - protein, 25 aa, Staphylococcus aureus
VMDDRQCVAFFTLHRGKGVAPFSDN

SEQ ID NO: 1691717 - protein, 27 aa, Staphylococcus aureus
VMKQLFEHRGLPQLPYISFLRSEYEKY

SEQ ID NO: 1691718 - protein, 23 aa, Staphylococcus aureus
VMQRLKFHYYFIDIENSKTATHL

SEQ ID NO: 1691719 - protein, 27 aa, Staphylococcus aureus
VNAAKALAFAYDKPLIPVHHIAGHIYA

SEQ ID NO: 1691720 - protein, 24 aa, Staphylococcus aureus
VNCVAPGPFWSPLQISGGQPQSKI

SEQ ID NO: 1691721 - protein, 22 aa, Staphylococcus aureus
VNDTILYLQQLHINLDDIEIQK

SEQ ID NO: 1691722 - protein, 17 aa, Staphylococcus aureus
VNFSGKFYNFVEYGVDK

SEQ ID NO: 1691723 - protein, 18 aa, Staphylococcus aureus
VNITRLRKKLQKLGLTDF

SEQ ID NO: 1691724 - protein, 27 aa, Staphylococcus aureus
VNNWSYEALVKIFYRYGEEKFSKQIAR

SEQ ID NO: 1691725 - protein, 21 aa, Staphylococcus aureus
VNVGTFTLAVNRTFTNAQGER

SEQ ID NO: 1691726 - protein, 25 aa, Staphylococcus aureus
VPDRDIPRFVNLYNQGRLNIDSLIS

SEQ ID NO: 1691727 - protein, 26 aa, Staphylococcus aureus
VQSLSSLFFSQMFQQLYRLGDENGAR

SEQ ID NO: 1691728 - protein, 19 aa, Staphylococcus aureus
VQVIGSMIVIYRESKDNKE

SEQ ID NO: 1691729 - protein, 24 aa, Staphylococcus aureus
VSAASSCYIISLAATLERAKFTDI

SEQ ID NO: 1691730 - protein, 18 aa, Staphylococcus aureus
VSINPYTKMWRIDGKDTD

SEQ ID NO: 1691731 - protein, 23 aa, Staphylococcus aureus
VSKQTIFNNIKRLNIETIKQENT

SEQ ID NO: 1691732 - protein, 27 aa, Staphylococcus aureus
VSRTSGIFFMIKGDVQYIFGDCAINPE

SEQ ID NO: 1691733 - protein, 25 aa, Staphylococcus aureus
VSVSYPLDKLVLYIIEEKDKLEYYM

SEQ ID NO: 1691734 - protein, 24 aa, Staphylococcus aureus
VSYYEIITLLNKRPLRQVDYGNKI

SEQ ID NO: 1691735 - protein, 23 aa, Staphylococcus aureus
VTDQKVIDWLWETQDKSFFSSKE

SEQ ID NO: 1691736 - protein, 27 aa, Staphylococcus aureus
VTHEQFEEWWKLYNKKKDKKMSFTKFK

SEQ ID NO: 1691737 - protein, 27 aa, Staphylococcus aureus
VTHPDFIIPMPHRIFDFYNAFIGTSDF

SEQ ID NO: 1691738 - protein, 17 aa, Staphylococcus aureus
VTSTKDALNGDAKLAEA

SEQ ID NO: 1691739 - protein, 32 aa, Staphylococcus aureus
VTTLHNALIEMIDYFKALFPNGGLYIHLDQAT

SEQ ID NO: 1691740 - protein, 27 aa, Staphylococcus aureus
VVGNPLLDKFMKDLIIQILAMVSEQER

SEQ ID NO: 1691741 - protein, 18 aa, Staphylococcus aureus
VVIEEMKPNHYGVAGVRK

SEQ ID NO: 1691742 - protein, 17 aa, Staphylococcus aureus
VVLFKMHPFVKNRLNIS

SEQ ID NO: 1691743 - protein, 19 aa, Staphylococcus aureus
VYAEFYDNTYYYVFRGEGI

SEQ ID NO: 1691744 - protein, 18 aa, Staphylococcus aureus
VYIEPLTHDFIARIIRKE

SEQ ID NO: 1691745 - protein, 24 aa, Staphylococcus aureus
VYLDQIHQRLFLEQSLITERIKKY

SEQ ID NO: 1691746 - protein, 21 aa, Staphylococcus aureus
VYLSFLDTKSWCKNKFQVTNQ

SEQ ID NO: 1691747 - protein, 18 aa, Staphylococcus aureus
WFKVYRMFDELRETFKEE

SEQ ID NO: 1691748 - protein, 17 aa, Staphylococcus aureus
WFNTLETFKNWKKKPGK

SEQ ID NO: 1691749 - protein, 17 aa, Staphylococcus aureus
WHVSRTTIYRYLNKLED

SEQ ID NO: 1691750 - protein, 30 aa, Staphylococcus aureus
WLNQAPFSFDLSVMAIYPCLASGGTLNLVD

SEQ ID NO: 1691751 - protein, 17 aa, Staphylococcus aureus
WRSMLEHVNWNMIDNGV

SEQ ID NO: 1691752 - protein, 19 aa, Staphylococcus aureus
WVTSEVLPTLRKTGAYQVP

SEQ ID NO: 1691753 - protein, 19 aa, Staphylococcus aureus
YAEFYDNAYYYVFRGEGID

SEQ ID NO: 1691754 - protein, 18 aa, Staphylococcus aureus
YAEFYDNTYYYVFRGEGI

SEQ ID NO: 1691755 - protein, 25 aa, Staphylococcus aureus
YAVPTTDCYEIFWGGDNELYNYHYL

SEQ ID NO: 1691756 - protein, 31 aa, Staphylococcus aureus
YCTPKKETDILFILSLFRKINWKVYDESTGV

SEQ ID NO: 1691757 - protein, 27 aa, Staphylococcus aureus
YDGNLTLNKLIYFADAMNYAINNKKLV

SEQ ID NO: 1691758 - protein, 18 aa, Staphylococcus aureus
YDKGLYSLNLIINRHEVE

SEQ ID NO: 1691759 - protein, 24 aa, Staphylococcus aureus
YDKNFINQIGWYLNYNQEINLIGD

SEQ ID NO: 1691760 - protein, 23 aa, Staphylococcus aureus
YDKYDLLEYLFNQLTKAYFATDI

SEQ ID NO: 1691761 - protein, 28 aa, Staphylococcus aureus
YDNPFNPPMFARVFRKHLEGGIIKSIKQ

SEQ ID NO: 1691762 - protein, 21 aa, Staphylococcus aureus
YDVRKYFPSLLSYRRSELDMR

SEQ ID NO: 1691763 - protein, 23 aa, Staphylococcus aureus
YDYDYKRLHLFLTLTKEDGTLAS

SEQ ID NO: 1691764 - protein, 26 aa, Staphylococcus aureus
YEKTEFELIRLFGKRGRGLYNKARGI

SEQ ID NO: 1691765 - protein, 19 aa, Staphylococcus aureus
YELDYIIDDDWNYAAQLDA

SEQ ID NO: 1691766 - protein, 18 aa, Staphylococcus aureus
YELYIAALKLGVAIIPCS

SEQ ID NO: 1691767 - protein, 17 aa, Staphylococcus aureus
YELYKQFQKLRNIFKKE

SEQ ID NO: 1691768 - protein, 27 aa, Staphylococcus aureus
YESPYSSNLFLPFALANNYYTIDQLID

SEQ ID NO: 1691769 - protein, 29 aa, Staphylococcus aureus
YETKSFTRLQIMSFFSSLWISSYSIELDE

SEQ ID NO: 1691770 - protein, 19 aa, Staphylococcus aureus
YEVLKQLCTTYKMALDFYI

SEQ ID NO: 1691771 - protein, 20 aa, Staphylococcus aureus
YEVLKQLCTTYKMALDFYIE

SEQ ID NO: 1691772 - protein, 23 aa, Staphylococcus aureus
YHQPSKLFLLNPDVVEMLIENQS

SEQ ID NO: 1691773 - protein, 22 aa, Staphylococcus aureus
YIGQFKTGYFSPLANLARLTEE

SEQ ID NO: 1691774 - protein, 27 aa, Staphylococcus aureus
YIKNQQVLEYVLYKAINLDFETFDIPD

SEQ ID NO: 1691775 - protein, 28 aa, Staphylococcus aureus
YKKGDVVVGMLPWRIINHVQADQITKVP

SEQ ID NO: 1691776 - protein, 30 aa, Staphylococcus aureus
YKVFTSFYKKWRPYLRIRDVYHYDLNELID

SEQ ID NO: 1691777 - protein, 17 aa, Staphylococcus aureus
YLLFINAIEQEFKDIAN

SEQ ID NO: 1691778 - protein, 19 aa, Staphylococcus aureus
YLLKKIWDDKKPACTVITM

SEQ ID NO: 1691779 - protein, 19 aa, Staphylococcus aureus
YLNYDLVNDTKFDFNKKID

SEQ ID NO: 1691780 - protein, 25 aa, Staphylococcus aureus
YMEAEPFMWPVYEVIRKSTAEELKA

SEQ ID NO: 1691781 - protein, 18 aa, Staphylococcus aureus
YMGAYHLQWHMIKYAKSH

SEQ ID NO: 1691782 - protein, 25 aa, Staphylococcus aureus
YNDPFDMVYVMMKGKLYGHVYIKDC

SEQ ID NO: 1691783 - protein, 22 aa, Staphylococcus aureus
YNELDEPILYSLNYMKNSLVQF

SEQ ID NO: 1691784 - protein, 21 aa, Staphylococcus aureus
YNLEFPITKAIPYYAKLHFTS

SEQ ID NO: 1691785 - protein, 27 aa, Staphylococcus aureus
YNPEKHHLYINDFPAIPIEENDNIRLL

SEQ ID NO: 1691786 - protein, 33 aa, Staphylococcus aureus
YNVSEKVFYDLWTDLYRLFKKLRETFKEEGLEP

SEQ ID NO: 1691787 - protein, 29 aa, Staphylococcus aureus
YNYQTQLKFVLIYTIHIKKLTKLSIKKES

SEQ ID NO: 1691788 - protein, 18 aa, Staphylococcus aureus
YPVFVKPANLGSSVGISK

SEQ ID NO: 1691789 - protein, 23 aa, Staphylococcus aureus
YQKQNINPTLLKVYNGLGTFTTN

SEQ ID NO: 1691790 - protein, 19 aa, Staphylococcus aureus
YQLPGHVFIFGGQTLFEEM

SEQ ID NO: 1691791 - protein, 21 aa, Staphylococcus aureus
YQPKHLVIVGGGYIALEFASM

SEQ ID NO: 1691792 - protein, 20 aa, Staphylococcus aureus
YREPVYERPQPKDDYYDVPK

SEQ ID NO: 1691793 - protein, 19 aa, Staphylococcus aureus
YRGLTYKLEAFRGKVILVV

SEQ ID NO: 1691794 - protein, 19 aa, Staphylococcus aureus
YRYLERYTDPLTGKYKTVS

SEQ ID NO: 1691795 - protein, 28 aa, Staphylococcus aureus
YSRVLNEGLPLPDLIIVDGGKGHMNGVI

SEQ ID NO: 1691796 - protein, 18 aa, Staphylococcus aureus
YSSSLPIYNLYFIKRNIE

SEQ ID NO: 1691797 - protein, 20 aa, Staphylococcus aureus
YTKHGIIRLVFKYRHNTLQR

SEQ ID NO: 1691798 - protein, 17 aa, Staphylococcus aureus
YTLNQFKAAPLIVTEDT

SEQ ID NO: 1691799 - protein, 19 aa, Staphylococcus aureus
YTNAVSRAETILNKTQGAN

SEQ ID NO: 1691800 - protein, 19 aa, Staphylococcus aureus
YTRDLFNKHLSMNNEDAFA

SEQ ID NO: 1691801 - protein, 22 aa, Staphylococcus aureus
YVEADAWQSWGPYLLSGKDVFN

SEQ ID NO: 1691802 - protein, 18 aa, Staphylococcus aureus
YVFFLDSDDLLHERALED

SEQ ID NO: 1691803 - protein, 19 aa, Staphylococcus aureus
YVFHAAALKQVPSCEFFPV

SEQ ID NO: 1691804 - protein, 18 aa, Staphylococcus aureus
YVIREDGVDAFYYVMLLP

SEQ ID NO: 1691805 - protein, 26 aa, Staphylococcus aureus
AADPEYIFYAYKRFNFELKDPNFTSE

SEQ ID NO: 1691806 - protein, 31 aa, Staphylococcus aureus
AAGTLYNIVGFQTHLKWGAQKEIIKLIPGLE

SEQ ID NO: 1691807 - protein, 22 aa, Staphylococcus aureus
AAIKDFWEKVGLKTNVKLVEFG

SEQ ID NO: 1691808 - protein, 19 aa, Staphylococcus aureus
AAMKWINTFKRIHITSESN

SEQ ID NO: 1691809 - protein, 20 aa, Staphylococcus aureus
AAMLLIPEPWLYNEANDANV

SEQ ID NO: 1691810 - protein, 19 aa, Staphylococcus aureus
AAPKMLPMFSEELVNHAVS

SEQ ID NO: 1691811 - protein, 32 aa, Staphylococcus aureus
AAVPPLTHFITNSTYFLWDVLTTAYIGNKDLV

SEQ ID NO: 1691812 - protein, 30 aa, Staphylococcus aureus
ACALGAEEFGFATAPLVVLGCIMMRVCHKD

SEQ ID NO: 1691813 - protein, 17 aa, Staphylococcus aureus
ACDDVVLKFFNLTTKQY

SEQ ID NO: 1691814 - protein, 22 aa, Staphylococcus aureus
ACGYHLVKYFLQKTNIPIEVAT

SEQ ID NO: 1691815 - protein, 21 aa, Staphylococcus aureus
AEEVILQWKAQGIKPDVVMVD

SEQ ID NO: 1691816 - protein, 25 aa, Staphylococcus aureus
AFATARFYIRVLTRFFQNISKNKET

SEQ ID NO: 1691817 - protein, 17 aa, Staphylococcus aureus
AFEIPLVAKKLASSGNY

SEQ ID NO: 1691818 - protein, 21 aa, Staphylococcus aureus
AFYQYRTPLERILTNLLDNAL

SEQ ID NO: 1691819 - protein, 24 aa, Staphylococcus aureus
AGAKNLYDVYISKGLDTPKKIGPK

SEQ ID NO: 1691820 - protein, 24 aa, Staphylococcus aureus
AGEDFILFNKDFYLNDKIIENAKN

SEQ ID NO: 1691821 - protein, 26 aa, Staphylococcus aureus
AGLHAVWSHLIAHKLYNQKKYVSARA

SEQ ID NO: 1691822 - protein, 18 aa, Staphylococcus aureus
AGLIINNQLYRGANGEVG

SEQ ID NO: 1691823 - protein, 19 aa, Staphylococcus aureus
AGLYDYEANYKAHLSHRQK

SEQ ID NO: 1691824 - protein, 22 aa, Staphylococcus aureus
AGTLLRYYTGLLEHSKVQPYCF

SEQ ID NO: 1691825 - protein, 23 aa, Staphylococcus aureus
AGTLLRYYTGLLEHSKVQPYCFK

SEQ ID NO: 1691826 - protein, 17 aa, Staphylococcus aureus
AGTLYNIVGFQTHLKWG

SEQ ID NO: 1691827 - protein, 26 aa, Staphylococcus aureus
AHEIYAKNAFINKVPLISKFVEIIEK

SEQ ID NO: 1691828 - protein, 25 aa, Staphylococcus aureus
AHGLTPRLHLFMEDGSIFKNEPLIM

SEQ ID NO: 1691829 - protein, 27 aa, Staphylococcus aureus
AHHVVNFMHFIAQELREILASLGLKRV

SEQ ID NO: 1691830 - protein, 21 aa, Staphylococcus aureus
AHTNAISLFDLIISTEADAYE

SEQ ID NO: 1691831 - protein, 22 aa, Staphylococcus aureus
AHTNIALIKYWGKKDEGLIIPM

SEQ ID NO: 1691832 - protein, 17 aa, Staphylococcus aureus
AIAFLNDPQFIILDEPM

SEQ ID NO: 1691833 - protein, 23 aa, Staphylococcus aureus
AIAHANCMVMLPGGSRGFKAGHT

SEQ ID NO: 1691834 - protein, 23 aa, Staphylococcus aureus
AIKHIDGLITSDNVFFNQLSEEE

SEQ ID NO: 1691835 - protein, 27 aa, Staphylococcus aureus
AINFVYRLMKYDWANILVVRRFSNTNK

SEQ ID NO: 1691836 - protein, 21 aa, Staphylococcus aureus
AIPFYESLNFKMRGNIFFEEG

SEQ ID NO: 1691837 - protein, 19 aa, Staphylococcus aureus
AIQKYNIIKPFILGEQSLS

SEQ ID NO: 1691838 - protein, 18 aa, Staphylococcus aureus
AIRIFRAAAELDISTVAI

SEQ ID NO: 1691839 - protein, 18 aa, Staphylococcus aureus
AIRMSYLSKTPLIITYSY

SEQ ID NO: 1691840 - protein, 17 aa, Staphylococcus aureus
AKAILTKASGQNVDKAA

SEQ ID NO: 1691841 - protein, 31 aa, Staphylococcus aureus
AKASIKPFIRRTPLIKSMYLSQSITKGNVFL

SEQ ID NO: 1691842 - protein, 20 aa, Staphylococcus aureus
AKAWMINTRTPDWLYKSPRT

SEQ ID NO: 1691843 - protein, 23 aa, Staphylococcus aureus
AKENINCRCKLMYYIDEDDLPST

SEQ ID NO: 1691844 - protein, 26 aa, Staphylococcus aureus
AKGINIIGLINIQFVIAHDGVYVLEV

SEQ ID NO: 1691845 - protein, 24 aa, Staphylococcus aureus
AKKAKDWYRALSKEEIKALEEENF

SEQ ID NO: 1691846 - protein, 23 aa, Staphylococcus aureus
AKKIAETLNLLYQLTGNQNSVKV

SEQ ID NO: 1691847 - protein, 33 aa, Staphylococcus aureus
AKKRAPYIFRKLNIEWIYRALMDWKRIGRLKSI

SEQ ID NO: 1691848 - protein, 24 aa, Staphylococcus aureus
AKQEYLRILPHMQELPISNLDKAQ

SEQ ID NO: 1691849 - protein, 26 aa, Staphylococcus aureus
AKQIIEAMFEWIFTNAIPLNYKTSKL

SEQ ID NO: 1691850 - protein, 23 aa, Staphylococcus aureus
AKVLAETLINEGFRIVSGGTDNH

SEQ ID NO: 1691851 - protein, 25 aa, Staphylococcus aureus
ALGKAQQLNLPTSLVDRFLGDSDED

SEQ ID NO: 1691852 - protein, 26 aa, Staphylococcus aureus
ALKSAKMIIIDNYYLLLGGYNKTSNQ

SEQ ID NO: 1691853 - protein, 21 aa, Staphylococcus aureus
ALKYLIEGSNFTTGWIFFINS

SEQ ID NO: 1691854 - protein, 20 aa, Staphylococcus aureus
ALLDKWRTFMNLRDDVNRAL

SEQ ID NO: 1691855 - protein, 29 aa, Staphylococcus aureus
ALQRVKTAKNALNGDAKLIAAQNAAKQHL

SEQ ID NO: 1691856 - protein, 21 aa, Staphylococcus aureus
ALSPQIIIGAQYIQAAGVAFA

SEQ ID NO: 1691857 - protein, 28 aa, Staphylococcus aureus
ALVKALQAWDIYHLYGIPGDSIDAVVDS

SEQ ID NO: 1691858 - protein, 24 aa, Staphylococcus aureus
AMRESFHTVLPLNRNFLSAFTQQN

SEQ ID NO: 1691859 - protein, 21 aa, Staphylococcus aureus
APADHPWRTMPRNAMTVHYSG

SEQ ID NO: 1691860 - protein, 29 aa, Staphylococcus aureus
APTDEQWEAMLLGWKVVPSVKSNAIILSN

SEQ ID NO: 1691861 - protein, 20 aa, Staphylococcus aureus
AQAKQIIRLFNAETSQLINK

SEQ ID NO: 1691862 - protein, 22 aa, Staphylococcus aureus
AQHCEAFKANFKGAAQGDWVKS

SEQ ID NO: 1691863 - protein, 17 aa, Staphylococcus aureus
AQKEIIKLIPGLENVDI

SEQ ID NO: 1691864 - protein, 21 aa, Staphylococcus aureus
AQKNNLISQISSATRVSSVDT

SEQ ID NO: 1691865 - protein, 21 aa, Staphylococcus aureus
AREDLFITSKLYFEDFGRENV

SEQ ID NO: 1691866 - protein, 18 aa, Staphylococcus aureus
ARLVYNKCSSYLHGSDAI

SEQ ID NO: 1691867 - protein, 23 aa, Staphylococcus aureus
ARRHGFISAVPLHEIVEAHNYGV

SEQ ID NO: 1691868 - protein, 22 aa, Staphylococcus aureus
ARRLHTILEKMLEDLSFEAPRM

SEQ ID NO: 1691869 - protein, 18 aa, Staphylococcus aureus
ASERFKELVDLFNKRYDI

SEQ ID NO: 1691870 - protein, 19 aa, Staphylococcus aureus
ASERFKELVDLFNKRYDII

SEQ ID NO: 1691871 - protein, 17 aa, Staphylococcus aureus
ASNLLGEPLTIGGPNSV

SEQ ID NO: 1691872 - protein, 21 aa, Staphylococcus aureus
ASPDKQGAYTDAYNAAKNIVN

SEQ ID NO: 1691873 - protein, 22 aa, Staphylococcus aureus
ASQLYQDFFKAKAKQLPQITVK

SEQ ID NO: 1691874 - protein, 24 aa, Staphylococcus aureus
ASSDGIWMPIDDKGYFNFDFKTKR

SEQ ID NO: 1691875 - protein, 24 aa, Staphylococcus aureus
ATFGSFRPWPAYLYTIEHSIYVDA

SEQ ID NO: 1691876 - protein, 22 aa, Staphylococcus aureus
ATFNKLYLYSRQLNKRVLFESN

SEQ ID NO: 1691877 - protein, 20 aa, Staphylococcus aureus
ATYELYIAALKLGVAIIPCS

SEQ ID NO: 1691878 - protein, 24 aa, Staphylococcus aureus
AVEQALQRVNTAKTALNGDERLNE

SEQ ID NO: 1691879 - protein, 18 aa, Staphylococcus aureus
AVGLFFSKERILGSEHEA

SEQ ID NO: 1691880 - protein, 18 aa, Staphylococcus aureus
AVGLFFSKERILGSEHEV

SEQ ID NO: 1691881 - protein, 20 aa, Staphylococcus aureus
AVLSLLFHMQQEQGLWYVEG

SEQ ID NO: 1691882 - protein, 26 aa, Staphylococcus aureus
AVRHIYEISSLIYKSGMKIKIKAMGI

SEQ ID NO: 1691883 - protein, 25 aa, Staphylococcus aureus
AVTDLNQLNGLNNPQRQALESQINN

SEQ ID NO: 1691884 - protein, 19 aa, Staphylococcus aureus
AYAFIKRLIKQFGKPQKVV

SEQ ID NO: 1691885 - protein, 25 aa, Staphylococcus aureus
AYCINGYRWITYIANSGQCRYIATG

SEQ ID NO: 1691886 - protein, 17 aa, Staphylococcus aureus
AYIRLYSGVLHLRDSVR

SEQ ID NO: 1691887 - protein, 23 aa, Staphylococcus aureus
AYQLLLDEGYIYSRPRSGYFVSK

SEQ ID NO: 1691888 - protein, 19 aa, Staphylococcus aureus
AYVIIFMVNVREGLTQSDE

SEQ ID NO: 1691889 - protein, 23 aa, Staphylococcus aureus
CDLELYFTSLSRKTIVYKGWLRS

SEQ ID NO: 1691890 - protein, 18 aa, Staphylococcus aureus
CDVFIIQPTSYPVNLHLM

SEQ ID NO: 1691891 - protein, 24 aa, Staphylococcus aureus
CIIGQLHFGPFQLTAPVLVNLRYQ

SEQ ID NO: 1691892 - protein, 29 aa, Staphylococcus aureus
CIIRLKKEYYYNFFGQYLLSRKGKRKIFL

SEQ ID NO: 1691893 - protein, 18 aa, Staphylococcus aureus
CLYVLVDPYLIENLRNAD

SEQ ID NO: 1691894 - protein, 17 aa, Staphylococcus aureus
CNYRLGALGYLDWSYFN

SEQ ID NO: 1691895 - protein, 32 aa, Staphylococcus aureus
CPENFQRLMQLSKRLPIIPNINNQRSALYIKH

SEQ ID NO: 1691896 - protein, 18 aa, Staphylococcus aureus
CPIFTFGRSSGAYLSLLI

SEQ ID NO: 1691897 - protein, 17 aa, Staphylococcus aureus
CPNNKRIGFKRYAYRND

SEQ ID NO: 1691898 - protein, 18 aa, Staphylococcus aureus
CPNRNIFVVGGPGSYKSA

SEQ ID NO: 1691899 - protein, 18 aa, Staphylococcus aureus
CSTKFAVRGLTQVAAQDL

SEQ ID NO: 1691900 - protein, 20 aa, Staphylococcus aureus
CVAPGPFWSPLQISGGQPQS

SEQ ID NO: 1691901 - protein, 25 aa, Staphylococcus aureus
CVTRGWINYFGKGFIKRFLQELEPW

SEQ ID NO: 1691902 - protein, 32 aa, Staphylococcus aureus
DADLLIMVGTNYPYVDYLPKKNIKAIQIDTNP

SEQ ID NO: 1691903 - protein, 24 aa, Staphylococcus aureus
DAIKKYILTLKIEIIIFCIHITED

SEQ ID NO: 1691904 - protein, 17 aa, Staphylococcus aureus
DALKGDIYLDEAVGIMT

SEQ ID NO: 1691905 - protein, 18 aa, Staphylococcus aureus
DALRQMTHLSDAQKQSIT

SEQ ID NO: 1691906 - protein, 29 aa, Staphylococcus aureus
DASEFRNYILGLIFYRFLSEKAEQEYADA

SEQ ID NO: 1691907 - protein, 33 aa, Staphylococcus aureus
DATGHIVNLYFPFVEVETMLTLLDMAQIYVSSG

SEQ ID NO: 1691908 - protein, 25 aa, Staphylococcus aureus
DAYYGLFYEDVYTQSLFTALTNLNS

SEQ ID NO: 1691909 - protein, 24 aa, Staphylococcus aureus
DCEYTYAMPIAILIRHMMSFDNAH

SEQ ID NO: 1691910 - protein, 25 aa, Staphylococcus aureus
DDEQLIYLTPSFPQRYTSNTWIYKK

SEQ ID NO: 1691911 - protein, 19 aa, Staphylococcus aureus
DDIIDIVRRVQGGQFEHVG

SEQ ID NO: 1691912 - protein, 18 aa, Staphylococcus aureus
DDIMKMIPGMNKMKELDK

SEQ ID NO: 1691913 - protein, 17 aa, Staphylococcus aureus
DDNAAYDLTLNGSAKLN

SEQ ID NO: 1691914 - protein, 17 aa, Staphylococcus aureus
DDNIFPTKAFYILNDDI

SEQ ID NO: 1691915 - protein, 17 aa, Staphylococcus aureus
DDNIFPTKAFYILNDDM

SEQ ID NO: 1691916 - protein, 18 aa, Staphylococcus aureus
DDNIFPTKAFYILNDDMT

SEQ ID NO: 1691917 - protein, 30 aa, Staphylococcus aureus
DDTIYYRYFIEETMLYNIHLFMYKGDSMEE

SEQ ID NO: 1691918 - protein, 21 aa, Staphylococcus aureus
DDTWMAIFKDMNFELGIMELY

SEQ ID NO: 1691919 - protein, 20 aa, Staphylococcus aureus
DDVESLYSKLDLIMGYKDEE

SEQ ID NO: 1691920 - protein, 17 aa, Staphylococcus aureus
DDVKNYKFFNSKSDILF

SEQ ID NO: 1691921 - protein, 23 aa, Staphylococcus aureus
DDVVFRLKALAQSTMRTAKVQQQ

SEQ ID NO: 1691922 - protein, 24 aa, Staphylococcus aureus
DDYNNFIMVSYIKDKVNALYTNQN

SEQ ID NO: 1691923 - protein, 20 aa, Staphylococcus aureus
DDYVYAFLDISQVTKGHTLL

SEQ ID NO: 1691924 - protein, 28 aa, Staphylococcus aureus
DEAISAMKYIVAKYGWGGFKRAGDYAYA

SEQ ID NO: 1691925 - protein, 20 aa, Staphylococcus aureus
DEFFTVILSIRYIQTELHLS

SEQ ID NO: 1691926 - protein, 23 aa, Staphylococcus aureus
DEFFVNNFFLRYINSEVLDNAYG

SEQ ID NO: 1691927 - protein, 23 aa, Staphylococcus aureus
DEKGIFEMYYAYSEPIKCIANHR

SEQ ID NO: 1691928 - protein, 28 aa, Staphylococcus aureus
DEKYKNFSTYPILLEKDDFQFKVSDKTK

SEQ ID NO: 1691929 - protein, 32 aa, Staphylococcus aureus
DELHVINFERLRNYFFIKKPKRMKYINKFNEE

SEQ ID NO: 1691930 - protein, 18 aa, Staphylococcus aureus
DEQAKAFEEYKKGKEDEA

SEQ ID NO: 1691931 - protein, 26 aa, Staphylococcus aureus
DETILNQQFYALDKTLFVALNNKARI

SEQ ID NO: 1691932 - protein, 24 aa, Staphylococcus aureus
DETWHFDYITTLLDRILDKYKDKS

SEQ ID NO: 1691933 - protein, 39 aa, Staphylococcus aureus
DEVGFMVTKIDRHGFISFTPVGGWWNQVMLSQKVTITTD

SEQ ID NO: 1691934 - protein, 28 aa, Staphylococcus aureus
DEVKDHLLLELTVIFGISALVTSFLKHK

SEQ ID NO: 1691935 - protein, 22 aa, Staphylococcus aureus
DEVMPALAYFTFSPKNYEDKSN

SEQ ID NO: 1691936 - protein, 32 aa, Staphylococcus aureus
DFEQLRALLYLELDYSFVLYNELLRMIHLIKK

SEQ ID NO: 1691937 - protein, 20 aa, Staphylococcus aureus
DFHAIYVNDYLFYVRKMEKD

SEQ ID NO: 1691938 - protein, 27 aa, Staphylococcus aureus
DFKKFHYRIFQYYRIIKRKLKETVKNF

SEQ ID NO: 1691939 - protein, 19 aa, Staphylococcus aureus
DFKLNLMLNAFSSDFYYFV

SEQ ID NO: 1691940 - protein, 20 aa, Staphylococcus aureus
DFRFEDLFSKEEWLSMSLAE

SEQ ID NO: 1691941 - protein, 23 aa, Staphylococcus aureus
DFTDQLLRYYSMYPTAAIKVAYT

SEQ ID NO: 1691942 - protein, 19 aa, Staphylococcus aureus
DFTEEKLELAKKVIISHRY

SEQ ID NO: 1691943 - protein, 17 aa, Staphylococcus aureus
DFYGLELPKLPILNPEF

SEQ ID NO: 1691944 - protein, 28 aa, Staphylococcus aureus
DGAYCINGYRWITYIANSGQRRYIATGE

SEQ ID NO: 1691945 - protein, 24 aa, Staphylococcus aureus
DGEKLYINIFRPNKDGKFPVVMSA

SEQ ID NO: 1691946 - protein, 23 aa, Staphylococcus aureus
DGGINLFPFEIYEPRFGTIFESK

SEQ ID NO: 1691947 - protein, 24 aa, Staphylococcus aureus
DGKDALISSLKRKVNSLEKEKKML

SEQ ID NO: 1691948 - protein, 23 aa, Staphylococcus aureus
DGKKYYNFYGVGALDKDPIKTGA

SEQ ID NO: 1691949 - protein, 22 aa, Staphylococcus aureus
DGLLIQKRRGLNKPNILYLMKP

SEQ ID NO: 1691950 - protein, 19 aa, Staphylococcus aureus
DGQRVFVTEVAADSVQFLE

SEQ ID NO: 1691951 - protein, 22 aa, Staphylococcus aureus
DGSIISLIDFVIKPIHLIKEAQ

SEQ ID NO: 1691952 - protein, 24 aa, Staphylococcus aureus
DGSTAYMFVAYLGTDPITGKQKRT

SEQ ID NO: 1691953 - protein, 17 aa, Staphylococcus aureus
DGVPFIENWIKQYGSEA

SEQ ID NO: 1691954 - protein, 20 aa, Staphylococcus aureus
DHLNMDYFKMKPVGLIGNSG

SEQ ID NO: 1691955 - protein, 18 aa, Staphylococcus aureus
DHYIISFIYYISRNINAR

SEQ ID NO: 1691956 - protein, 22 aa, Staphylococcus aureus
DIAFEFASWISAEFKLYIIQDY

SEQ ID NO: 1691957 - protein, 24 aa, Staphylococcus aureus
DIDSITRLITDDYYFTILTDSFGY

SEQ ID NO: 1691958 - protein, 23 aa, Staphylococcus aureus
DIKNFYKTVFNNLTRYKAIVVST

SEQ ID NO: 1691959 - protein, 19 aa, Staphylococcus aureus
DILAIPVGNAGNITAYWKG

SEQ ID NO: 1691960 - protein, 17 aa, Staphylococcus aureus
DILTTQKLPSLMKYGFS

SEQ ID NO: 1691961 - protein, 24 aa, Staphylococcus aureus
DINTLEKHWFNWLTENNIPIKRRS

SEQ ID NO: 1691962 - protein, 24 aa, Staphylococcus aureus
DISNYVLLEYGQPLHMFDQDAIGS

SEQ ID NO: 1691963 - protein, 19 aa, Staphylococcus aureus
DIYYKLNVSFPQAALGDEI

SEQ ID NO: 1691964 - protein, 32 aa, Staphylococcus aureus
DKANLVIWDAPNHEYIPYHFGINHAEKVIKDG

SEQ ID NO: 1691965 - protein, 24 aa, Staphylococcus aureus
DKDKVLGLFADKNMPLAIDASKDE

SEQ ID NO: 1691966 - protein, 23 aa, Staphylococcus aureus
DKEVQRLLTMINGKGIFESARIL

SEQ ID NO: 1691967 - protein, 29 aa, Staphylococcus aureus
DKIPAVQRQTMLFSATMPKAIQALVQQFM

SEQ ID NO: 1691968 - protein, 27 aa, Staphylococcus aureus
DKQLIYLTPIFPQRYTSNTWLYKKMPT

SEQ ID NO: 1691969 - protein, 21 aa, Staphylococcus aureus
DKQVQALIDEIDRNPNLTDKE

SEQ ID NO: 1691970 - protein, 22 aa, Staphylococcus aureus
DKTETLNSINFTDADQAKKDAY

SEQ ID NO: 1691971 - protein, 25 aa, Staphylococcus aureus
DLEMSDIFMYKTLIDAYNRRLSDLS

SEQ ID NO: 1691972 - protein, 31 aa, Staphylococcus aureus
DLFYGFQCYDYANMFFMLATGERLQGLYAYN

SEQ ID NO: 1691973 - protein, 27 aa, Staphylococcus aureus
DLHKDLIPVVWIAFKTGLRISDVLTLK

SEQ ID NO: 1691974 - protein, 27 aa, Staphylococcus aureus
DLHKDLIPVVWIAFKTGLRISDVLTLQ

SEQ ID NO: 1691975 - protein, 26 aa, Staphylococcus aureus
DLKGSWSVVCFYPADFSFVCPTELED

SEQ ID NO: 1691976 - protein, 17 aa, Staphylococcus aureus
DLLIDQVEFCDVLIINK

SEQ ID NO: 1691977 - protein, 26 aa, Staphylococcus aureus
DLNVYDKPTPFLFGEDFSFYGQQLAP

SEQ ID NO: 1691978 - protein, 27 aa, Staphylococcus aureus
DLNVYDKPTPFLFGEDFSFYGQQLAPA

SEQ ID NO: 1691979 - protein, 18 aa, Staphylococcus aureus
DLRALYRGKAHHVVNFMH

SEQ ID NO: 1691980 - protein, 25 aa, Staphylococcus aureus
DLTNLYEVTKPYIAEGRRYTGSFTV

SEQ ID NO: 1691981 - protein, 20 aa, Staphylococcus aureus
DLVSLFLLLQMENVHLIGVS

SEQ ID NO: 1691982 - protein, 20 aa, Staphylococcus aureus
DLVVKFIHWVSRSCIENMSP

SEQ ID NO: 1691983 - protein, 22 aa, Staphylococcus aureus
DMAEIRVFYRDEFLCTAICPEI

SEQ ID NO: 1691984 - protein, 22 aa, Staphylococcus aureus
DMDKAFDRLKLNIFISLAELES

SEQ ID NO: 1691985 - protein, 18 aa, Staphylococcus aureus
DMLRYALSNPFLSPARRD

SEQ ID NO: 1691986 - protein, 17 aa, Staphylococcus aureus
DNAITQAESYLNKDHGA

SEQ ID NO: 1691987 - protein, 17 aa, Staphylococcus aureus
DNAQYLKNGLSKLGYDT

SEQ ID NO: 1691988 - protein, 23 aa, Staphylococcus aureus
DNDRAMFEFGYYTVAMKNARPEI

SEQ ID NO: 1691989 - protein, 24 aa, Staphylococcus aureus
DNEKQKYQFLDLSKYQGIDKNRIK

SEQ ID NO: 1691990 - protein, 24 aa, Staphylococcus aureus
DNELYNYHYLYSHQRYAIDLVIKE

SEQ ID NO: 1691991 - protein, 21 aa, Staphylococcus aureus
DNFVDFIRWMKTPFEYENVLS

SEQ ID NO: 1691992 - protein, 20 aa, Staphylococcus aureus
DNGFYPLGSCTMKYNPRINE

SEQ ID NO: 1691993 - protein, 17 aa, Staphylococcus aureus
DNHSHLSVLQNLATILG

SEQ ID NO: 1691994 - protein, 21 aa, Staphylococcus aureus
DNLSIIKPVIMPVAYKHCALQ

SEQ ID NO: 1691995 - protein, 22 aa, Staphylococcus aureus
DNNLTFTSSYYHTMRKSFSGEQ

SEQ ID NO: 1691996 - protein, 28 aa, Staphylococcus aureus
DNNPELENLLLDPYFKNIVTDYQEALRD

SEQ ID NO: 1691997 - protein, 26 aa, Staphylococcus aureus
DNQQPLPNKLYLISPILDATLSNKDI

SEQ ID NO: 1691998 - protein, 20 aa, Staphylococcus aureus
DNTFLTPYLSTPLAEGADIV

SEQ ID NO: 1691999 - protein, 24 aa, Staphylococcus aureus
DNYKQFLTTYFGLNVTISRLENSE

SEQ ID NO: 1692000 - protein, 25 aa, Staphylococcus aureus
DPDVLRFFVISVHYRSPINYNLELV

SEQ ID NO: 1692001 - protein, 22 aa, Staphylococcus aureus
DPLEIEEFKKIILKTIFGETEV

SEQ ID NO: 1692002 - protein, 27 aa, Staphylococcus aureus
DPLKPYLPELMNMHKLIYPAGDGRINY

SEQ ID NO: 1692003 - protein, 17 aa, Staphylococcus aureus
DPNIWRSMKDLINYDLI

SEQ ID NO: 1692004 - protein, 19 aa, Staphylococcus aureus
DQKVIDWLWETQDKSFFSS

SEQ ID NO: 1692005 - protein, 21 aa, Staphylococcus aureus
DQLHRQILEQAIVDGLKIYFS

SEQ ID NO: 1692006 - protein, 21 aa, Staphylococcus aureus
DQLTHLNNAQRQLAIQQINNA

SEQ ID NO: 1692007 - protein, 24 aa, Staphylococcus aureus
DQQFTMFETDAELFGYCYGVAGTV

SEQ ID NO: 1692008 - protein, 28 aa, Staphylococcus aureus
DQTTAILTGNFLLALGLEHLMAVKDNRV

SEQ ID NO: 1692009 - protein, 21 aa, Staphylococcus aureus
DQVEFCDVLIINKIDLISEEE

SEQ ID NO: 1692010 - protein, 20 aa, Staphylococcus aureus
DRNLYVPYDLPIAKNNLFEY

SEQ ID NO: 1692011 - protein, 32 aa, Staphylococcus aureus
DRSDDQFRMIIKQLYFFSVANPNPKNWLDQLV

SEQ ID NO: 1692012 - protein, 25 aa, Staphylococcus aureus
DRYPKLNMIIGHWGEFIPFFLERMD

SEQ ID NO: 1692013 - protein, 23 aa, Staphylococcus aureus
DSKRQFLMNQIQALIRGVWLLSG

SEQ ID NO: 1692014 - protein, 17 aa, Staphylococcus aureus
DSLVEMDYYRHGGILQM

SEQ ID NO: 1692015 - protein, 19 aa, Staphylococcus aureus
DSNNKMLQRIYGTAFFDKK

SEQ ID NO: 1692016 - protein, 22 aa, Staphylococcus aureus
DSNVYRVYFNDVQLPLLADQVR

SEQ ID NO: 1692017 - protein, 24 aa, Staphylococcus aureus
DSVKVGASVFTGFGPRIVRINNFS

SEQ ID NO: 1692018 - protein, 20 aa, Staphylococcus aureus
DTHKQQVVPVFWIAGEDHDF

SEQ ID NO: 1692019 - protein, 22 aa, Staphylococcus aureus
DTKHFPIELFRKYSKDLYDTNH

SEQ ID NO: 1692020 - protein, 22 aa, Staphylococcus aureus
DTLAWVYVPDTLSALALDAYES

SEQ ID NO: 1692021 - protein, 27 aa, Staphylococcus aureus
DTQHMTLPMLFSDILIYCTERNVMLVD

SEQ ID NO: 1692022 - protein, 23 aa, Staphylococcus aureus
DTQLIIDEILAIKLPAEVIKASP

SEQ ID NO: 1692023 - protein, 20 aa, Staphylococcus aureus
DTYCGIGTIGLYMAPHAKHV

SEQ ID NO: 1692024 - protein, 22 aa, Staphylococcus aureus
DTYCGIGTIGLYMAPHAKHVYG

SEQ ID NO: 1692025 - protein, 20 aa, Staphylococcus aureus
DVARRLGESLQLINILRDVG

SEQ ID NO: 1692026 - protein, 29 aa, Staphylococcus aureus
DVDNALNAVTRAKAALNGAENLRNAKTSA

SEQ ID NO: 1692027 - protein, 21 aa, Staphylococcus aureus
DVEKALAMKVPLGIFSHQLQR

SEQ ID NO: 1692028 - protein, 34 aa, Staphylococcus aureus
DVEKVLAMTAPLGIFSHQLQRFIHLVWDVRDVIN

SEQ ID NO: 1692029 - protein, 25 aa, Staphylococcus aureus
DWSSIAFIVPRNKVAFIPSEAQFIQ

SEQ ID NO: 1692030 - protein, 27 aa, Staphylococcus aureus
DYDNPVTEIYFIEPDLHFTIIDFNQEL

SEQ ID NO: 1692031 - protein, 26 aa, Staphylococcus aureus
DYEKYVISDAVHIGWKGWVYMDEQIA

SEQ ID NO: 1692032 - protein, 23 aa, Staphylococcus aureus
DYETWRTYMLAQETFTGGVTPVA

SEQ ID NO: 1692033 - protein, 17 aa, Staphylococcus aureus
DYFKMKPVGLIGNSGGI

SEQ ID NO: 1692034 - protein, 18 aa, Staphylococcus aureus
DYILEYRQLSKLQSTYVE

SEQ ID NO: 1692035 - protein, 23 aa, Staphylococcus aureus
DYMRHMFIEYVRTYYGYDERISL

SEQ ID NO: 1692036 - protein, 23 aa, Staphylococcus aureus
DYNNFIMVSYIKDKVNAIYTNQN

SEQ ID NO: 1692037 - protein, 23 aa, Staphylococcus aureus
DYRKIPRKYLNPKIPQGRGKIKW

SEQ ID NO: 1692038 - protein, 23 aa, Staphylococcus aureus
EADFINCVTFRKQADNVNNYLSK

SEQ ID NO: 1692039 - protein, 20 aa, Staphylococcus aureus
EAIREVVNKQIEIIENADAS

SEQ ID NO: 1692040 - protein, 27 aa, Staphylococcus aureus
EAKRKGLEPLAIWMKALKHEVSIEEKA

SEQ ID NO: 1692041 - protein, 24 aa, Staphylococcus aureus
EALHAPYGMRLAEYKEIVLARIMQ

SEQ ID NO: 1692042 - protein, 17 aa, Staphylococcus aureus
EALWNIANLTNVLGINL

SEQ ID NO: 1692043 - protein, 22 aa, Staphylococcus aureus
EAVIGFLYLEKREERLEALLNE

SEQ ID NO: 1692044 - protein, 25 aa, Staphylococcus aureus
EAVQSLLHYLAFYTSKDKEQMERIF

SEQ ID NO: 1692045 - protein, 17 aa, Staphylococcus aureus
EAYLTSFSLTLERANKK

SEQ ID NO: 1692046 - protein, 33 aa, Staphylococcus aureus
EAYQPALAELAMPRPYVFVSPKDFKNGTTKDGV

SEQ ID NO: 1692047 - protein, 20 aa, Staphylococcus aureus
EDALRMIRCLRFQSQLSFDI

SEQ ID NO: 1692048 - protein, 17 aa, Staphylococcus aureus
EDGIGRYLNDFFNLNIR

SEQ ID NO: 1692049 - protein, 20 aa, Staphylococcus aureus
EDGLAILNELIKKAKVTTNE

SEQ ID NO: 1692050 - protein, 22 aa, Staphylococcus aureus
EDIDQFYYILEDAKHELYDEMA

SEQ ID NO: 1692051 - protein, 21 aa, Staphylococcus aureus
EDIPFFLEVLTYDDNIPDNGS

SEQ ID NO: 1692052 - protein, 23 aa, Staphylococcus aureus
EDKQKVLLYANKDNDMYYLNSGS

SEQ ID NO: 1692053 - protein, 23 aa, Staphylococcus aureus
EDLANFLYFVAQKNMGIGAGDHL

SEQ ID NO: 1692054 - protein, 27 aa, Staphylococcus aureus
EDLIRLIAADLVEFDWLEGFDIECRNE

SEQ ID NO: 1692055 - protein, 24 aa, Staphylococcus aureus
EDPEKMIEDFWNALYGRSKVSQNI

SEQ ID NO: 1692056 - protein, 20 aa, Staphylococcus aureus
EDVLALWNKINPSFALKSMF

SEQ ID NO: 1692057 - protein, 24 aa, Staphylococcus aureus
EDYYMYKKFGIWPEKEYAINRVKK

SEQ ID NO: 1692058 - protein, 25 aa, Staphylococcus aureus
EEESDLPWVSLINKTKKISIKFLFE

SEQ ID NO: 1692059 - protein, 29 aa, Staphylococcus aureus
EEFEIFLNTALIHIVERLKLRIAFATARE

SEQ ID NO: 1692060 - protein, 23 aa, Staphylococcus aureus
EEFEILIIAYSIDGGAISAIDMT

SEQ ID NO: 1692061 - protein, 22 aa, Staphylococcus aureus
EEGEVPKLYLTSHMDTVVPAIN

SEQ ID NO: 1692062 - protein, 30 aa, Staphylococcus aureus
EEIFDDLWMNLYYLFMNLRDLFKKEGLEPW

SEQ ID NO: 1692063 - protein, 31 aa, Staphylococcus aureus
EEIFDDLWMNLYYLFMNLRDLFKKEGLEPWT

SEQ ID NO: 1692064 - protein, 18 aa, Staphylococcus aureus
EELKLLNNNLRVLTTELS

SEQ ID NO: 1692065 - protein, 21 aa, Staphylococcus aureus
EEMQFFTYSLNIDNQTAYFIG

SEQ ID NO: 1692066 - protein, 26 aa, Staphylococcus aureus
EENKKVGLWSFDFNIDWHAGGDKRKY

SEQ ID NO: 1692067 - protein, 25 aa, Staphylococcus aureus
EENYKERFYQLPKVFFTNPNYKDLS

SEQ ID NO: 1692068 - protein, 19 aa, Staphylococcus aureus
EEPFFMSLNEMFALKEYKK

SEQ ID NO: 1692069 - protein, 23 aa, Staphylococcus aureus
EEPQFYFIDPYANYSEFKDVDDL

SEQ ID NO: 1692070 - protein, 25 aa, Staphylococcus aureus
EEQQKIGDLFYKIDKYISFNKCKIE

SEQ ID NO: 1692071 - protein, 17 aa, Staphylococcus aureus
EERLNGTVLWLGESDEL

SEQ ID NO: 1692072 - protein, 22 aa, Staphylococcus aureus
EETPEFLLLASGSEVNLAVEAA

SEQ ID NO: 1692073 - protein, 18 aa, Staphylococcus aureus
EEWVNLWQRALQVDYRPV

SEQ ID NO: 1692074 - protein, 19 aa, Staphylococcus aureus
EFDFILIEGAGGIGVPIYE

SEQ ID NO: 1692075 - protein, 32 aa, Staphylococcus aureus
EFDNLFKRIPVKPGDFYYVPAGTVHAIGSGIL

SEQ ID NO: 1692076 - protein, 22 aa, Staphylococcus aureus
EFEPRKFVFTNGEIKYNSNFEK

SEQ ID NO: 1692077 - protein, 18 aa, Staphylococcus aureus
EFHVKQNPLYNRMTIRIK

SEQ ID NO: 1692078 - protein, 17 aa, Staphylococcus aureus
EFKLQVVRLYENGKLKN

SEQ ID NO: 1692079 - protein, 17 aa, Staphylococcus aureus
EFNINTIKPENIVLIGM

SEQ ID NO: 1692080 - protein, 32 aa, Staphylococcus aureus
EFNQLIDWVMDVSNIQYLAIASWGRNIYQNTS

SEQ ID NO: 1692081 - protein, 28 aa, Staphylococcus aureus
EFQYAYGLPDYGIIGMQLPLTIVIIGET

SEQ ID NO: 1692082 - protein, 17 aa, Staphylococcus aureus
EGAFYITFSNVTELLSE

SEQ ID NO: 1692083 - protein, 20 aa, Staphylococcus aureus
EGAFYITFSNVTELLSENDD

SEQ ID NO: 1692084 - protein, 24 aa, Staphylococcus aureus
EGDKPEMVIPLTRRKRAMQLTEQV

SEQ ID NO: 1692085 - protein, 21 aa, Staphylococcus aureus
EGEVPKLYLTSHMDTVVPAIN

SEQ ID NO: 1692086 - protein, 19 aa, Staphylococcus aureus
EGLLKEIEDVYKKARAFDE

SEQ ID NO: 1692087 - protein, 20 aa, Staphylococcus aureus
EGMVLYLNRNTKKATGYYFV

SEQ ID NO: 1692088 - protein, 27 aa, Staphylococcus aureus
EGSNFTTGWIFFINSVGEHELVSHVAL

SEQ ID NO: 1692089 - protein, 20 aa, Staphylococcus aureus
EGVFFHERKALSHFEKRYTK

SEQ ID NO: 1692090 - protein, 23 aa, Staphylococcus aureus
EHGSNIWFEREAIDLLPEGFTHP

SEQ ID NO: 1692091 - protein, 26 aa, Staphylococcus aureus
EHKEDALDFTLWKKAKPGEISWDSPF

SEQ ID NO: 1692092 - protein, 27 aa, Staphylococcus aureus
EHKEDALDFTLWKKAKPGEISWDSPFG

SEQ ID NO: 1692093 - protein, 24 aa, Staphylococcus aureus
EHRRWGAPFPVIEIVKLGINKQEA

SEQ ID NO: 1692094 - protein, 24 aa, Staphylococcus aureus
EHRTSIYVPALFHKENVLTMNFDK

SEQ ID NO: 1692095 - protein, 26 aa, Staphylococcus aureus
EIDENISFYKLVNKFSPEVAPEDTVD

SEQ ID NO: 1692096 - protein, 29 aa, Staphylococcus aureus
EIEGIAYDRLWVHLIPIIKNQQSKIEKLE

SEQ ID NO: 1692097 - protein, 20 aa, Staphylococcus aureus
EIEMFKIMGLPFISHSIVSQ

SEQ ID NO: 1692098 - protein, 29 aa, Staphylococcus aureus
EIFDDLWMNLYYLFKNLRNLFKEEGLEPW

SEQ ID NO: 1692099 - protein, 26 aa, Staphylococcus aureus
EIFEQNFDLLFVKWIPREQNKEANQH

SEQ ID NO: 1692100 - protein, 25 aa, Staphylococcus aureus
EIHSNLPKCLFPLTLRTRQSGDTFK

SEQ ID NO: 1692101 - protein, 20 aa, Staphylococcus aureus
EIIKLIPGLENVDIVRYGVM

SEQ ID NO: 1692102 - protein, 17 aa, Staphylococcus aureus
EIILRNDPNLKGKIVFN

SEQ ID NO: 1692103 - protein, 18 aa, Staphylococcus aureus
EIKGLLTAKILRAQEMNI

SEQ ID NO: 1692104 - protein, 21 aa, Staphylococcus aureus
EIKIRYKVPKIAYASHLKSDV

SEQ ID NO: 1692105 - protein, 18 aa, Staphylococcus aureus
EILLLDESLSALDLKLRT

SEQ ID NO: 1692106 - protein, 17 aa, Staphylococcus aureus
EILYDTELGYYRGSNHL

SEQ ID NO: 1692107 - protein, 23 aa, Staphylococcus aureus
EIMELKQFIKSYVQSHSFIKSLV

SEQ ID NO: 1692108 - protein, 19 aa, Staphylococcus aureus
EIMEMYKPYAVYHAAAHKH

SEQ ID NO: 1692109 - protein, 24 aa, Staphylococcus aureus
EINSLPEFSQYIDKKLESEMNKDV

SEQ ID NO: 1692110 - protein, 27 aa, Staphylococcus aureus
EISIAQRLLIQTFFSTFSNKRTDHYGT

SEQ ID NO: 1692111 - protein, 22 aa, Staphylococcus aureus
EIVDVIKYLINTIPKIRKNLRH

SEQ ID NO: 1692112 - protein, 22 aa, Staphylococcus aureus
EIVKTMIFKVNGEYIMVLVRGH

SEQ ID NO: 1692113 - protein, 18 aa, Staphylococcus aureus
EIVPVEIELLPSGTLFKQ

SEQ ID NO: 1692114 - protein, 19 aa, Staphylococcus aureus
EIYAPLAHRLGINTIKWEL

SEQ ID NO: 1692115 - protein, 24 aa, Staphylococcus aureus
EKAGSNILGVILNKAKVDKSSSYY

SEQ ID NO: 1692116 - protein, 24 aa, Staphylococcus aureus
EKANQHFYIMDKQGLLFDDMDDLT

SEQ ID NO: 1692117 - protein, 23 aa, Staphylococcus aureus
EKANQRFYIMDKQGLLFDDMDEL

SEQ ID NO: 1692118 - protein, 18 aa, Staphylococcus aureus
EKAYQYVLNAEPSNLFET

SEQ ID NO: 1692119 - protein, 30 aa, Staphylococcus aureus
EKKKEYEKFGRWFFNKFKVNRSADAKKIIN

SEQ ID NO: 1692120 - protein, 22 aa, Staphylococcus aureus
EKQLSIVKPLPNGSFQILTEID

SEQ ID NO: 1692121 - protein, 17 aa, Staphylococcus aureus
EKRYTKRSQLRDFNVDE

SEQ ID NO: 1692122 - protein, 18 aa, Staphylococcus aureus
EKSYTKYLLTEGIEKITK

SEQ ID NO: 1692123 - protein, 21 aa, Staphylococcus aureus
EKVATPFPRISYDDAIEFLKS

SEQ ID NO: 1692124 - protein, 22 aa, Staphylococcus aureus
ELAKGRPLFEAVHKAKKFISLS

SEQ ID NO: 1692125 - protein, 17 aa, Staphylococcus aureus
ELAKKYLKNRLITGDIA

SEQ ID NO: 1692126 - protein, 29 aa, Staphylococcus aureus
ELEIPQELKLVPNWVLWRAEWNEKQQNFG

SEQ ID NO: 1692127 - protein, 29 aa, Staphylococcus aureus
ELEIPQELKLVPNWVLWRAEWNEKQQNYG

SEQ ID NO: 1692128 - protein, 23 aa, Staphylococcus aureus
ELENKVLMLGHAFPNQHEARENL

SEQ ID NO: 1692129 - protein, 30 aa, Staphylococcus aureus
ELEPWLNRRIRQLILKRWKKIKTKYKMLRK

SEQ ID NO: 1692130 - protein, 17 aa, Staphylococcus aureus
ELEQSHIDLLENGYPLK

SEQ ID NO: 1692131 - protein, 22 aa, Staphylococcus aureus
ELFPVKEGILQFWISSEDQMYG

SEQ ID NO: 1692132 - protein, 18 aa, Staphylococcus aureus
ELGYTFFNYHYTAKLIKS

SEQ ID NO: 1692133 - protein, 21 aa, Staphylococcus aureus
ELIRRLRRGIYAKQKVVVFKP

SEQ ID NO: 1692134 - protein, 17 aa, Staphylococcus aureus
ELKIWERWLHTQGYKDI

SEQ ID NO: 1692135 - protein, 17 aa, Staphylococcus aureus
ELKLLNKSLRVLNTELS

SEQ ID NO: 1692136 - protein, 20 aa, Staphylococcus aureus
ELLHVYLKEFGELIQKFHEI

SEQ ID NO: 1692137 - protein, 18 aa, Staphylococcus aureus
ELLIAIVSVKFDINYSLK

SEQ ID NO: 1692138 - protein, 17 aa, Staphylococcus aureus
ELLKYDSITIRHAYIEV

SEQ ID NO: 1692139 - protein, 19 aa, Staphylococcus aureus
ELLRYPYIESFEDVDEVIQ

SEQ ID NO: 1692140 - protein, 23 aa, Staphylococcus aureus
ELNERYTFLSEQRTDLRKAKETL

SEQ ID NO: 1692141 - protein, 18 aa, Staphylococcus aureus
ELRIGTWSILPFDIEHDA

SEQ ID NO: 1692142 - protein, 18 aa, Staphylococcus aureus
ELVPRWYVEYDGEWYVYN

SEQ ID NO: 1692143 - protein, 18 aa, Staphylococcus aureus
ELVQYFLHQLCKNNDQII

SEQ ID NO: 1692144 - protein, 25 aa, Staphylococcus aureus
EMDLPLKELALITGAALLARRRSKK

SEQ ID NO: 1692145 - protein, 25 aa, Staphylococcus aureus
EMHDLAFLLLVYPLSEYEGALDSAY

SEQ ID NO: 1692146 - protein, 20 aa, Staphylococcus aureus
EMKLVFLEGIFKTLLNKNSQ

SEQ ID NO: 1692147 - protein, 23 aa, Staphylococcus aureus
ENALNGDANLQRAKTEAIQAIDN

SEQ ID NO: 1692148 - protein, 23 aa, Staphylococcus aureus
ENDKKLVVSAPTKKPTSPTTYTE

SEQ ID NO: 1692149 - protein, 26 aa, Staphylococcus aureus
ENEKGILVYRDKSFHAILNFIDENKF

SEQ ID NO: 1692150 - protein, 19 aa, Staphylococcus aureus
ENFKFFGQYADFKSLKSYN

SEQ ID NO: 1692151 - protein, 24 aa, Staphylococcus aureus
ENKKVGLWSFDFNIDWHAGGDKRQ

SEQ ID NO: 1692152 - protein, 21 aa, Staphylococcus aureus
ENLLKKLIIYLKILRMIILQQ

SEQ ID NO: 1692153 - protein, 23 aa, Staphylococcus aureus
ENNVPMVLLAQINLDNLPEQQEL

SEQ ID NO: 1692154 - protein, 17 aa, Staphylococcus aureus
ENPWERLERLRKAIPNV

SEQ ID NO: 1692155 - protein, 23 aa, Staphylococcus aureus
ENYKERFYQIPKVFFTSENYKNL

SEQ ID NO: 1692156 - protein, 20 aa, Staphylococcus aureus
EPKIKLYVSLKCRNFDDVAQ

SEQ ID NO: 1692157 - protein, 21 aa, Staphylococcus aureus
EPKIKLYVSLKCRNFDDVAQK

SEQ ID NO: 1692158 - protein, 19 aa, Staphylococcus aureus
EPQFSQYTILALIARGHAM

SEQ ID NO: 1692159 - protein, 28 aa, Staphylococcus aureus
EPWSQPPSGYKWYDPTTFKAGSYGSEKG

SEQ ID NO: 1692160 - protein, 21 aa, Staphylococcus aureus
EQHLQAIIEWTLQQIENNFEF

SEQ ID NO: 1692161 - protein, 25 aa, Staphylococcus aureus
EQILKIQIEFLIAYATAQTELSMRE

SEQ ID NO: 1692162 - protein, 22 aa, Staphylococcus aureus
EQLMHHMCSGLTLLDSVKIVST

SEQ ID NO: 1692163 - protein, 20 aa, Staphylococcus aureus
EQTKLNVEAFSNAVKKAVNE

SEQ ID NO: 1692164 - protein, 19 aa, Staphylococcus aureus
ERDLVAAQLYLLEHNHLPF

SEQ ID NO: 1692165 - protein, 31 aa, Staphylococcus aureus
EREAILKRYNFISVLGWPTYYANLGYQRASM

SEQ ID NO: 1692166 - protein, 22 aa, Staphylococcus aureus
EREFIQEYYFNKKTLIAVCYDI

SEQ ID NO: 1692167 - protein, 23 aa, Staphylococcus aureus
ERFEPWTSCEFDFTRDGNLNVSF

SEQ ID NO: 1692168 - protein, 21 aa, Staphylococcus aureus
ERFIEMIQYFKEKITEGDMFQ

SEQ ID NO: 1692169 - protein, 18 aa, Staphylococcus aureus
ERGIDGLIIAQYISSPDA

SEQ ID NO: 1692170 - protein, 21 aa, Staphylococcus aureus
ERHMWYIVRDVLDNIFDQLVH

SEQ ID NO: 1692171 - protein, 26 aa, Staphylococcus aureus
ERLADSGVLVCTVIGFPLGASTTATK

SEQ ID NO: 1692172 - protein, 22 aa, Staphylococcus aureus
ERLTSYSLCSFGCGKTGSFNSF

SEQ ID NO: 1692173 - protein, 23 aa, Staphylococcus aureus
ERQKSFFDFYLKEENNDWKDTPH

SEQ ID NO: 1692174 - protein, 17 aa, Staphylococcus aureus
ERSKLKLNLLKHANSNL

SEQ ID NO: 1692175 - protein, 17 aa, Staphylococcus aureus
ERVKSLSTPYFLSGENF

SEQ ID NO: 1692176 - protein, 23 aa, Staphylococcus aureus
ERVYIASVLVLEPKLIIADEPVA

SEQ ID NO: 1692177 - protein, 19 aa, Staphylococcus aureus
ESFRRLFKYKKISKNLIGF

SEQ ID NO: 1692178 - protein, 19 aa, Staphylococcus aureus
ESLNTAMGNLINAIADHQA

SEQ ID NO: 1692179 - protein, 24 aa, Staphylococcus aureus
ESVIPGFDFYFVPTVLNSTDVAFH

SEQ ID NO: 1692180 - protein, 25 aa, Staphylococcus aureus
ETCKECLFYPYLLVQGEAGIGKSHL

SEQ ID NO: 1692181 - protein, 18 aa, Staphylococcus aureus
ETDLLQFIDAEELYKYPV

SEQ ID NO: 1692182 - protein, 23 aa, Staphylococcus aureus
ETIDPVIGLSPFQARRIAFNINI

SEQ ID NO: 1692183 - protein, 21 aa, Staphylococcus aureus
ETILNQQYYALDKTLFVALNN

SEQ ID NO: 1692184 - protein, 23 aa, Staphylococcus aureus
ETILNQQYYALDKTLFVALNNKA

SEQ ID NO: 1692185 - protein, 27 aa, Staphylococcus aureus
ETKKELLLLLMRLMKVKVKGYGEIIFK

SEQ ID NO: 1692186 - protein, 17 aa, Staphylococcus aureus
ETKVLTMGFIDDLLYPD

SEQ ID NO: 1692187 - protein, 18 aa, Staphylococcus aureus
ETLALDDMDLYTAKQFAY

SEQ ID NO: 1692188 - protein, 24 aa, Staphylococcus aureus
ETVQRFYNKGFFHENGQPDFLNIK

SEQ ID NO: 1692189 - protein, 18 aa, Staphylococcus aureus
ETVRFTIKKGSQGGIYKL

SEQ ID NO: 1692190 - protein, 17 aa, Staphylococcus aureus
ETWTTFFEYLKERGLQG

SEQ ID NO: 1692191 - protein, 18 aa, Staphylococcus aureus
EVAIYRRAEINLSVILCR

SEQ ID NO: 1692192 - protein, 18 aa, Staphylococcus aureus
EVALALYIRNDHYGAQTA

SEQ ID NO: 1692193 - protein, 17 aa, Staphylococcus aureus
EVDGEIIFKHGLSLAQV

SEQ ID NO: 1692194 - protein, 18 aa, Staphylococcus aureus
EVFCTLAYTGMRAGELLA

SEQ ID NO: 1692195 - protein, 27 aa, Staphylococcus aureus
EVFDDLWMELYRSFKKLRNIFKEESLE

SEQ ID NO: 1692196 - protein, 24 aa, Staphylococcus aureus
EVGRWFAYFVKHAPRVPFVIIGKN

SEQ ID NO: 1692197 - protein, 17 aa, Staphylococcus aureus
EVKDYLNGLKTVSVDDV

SEQ ID NO: 1692198 - protein, 17 aa, Staphylococcus aureus
EVLIRTSLIVREDAQLL

SEQ ID NO: 1692199 - protein, 22 aa, Staphylococcus aureus
EVLKEREHFAIFPASHFVTREE

SEQ ID NO: 1692200 - protein, 18 aa, Staphylococcus aureus
EVMGIPSLLVFKNGDKIA

SEQ ID NO: 1692201 - protein, 24 aa, Staphylococcus aureus
EVNLPELIQWAWDNPKLSGNKRFY

SEQ ID NO: 1692202 - protein, 25 aa, Staphylococcus aureus
EWQKQFPFWSLITIKRTIYSLEKQN

SEQ ID NO: 1692203 - protein, 18 aa, Staphylococcus aureus
EYDEAIVRFFKGDKETLR

SEQ ID NO: 1692204 - protein, 24 aa, Staphylococcus aureus
EYDLDLLHMHYAVPHAICGILARE

SEQ ID NO: 1692205 - protein, 17 aa, Staphylococcus aureus
EYDLTPSALGKWIKQHQ

SEQ ID NO: 1692206 - protein, 27 aa, Staphylococcus aureus
EYDNPVTEIYFIEPDLHFTIIDFNQEL

SEQ ID NO: 1692207 - protein, 21 aa, Staphylococcus aureus
EYELRAMLRMMPSLIDTGDDN

SEQ ID NO: 1692208 - protein, 23 aa, Staphylococcus aureus
EYFILLKHEFGIRWLRGRDFNDQ

SEQ ID NO: 1692209 - protein, 17 aa, Staphylococcus aureus
EYGDIFNYFVKKYSNII

SEQ ID NO: 1692210 - protein, 19 aa, Staphylococcus aureus
EYGDIFNYFVKKYSNIIFS

SEQ ID NO: 1692211 - protein, 17 aa, Staphylococcus aureus
EYHPYLTQHKLKLYLAA

SEQ ID NO: 1692212 - protein, 24 aa, Staphylococcus aureus
EYKKQRYELIGVIAKLRDCNKELE

SEQ ID NO: 1692213 - protein, 20 aa, Staphylococcus aureus
EYPNALLHWEDFGRGHAKNI

SEQ ID NO: 1692214 - protein, 17 aa, Staphylococcus aureus
EYRKYYEPLIHKNDKEF

SEQ ID NO: 1692215 - protein, 24 aa, Staphylococcus aureus
EYSLDFYYQAYKRIRKYGGGAIAS

SEQ ID NO: 1692216 - protein, 27 aa, Staphylococcus aureus
EYTKYKIGGTWYQFYKKVDEELTKKFV

SEQ ID NO: 1692217 - protein, 27 aa, Staphylococcus aureus
FDFFQDNGFGFITPYNLDDLNYYLDSF

SEQ ID NO: 1692218 - protein, 19 aa, Staphylococcus aureus
FDNRISVGVMYMLKLAHMV

SEQ ID NO: 1692219 - protein, 20 aa, Staphylococcus aureus
FDPFAILNKKDKLFESNDLD

SEQ ID NO: 1692220 - protein, 26 aa, Staphylococcus aureus
FEEMQPLYEWLGLTASLGFVDIVDYE

SEQ ID NO: 1692221 - protein, 28 aa, Staphylococcus aureus
FEKVTKLKRLPYWRSKGDTNYYWADIDT

SEQ ID NO: 1692222 - protein, 18 aa, Staphylococcus aureus
FENLYFVGGSVNPGGGIP

SEQ ID NO: 1692223 - protein, 23 aa, Staphylococcus aureus
FERYKLAFAIRDAAATKNVGTEN

SEQ ID NO: 1692224 - protein, 19 aa, Staphylococcus aureus
FETTAYIKAFLDSLNIKYD

SEQ ID NO: 1692225 - protein, 18 aa, Staphylococcus aureus
FFVEINENRPLNIPALVE

SEQ ID NO: 1692226 - protein, 29 aa, Staphylococcus aureus
FGHYNSEKRYFILNFFRRGTTLVGNEAIT

SEQ ID NO: 1692227 - protein, 19 aa, Staphylococcus aureus
FGMFIELPNMIEGMVHIAN

SEQ ID NO: 1692228 - protein, 18 aa, Staphylococcus aureus
FGRYVFGYAVRNWVKGFK

SEQ ID NO: 1692229 - protein, 24 aa, Staphylococcus aureus
FGSQLFRNTTFPDEKYLKELMDNY

SEQ ID NO: 1692230 - protein, 18 aa, Staphylococcus aureus
FGVIAKTLAASERKYREI

SEQ ID NO: 1692231 - protein, 17 aa, Staphylococcus aureus
FHNLKSILSKRGLETAV

SEQ ID NO: 1692232 - protein, 17 aa, Staphylococcus aureus
FHSVLKYISERINGDFK

SEQ ID NO: 1692233 - protein, 18 aa, Staphylococcus aureus
FICRFNVAILDDGYYLPM

SEQ ID NO: 1692234 - protein, 27 aa, Staphylococcus aureus
FIDAIKKYILTLKIEIIIFCIHITEDA

SEQ ID NO: 1692235 - protein, 36 aa, Staphylococcus aureus
FIDAQFEPLRKMEAPMFKKILKKHQLLDDAFRATQQ

SEQ ID NO: 1692236 - protein, 24 aa, Staphylococcus aureus
FIDAQFEPLRKMEAPMFKKILKNH

SEQ ID NO: 1692237 - protein, 35 aa, Staphylococcus aureus
FIEDKKALFIVYANPLALGLLTAPGSFGADIVVGD

SEQ ID NO: 1692238 - protein, 18 aa, Staphylococcus aureus
FIIELLGVNADQFRQLFI

SEQ ID NO: 1692239 - protein, 17 aa, Staphylococcus aureus
FIIQPTSYPVNLHLMEL

SEQ ID NO: 1692240 - protein, 19 aa, Staphylococcus aureus
FIKRLACLPSHIYRLKGFM

SEQ ID NO: 1692241 - protein, 20 aa, Staphylococcus aureus
FKARIMMIFSLYKGEKRRQP

SEQ ID NO: 1692242 - protein, 25 aa, Staphylococcus aureus
FKCHIDTTIKKQVPVCCFTFGIPSE

SEQ ID NO: 1692243 - protein, 27 aa, Staphylococcus aureus
FKEERTVYLPKAYHPLLNRETVVANTI

SEQ ID NO: 1692244 - protein, 26 aa, Staphylococcus aureus
FKEKPNSRWLFLTLSIRNAIGGDTLE

SEQ ID NO: 1692245 - protein, 25 aa, Staphylococcus aureus
FKEKRTFSKFEAWIYLLMEANHSEA

SEQ ID NO: 1692246 - protein, 28 aa, Staphylococcus aureus
FKEKRTFSKFEAWIYLLMEANHSKAKVP

SEQ ID NO: 1692247 - protein, 17 aa, Staphylococcus aureus
FKFFVQYGNFKELENYK

SEQ ID NO: 1692248 - protein, 23 aa, Staphylococcus aureus
FKHMRVRMMPAQQPPYTRLIDSA

SEQ ID NO: 1692249 - protein, 19 aa, Staphylococcus aureus
FKKSQLIEQFIRSLEVSIA

SEQ ID NO: 1692250 - protein, 17 aa, Staphylococcus aureus
FKLNLMLNAFSSDFYYF

SEQ ID NO: 1692251 - protein, 18 aa, Staphylococcus aureus
FKLQIIFVILKMSETKMI

SEQ ID NO: 1692252 - protein, 25 aa, Staphylococcus aureus
FKNGKQYIRWETINKYLGKYLSQEV

SEQ ID NO: 1692253 - protein, 18 aa, Staphylococcus aureus
FLEGIFKTLLNKNSQVVF

SEQ ID NO: 1692254 - protein, 17 aa, Staphylococcus aureus
FLIQSGDLTSILNSNDL

SEQ ID NO: 1692255 - protein, 28 aa, Staphylococcus aureus
FLKEELYKIFMYVKTFYFQHTPFDDSYI

SEQ ID NO: 1692256 - protein, 25 aa, Staphylococcus aureus
FLKHLKNILILIKQGKKPLAQAGHF

SEQ ID NO: 1692257 - protein, 18 aa, Staphylococcus aureus
FLQELEPWLNRRIRQLIL

SEQ ID NO: 1692258 - protein, 23 aa, Staphylococcus aureus
FNAAFDLILKQNKVRDAHPEVTL

SEQ ID NO: 1692259 - protein, 20 aa, Staphylococcus aureus
FNEIIIATPAQWISHTQDIF

SEQ ID NO: 1692260 - protein, 30 aa, Staphylococcus aureus
FNEQRQFLQPLIYIPEIQSLIWENSCGSGT

SEQ ID NO: 1692261 - protein, 18 aa, Staphylococcus aureus
FNHIIQVGYLRNLLNTQY

SEQ ID NO: 1692262 - protein, 20 aa, Staphylococcus aureus
FNIYNRYTLHRFNEEYALEP

SEQ ID NO: 1692263 - protein, 17 aa, Staphylococcus aureus
FNKKTLIAVCYDIHISE

SEQ ID NO: 1692264 - protein, 25 aa, Staphylococcus aureus
FNNKHDLAALSYLTFVALDDDGKPK

SEQ ID NO: 1692265 - protein, 40 aa, Staphylococcus aureus
FNVDLWYAFQCFDYANAGWKALFGLLLKGVGAKDIPFANN

SEQ ID NO: 1692266 - protein, 25 aa, Staphylococcus aureus
FNVERLLMDYLSALPYQLTESSYLT

SEQ ID NO: 1692267 - protein, 28 aa, Staphylococcus aureus
FNVLQPSPFHWRLLDKITLSTLYEVVLP

SEQ ID NO: 1692268 - protein, 18 aa, Staphylococcus aureus
FPLVLGGDHSIAVGSVSA

SEQ ID NO: 1692269 - protein, 24 aa, Staphylococcus aureus
FPSLETIFNLLIGFKTHIEYKMGS

SEQ ID NO: 1692270 - protein, 27 aa, Staphylococcus aureus
FQCYDYANMFFMIATGERLQGLYAYNI

SEQ ID NO: 1692271 - protein, 21 aa, Staphylococcus aureus
FQNDGYRIGYGGGYYDRFLAN

SEQ ID NO: 1692272 - protein, 24 aa, Staphylococcus aureus
FQPMNANFGLLPSLETRIKDKKER

SEQ ID NO: 1692273 - protein, 19 aa, Staphylococcus aureus
FQSIYMTWNSQKFFDLIKY

SEQ ID NO: 1692274 - protein, 21 aa, Staphylococcus aureus
FRDILINECIYFASKNKKLVR

SEQ ID NO: 1692275 - protein, 24 aa, Staphylococcus aureus
FRERFEPLYRSRVVKFITEKSELM

SEQ ID NO: 1692276 - protein, 24 aa, Staphylococcus aureus
FSAKPYLHCVFNKDILNMDKVDIE

SEQ ID NO: 1692277 - protein, 18 aa, Staphylococcus aureus
FSELLEEKVPLIDLNYVN

SEQ ID NO: 1692278 - protein, 23 aa, Staphylococcus aureus
FSELNNIFINLSIQHASLLSEAT

SEQ ID NO: 1692279 - protein, 27 aa, Staphylococcus aureus
FSENLRNLLLQPPMKGKQILGVDPAFR

SEQ ID NO: 1692280 - protein, 23 aa, Staphylococcus aureus
FSTNTFPSWKRAHPNRMLMHNGE

SEQ ID NO: 1692281 - protein, 23 aa, Staphylococcus aureus
FTEGKYSVLDFGSGTTIIDTYQN

SEQ ID NO: 1692282 - protein, 18 aa, Staphylococcus aureus
FTLKRLSNYVIIKDRSYP

SEQ ID NO: 1692283 - protein, 24 aa, Staphylococcus aureus
FVANSFAMRLNQLGKQAFVIGEST

SEQ ID NO: 1692284 - protein, 18 aa, Staphylococcus aureus
FVDHRTLIYFPAYSFHKK

SEQ ID NO: 1692285 - protein, 28 aa, Staphylococcus aureus
FVHLGIGYAIIPRFYYQSFNTSNLEYKK

SEQ ID NO: 1692286 - protein, 26 aa, Staphylococcus aureus
FVICCQFYHQYFYQHTLIGANGAMIS

SEQ ID NO: 1692287 - protein, 19 aa, Staphylococcus aureus
FVKYFIKRCAMEKGIFNYD

SEQ ID NO: 1692288 - protein, 32 aa, Staphylococcus aureus
FYCTPKKETDILFILSLFRKINWKVYDESTGV

SEQ ID NO: 1692289 - protein, 23 aa, Staphylococcus aureus
FYNTPARLKYIKSLYTELGKITD

SEQ ID NO: 1692290 - protein, 18 aa, Staphylococcus aureus
FYYDLFDFKVKKRVDFLK

SEQ ID NO: 1692291 - protein, 17 aa, Staphylococcus aureus
FYYFVKHNQKLTKQQFL

SEQ ID NO: 1692292 - protein, 23 aa, Staphylococcus aureus
GADGLIFHPYLAGERAPLWNANA

SEQ ID NO: 1692293 - protein, 24 aa, Staphylococcus aureus
GAEVLGVVAIFTYGLKKADDTFSN

SEQ ID NO: 1692294 - protein, 24 aa, Staphylococcus aureus
GAGNDFLGWVDLPVDYDKEEFSRI

SEQ ID NO: 1692295 - protein, 17 aa, Staphylococcus aureus
GAMTVLKAAIADKERTK

SEQ ID NO: 1692296 - protein, 28 aa, Staphylococcus aureus
GANLDPSHLWWQGIDPIAAIRILGQANA

SEQ ID NO: 1692297 - protein, 29 aa, Staphylococcus aureus
GATLSTIDSYLLLRGLKTLHLRIERAQSN

SEQ ID NO: 1692298 - protein, 23 aa, Staphylococcus aureus
GCRDDIMVYLMYAGLEASMAFKI

SEQ ID NO: 1692299 - protein, 17 aa, Staphylococcus aureus
GDAFYAIKTPTMTSYTL

SEQ ID NO: 1692300 - protein, 17 aa, Staphylococcus aureus
GDAVDALQLRFILDWNS

SEQ ID NO: 1692301 - protein, 17 aa, Staphylococcus aureus
GDIFNYFVKKYSNIIFS

SEQ ID NO: 1692302 - protein, 21 aa, Staphylococcus aureus
GDILLQVLLHTSIGKKEGYID

SEQ ID NO: 1692303 - protein, 33 aa, Staphylococcus aureus
GDIPNNLLFYIYGSLIEGFLHWIKDEKIDWPSE

SEQ ID NO: 1692304 - protein, 17 aa, Staphylococcus aureus
GDKLLVKTLFIDEIKRQ

SEQ ID NO: 1692305 - protein, 31 aa, Staphylococcus aureus
GDLSTVAVVYPFLDKEISFSVSIYGSIVLYT

SEQ ID NO: 1692306 - protein, 31 aa, Staphylococcus aureus
GEIEGIAYDRLWIHLIPVIKEQQLRIKKLEE

SEQ ID NO: 1692307 - protein, 25 aa, Staphylococcus aureus
GEPIQYIVGFASFYGRKFDVNSNCL

SEQ ID NO: 1692308 - protein, 19 aa, Staphylococcus aureus
GEQFFKDNFGLKVKATNVV

SEQ ID NO: 1692309 - protein, 24 aa, Staphylococcus aureus
GESIKDVLTKYKNPMYSYNEDGTE

SEQ ID NO: 1692310 - protein, 27 aa, Staphylococcus aureus
GEVGRTLYNFIWDDFCDWYIEMSKIPM

SEQ ID NO: 1692311 - protein, 24 aa, Staphylococcus aureus
GEYFEEFIIFILTCSNIFECTKNI

SEQ ID NO: 1692312 - protein, 21 aa, Staphylococcus aureus
GFAMPMLLAISHVHQLLIKAD

SEQ ID NO: 1692313 - protein, 18 aa, Staphylococcus aureus
GFNRKEIINFEKTIGKAY

SEQ ID NO: 1692314 - protein, 26 aa, Staphylococcus aureus
GFRNEYYYLTAIPYTLDEYKKYFQPL

SEQ ID NO: 1692315 - protein, 19 aa, Staphylococcus aureus
GFWVPNDYVVVKVALRGSD

SEQ ID NO: 1692316 - protein, 20 aa, Staphylococcus aureus
GGAVRKLGEFKNYLGGIGKS

SEQ ID NO: 1692317 - protein, 29 aa, Staphylococcus aureus
GGEEQLNDIAYLKATFKTNKKINGDTKDI

SEQ ID NO: 1692318 - protein, 25 aa, Staphylococcus aureus
GGITDTGFYRFWTQGIFARWTDNPN

SEQ ID NO: 1692319 - protein, 17 aa, Staphylococcus aureus
GIAIAFLNDPQFIILDE

SEQ ID NO: 1692320 - protein, 23 aa, Staphylococcus aureus
GIDDLLEMIGLVAEVQELKANPK

SEQ ID NO: 1692321 - protein, 24 aa, Staphylococcus aureus
GIDVPTLDAVIFLAPKKSQVDIVQ

SEQ ID NO: 1692322 - protein, 19 aa, Staphylococcus aureus
GINPNWLTKPVLGEIFKDV

SEQ ID NO: 1692323 - protein, 17 aa, Staphylococcus aureus
GIVISLLSLNHIEVSDD

SEQ ID NO: 1692324 - protein, 18 aa, Staphylococcus aureus
GKDYLVVPGTNLLEFIKS

SEQ ID NO: 1692325 - protein, 23 aa, Staphylococcus aureus
GKTYKGIMPNWEPGKKVHLVGHS

SEQ ID NO: 1692326 - protein, 25 aa, Staphylococcus aureus
GKWKIPIIFHLLQDKVLRLSELQKK

SEQ ID NO: 1692327 - protein, 17 aa, Staphylococcus aureus
GLDLSIYGKAYEIMIRN

SEQ ID NO: 1692328 - protein, 23 aa, Staphylococcus aureus
GLEDIAIMYKYHSIISNSDNDPE

SEQ ID NO: 1692329 - protein, 17 aa, Staphylococcus aureus
GLLDLGFRSYQNVRFEL

SEQ ID NO: 1692330 - protein, 20 aa, Staphylococcus aureus
GLLTAKILRAQEMNIPISIE

SEQ ID NO: 1692331 - protein, 28 aa, Staphylococcus aureus
GLNSNWDMLFIVFSIHLIDILKKLSHDE

SEQ ID NO: 1692332 - protein, 20 aa, Staphylococcus aureus
GLQIRHYTVQSLKLLKTHFN

SEQ ID NO: 1692333 - protein, 25 aa, Staphylococcus aureus
GLRKDLRLCNWPKFINRLNSVSKKS

SEQ ID NO: 1692334 - protein, 18 aa, Staphylococcus aureus
GLTALPNAIQLSKANVVD

SEQ ID NO: 1692335 - protein, 18 aa, Staphylococcus aureus
GLYNLKLFAQVLGKGFDK

SEQ ID NO: 1692336 - protein, 26 aa, Staphylococcus aureus
GMDLPLKEFALITGAALLARRRTKNE

SEQ ID NO: 1692337 - protein, 21 aa, Staphylococcus aureus
GMIGPTIIPGKTLCWECIVDY

SEQ ID NO: 1692338 - protein, 26 aa, Staphylococcus aureus
GMIPVEWEQVFTIAYVTDQAGEVIFN

SEQ ID NO: 1692339 - protein, 23 aa, Staphylococcus aureus
GNDTAVDPMKWLKSLKGGGGKVG

SEQ ID NO: 1692340 - protein, 25 aa, Staphylococcus aureus
GNFVRGAHLHFQLMRGSHPGNDTAV

SEQ ID NO: 1692341 - protein, 19 aa, Staphylococcus aureus
GNHKKQFYVTLKLNNEIIK

SEQ ID NO: 1692342 - protein, 26 aa, Staphylococcus aureus
GNIAVPLDLPALFKGYYKEPERTAKA

SEQ ID NO: 1692343 - protein, 27 aa, Staphylococcus aureus
GNKYSNIDLGLTQWGFKQLPNESYIDY

SEQ ID NO: 1692344 - protein, 21 aa, Staphylococcus aureus
GNLVYRNNFYNEVYTQPVYDL

SEQ ID NO: 1692345 - protein, 22 aa, Staphylococcus aureus
GNLVYRNNFYNEVYTQPVYDLD

SEQ ID NO: 1692346 - protein, 24 aa, Staphylococcus aureus
GNQDNWTYPPFQLTEKDGKLYGRG

SEQ ID NO: 1692347 - protein, 24 aa, Staphylococcus aureus
GNQIKCHYVLMTYYNIICHYGEQA

SEQ ID NO: 1692348 - protein, 17 aa, Staphylococcus aureus
GNRFLNILVVCISGMGT

SEQ ID NO: 1692349 - protein, 18 aa, Staphylococcus aureus
GNSKYLFTYFVKHNPMTA

SEQ ID NO: 1692350 - protein, 23 aa, Staphylococcus aureus
GNTVCYMWLRFNMDQQFDDTAIN

SEQ ID NO: 1692351 - protein, 17 aa, Staphylococcus aureus
GPCVYDVDLSKYAQMTK

SEQ ID NO: 1692352 - protein, 24 aa, Staphylococcus aureus
GQINQIREYCDFNNFVVVDVYADR

SEQ ID NO: 1692353 - protein, 20 aa, Staphylococcus aureus
GQRQMELIKILFQKAQEVDS

SEQ ID NO: 1692354 - protein, 23 aa, Staphylococcus aureus
GQSGYAAFVVFNMMFGGDPSSVL

SEQ ID NO: 1692355 - protein, 24 aa, Staphylococcus aureus
GQTPQSFNIKLLQDSYRALSSAQK

SEQ ID NO: 1692356 - protein, 24 aa, Staphylococcus aureus
GREHYYMYKKFGIWPEKEYAINWV

SEQ ID NO: 1692357 - protein, 26 aa, Staphylococcus aureus
GRGMTINRMYWRARRRESIFMTYILK

SEQ ID NO: 1692358 - protein, 21 aa, Staphylococcus aureus
GRLMDSLINYLDVIEYTTLSE

SEQ ID NO: 1692359 - protein, 27 aa, Staphylococcus aureus
GRLVDTKTLFLEYRKKLQDVYTDVEDV

SEQ ID NO: 1692360 - protein, 19 aa, Staphylococcus aureus
GRRNKFCENIISVPLPLAF

SEQ ID NO: 1692361 - protein, 23 aa, Staphylococcus aureus
GRYSVLTAVGLLPIAAAGINIEA

SEQ ID NO: 1692362 - protein, 19 aa, Staphylococcus aureus
GRYVSLYLSYEAAKYFNHV

SEQ ID NO: 1692363 - protein, 19 aa, Staphylococcus aureus
GSEYDLYKFAPTKKHPNGY

SEQ ID NO: 1692364 - protein, 18 aa, Staphylococcus aureus
GSKEMILILDFTEATNLT

SEQ ID NO: 1692365 - protein, 21 aa, Staphylococcus aureus
GSNFYWMDYYTIKQIIQRLGV

SEQ ID NO: 1692366 - protein, 17 aa, Staphylococcus aureus
GSPIIECNERMIRLSDA

SEQ ID NO: 1692367 - protein, 23 aa, Staphylococcus aureus
GTDDDWLHDYWAGVPIGTDKTDT

SEQ ID NO: 1692368 - protein, 17 aa, Staphylococcus aureus
GTDYVYAEFYDNAYYYV

SEQ ID NO: 1692369 - protein, 24 aa, Staphylococcus aureus
GTEHYYEFHTKKGMLLVTTDGKKN

SEQ ID NO: 1692370 - protein, 18 aa, Staphylococcus aureus
GTFTLAVNRTFTNAQGER

SEQ ID NO: 1692371 - protein, 32 aa, Staphylococcus aureus
GTGDLSYRKLLPSIFNLYKKGHFKKLVIISTG

SEQ ID NO: 1692372 - protein, 28 aa, Staphylococcus aureus
GTGKSHAFLLPLMQLFDSEIKEPQAIVV

SEQ ID NO: 1692373 - protein, 17 aa, Staphylococcus aureus
GTKKARFDDKKVVSFGA

SEQ ID NO: 1692374 - protein, 21 aa, Staphylococcus aureus
GTKKRIRYYSCSNFRNKGSKV

SEQ ID NO: 1692375 - protein, 17 aa, Staphylococcus aureus
GTKQHLLAIDDIGIMKE

SEQ ID NO: 1692376 - protein, 28 aa, Staphylococcus aureus
GTKSLVKLFKTFPTKIIGLLKLFENNND

SEQ ID NO: 1692377 - protein, 24 aa, Staphylococcus aureus
GTNFDVLPLIYQLPNESVKFYEYP

SEQ ID NO: 1692378 - protein, 20 aa, Staphylococcus aureus
GTRPLLIEVQALVTPTTFNN

SEQ ID NO: 1692379 - protein, 49 aa, Staphylococcus aureus
GTVKRKYTLDFYLRPFVKTKIKAWVRQLLWMSIYQYVYLDKVPNHAIIN

SEQ ID NO: 1692380 - protein, 22 aa, Staphylococcus aureus
GTYYFHGHIVPGWQGVKKTFNT

SEQ ID NO: 1692381 - protein, 29 aa, Staphylococcus aureus
GVDREIRLRPSYFPFTEPSVEVDVSCFKC

SEQ ID NO: 1692382 - protein, 19 aa, Staphylococcus aureus
GVEAFFATIPGIIHTEAGR

SEQ ID NO: 1692383 - protein, 18 aa, Staphylococcus aureus
GVFFHERKALSHFEKRYT

SEQ ID NO: 1692384 - protein, 25 aa, Staphylococcus aureus
GVGPLTITMVLNNTLLAEKMRRGFD

SEQ ID NO: 1692385 - protein, 26 aa, Staphylococcus aureus
GVGSLLVQQLAKENLPFTAGVRQSDQ

SEQ ID NO: 1692386 - protein, 30 aa, Staphylococcus aureus
GVVGKFVEFFGPGVQYLPLADRATIANMAP

SEQ ID NO: 1692387 - protein, 17 aa, Staphylococcus aureus
GWLKRRIETLYKVTLNN

SEQ ID NO: 1692388 - protein, 20 aa, Staphylococcus aureus
GYEEFIIASAAFKQNAPSFI

SEQ ID NO: 1692389 - protein, 26 aa, Staphylococcus aureus
GYENPDLGTFFLMDTTSRIIGHDARE

SEQ ID NO: 1692390 - protein, 24 aa, Staphylococcus aureus
GYYDGITFHRVINDFMIQGGDPTA

SEQ ID NO: 1692391 - protein, 32 aa, Staphylococcus aureus
HAAPPEEILQSSPFIWFKDALDGYDYLVEQGY

SEQ ID NO: 1692392 - protein, 20 aa, Staphylococcus aureus
HAPFANYWMHNGFINIDNEK

SEQ ID NO: 1692393 - protein, 17 aa, Staphylococcus aureus
HCEAFKANFKGAAQGDW

SEQ ID NO: 1692394 - protein, 18 aa, Staphylococcus aureus
HCFFKGKLPDNRKKKRTD

SEQ ID NO: 1692395 - protein, 18 aa, Staphylococcus aureus
HCGYFATTKKLMRKVPGR

SEQ ID NO: 1692396 - protein, 19 aa, Staphylococcus aureus
HDINGNVPIFINIGEWDGD

SEQ ID NO: 1692397 - protein, 18 aa, Staphylococcus aureus
HDKKFILMTAHRRENIGQ

SEQ ID NO: 1692398 - protein, 22 aa, Staphylococcus aureus
HDLSYIALDGDIGCMVNGAGLA

SEQ ID NO: 1692399 - protein, 18 aa, Staphylococcus aureus
HDTIVAGGNYTNASPDKQ

SEQ ID NO: 1692400 - protein, 23 aa, Staphylococcus aureus
HDYAFDIRGLYTKASLSVLTSDY

SEQ ID NO: 1692401 - protein, 25 aa, Staphylococcus aureus
HENIGFGYIGFDALNYIVHHDSFKD

SEQ ID NO: 1692402 - protein, 17 aa, Staphylococcus aureus
HEPWTSCEFDFTRDGKL

SEQ ID NO: 1692403 - protein, 19 aa, Staphylococcus aureus
HFAIFPASHFVTREEKLKV

SEQ ID NO: 1692404 - protein, 23 aa, Staphylococcus aureus
HGFKNYVALLFHKGAILEDKYHT

SEQ ID NO: 1692405 - protein, 19 aa, Staphylococcus aureus
HGIVFNASLPLYKDAIHQK

SEQ ID NO: 1692406 - protein, 17 aa, Staphylococcus aureus
HGLLYEQELGLQVTIFD

SEQ ID NO: 1692407 - protein, 30 aa, Staphylococcus aureus
HGNEFPISAGFFFINPFEVVYYAGGTSNAF

SEQ ID NO: 1692408 - protein, 17 aa, Staphylococcus aureus
HGYIFLTDFTSRNQYQP

SEQ ID NO: 1692409 - protein, 19 aa, Staphylococcus aureus
HISLLVEMNISLKAIMKRV

SEQ ID NO: 1692410 - protein, 25 aa, Staphylococcus aureus
HIYSEYFFRDLLNIVYGYSLENHNK

SEQ ID NO: 1692411 - protein, 18 aa, Staphylococcus aureus
HKEFTIPVKFTIKVVLTD

SEQ ID NO: 1692412 - protein, 21 aa, Staphylococcus aureus
HKGKMAFRVYPKWCNQLNKTA

SEQ ID NO: 1692413 - protein, 18 aa, Staphylococcus aureus
HLKAMIPWEGLNDMYREV

SEQ ID NO: 1692414 - protein, 29 aa, Staphylococcus aureus
HLKNVDVFKALRFLRPRTAGRHYIIITLW

SEQ ID NO: 1692415 - protein, 17 aa, Staphylococcus aureus
HLLSISEIYYELLNLIK

SEQ ID NO: 1692416 - protein, 19 aa, Staphylococcus aureus
HLNQDVTIGAWLTNKRSSG

SEQ ID NO: 1692417 - protein, 20 aa, Staphylococcus aureus
HLQAIIEWALQQIENNFDFE

SEQ ID NO: 1692418 - protein, 23 aa, Staphylococcus aureus
HMHRKTSLGYYLDKQFEGKGVMT

SEQ ID NO: 1692419 - protein, 29 aa, Staphylococcus aureus
HMMHVTISYPLPDNQLLTQLFTELEEGAV

SEQ ID NO: 1692420 - protein, 17 aa, Staphylococcus aureus
HMNMSLFKFLLTLSNEK

SEQ ID NO: 1692421 - protein, 20 aa, Staphylococcus aureus
HNEWRKRWENVQNKHLEKNG

SEQ ID NO: 1692422 - protein, 26 aa, Staphylococcus aureus
HNNQMFDLFHLYIEQFDKIIEKFHEI

SEQ ID NO: 1692423 - protein, 21 aa, Staphylococcus aureus
HPFFICQILAFLFPTSPHVNL

SEQ ID NO: 1692424 - protein, 17 aa, Staphylococcus aureus
HQTITQIKKLASAVPEH

SEQ ID NO: 1692425 - protein, 19 aa, Staphylococcus aureus
HRSWRKVSIQKCASWRGPN

SEQ ID NO: 1692426 - protein, 20 aa, Staphylococcus aureus
HSHLSVLQNLATILGDNQTV

SEQ ID NO: 1692427 - protein, 22 aa, Staphylococcus aureus
HTNNHLLPYFKSIDVFKMTTQD

SEQ ID NO: 1692428 - protein, 25 aa, Staphylococcus aureus
HTNPLWHVYRLVKFSKVFKNVIIIE

SEQ ID NO: 1692429 - protein, 17 aa, Staphylococcus aureus
HTTQNLIIPIYGKAESL

SEQ ID NO: 1692430 - protein, 24 aa, Staphylococcus aureus
HTTQNLIIPIYGKAESLNVAIAGS

SEQ ID NO: 1692431 - protein, 24 aa, Staphylococcus aureus
HVKAKKIKLPKGKKPLIISIDDMN

SEQ ID NO: 1692432 - protein, 28 aa, Staphylococcus aureus
HVQTVGKGGLLITLAKLSAHYGLGLKSS

SEQ ID NO: 1692433 - protein, 17 aa, Staphylococcus aureus
HVQYLFKQNNNIPNDVL

SEQ ID NO: 1692434 - protein, 17 aa, Staphylococcus aureus
HWNSNHFFPNMPSSLEQ

SEQ ID NO: 1692435 - protein, 17 aa, Staphylococcus aureus
IAMIQFKLEIPIIKRRP

SEQ ID NO: 1692436 - protein, 17 aa, Staphylococcus aureus
IANLKECGYLHVEIIRN

SEQ ID NO: 1692437 - protein, 24 aa, Staphylococcus aureus
IAPKPCHEILKDTIKQGLYFKPKV

SEQ ID NO: 1692438 - protein, 24 aa, Staphylococcus aureus
IAQQDMLIPWEMIPRCPKCDAPME

SEQ ID NO: 1692439 - protein, 17 aa, Staphylococcus aureus
IATKVKFPVTINGFSNV

SEQ ID NO: 1692440 - protein, 20 aa, Staphylococcus aureus
IATYIFRHREETSRFLTMQR

SEQ ID NO: 1692441 - protein, 18 aa, Staphylococcus aureus
ICYLHMNMSLFKFLLTLS

SEQ ID NO: 1692442 - protein, 23 aa, Staphylococcus aureus
IDAEFYMEGYFVKHMNFSGHNLL

SEQ ID NO: 1692443 - protein, 22 aa, Staphylococcus aureus
IDAFGMRPYIKKKVKKYSMGMK

SEQ ID NO: 1692444 - protein, 19 aa, Staphylococcus aureus
IDELSICSDYLFVKIKGRN

SEQ ID NO: 1692445 - protein, 23 aa, Staphylococcus aureus
IDFIGNYKTNYLIPIALSGDQSQ

SEQ ID NO: 1692446 - protein, 18 aa, Staphylococcus aureus
IDGGFSPLAIAIHIVYFD

SEQ ID NO: 1692447 - protein, 23 aa, Staphylococcus aureus
IDGKYARLPVTDKILCMNGSYVI

SEQ ID NO: 1692448 - protein, 18 aa, Staphylococcus aureus
IDGLAQLNNAQKAKLKEQ

SEQ ID NO: 1692449 - protein, 19 aa, Staphylococcus aureus
IDGTINWVTDVVTGAFGVK

SEQ ID NO: 1692450 - protein, 25 aa, Staphylococcus aureus
IDIEKYDVITLASSKYMVFEAQGAV

SEQ ID NO: 1692451 - protein, 17 aa, Staphylococcus aureus
IDIIMPNMTKGQALKRL

SEQ ID NO: 1692452 - protein, 28 aa, Staphylococcus aureus
IDKKDILPLRIILGAVNLYGILSTNHLL

SEQ ID NO: 1692453 - protein, 23 aa, Staphylococcus aureus
IDKLICSWLKRIDNVIPQLIMEM

SEQ ID NO: 1692454 - protein, 25 aa, Staphylococcus aureus
IDKNRIKRMLVDRPTLLKHTDDFLK

SEQ ID NO: 1692455 - protein, 29 aa, Staphylococcus aureus
IDLKAYGLTPRLHLFMEDGSIFKNEPLII

SEQ ID NO: 1692456 - protein, 38 aa, Staphylococcus aureus
IDNLKPKKLKFKSQNWYWFAYFDVPLKLPKNPRGSVKF

SEQ ID NO: 1692457 - protein, 23 aa, Staphylococcus aureus
IDTKHFPIELFRKYSKDLYDKTH

SEQ ID NO: 1692458 - protein, 24 aa, Staphylococcus aureus
IDTPIKFILLNIDPAQITTILDEL

SEQ ID NO: 1692459 - protein, 23 aa, Staphylococcus aureus
IDTPIKIILLNIDPAQITTILDE

SEQ ID NO: 1692460 - protein, 22 aa, Staphylococcus aureus
IDTPIKIILLNIEPTQITTILD

SEQ ID NO: 1692461 - protein, 21 aa, Staphylococcus aureus
IDTPIKVILLNIDPAQITTIL

SEQ ID NO: 1692462 - protein, 23 aa, Staphylococcus aureus
IDTQIKVFKKNNKFPRNLEYVDS

SEQ ID NO: 1692463 - protein, 40 aa, Staphylococcus aureus
IDYTYVRMAMYMDPLKPYLPELMKMHKLIYPAGDGRINYI

SEQ ID NO: 1692464 - protein, 27 aa, Staphylococcus aureus
IDYTYVRMAMYMDPLKPYLPELMNMHK

SEQ ID NO: 1692465 - protein, 17 aa, Staphylococcus aureus
IDYVFADELLNHVSPPI

SEQ ID NO: 1692466 - protein, 17 aa, Staphylococcus aureus
IECNERMIRLSDAFTNA

SEQ ID NO: 1692467 - protein, 21 aa, Staphylococcus aureus
IEDKKLRALKPGEALVQTEYC

SEQ ID NO: 1692468 - protein, 18 aa, Staphylococcus aureus
IEDVEKRLFLARKQLEFY

SEQ ID NO: 1692469 - protein, 24 aa, Staphylococcus aureus
IEGVKEALIDLKAKGYKLGIVTSD

SEQ ID NO: 1692470 - protein, 22 aa, Staphylococcus aureus
IEIEYIVDWFLKAREKYGLEKV

SEQ ID NO: 1692471 - protein, 19 aa, Staphylococcus aureus
IEKSRLKALYLSVIDRIDI

SEQ ID NO: 1692472 - protein, 18 aa, Staphylococcus aureus
IEMNQGISFLPIYITTNS

SEQ ID NO: 1692473 - protein, 19 aa, Staphylococcus aureus
IENKIPVINIPVGYVANLK

SEQ ID NO: 1692474 - protein, 26 aa, Staphylococcus aureus
IENLKNIPLIPKSKLPDILHHKFLEM

SEQ ID NO: 1692475 - protein, 19 aa, Staphylococcus aureus
IENNKIRFLKLKVGKIINV

SEQ ID NO: 1692476 - protein, 21 aa, Staphylococcus aureus
IEPYFHKVVLLSGALRLDTLK

SEQ ID NO: 1692477 - protein, 26 aa, Staphylococcus aureus
IEQSNKLFLLFINTYGEIFELNNKEY

SEQ ID NO: 1692478 - protein, 27 aa, Staphylococcus aureus
IEQTVQRFYNKGFFHENGQPDFLNIKI

SEQ ID NO: 1692479 - protein, 25 aa, Staphylococcus aureus
IEQYKRTMFWLEFEIRQYTHSNITL

SEQ ID NO: 1692480 - protein, 17 aa, Staphylococcus aureus
IESKIFIKGYTITNKSV

SEQ ID NO: 1692481 - protein, 17 aa, Staphylococcus aureus
IETGWAVNRLLDNNELS

SEQ ID NO: 1692482 - protein, 24 aa, Staphylococcus aureus
IEYIADFALYLDGKLIEVIDIKGM

SEQ ID NO: 1692483 - protein, 20 aa, Staphylococcus aureus
IFEMYYAYSEPIKRIANHRV

SEQ ID NO: 1692484 - protein, 17 aa, Staphylococcus aureus
IFGDRDMYFISENGAVI

SEQ ID NO: 1692485 - protein, 17 aa, Staphylococcus aureus
IFNYFVKKYSNIIFSAH

SEQ ID NO: 1692486 - protein, 25 aa, Staphylococcus aureus
IGACDDVILKFFNLNTKQYEETHIT

SEQ ID NO: 1692487 - protein, 19 aa, Staphylococcus aureus
IGFLIEHPKLYDNKSGLYN

SEQ ID NO: 1692488 - protein, 19 aa, Staphylococcus aureus
IGKAFARRLQGFNTNILYH

SEQ ID NO: 1692489 - protein, 20 aa, Staphylococcus aureus
IGKAFARRLQGFNTNILYHN

SEQ ID NO: 1692490 - protein, 21 aa, Staphylococcus aureus
IGRELLLDYQFVEKIKDGRED

SEQ ID NO: 1692491 - protein, 17 aa, Staphylococcus aureus
IGVKYLTLYAFSTENWS

SEQ ID NO: 1692492 - protein, 25 aa, Staphylococcus aureus
IGYDDYYYYYIDPLWSHIRRGLVLP

SEQ ID NO: 1692493 - protein, 23 aa, Staphylococcus aureus
IHDKIMYLYRKFLDLLDLTDNTF

SEQ ID NO: 1692494 - protein, 29 aa, Staphylococcus aureus
IHGKVARLTQFGVFIDIGGVDGLVHVSEL

SEQ ID NO: 1692495 - protein, 17 aa, Staphylococcus aureus
IHHQLMKMIDDVQTIVY

SEQ ID NO: 1692496 - protein, 26 aa, Staphylococcus aureus
IHNDQMFDLLLLYTEKFDELITRFDA

SEQ ID NO: 1692497 - protein, 27 aa, Staphylococcus aureus
IHQYKFLKDYYLCELLAHLIEIPQISY

SEQ ID NO: 1692498 - protein, 18 aa, Staphylococcus aureus
IHYFRTKAFYYREENKKL

SEQ ID NO: 1692499 - protein, 23 aa, Staphylococcus aureus
IIAGDWFYGMKIPSQRQLAIQYN

SEQ ID NO: 1692500 - protein, 17 aa, Staphylococcus aureus
IIDEFFVEINENRPLNI

SEQ ID NO: 1692501 - protein, 18 aa, Staphylococcus aureus
IIDPLQIDVAKQAGASMI

SEQ ID NO: 1692502 - protein, 20 aa, Staphylococcus aureus
IIDYSLYIKKGLVEPFIVFY

SEQ ID NO: 1692503 - protein, 24 aa, Staphylococcus aureus
IIEDKYLSERTKRLKLKQLLNSQN

SEQ ID NO: 1692504 - protein, 21 aa, Staphylococcus aureus
IIEFITLNNYVLIKTSPGFAQ

SEQ ID NO: 1692505 - protein, 17 aa, Staphylococcus aureus
IIFLDEPTTYLDICHQL

SEQ ID NO: 1692506 - protein, 18 aa, Staphylococcus aureus
IIGIPNERFGQIGVLLYS

SEQ ID NO: 1692507 - protein, 18 aa, Staphylococcus aureus
IIISYKLFKDKDQMFYAT

SEQ ID NO: 1692508 - protein, 20 aa, Staphylococcus aureus
IIKNYDSFLPQKLDIVVFPS

SEQ ID NO: 1692509 - protein, 21 aa, Staphylococcus aureus
IINQALIRFRTNHKIRSEFFL

SEQ ID NO: 1692510 - protein, 17 aa, Staphylococcus aureus
IIRLFNAETSQLINKVN

SEQ ID NO: 1692511 - protein, 18 aa, Staphylococcus aureus
IIRLLEGPITFVESIESE

SEQ ID NO: 1692512 - protein, 35 aa, Staphylococcus aureus
IIWSIATFYYSRMMKIMNLAILKIKIGGVNMLNIQ

SEQ ID NO: 1692513 - protein, 22 aa, Staphylococcus aureus
IKAIILSFAYDKNKFKVIGPFV

SEQ ID NO: 1692514 - protein, 21 aa, Staphylococcus aureus
IKATFKGLGTGPTIALRAVFD

SEQ ID NO: 1692515 - protein, 38 aa, Staphylococcus aureus
IKDHVGVILYDKNIYILKKYIFEVLFDLEEKFLKETKK

SEQ ID NO: 1692516 - protein, 18 aa, Staphylococcus aureus
IKEIVFDRGGYLYHGRVK

SEQ ID NO: 1692517 - protein, 27 aa, Staphylococcus aureus
IKEKPKARWLFLTLSTKNAIDGDTLEQ

SEQ ID NO: 1692518 - protein, 24 aa, Staphylococcus aureus
IKGSNFYWMDYYTIKQIIQRLGVN

SEQ ID NO: 1692519 - protein, 32 aa, Staphylococcus aureus
IKLHKEFTIPVKFTIKVVLTDPYKYSVTGYKN

SEQ ID NO: 1692520 - protein, 18 aa, Staphylococcus aureus
IKNLYASEYIWNSIKDDK

SEQ ID NO: 1692521 - protein, 22 aa, Staphylococcus aureus
IKSIRLYEESYILLAPKETFKN

SEQ ID NO: 1692522 - protein, 20 aa, Staphylococcus aureus
ILALFCRIFKYKFGMNNKMV

SEQ ID NO: 1692523 - protein, 29 aa, Staphylococcus aureus
ILEGYHTLLTIGRFPICYINIEMNPILVD

SEQ ID NO: 1692524 - protein, 25 aa, Staphylococcus aureus
ILEIHLPREIPSVNLIPYARKLEVL

SEQ ID NO: 1692525 - protein, 18 aa, Staphylococcus aureus
ILKNISWQINEGDKWILY

SEQ ID NO: 1692526 - protein, 20 aa, Staphylococcus aureus
ILNKHNIPFDGMISELFKAT

SEQ ID NO: 1692527 - protein, 25 aa, Staphylococcus aureus
ILQDGTFNFVFFNQNLFECDKYERK

SEQ ID NO: 1692528 - protein, 19 aa, Staphylococcus aureus
IMCLDISYHKLKFKHNLFI

SEQ ID NO: 1692529 - protein, 25 aa, Staphylococcus aureus
INEENPHAHLLCTLRGLDKNNEFEP

SEQ ID NO: 1692530 - protein, 19 aa, Staphylococcus aureus
INIDYLYYISDSLSTFMKS

SEQ ID NO: 1692531 - protein, 28 aa, Staphylococcus aureus
INIGQRRLFEWLRQNGFLIKHKGVDYNM

SEQ ID NO: 1692532 - protein, 23 aa, Staphylococcus aureus
INLPTHPILIQTAQYNLIIDAGI

SEQ ID NO: 1692533 - protein, 31 aa, Staphylococcus aureus
INLTEAYTNYAILFISGTYPGGVIEAFSLTS

SEQ ID NO: 1692534 - protein, 27 aa, Staphylococcus aureus
INLTRLSIFIFIINILNQLRGSVIYQN

SEQ ID NO: 1692535 - protein, 17 aa, Staphylococcus aureus
INNIPYKVDIYPYYGSD

SEQ ID NO: 1692536 - protein, 23 aa, Staphylococcus aureus
INPIPIKALTSYLGFGNYELRLP

SEQ ID NO: 1692537 - protein, 20 aa, Staphylococcus aureus
INRFGYTIRGIYGEGSQVYG

SEQ ID NO: 1692538 - protein, 24 aa, Staphylococcus aureus
INSSFKYHEIYLMNGKGLGELIWK

SEQ ID NO: 1692539 - protein, 20 aa, Staphylococcus aureus
INTQLREYTFLGKEGRFVTL

SEQ ID NO: 1692540 - protein, 18 aa, Staphylococcus aureus
INVTYVGKFFSLLSTTNK

SEQ ID NO: 1692541 - protein, 20 aa, Staphylococcus aureus
IPKHLIIAFRLSKGKYQILV

SEQ ID NO: 1692542 - protein, 22 aa, Staphylococcus aureus
IPKLFDYIHKRYAKLSLEDLIN

SEQ ID NO: 1692543 - protein, 22 aa, Staphylococcus aureus
IPNERFGQIGVLLYSGDVTLTH

SEQ ID NO: 1692544 - protein, 24 aa, Staphylococcus aureus
IPTNKAPKLLLKGSGDLKGSSVGY

SEQ ID NO: 1692545 - protein, 24 aa, Staphylococcus aureus
IQAIDNLTHLNTPQKTALKQQVNA

SEQ ID NO: 1692546 - protein, 24 aa, Staphylococcus aureus
IQDQFKPIGILLSALSVDINPIPI

SEQ ID NO: 1692547 - protein, 18 aa, Staphylococcus aureus
IQITKFIRPANIERMIDH

SEQ ID NO: 1692548 - protein, 17 aa, Staphylococcus aureus
IQKMKSLYNYLKKSYRN

SEQ ID NO: 1692549 - protein, 17 aa, Staphylococcus aureus
IQKYELDYIIDDDWNYA

SEQ ID NO: 1692550 - protein, 28 aa, Staphylococcus aureus
IQVWKKPSSFVIKPLPKNKYPDSIEDST

SEQ ID NO: 1692551 - protein, 28 aa, Staphylococcus aureus
IREADVILYDRLVNPLILQYAKSTTEII

SEQ ID NO: 1692552 - protein, 19 aa, Staphylococcus aureus
IREGGIRGIVISLLSLNHI

SEQ ID NO: 1692553 - protein, 26 aa, Staphylococcus aureus
IRQFKSLRRFFKIYVRGIRGASELRH

SEQ ID NO: 1692554 - protein, 18 aa, Staphylococcus aureus
ISGISTYFKTYSPTTKII

SEQ ID NO: 1692555 - protein, 18 aa, Staphylococcus aureus
ISGPAALRCSQFVYKEQK

SEQ ID NO: 1692556 - protein, 18 aa, Staphylococcus aureus
ISIKFLFESYTGKDYTLL

SEQ ID NO: 1692557 - protein, 25 aa, Staphylococcus aureus
ISKKYQWIAYYEILAKLVDKFPDVQ

SEQ ID NO: 1692558 - protein, 20 aa, Staphylococcus aureus
ISKQFWAYLVKTGQLENPDR

SEQ ID NO: 1692559 - protein, 22 aa, Staphylococcus aureus
ISLDLMYHLPKQTIEDFEQSLD

SEQ ID NO: 1692560 - protein, 24 aa, Staphylococcus aureus
ISMADQYLTYTLLRTPAKKEISDM

SEQ ID NO: 1692561 - protein, 34 aa, Staphylococcus aureus
ISVIIFETLIRIYWFYKQYFYYGKSLKESIPIAN

SEQ ID NO: 1692562 - protein, 17 aa, Staphylococcus aureus
ITAEPWLEISKKGLQLE

SEQ ID NO: 1692563 - protein, 17 aa, Staphylococcus aureus
ITAKILRAQEMNIPISI

SEQ ID NO: 1692564 - protein, 19 aa, Staphylococcus aureus
ITCNYRLGALGYLDWSYFN

SEQ ID NO: 1692565 - protein, 27 aa, Staphylococcus aureus
ITEGFARCIPMIFLNPAPGQELENALY

SEQ ID NO: 1692566 - protein, 26 aa, Staphylococcus aureus
ITGDFDKLIYGIPQLIEYKIDETAQL

SEQ ID NO: 1692567 - protein, 17 aa, Staphylococcus aureus
ITIPLKPTGSHFQQCVW

SEQ ID NO: 1692568 - protein, 19 aa, Staphylococcus aureus
ITRHLLKKYQERFYTYPAA

SEQ ID NO: 1692569 - protein, 20 aa, Staphylococcus aureus
ITSTFYPKMFKAHPELLNMF

SEQ ID NO: 1692570 - protein, 24 aa, Staphylococcus aureus
IVCDYLFCKAFGKLASNIEKYTNQ

SEQ ID NO: 1692571 - protein, 23 aa, Staphylococcus aureus
IVDVIKYLINTIPKIRKNLRHAI

SEQ ID NO: 1692572 - protein, 19 aa, Staphylococcus aureus
IVGKTDMFVFPHGAQDRHT

SEQ ID NO: 1692573 - protein, 28 aa, Staphylococcus aureus
IVIFAKYGYIHHLFSKVNLKKIYTCLVY

SEQ ID NO: 1692574 - protein, 18 aa, Staphylococcus aureus
IVTLIKRYQSAASLSDFE

SEQ ID NO: 1692575 - protein, 17 aa, Staphylococcus aureus
IVYYTNNSKVTLFERPS

SEQ ID NO: 1692576 - protein, 17 aa, Staphylococcus aureus
IYAGNIQVWKKPSSFVI

SEQ ID NO: 1692577 - protein, 17 aa, Staphylococcus aureus
IYLSLNQGWSKISNMFP

SEQ ID NO: 1692578 - protein, 35 aa, Staphylococcus aureus
IYSGYDQLLAFFNNSYWRSQFNPRGGWSPSGPRRY

SEQ ID NO: 1692579 - protein, 18 aa, Staphylococcus aureus
IYSSATIEHKKWGKGVDV

SEQ ID NO: 1692580 - protein, 25 aa, Staphylococcus aureus
IYTHPINNYILNGITRIVIKKIAKD

SEQ ID NO: 1692581 - protein, 17 aa, Staphylococcus aureus
IYTIAAMAPCPYIYAEL

SEQ ID NO: 1692582 - protein, 27 aa, Staphylococcus aureus
KAAGTWHYICLFIDLFNREIIGYSAGK

SEQ ID NO: 1692583 - protein, 17 aa, Staphylococcus aureus
KADYIFVDDFHPLIYTV

SEQ ID NO: 1692584 - protein, 17 aa, Staphylococcus aureus
KAFGIAGLRLGVLMSTV

SEQ ID NO: 1692585 - protein, 26 aa, Staphylococcus aureus
KAFYTHGHLYQVNRTRDLLAAKGLEL

SEQ ID NO: 1692586 - protein, 29 aa, Staphylococcus aureus
KAIETLKESKPYLFASSKPVGKTPQGGGN

SEQ ID NO: 1692587 - protein, 18 aa, Staphylococcus aureus
KAIQLLGIPVEKIHLYFF

SEQ ID NO: 1692588 - protein, 21 aa, Staphylococcus aureus
KAKADRYVPYTIAVNGTSTPI

SEQ ID NO: 1692589 - protein, 17 aa, Staphylococcus aureus
KAKTLMEKAGSNILGVI

SEQ ID NO: 1692590 - protein, 24 aa, Staphylococcus aureus
KAMAADFLILGTPNYHGSYSGILK

SEQ ID NO: 1692591 - protein, 35 aa, Staphylococcus aureus; identical to SEQ ID NO: 1594494

SEQ ID NO: 1692592 - protein, 22 aa, Staphylococcus aureus
KAPNTLYIEKRNLMKQKLEMLG

SEQ ID NO: 1692593 - protein, 23 aa, Staphylococcus aureus
KAQYFVSMMGYSPGFSYLTGLNK

SEQ ID NO: 1692594 - protein, 18 aa, Staphylococcus aureus
KARIMMIFSLYKGEKKKT

SEQ ID NO: 1692595 - protein, 28 aa, Staphylococcus aureus
KASNGWILHIPSCYLGIAQAARNYAVDF

SEQ ID NO: 1692596 - protein, 26 aa, Staphylococcus aureus
KASTSLLQRQFRIGYNRASRLMDDLE

SEQ ID NO: 1692597 - protein, 22 aa, Staphylococcus aureus
KATNPEQLFAAGYASCFNAAFD

SEQ ID NO: 1692598 - protein, 22 aa, Staphylococcus aureus
KATNPEQLFAAGYASCFNGAFD

SEQ ID NO: 1692599 - protein, 22 aa, Staphylococcus aureus
KAVSTFIRRSLQVGAIDLSGEV

SEQ ID NO: 1692600 - protein, 19 aa, Staphylococcus aureus
KAWMINTRTPDWLYKSPRT

SEQ ID NO: 1692601 - protein, 17 aa, Staphylococcus aureus
KAYQYVLNAEPSNLFET

SEQ ID NO: 1692602 - protein, 26 aa, Staphylococcus aureus
KDDTNKLFNFTPYNSKKIYARSITNG

SEQ ID NO: 1692603 - protein, 17 aa, Staphylococcus aureus
KDENIVFWSGWNKITMF

SEQ ID NO: 1692604 - protein, 21 aa, Staphylococcus aureus
KDEVLPALAYFTFSPKNYEDK

SEQ ID NO: 1692605 - protein, 26 aa, Staphylococcus aureus
KDIDYPIAIVFQASCFNEFVVKGRLS

SEQ ID NO: 1692606 - protein, 25 aa, Staphylococcus aureus
KDIEARIYPVGRLDYDTSGLLLLTN

SEQ ID NO: 1692607 - protein, 19 aa, Staphylococcus aureus
KDLINKTTDPTLAKSIIDQ

SEQ ID NO: 1692608 - protein, 21 aa, Staphylococcus aureus
KDMYLNYIDIFKEASIQYLKE

SEQ ID NO: 1692609 - protein, 25 aa, Staphylococcus aureus
KDRIIKPLTYLYNKDLERTGLLNTA

SEQ ID NO: 1692610 - protein, 17 aa, Staphylococcus aureus
KDTIKQGLYFKPKVHLN

SEQ ID NO: 1692611 - protein, 22 aa, Staphylococcus aureus
KDYQLMMQKIHLHKSLHDNEDE

SEQ ID NO: 1692612 - protein, 26 aa, Staphylococcus aureus
KEDMLNEYYYLPKTLYNTLAGPEFED

SEQ ID NO: 1692613 - protein, 22 aa, Staphylococcus aureus
KEEEFFLKSKLPLYLYSFNYVD

SEQ ID NO: 1692614 - protein, 29 aa, Staphylococcus aureus
KEEFLEKIRKALYMSKICSYAQGFAQMRK

SEQ ID NO: 1692615 - protein, 17 aa, Staphylococcus aureus
KEGFSYHERRIHNDQMF

SEQ ID NO: 1692616 - protein, 24 aa, Staphylococcus aureus
KEIAQYFADKIIGLSISDLGEYAK

SEQ ID NO: 1692617 - protein, 18 aa, Staphylococcus aureus
KEIEEFKFFVQYGNFKEL

SEQ ID NO: 1692618 - protein, 25 aa, Staphylococcus aureus
KENDGIIIYLNFKDVNYQLISEGNT

SEQ ID NO: 1692619 - protein, 18 aa, Staphylococcus aureus
KENIFTSFINGNDLPYEH

SEQ ID NO: 1692620 - protein, 25 aa, Staphylococcus aureus
KENNDLFLSIYKKTEVKPTHSIKAL

SEQ ID NO: 1692621 - protein, 23 aa, Staphylococcus aureus
KENQWNAKFIDRGYIFTNTAGSP

SEQ ID NO: 1692622 - protein, 22 aa, Staphylococcus aureus
KENVLASSKLWRKVVNEVSQLY

SEQ ID NO: 1692623 - protein, 31 aa, Staphylococcus aureus
KEPLKPNPYLSYAANFLYMLRGELPTDIEVE

SEQ ID NO: 1692624 - protein, 32 aa, Staphylococcus aureus
KESFIEYLLFRYRFKSRIAVWVLNYIKVNEAK

SEQ ID NO: 1692625 - protein, 32 aa, Staphylococcus aureus
KESKDGYYLVYLFHPEGEGIYLSLNQGWSKIS

SEQ ID NO: 1692626 - protein, 17 aa, Staphylococcus aureus
KEVYVDNLSLKDGGRNN

SEQ ID NO: 1692627 - protein, 20 aa, Staphylococcus aureus
KEYMEIISKYQVRTVTFADT

SEQ ID NO: 1692628 - protein, 27 aa, Staphylococcus aureus
KFDVEYGFYILFIKPIFEIVFSSNYVK

SEQ ID NO: 1692629 - protein, 25 aa, Staphylococcus aureus
KFERPFVVAISIMYLFEMLSISNEE

SEQ ID NO: 1692630 - protein, 25 aa, Staphylococcus aureus
KFGRTFQHRAYFNKRLRTTGGRYLL

SEQ ID NO: 1692631 - protein, 17 aa, Staphylococcus aureus
KFKLNTPYGKVTARKGS

SEQ ID NO: 1692632 - protein, 43 aa, Staphylococcus aureus
KFKNKEGYNLTFFAFFVKAVADALKAYPLLNSSWQGNEIVLHK

SEQ ID NO: 1692633 - protein, 22 aa, Staphylococcus aureus
KFLDDAKYYLSAYPNETIVMSM

SEQ ID NO: 1692634 - protein, 17 aa, Staphylococcus aureus
KFLHLSVKETSGTKWEY

SEQ ID NO: 1692635 - protein, 20 aa, Staphylococcus aureus
KFQGDTFFPPYTFENWEVES

SEQ ID NO: 1692636 - protein, 17 aa, Staphylococcus aureus
KFQVLPKAVNPTFINNK

SEQ ID NO: 1692637 - protein, 23 aa, Staphylococcus aureus
KFRGDTFFPPYTFEDWEVASSVE

SEQ ID NO: 1692638 - protein, 22 aa, Staphylococcus aureus
KFVDEDILINKITLSYAQQVFD

SEQ ID NO: 1692639 - protein, 27 aa, Staphylococcus aureus
KGDIDQYFLMRYIKQGDILKLRLYRND

SEQ ID NO: 1692640 - protein, 18 aa, Staphylococcus aureus
KGDKPEITIPLKPTGSHF

SEQ ID NO: 1692641 - protein, 17 aa, Staphylococcus aureus
KGEFFIARAITPQDKRL

SEQ ID NO: 1692642 - protein, 24 aa, Staphylococcus aureus
KGEHQLPLFRYLTAAQHGFFNEKI

SEQ ID NO: 1692643 - protein, 18 aa, Staphylococcus aureus
KGFIKRFLQELEPWLNRR

SEQ ID NO: 1692644 - protein, 19 aa, Staphylococcus aureus
KGIFKFTDINLAREAKNRL

SEQ ID NO: 1692645 - protein, 18 aa, Staphylococcus aureus
KGIGAGLIINNQLYRGAN

SEQ ID NO: 1692646 - protein, 35 aa, Staphylococcus aureus
KGISKMFDLMLPKDPIHMPLSKMNMFGLGNIMMRY

SEQ ID NO: 1692647 - protein, 24 aa, Staphylococcus aureus
KGIVWLAQYNRVACLLSQAGSSCN

SEQ ID NO: 1692648 - protein, 22 aa, Staphylococcus aureus
KGIVYTPEQLPAKSKWSHAVDQ

SEQ ID NO: 1692649 - protein, 23 aa, Staphylococcus aureus
KGKKAIIYFYPRDNTPTCTTEAC

SEQ ID NO: 1692650 - protein, 21 aa, Staphylococcus aureus
KGKPLITAKDLIKTEFENSND

SEQ ID NO: 1692651 - protein, 25 aa, Staphylococcus aureus
KGKSIKFNGKLPHWSNDDPGKGNLY

SEQ ID NO: 1692652 - protein, 20 aa, Staphylococcus aureus
KGLIYKGKKPVYWSPSSESS

SEQ ID NO: 1692653 - protein, 23 aa, Staphylococcus aureus
KGPDLYVYLTKNGDIKNGKEIAM

SEQ ID NO: 1692654 - protein, 24 aa, Staphylococcus aureus
KGQSEPIVLVIFTNKDNKSDKPND

SEQ ID NO: 1692655 - protein, 31 aa, Staphylococcus aureus
KGRGSGLPVPGWFSLQKLQFGKIPLNGKDMT

SEQ ID NO: 1692656 - protein, 22 aa, Staphylococcus aureus
KGRLPDCLVQWSAKRLKEQGAN

SEQ ID NO: 1692657 - protein, 20 aa, Staphylococcus aureus
KGRYVVLKKKNSLFKGKEIE

SEQ ID NO: 1692658 - protein, 32 aa, Staphylococcus aureus
KGSKRQLVLQPWQHFIIGSLFGWVHKETKLRR

SEQ ID NO: 1692659 - protein, 23 aa, Staphylococcus aureus
KGTDILVESLFYNTPARLKYIKS

SEQ ID NO: 1692660 - protein, 17 aa, Staphylococcus aureus
KGTIYKIYFGFADRQTY

SEQ ID NO: 1692661 - protein, 24 aa, Staphylococcus aureus
KGYFNFDFKTKRFDNLELKKNDDI

SEQ ID NO: 1692662 - protein, 20 aa, Staphylococcus aureus
KGYYFVKKFYEKDKLPDRKN

SEQ ID NO: 1692663 - protein, 18 aa, Staphylococcus aureus
KHAISTLCPYKLGNAATN

SEQ ID NO: 1692664 - protein, 23 aa, Staphylococcus aureus
KHDLSYIALDGDIGCMVNGAGLA

SEQ ID NO: 1692665 - protein, 22 aa, Staphylococcus aureus
KHSKPFLKQFPTSGDHVLMGPG

SEQ ID NO: 1692666 - protein, 26 aa, Staphylococcus aureus
KHVNEVYLISHALLETGAVKSELANG

SEQ ID NO: 1692667 - protein, 29 aa, Staphylococcus aureus
KIAYVVEFFEWFNTLETFKNWKKKPGKPL

SEQ ID NO: 1692668 - protein, 21 aa, Staphylococcus aureus
KIENIIFKLADQGVAIMWITH

SEQ ID NO: 1692669 - protein, 17 aa, Staphylococcus aureus
KIISDICWKHKIPHIIS

SEQ ID NO: 1692670 - protein, 20 aa, Staphylococcus aureus
KIIVQTVPKSKLDFLANAPH

SEQ ID NO: 1692671 - protein, 30 aa, Staphylococcus aureus
KIKDILTEYNIRILDLPLATGLVAEVGQGP

SEQ ID NO: 1692672 - protein, 29 aa, Staphylococcus aureus
KIKHRYYSKIFYSGNYIALGGYDDLNKAR

SEQ ID NO: 1692673 - protein, 33 aa, Staphylococcus aureus
KILFVAATAPFTPFYRALDWIVTDPLESIKEEI

SEQ ID NO: 1692674 - protein, 35 aa, Staphylococcus aureus
KINKDVWYKASVGLLNSLLLYAKYEFEPEKRTIGN

SEQ ID NO: 1692675 - protein, 24 aa, Staphylococcus aureus
KIVDVIKYLINTIPKIRKNLRHAI

SEQ ID NO: 1692676 - protein, 28 aa, Staphylococcus aureus
KIVKLKIHNLVVKILLPISDLHIKEKLN

SEQ ID NO: 1692677 - protein, 20 aa, Staphylococcus aureus
KIVLFNRMGGTYIKSGYGAD

SEQ ID NO: 1692678 - protein, 17 aa, Staphylococcus aureus
KIYTRSITNGRLEPQWT

SEQ ID NO: 1692679 - protein, 25 aa, Staphylococcus aureus
KKEIENFKFFAQYGSFKDLSKYKDG

SEQ ID NO: 1692680 - protein, 25 aa, Staphylococcus aureus
KKEIENFKFFAQYGSFKDLSKYKEG

SEQ ID NO: 1692681 - protein, 20 aa, Staphylococcus aureus
KKENPEILAFIKSFKKYIAN

SEQ ID NO: 1692682 - protein, 25 aa, Staphylococcus aureus
KKGQKAKLFPLDYTHIFPGECIWFD

SEQ ID NO: 1692683 - protein, 17 aa, Staphylococcus aureus
KKIEPVFIKGADLEGQD

SEQ ID NO: 1692684 - protein, 18 aa, Staphylococcus aureus
KKLGLSLNIINKAKTMIG

SEQ ID NO: 1692685 - protein, 21 aa, Staphylococcus aureus
KKLREVYPITTKKSPVLKLHI

SEQ ID NO: 1692686 - protein, 20 aa, Staphylococcus aureus
KKPVIIYFYGGSFENGHGTA

SEQ ID NO: 1692687 - protein, 25 aa, Staphylococcus aureus
KLDLKKIKHPYLKKTFIEIVETLKN

SEQ ID NO: 1692688 - protein, 21 aa, Staphylococcus aureus
KLFLEFLVFIICNYTTSFTNI

SEQ ID NO: 1692689 - protein, 21 aa, Staphylococcus aureus
KLIQPIMQLFIDNAILNIVQN

SEQ ID NO: 1692690 - protein, 24 aa, Staphylococcus aureus
KLKEKSMFQIINEKLTFLAEDFDI

SEQ ID NO: 1692691 - protein, 17 aa, Staphylococcus aureus
KLKEYMEIISKYQVRTV

SEQ ID NO: 1692692 - protein, 19 aa, Staphylococcus aureus
KLKIVLIHSKLSRTMSLSK

SEQ ID NO: 1692693 - protein, 24 aa, Staphylococcus aureus
KLKNEIIREYDLKPSIFSNSIKQH

SEQ ID NO: 1692694 - protein, 25 aa, Staphylococcus aureus
KLLSEDKALLYWDTINRNCVICGKP

SEQ ID NO: 1692695 - protein, 23 aa, Staphylococcus aureus
KLNDLRSRVKLETDGKLLTGKDV

SEQ ID NO: 1692696 - protein, 22 aa, Staphylococcus aureus
KLNSNDILVLRLGGEYTVKRVR

SEQ ID NO: 1692697 - protein, 17 aa, Staphylococcus aureus
KLQVVRLYENGKLKNEI

SEQ ID NO: 1692698 - protein, 17 aa, Staphylococcus aureus
KLSGKHAFSKKLKALGY

SEQ ID NO: 1692699 - protein, 17 aa, Staphylococcus aureus
KLTKPAEYISDELTSKL

SEQ ID NO: 1692700 - protein, 19 aa, Staphylococcus aureus
KLTTIFNKFNHMSLSHYPI

SEQ ID NO: 1692701 - protein, 20 aa, Staphylococcus aureus
KLTTIFNKFNHMSLSHYPIQ

SEQ ID NO: 1692702 - protein, 21 aa, Staphylococcus aureus
KLVDERIPEINWIEGVKEALI

SEQ ID NO: 1692703 - protein, 38 aa, Staphylococcus aureus
KLVDGFTHLPGWVRKASLGLAIFGASIGPAVLAGGLLI

SEQ ID NO: 1692704 - protein, 39 aa, Staphylococcus aureus
KLVDGFTHLPGWVRKASVGLALFGASIGPAVLAGGLLIR

SEQ ID NO: 1692705 - protein, 17 aa, Staphylococcus aureus
KLVDYKIGGLEPSQLIV

SEQ ID NO: 1692706 - protein, 19 aa, Staphylococcus aureus
KLVRLNYKSEAYVGVWTEE

SEQ ID NO: 1692707 - protein, 21 aa, Staphylococcus aureus
KLYDLFIRKLAERHTRPAIVE

SEQ ID NO: 1692708 - protein, 19 aa, Staphylococcus aureus
KMDLPNGIHSLGYTNVPVK

SEQ ID NO: 1692709 - protein, 17 aa, Staphylococcus aureus
KMEAPMFKKILKKHQLL

SEQ ID NO: 1692710 - protein, 20 aa, Staphylococcus aureus
KMLQRIYGTAFFDKNELKAH

SEQ ID NO: 1692711 - protein, 27 aa, Staphylococcus aureus
KMRRIYRRKLTYILKRLKPYKEQLDIQ

SEQ ID NO: 1692712 - protein, 20 aa, Staphylococcus aureus
KMTLLELVEWAWNNPEQVES

SEQ ID NO: 1692713 - protein, 24 aa, Staphylococcus aureus
KNDLFSFSSVLYTKALIGGRTPAK

SEQ ID NO: 1692714 - protein, 24 aa, Staphylococcus aureus
KNELLGRYEHYCFKIRELHPESKA

SEQ ID NO: 1692715 - protein, 33 aa, Staphylococcus aureus
KNEPLIIDDVVKGFLTYNIPKKVIKHAGYVRCK

SEQ ID NO: 1692716 - protein, 18 aa, Staphylococcus aureus
KNFKYSLLNGWELMEDEL

SEQ ID NO: 1692717 - protein, 23 aa, Staphylococcus aureus
KNHPKSLFIWRSNLISSSAKGQE

SEQ ID NO: 1692718 - protein, 19 aa, Staphylococcus aureus
KNHPLNIWALHKLLKQCNL

SEQ ID NO: 1692719 - protein, 17 aa, Staphylococcus aureus
KNIVDIALQQDVDFVII

SEQ ID NO: 1692720 - protein, 22 aa, Staphylococcus aureus
KNLDEFLNNLKIASPILENHLD

SEQ ID NO: 1692721 - protein, 31 aa, Staphylococcus aureus
KNLIGAFYRPTAVIYDLDFLKTLPFEQILSG

SEQ ID NO: 1692722 - protein, 30 aa, Staphylococcus aureus
KNLNLEFKYLFLKLIVKEDWSLSNLFNTGA

SEQ ID NO: 1692723 - protein, 25 aa, Staphylococcus aureus
KNNKKTIMLYLSSDWFAELGYTFFN

SEQ ID NO: 1692724 - protein, 21 aa, Staphylococcus aureus
KNPGFLTVKKICDALQVDIAN

SEQ ID NO: 1692725 - protein, 28 aa, Staphylococcus aureus
KNRKYKCNSYWLYKFRNIRESKYKRRTF

SEQ ID NO: 1692726 - protein, 20 aa, Staphylococcus aureus
KNVMVALREPALGPTFGIKG

SEQ ID NO: 1692727 - protein, 25 aa, Staphylococcus aureus
KPDWKIFQAIANKLGFDWNYKHPSE

SEQ ID NO: 1692728 - protein, 19 aa, Staphylococcus aureus
KPVIIYFYGGSFENGHGKA

SEQ ID NO: 1692729 - protein, 24 aa, Staphylococcus aureus
KQALKDRINQILQQGHNDINNALT

SEQ ID NO: 1692730 - protein, 25 aa, Staphylococcus aureus
KQDKLKLYKFFIIIAKYIKRNEQFF

SEQ ID NO: 1692731 - protein, 18 aa, Staphylococcus aureus
KQDLILLRHEALEHYLMN

SEQ ID NO: 1692732 - protein, 25 aa, Staphylococcus aureus
KQETVLNLFYKLHPSFEGQGYACEA

SEQ ID NO: 1692733 - protein, 18 aa, Staphylococcus aureus
KQHLLAIDDIGIMKEHRK

SEQ ID NO: 1692734 - protein, 17 aa, Staphylococcus aureus
KQHQLFTLKYSKQNSET

SEQ ID NO: 1692735 - protein, 19 aa, Staphylococcus aureus
KQILGVDPAFRTGCKLAVI

SEQ ID NO: 1692736 - protein, 23 aa, Staphylococcus aureus
KQLHQQIELIRRLVPYVPKVELH

SEQ ID NO: 1692737 - protein, 17 aa, Staphylococcus aureus
KQLILDDNMLVVGVRDR

SEQ ID NO: 1692738 - protein, 22 aa, Staphylococcus aureus
KQLYSPVQFINSTEWLIDQGVD

SEQ ID NO: 1692739 - protein, 30 aa, Staphylococcus aureus
KQMSPKDAILFKFLCNQKVIPAVRYKYIRD

SEQ ID NO: 1692740 - protein, 17 aa, Staphylococcus aureus
KQNNYVAVWFRQERKDG

SEQ ID NO: 1692741 - protein, 20 aa, Staphylococcus aureus
KQNPLYNRMTIRIKDNGIGI

SEQ ID NO: 1692742 - protein, 26 aa, Staphylococcus aureus
KQNRHSLGHKLYLKNKIYALQNDERF

SEQ ID NO: 1692743 - protein, 22 aa, Staphylococcus aureus
KQPIDYFVAPVSTTGSIMGMSR

SEQ ID NO: 1692744 - protein, 23 aa, Staphylococcus aureus
KQPRVIFEKVFAEHFLNLYEKTK

SEQ ID NO: 1692745 - protein, 22 aa, Staphylococcus aureus
KQSFESQITQAPLVTDVTTINQ

SEQ ID NO: 1692746 - protein, 21 aa, Staphylococcus aureus
KQTRQLAAIYLASGIDPDKAT

SEQ ID NO: 1692747 - protein, 20 aa, Staphylococcus aureus
KQVQALIDEIDRNPNLTDKE

SEQ ID NO: 1692748 - protein, 18 aa, Staphylococcus aureus
KRDAIIKVSQLFENIREC

SEQ ID NO: 1692749 - protein, 21 aa, Staphylococcus aureus
KRELGFVLMALNIRKIAAQRA

SEQ ID NO: 1692750 - protein, 19 aa, Staphylococcus aureus
KRGEQFFMDNFGLKVKATN

SEQ ID NO: 1692751 - protein, 20 aa, Staphylococcus aureus
KRIDLYFKYNLNNYHSMKVT

SEQ ID NO: 1692752 - protein, 25 aa, Staphylococcus aureus
KRKDYQIYRPLLAVSKKEIKQFQER

SEQ ID NO: 1692753 - protein, 22 aa, Staphylococcus aureus
KRLLELYKNYKGNITRFVAEND

SEQ ID NO: 1692754 - protein, 26 aa, Staphylococcus aureus
KRNEILQLMMLEPKFAILDEIDSGLD

SEQ ID NO: 1692755 - protein, 20 aa, Staphylococcus aureus
KSAILFASLFSKESTIIKEL

SEQ ID NO: 1692756 - protein, 22 aa, Staphylococcus aureus
KSAKEYVLKLAIDTLADMLQRD

SEQ ID NO: 1692757 - protein, 19 aa, Staphylococcus aureus
KSCESQLLSMLPIEVEEIP

SEQ ID NO: 1692758 - protein, 21 aa, Staphylococcus aureus
KSEIVVPIFKDDKIIGVLDID

SEQ ID NO: 1692759 - protein, 22 aa, Staphylococcus aureus
KSEPGLLKAIQFLDDYYHEKFI

SEQ ID NO: 1692760 - protein, 22 aa, Staphylococcus aureus
KSFKDLVECSIGLLAREVPEEV

SEQ ID NO: 1692761 - protein, 24 aa, Staphylococcus aureus
KSIDSLLSIVQMPGGIPVATTAIG

SEQ ID NO: 1692762 - protein, 23 aa, Staphylococcus aureus
KSINPNLKGQLFKLLEFSNMEES

SEQ ID NO: 1692763 - protein, 17 aa, Staphylococcus aureus
KSLINRSLSFFNQIGEV

SEQ ID NO: 1692764 - protein, 30 aa, Staphylococcus aureus
KSTKEDKLLNLFLYYFIQTKRYSDVASKSA

SEQ ID NO: 1692765 - protein, 23 aa, Staphylococcus aureus
KSVDYLHHLIQAMHLAYSDRAQY

SEQ ID NO: 1692766 - protein, 25 aa, Staphylococcus aureus
KTDKPIVRIYPLPFNPDAYADDNEF

SEQ ID NO: 1692767 - protein, 25 aa, Staphylococcus aureus
KTEYLTSFIYSYKISLERAYYMVEN

SEQ ID NO: 1692768 - protein, 25 aa, Staphylococcus aureus
KTIKDLIVVFLLNKYNYIKNKDDFF

SEQ ID NO: 1692769 - protein, 25 aa, Staphylococcus aureus
KTIKSLRKQLLYLKDKFKNIEQSLK

SEQ ID NO: 1692770 - protein, 28 aa, Staphylococcus aureus
KTLEEPPAHAIFILATTEPHKIPPTIIS

SEQ ID NO: 1692771 - protein, 17 aa, Staphylococcus aureus
KTLLTWLARHHFNYQEI

SEQ ID NO: 1692772 - protein, 17 aa, Staphylococcus aureus
KTLMEKAGSNILGVILN

SEQ ID NO: 1692773 - protein, 23 aa, Staphylococcus aureus
KTNIDFMSDYYFYLIETGQKEQA

SEQ ID NO: 1692774 - protein, 17 aa, Staphylococcus aureus
KTPLITYGMFIKDKTRK

SEQ ID NO: 1692775 - protein, 22 aa, Staphylococcus aureus
KTPYKKWFERMSDYGFEENIDY

SEQ ID NO: 1692776 - protein, 24 aa, Staphylococcus aureus
KTQLNWHFNLSERSIKNLGDSKIY

SEQ ID NO: 1692777 - protein, 26 aa, Staphylococcus aureus
KTYAYALKNFFVYLESKKICYKEVSF

SEQ ID NO: 1692778 - protein, 33 aa, Staphylococcus aureus
KTYKEFLDTTAKFHNYSINNIILIAGQNPEATA

SEQ ID NO: 1692779 - protein, 32 aa, Staphylococcus aureus
KTYPPELIQLDQLLVSILQPYEQRIKHENRTL

SEQ ID NO: 1692780 - protein, 30 aa, Staphylococcus aureus
KVARELIELIIAFMFHHQIPMSVEMSKLLS

SEQ ID NO: 1692781 - protein, 18 aa, Staphylococcus aureus
KVATPFPRISYDDAIEFL

SEQ ID NO: 1692782 - protein, 24 aa, Staphylococcus aureus
KVKRELGFVLMALNIRKIAAQRAV

SEQ ID NO: 1692783 - protein, 27 aa, Staphylococcus aureus
KVNYKLRDWLFSRQRYWGEPIPVIHWE

SEQ ID NO: 1692784 - protein, 22 aa, Staphylococcus aureus
KVNYLTETLGFDAGIDYKNEDF

SEQ ID NO: 1692785 - protein, 19 aa, Staphylococcus aureus
KVPLISKFVEIIEKHIVKH

SEQ ID NO: 1692786 - protein, 18 aa, Staphylococcus aureus
KVSYITYMDSEYPVLLKE

SEQ ID NO: 1692787 - protein, 28 aa, Staphylococcus aureus
KVTWGYAKSILNTWLNANLKSIEQVRAF

SEQ ID NO: 1692788 - protein, 23 aa, Staphylococcus aureus
KWRNHWQQYQFGYFVLVKKIDCS

SEQ ID NO: 1692789 - protein, 19 aa, Staphylococcus aureus
KYAVKFYNYPNEHILNSVT

SEQ ID NO: 1692790 - protein, 35 aa, Staphylococcus aureus
KYCLDGNRLFYLAMNPQFFKIITQSISQSGLSDTN

SEQ ID NO: 1692791 - protein, 26 aa, Staphylococcus aureus
KYDGKTWIFNSYPEWQKQFPFWSLIT

SEQ ID NO: 1692792 - protein, 25 aa, Staphylococcus aureus
KYDKLYSLYSLLYTMKKISANLQGT

SEQ ID NO: 1692793 - protein, 17 aa, Staphylococcus aureus
KYDSMIILYGGQGVGKS

SEQ ID NO: 1692794 - protein, 21 aa, Staphylococcus aureus
KYKNLIKEISPVDLTDLMKST

SEQ ID NO: 1692795 - protein, 24 aa, Staphylococcus aureus
KYMEPKVAHYLPKDYVYAPIQTTK

SEQ ID NO: 1692796 - protein, 20 aa, Staphylococcus aureus
KYNHYLFNAELFKHFKKGAV

SEQ ID NO: 1692797 - protein, 27 aa, Staphylococcus aureus
LAAPAEIKFLLYFAKMTKKDKNKLYHF

SEQ ID NO: 1692798 - protein, 31 aa, Staphylococcus aureus
LADENEEKYLRLYADFENYKRRIQKENEINK

SEQ ID NO: 1692799 - protein, 23 aa, Staphylococcus aureus
LADSEVLVCTVIGFPLGASTTAT

SEQ ID NO: 1692800 - protein, 18 aa, Staphylococcus aureus
LAEYLFNNPGELLKYNVI

SEQ ID NO: 1692801 - protein, 26 aa, Staphylococcus aureus
LANEKTRVRLYKSGKNWVKSGIKEIE

SEQ ID NO: 1692802 - protein, 20 aa, Staphylococcus aureus
LAQYCSFYSDFVKASLILEQ

SEQ ID NO: 1692803 - protein, 23 aa, Staphylococcus aureus
LCKKIRLKYNINIISISYEDLFK

SEQ ID NO: 1692804 - protein, 24 aa, Staphylococcus aureus
LDCTSFPYKIARPGSITAAMITDI

SEQ ID NO: 1692805 - protein, 18 aa, Staphylococcus aureus
LDDEGMVLYLNRNTKKAT

SEQ ID NO: 1692806 - protein, 18 aa, Staphylococcus aureus
LDDKLFLEFLVFIICNYT

SEQ ID NO: 1692807 - protein, 27 aa, Staphylococcus aureus
LDEETFGYVVYFFELVCAMSGYQLGVN

SEQ ID NO: 1692808 - protein, 17 aa, Staphylococcus aureus
LDEGYIYSRPRSGYYVS

SEQ ID NO: 1692809 - protein, 18 aa, Staphylococcus aureus
LDFKLRKQLIEKHNLYGN

SEQ ID NO: 1692810 - protein, 17 aa, Staphylococcus aureus
LDIFILDQKGNINRPWL

SEQ ID NO: 1692811 - protein, 25 aa, Staphylococcus aureus
LDKCFYKYYGLNKLINLLIKEKPDL

SEQ ID NO: 1692812 - protein, 17 aa, Staphylococcus aureus
LDKLGFGGNDLGSDALK

SEQ ID NO: 1692813 - protein, 18 aa, Staphylococcus aureus
LDNHQNMIFAFEESYGFL

SEQ ID NO: 1692814 - protein, 18 aa, Staphylococcus aureus
LDTASHFVLIFARKNVTS

SEQ ID NO: 1692815 - protein, 29 aa, Staphylococcus aureus
LDVNEGDTFTFDKVLFVGGDSVKVGAPTV

SEQ ID NO: 1692816 - protein, 20 aa, Staphylococcus aureus
LDYLLQFKIDHKALLQCIEA

SEQ ID NO: 1692817 - protein, 17 aa, Staphylococcus aureus
LDYYAGLSFRTLVPKYP

SEQ ID NO: 1692818 - protein, 22 aa, Staphylococcus aureus
LEAIREVVNKQIEIIENADADA

SEQ ID NO: 1692819 - protein, 25 aa, Staphylococcus aureus
LEALNAPYGMRLAEYKEIVLSKIME

SEQ ID NO: 1692820 - protein, 22 aa, Staphylococcus aureus
LECPSIISQVKFYHVPDGITIE

SEQ ID NO: 1692821 - protein, 27 aa, Staphylococcus aureus
LEDDKLKLDYALDFDQDKYTYAEAKYT

SEQ ID NO: 1692822 - protein, 30 aa, Staphylococcus aureus
LEENIAYQYATIRNLLYSKGYTTEMLINYE

SEQ ID NO: 1692823 - protein, 18 aa, Staphylococcus aureus
LEGVLYNLYTVYLALIEV

SEQ ID NO: 1692824 - protein, 27 aa, Staphylococcus aureus
LEGYHTLLTIGRFPICYINIEMDPILV

SEQ ID NO: 1692825 - protein, 29 aa, Staphylococcus aureus
LEHALKIELDFYFPLLKSWSKKKKIEMVG

SEQ ID NO: 1692826 - protein, 30 aa, Staphylococcus aureus
LEHALKIELDFYFPLLKSWSKKKKSEMVGQ

SEQ ID NO: 1692827 - protein, 25 aa, Staphylococcus aureus
LEIKIKIIRLILYTISNVHEKGIIH

SEQ ID NO: 1692828 - protein, 17 aa, Staphylococcus aureus
LEILELFENKNVLFRSA

SEQ ID NO: 1692829 - protein, 24 aa, Staphylococcus aureus
LEKGLYRKRMLSYGGLLKQKHKIL

SEQ ID NO: 1692830 - protein, 28 aa, Staphylococcus aureus
LEKHNIYYGQWLILRDIAKYQPTTLIEI

SEQ ID NO: 1692831 - protein, 25 aa, Staphylococcus aureus
LEKYTLMTMHGLFNQLKLGIISIDN

SEQ ID NO: 1692832 - protein, 20 aa, Staphylococcus aureus
LENKVVGFIGELHPILAADN

SEQ ID NO: 1692833 - protein, 18 aa, Staphylococcus aureus
LENLPWKELDIDIAIDAT

SEQ ID NO: 1692834 - protein, 18 aa, Staphylococcus aureus
LENTPAYYKLYGDKIVGF

SEQ ID NO: 1692835 - protein, 19 aa, Staphylococcus aureus
LEPPIKEWEKMGLLTIVDD

SEQ ID NO: 1692836 - protein, 20 aa, Staphylococcus aureus
LEPWTSCEFDFTRDGKLNVV

SEQ ID NO: 1692837 - protein, 18 aa, Staphylococcus aureus
LEVFPQIIKATLMEDFTK

SEQ ID NO: 1692838 - protein, 23 aa, Staphylococcus aureus
LFDLDAPIMRLAAPDIPSMPFSP

SEQ ID NO: 1692839 - protein, 30 aa, Staphylococcus aureus
LFESTYFDHQILRRLVAFMYEIPSTIIEYF

SEQ ID NO: 1692840 - protein, 17 aa, Staphylococcus aureus
LFTALTNLNSNAILPVR

SEQ ID NO: 1692841 - protein, 29 aa, Staphylococcus aureus
LGFIRNDLIDYLDCKVLFIGNLDELNKKA

SEQ ID NO: 1692842 - protein, 17 aa, Staphylococcus aureus
LGFQHVSDFPRALFMST

SEQ ID NO: 1692843 - protein, 25 aa, Staphylococcus aureus
LGFRGNIFGGYILYNLGYIHSTGHY

SEQ ID NO: 1692844 - protein, 19 aa, Staphylococcus aureus
LGHTLYRRHYYPKEKNLRF

SEQ ID NO: 1692845 - protein, 20 aa, Staphylococcus aureus
LGKSGLLVVYVVDDSTARAT

SEQ ID NO: 1692846 - protein, 24 aa, Staphylococcus aureus
LGLKYLDLYLVHWPGTNEAVMVDT

SEQ ID NO: 1692847 - protein, 29 aa, Staphylococcus aureus
LGMSNGIPNIVFYNPAPISITSLNPNSPD

SEQ ID NO: 1692848 - protein, 23 aa, Staphylococcus aureus
LGRENYYMYKKFGVIPEMEYEMK

SEQ ID NO: 1692849 - protein, 18 aa, Staphylococcus aureus
LGRENYYMYKKFGVLPEM

SEQ ID NO: 1692850 - protein, 21 aa, Staphylococcus aureus
LGTLNHITNAQRTALEGQINQ

SEQ ID NO: 1692851 - protein, 19 aa, Staphylococcus aureus
LGVMDARLKKMRKQRDEYK

SEQ ID NO: 1692852 - protein, 26 aa, Staphylococcus aureus
LGYQRASMYDIYPPYDGIPDEVFLIK

SEQ ID NO: 1692853 - protein, 22 aa, Staphylococcus aureus
LHEPYDLQKILLGGAKLSATMI

SEQ ID NO: 1692854 - protein, 24 aa, Staphylococcus aureus
LHHDAPIQIMPAPENLFVEYIEDG

SEQ ID NO: 1692855 - protein, 19 aa, Staphylococcus aureus
LHIVVSIPVFLAERVEVLP

SEQ ID NO: 1692856 - protein, 17 aa, Staphylococcus aureus
LHMHYAVPHAICGILAR

SEQ ID NO: 1692857 - protein, 20 aa, Staphylococcus aureus
LIDEIDRNPILTDKEKQALK

SEQ ID NO: 1692858 - protein, 18 aa, Staphylococcus aureus
LIDFLSNNNLMRIPQVVD

SEQ ID NO: 1692859 - protein, 25 aa, Staphylococcus aureus
LIDILNPYLCIVFCNSRDNANDLAR

SEQ ID NO: 1692860 - protein, 29 aa, Staphylococcus aureus
LIFASARPIRYLLPVLPSVFHQHTLIGAN

SEQ ID NO: 1692861 - protein, 18 aa, Staphylococcus aureus
LIGLHHRICYTTSASVLT

SEQ ID NO: 1692862 - protein, 18 aa, Staphylococcus aureus
LIISFYPGYAVHPDHEAT

SEQ ID NO: 1692863 - protein, 18 aa, Staphylococcus aureus
LIKHFNKPFRQKLQLMNH

SEQ ID NO: 1692864 - protein, 24 aa, Staphylococcus aureus
LINESGLYSLIFDASKQSKNEKIR

SEQ ID NO: 1692865 - protein, 28 aa, Staphylococcus aureus
LINMPSMLNKYFNKLSVFRKLFGNLTYS

SEQ ID NO: 1692866 - protein, 17 aa, Staphylococcus aureus
LIPEYITIDIAHGHSDS

SEQ ID NO: 1692867 - protein, 17 aa, Staphylococcus aureus
LITKFNFKTPGREDKAA

SEQ ID NO: 1692868 - protein, 17 aa, Staphylococcus aureus
LITTEIQRKWIEKFKAI

SEQ ID NO: 1692869 - protein, 31 aa, Staphylococcus aureus
LKACVDLSIQYIPQRLLPDKAIDVLDITAAH

SEQ ID NO: 1692870 - protein, 18 aa, Staphylococcus aureus
LKDADYVFLGTKPHDFDA

SEQ ID NO: 1692871 - protein, 18 aa, Staphylococcus aureus
LKDGFPFGSILLYEYEND

SEQ ID NO: 1692872 - protein, 26 aa, Staphylococcus aureus
LKHTERPMIFPLSNPTKLAEATAQDL

SEQ ID NO: 1692873 - protein, 18 aa, Staphylococcus aureus
LKIAVSVLIRAIFLKINA

SEQ ID NO: 1692874 - protein, 24 aa, Staphylococcus aureus
LKIHEYIIAVTYVNLLNHSYMKYI

SEQ ID NO: 1692875 - protein, 17 aa, Staphylococcus aureus
LKKIELLNNIKFLKGAD

SEQ ID NO: 1692876 - protein, 18 aa, Staphylococcus aureus
LKLTRWKNDGLAGFTASS

SEQ ID NO: 1692877 - protein, 26 aa, Staphylococcus aureus
LKQLDAGSWFNKKYPKYARASYKNAK

SEQ ID NO: 1692878 - protein, 17 aa, Staphylococcus aureus
LKRLIVPSIEREIHADL

SEQ ID NO: 1692879 - protein, 19 aa, Staphylococcus aureus
LKRTYVFELNFDALMSVSV

SEQ ID NO: 1692880 - protein, 20 aa, Staphylococcus aureus
LKYLDLYLVHWPGTNEAVMV

SEQ ID NO: 1692881 - protein, 17 aa, Staphylococcus aureus
LLCPFDGPNTKEIQQNH

SEQ ID NO: 1692882 - protein, 17 aa, Staphylococcus aureus
LLCQHLSVKPDTLKFML

SEQ ID NO: 1692883 - protein, 23 aa, Staphylococcus aureus
LLDRIYPYRKCDKMPDKLCLYYH

SEQ ID NO: 1692884 - protein, 19 aa, Staphylococcus aureus
LLEALILVGAFDAFGKTRS

SEQ ID NO: 1692885 - protein, 23 aa, Staphylococcus aureus
LLEGNVVLIFKYGEEIMPGGSQE

SEQ ID NO: 1692886 - protein, 17 aa, Staphylococcus aureus
LLELDDMDYLFATAAGV

SEQ ID NO: 1692887 - protein, 19 aa, Staphylococcus aureus
LLEYLPFDLTCTYDSYQFD

SEQ ID NO: 1692888 - protein, 17 aa, Staphylococcus aureus
LLIEFPSNEVPHYTDQL

SEQ ID NO: 1692889 - protein, 31 aa, Staphylococcus aureus
LLNEDKVEWIILAGYMRLIGPDLLASFEGKI

SEQ ID NO: 1692890 - protein, 23 aa, Staphylococcus aureus
LLPEHNWGNYKLVFNTRNGANLQ

SEQ ID NO: 1692891 - protein, 29 aa, Staphylococcus aureus
LLRSLVTTEFIWSVPGRFDIYGPQILIQE

SEQ ID NO: 1692892 - protein, 26 aa, Staphylococcus aureus
LLSDNLNYFKLKKFIVALESKTAIIE

SEQ ID NO: 1692893 - protein, 20 aa, Staphylococcus aureus
LLTTMAVVTWKVWKIERNTR

SEQ ID NO: 1692894 - protein, 17 aa, Staphylococcus aureus
LMEIRTIYRMILKLHNI

SEQ ID NO: 1692895 - protein, 27 aa, Staphylococcus aureus
LMNLELDMLYQMIDLINDTLVSIRFSV

SEQ ID NO: 1692896 - protein, 18 aa, Staphylococcus aureus
LMTLKLAQHYPLKRIAVM

SEQ ID NO: 1692897 - protein, 17 aa, Staphylococcus aureus
LMTSFFVDKNPLTPKEQ

SEQ ID NO: 1692898 - protein, 23 aa, Staphylococcus aureus
LNDDWWYELDYWLNKRKSENEQI

SEQ ID NO: 1692899 - protein, 24 aa, Staphylococcus aureus
LNDVTQLLRLLHDKYPHAFIHMVG

SEQ ID NO: 1692900 - protein, 32 aa, Staphylococcus aureus
LNEMFALKEYKKKYLILRIFNVSGEEPQFYFI

SEQ ID NO: 1692901 - protein, 26 aa, Staphylococcus aureus
LNERPESLFNYFKQLFAQVTNPPIDA

SEQ ID NO: 1692902 - protein, 23 aa, Staphylococcus aureus
LNFLNTKKLSIGWKIYLEKISLR

SEQ ID NO: 1692903 - protein, 18 aa, Staphylococcus aureus
LNILVVCISGMGTSRLLS

SEQ ID NO: 1692904 - protein, 26 aa, Staphylococcus aureus
LNKCFYKYYGLNKLINLLIKEKPDLI

SEQ ID NO: 1692905 - protein, 20 aa, Staphylococcus aureus
LNQAPFSFDLSVMAIYPCLA

SEQ ID NO: 1692906 - protein, 22 aa, Staphylococcus aureus
LNQTFITYTRLLEQFTMEDIAA

SEQ ID NO: 1692907 - protein, 17 aa, Staphylococcus aureus
LNTKRSLALLLMAEVDI

SEQ ID NO: 1692908 - protein, 23 aa, Staphylococcus aureus
LNTLTIFRVFIIDSQALKRSIDL

SEQ ID NO: 1692909 - protein, 21 aa, Staphylococcus aureus
LNVNEAWLMGFDISKNRKIEN

SEQ ID NO: 1692910 - protein, 22 aa, Staphylococcus aureus
LNYYLKQYVITIPFKNMDVQNG

SEQ ID NO: 1692911 - protein, 17 aa, Staphylococcus aureus
LPKSIWENFKSQNFENM

SEQ ID NO: 1692912 - protein, 25 aa, Staphylococcus aureus
LPNALFTVTLYDKDWLIGMGRVIGD

SEQ ID NO: 1692913 - protein, 24 aa, Staphylococcus aureus
LPNESYIDYIKRVSKSKIWTSDDN

SEQ ID NO: 1692914 - protein, 18 aa, Staphylococcus aureus
LPSYTILSIDLLNELLRE

SEQ ID NO: 1692915 - protein, 28 aa, Staphylococcus aureus
LQEEVPEGLIPLMKIQGLGSKKIAKLYK

SEQ ID NO: 1692916 - protein, 19 aa, Staphylococcus aureus
LQNYLLTPEKWMQNSTGYF

SEQ ID NO: 1692917 - protein, 20 aa, Staphylococcus aureus
LREEFNKRLNLIHQKLNDNI

SEQ ID NO: 1692918 - protein, 25 aa, Staphylococcus aureus
LRGGIIDIFPLIGEPIRIELFDTKI

SEQ ID NO: 1692919 - protein, 17 aa, Staphylococcus aureus
LRGINKIKHRYYSKIFY

SEQ ID NO: 1692920 - protein, 17 aa, Staphylococcus aureus
LRIDNDVYFDLGKTSGS

SEQ ID NO: 1692921 - protein, 19 aa, Staphylococcus aureus
LRKWGLLSLTQLAETAYAR

SEQ ID NO: 1692922 - protein, 24 aa, Staphylococcus aureus
LRMHGITAKILVLGVLPVKDIDKA

SEQ ID NO: 1692923 - protein, 22 aa, Staphylococcus aureus
LRNRYEAFYRPSDGNLVVYANK

SEQ ID NO: 1692924 - protein, 20 aa, Staphylococcus aureus
LRQENYSLRSIARKLKRFVS

SEQ ID NO: 1692925 - protein, 18 aa, Staphylococcus aureus
LRQSIIGINPNWLTKPVL

SEQ ID NO: 1692926 - protein, 20 aa, Staphylococcus aureus
LSDKPVYILGSSSGSIVAMH

SEQ ID NO: 1692927 - protein, 20 aa, Staphylococcus aureus
LSENLFSAVKIYGTFKHMRV

SEQ ID NO: 1692928 - protein, 29 aa, Staphylococcus aureus
LSHDIERQIIFELYPYKVERKAKSPLLFG

SEQ ID NO: 1692929 - protein, 19 aa, Staphylococcus aureus
LSHFEIPLHLAKHYGGFRN

SEQ ID NO: 1692930 - protein, 20 aa, Staphylococcus aureus
LSLKELLILAYFYYKNEHSI

SEQ ID NO: 1692931 - protein, 27 aa, Staphylococcus aureus
LSLNNRFQLFDPFGIKSRFFDSIKIDS

SEQ ID NO: 1692932 - protein, 26 aa, Staphylococcus aureus
LSNDGFCYLSYWYGDNENIVNIFHFD

SEQ ID NO: 1692933 - protein, 28 aa, Staphylococcus aureus
LSNKLNKYSIRKFTVGTASILIGSLMYL

SEQ ID NO: 1692934 - protein, 23 aa, Staphylococcus aureus
LSQIAQQFYFFGAGKIEKIERKN

SEQ ID NO: 1692935 - protein, 21 aa, Staphylococcus aureus
LTAKFKSNENVLILGYTKHMN

SEQ ID NO: 1692936 - protein, 23 aa, Staphylococcus aureus
LTGITAYETFFDTFKISHNPAEN

SEQ ID NO: 1692937 - protein, 18 aa, Staphylococcus aureus
LTGRELLIANQLPVIVHE

SEQ ID NO: 1692938 - protein, 25 aa, Staphylococcus aureus
LTTGAFNALLKTLEEPPAHAIFILA

SEQ ID NO: 1692939 - protein, 18 aa, Staphylococcus aureus
LTTKRLRKWGLLSLTQLA

SEQ ID NO: 1692940 - protein, 17 aa, Staphylococcus aureus
LVAGIKAALLDTTGIKL

SEQ ID NO: 1692941 - protein, 18 aa, Staphylococcus aureus
LVARVQAMRRRKVPGWGV

SEQ ID NO: 1692942 - protein, 23 aa, Staphylococcus aureus
LVEKLISMLGWDPQSPVPINDHG

SEQ ID NO: 1692943 - protein, 21 aa, Staphylococcus aureus
LVELKIWKRWLHTQGYKDIHL

SEQ ID NO: 1692944 - protein, 20 aa, Staphylococcus aureus
LVFFSRQIAPGLKRIDSIVL

SEQ ID NO: 1692945 - protein, 17 aa, Staphylococcus aureus
LVLIDLQEGILKMDYAP

SEQ ID NO: 1692946 - protein, 19 aa, Staphylococcus aureus
LVPMLQRTITIAAKEGIKN

SEQ ID NO: 1692947 - protein, 29 aa, Staphylococcus aureus
LVPVKELKLIPFPLPVKFEQDKISQFILI

SEQ ID NO: 1692948 - protein, 20 aa, Staphylococcus aureus
LYDSKALFKLLALESQHARL

SEQ ID NO: 1692949 - protein, 21 aa, Staphylococcus aureus
LYEKKLITYPRTDSRYITEDE

SEQ ID NO: 1692950 - protein, 21 aa, Staphylococcus aureus
LYIDEQTFVPCTPLGIMEILK

SEQ ID NO: 1692951 - protein, 21 aa, Staphylococcus aureus
LYNIVGFQTHLKWGAQKEVIK

SEQ ID NO: 1692952 - protein, 21 aa, Staphylococcus aureus
LYSVKEIFRYFTDSNLHRKKI

SEQ ID NO: 1692953 - protein, 17 aa, Staphylococcus aureus
MADIKFLSIERIVIELT

SEQ ID NO: 1692954 - protein, 20 aa, Staphylococcus aureus
MANQVNTTKAALNGAQNLAQ

SEQ ID NO: 1692955 - protein, 18 aa, Staphylococcus aureus
MARHFGVYYSLTTISRDL

SEQ ID NO: 1692956 - protein, 18 aa, Staphylococcus aureus
MARLDELVATEYPVLLAT

SEQ ID NO: 1692957 - protein, 21 aa, Staphylococcus aureus
MDKAFDRLKLNIFISLAELES

SEQ ID NO: 1692958 - protein, 18 aa, Staphylococcus aureus
MDLYDLFEELRDLFKEEG

SEQ ID NO: 1692959 - protein, 17 aa, Staphylococcus aureus
MFDQWTIRKVPKYIVYA

SEQ ID NO: 1692960 - protein, 18 aa, Staphylococcus aureus
MGIPTDIKPFVTTKLISP

SEQ ID NO: 1692961 - protein, 24 aa, Staphylococcus aureus
MIAIDVNPYYQLCKAKGLLSIIDN

SEQ ID NO: 1692962 - protein, 26 aa, Staphylococcus aureus
MIRTPLLSVEFFNLFLNTEQIKYSDL

SEQ ID NO: 1692963 - protein, 17 aa, Staphylococcus aureus
MKIAGDFNAYNALAAYS

SEQ ID NO: 1692964 - protein, 17 aa, Staphylococcus aureus
MKIKPIGTLDDGRLELV

SEQ ID NO: 1692965 - protein, 29 aa, Staphylococcus aureus
MKLANIEFPWLRLVVLRAFIDNIKKYHDI

SEQ ID NO: 1692966 - protein, 19 aa, Staphylococcus aureus
MKLRIGFSDIFFNVDQLTS

SEQ ID NO: 1692967 - protein, 17 aa, Staphylococcus aureus
MKMIPGMNKMKELDKLN

SEQ ID NO: 1692968 - protein, 19 aa, Staphylococcus aureus
MKSLSIPLQYLVAAALEVT

SEQ ID NO: 1692969 - protein, 32 aa, Staphylococcus aureus
MKVPLGIFSHQLQRFIHLVWDVRNVINDNIKE

SEQ ID NO: 1692970 - protein, 21 aa, Staphylococcus aureus
MLNGIYYYHPSVESIQKYANL

SEQ ID NO: 1692971 - protein, 19 aa, Staphylococcus aureus
MLNTILEAITAFLKNEFPQ

SEQ ID NO: 1692972 - protein, 18 aa, Staphylococcus aureus
MLPMFSEELVNHAVSYLE

SEQ ID NO: 1692973 - protein, 17 aa, Staphylococcus aureus
MLSVLSLEDEFKLEEIQ

SEQ ID NO: 1692974 - protein, 17 aa, Staphylococcus aureus
MLTLLDMAQIYVSSGSA

SEQ ID NO: 1692975 - protein, 17 aa, Staphylococcus aureus
MMFYEKNAEYMRILAFV

SEQ ID NO: 1692976 - protein, 17 aa, Staphylococcus aureus
MNAHIYLELADDYQALA

SEQ ID NO: 1692977 - protein, 21 aa, Staphylococcus aureus
MNARWIPTVEKIMKDLGGSEA

SEQ ID NO: 1692978 - protein, 23 aa, Staphylococcus aureus
MNYSDIYSLFKRLKHKTSINVHP

SEQ ID NO: 1692979 - protein, 18 aa, Staphylococcus aureus
MPAALMFPSGNKFYDWIY

SEQ ID NO: 1692980 - protein, 33 aa, Staphylococcus aureus
MPKAMIMKFDLALQRMLLGEPIQYIVGFASFYG

SEQ ID NO: 1692981 - protein, 17 aa, Staphylococcus aureus
MPKWSKLVNKLSVPIEA

SEQ ID NO: 1692982 - protein, 24 aa, Staphylococcus aureus
MPNMTKGQALKRLLDKWGMSPSEL

SEQ ID NO: 1692983 - protein, 25 aa, Staphylococcus aureus
MPNMTKGQALKRLLDKWGMSSSELM

SEQ ID NO: 1692984 - protein, 21 aa, Staphylococcus aureus
MQGITYDAGILYWYTGDSKPA

SEQ ID NO: 1692985 - protein, 28 aa, Staphylococcus aureus
MTLPNKEFQLLFMLAARPKQIFTREQII

SEQ ID NO: 1692986 - protein, 28 aa, Staphylococcus aureus
MTWNSQKFFDLIKYFELPLQTKIKTFSR

SEQ ID NO: 1692987 - protein, 19 aa, Staphylococcus aureus
MVDDELFIYNSKNQALTNY

SEQ ID NO: 1692988 - protein, 28 aa, Staphylococcus aureus
MVKLALELYNSPWIAWYYQQMQDKKAKL

SEQ ID NO: 1692989 - protein, 17 aa, Staphylococcus aureus
MVLFLNRNTKKATGYYY

SEQ ID NO: 1692990 - protein, 32 aa, Staphylococcus aureus
MVVSQFLTKDLFINWTWGEDFFRKYLIDYDAT

SEQ ID NO: 1692991 - protein, 20 aa, Staphylococcus aureus
NAAKAILTKASGQNVDKAAV

SEQ ID NO: 1692992 - protein, 17 aa, Staphylococcus aureus
NAERKQHQLFTLKYSKQ

SEQ ID NO: 1692993 - protein, 25 aa, Staphylococcus aureus
NAKEDLALSLGLTATALKGNINISN

SEQ ID NO: 1692994 - protein, 23 aa, Staphylococcus aureus
NCIQPIIEPIKYTTTFKNVLKYC

SEQ ID NO: 1692995 - protein, 35 aa, Staphylococcus aureus
NDHRRIDLAVTKNLPRFIDVLATVLKEMEIQKIYL

SEQ ID NO: 1692996 - protein, 19 aa, Staphylococcus aureus
NDIIFITCNYRLGALGYLD

SEQ ID NO: 1692997 - protein, 18 aa, Staphylococcus aureus
NDILVLRLGGEYTVKRVR

SEQ ID NO: 1692998 - protein, 17 aa, Staphylococcus aureus
NDLYTWSSGIKSSIYCD

SEQ ID NO: 1692999 - protein, 29 aa, Staphylococcus aureus
NDNAQGEYYLPDVLSLILNDGGIVEVYRT

SEQ ID NO: 1693000 - protein, 24 aa, Staphylococcus aureus
NDNGLTRLIFNVPARGMIGYTTEF

SEQ ID NO: 1693001 - protein, 24 aa, Staphylococcus aureus
NDRERLWLKLYLEGYKQFEIADIM

SEQ ID NO: 1693002 - protein, 21 aa, Staphylococcus aureus
NDYFVRIQQWCQKFNIALTIK

SEQ ID NO: 1693003 - protein, 23 aa, Staphylococcus aureus
NEASEFFIKALKKEFESFKDTGA

SEQ ID NO: 1693004 - protein, 21 aa, Staphylococcus aureus
NECIYFASKNKKLVRLNYKSE

SEQ ID NO: 1693005 - protein, 24 aa, Staphylococcus aureus
NEETPIVMSSRIRLARNLENHVHP

SEQ ID NO: 1693006 - protein, 17 aa, Staphylococcus aureus
NEFLIAGFNYEGQLAAA

SEQ ID NO: 1693007 - protein, 25 aa, Staphylococcus aureus
NEIKQRKLYPLTEMIRPINTNDNTP

SEQ ID NO: 1693008 - protein, 23 aa, Staphylococcus aureus
NELLRMIHLIKKYKLAANSKIIE

SEQ ID NO: 1693009 - protein, 18 aa, Staphylococcus aureus
NELMVAIQSPFLLDEEDD

SEQ ID NO: 1693010 - protein, 24 aa, Staphylococcus aureus
NERDFIRKYITPNIAKYLRHAGHE

SEQ ID NO: 1693011 - protein, 25 aa, Staphylococcus aureus
NERMPIKSLNLLASQVLEIIKIVAR

SEQ ID NO: 1693012 - protein, 22 aa, Staphylococcus aureus
NEYGTKWYTYYDDDYNNFIMIS

SEQ ID NO: 1693013 - protein, 29 aa, Staphylococcus aureus
NFGGFKSYRLLRPVKGTIYKIYFGFADRQ

SEQ ID NO: 1693014 - protein, 18 aa, Staphylococcus aureus
NFHIINNLDLPYVYIPTK

SEQ ID NO: 1693015 - protein, 17 aa, Staphylococcus aureus
NFINADTDKQTAYNTAV

SEQ ID NO: 1693016 - protein, 25 aa, Staphylococcus aureus
NFLKESNLYRLLREISMESVKCIEP

SEQ ID NO: 1693017 - protein, 25 aa, Staphylococcus aureus
NGEVTFINPLMPSGLPIHEWLMLKQ

SEQ ID NO: 1693018 - protein, 19 aa, Staphylococcus aureus
NGFRAYVFAPVIKGKVDTG

SEQ ID NO: 1693019 - protein, 27 aa, Staphylococcus aureus
NGKARTGWLIVDYAGYPWPGYDDIVSE

SEQ ID NO: 1693020 - protein, 17 aa, Staphylococcus aureus
NGMANQVNTTKAALNGA

SEQ ID NO: 1693021 - protein, 19 aa, Staphylococcus aureus
NGMRIGELLAIKRENINYE

SEQ ID NO: 1693022 - protein, 18 aa, Staphylococcus aureus
NGRPTILSRSYNLYSTIQ

SEQ ID NO: 1693023 - protein, 26 aa, Staphylococcus aureus
NGTVGFLVLHIPFISSVDFGKFEKEL

SEQ ID NO: 1693024 - protein, 23 aa, Staphylococcus aureus
NGTYYFHGHIVPGWQSVKKTFDT

SEQ ID NO: 1693025 - protein, 23 aa, Staphylococcus aureus
NGVELRNRFVLAPLTHISSNDDS

SEQ ID NO: 1693026 - protein, 23 aa, Staphylococcus aureus
NHKNIIFWVGWNEEAFNIGADLK

SEQ ID NO: 1693027 - protein, 19 aa, Staphylococcus aureus
NIDLNIYRPLFGNGSSPDE

SEQ ID NO: 1693028 - protein, 28 aa, Staphylococcus aureus
NIGQRRLFEWLRQNGFLIKRKGVDYNMP

SEQ ID NO: 1693029 - protein, 17 aa, Staphylococcus aureus
NIHQFRDILSPEKELVV

SEQ ID NO: 1693030 - protein, 26 aa, Staphylococcus aureus
NIKAKIFRYQYRDVNLTWICKAPKYT

SEQ ID NO: 1693031 - protein, 20 aa, Staphylococcus aureus
NIKVLNHAMPILLVSGYDDP

SEQ ID NO: 1693032 - protein, 18 aa, Staphylococcus aureus
NIPFDGMISELFKATDDF

SEQ ID NO: 1693033 - protein, 22 aa, Staphylococcus aureus
NISKILDFQISENKPIIGENIF

SEQ ID NO: 1693034 - protein, 26 aa, Staphylococcus aureus
NITKFNILQFILDLSLKDSKLTNRCL

SEQ ID NO: 1693035 - protein, 28 aa, Staphylococcus aureus
NITSMPHYDGFITDLPFIGQHTLESYND

SEQ ID NO: 1693036 - protein, 18 aa, Staphylococcus aureus
NIWALHKLLKQCNLGKRD

SEQ ID NO: 1693037 - protein, 24 aa, Staphylococcus aureus
NKADALKAITALKLQMDEELKTAR

SEQ ID NO: 1693038 - protein, 17 aa, Staphylococcus aureus
NKDLRALYRGKAHHVVN

SEQ ID NO: 1693039 - protein, 27 aa, Staphylococcus aureus
NKGDKLAQLVIVPIWTPELKQVEEFEC

SEQ ID NO: 1693040 - protein, 23 aa, Staphylococcus aureus
NKLSEYQLLTQFNPAFINKKIKM

SEQ ID NO: 1693041 - protein, 27 aa, Staphylococcus aureus
NKNKALRKYDYLIKKIAFIDEYEEYIT

SEQ ID NO: 1693042 - protein, 26 aa, Staphylococcus aureus
NKNQHDKFVFGAIQKKLLSEYDFDYS

SEQ ID NO: 1693043 - protein, 20 aa, Staphylococcus aureus
NKRFGQIGVLLYYGDVTLTH

SEQ ID NO: 1693044 - protein, 27 aa, Staphylococcus aureus
NKTIPWLYVERGFEIPSFNYVLKTENV

SEQ ID NO: 1693045 - protein, 22 aa, Staphylococcus aureus
NKVPVNIFMAIIASESQWGKGE

SEQ ID NO: 1693046 - protein, 24 aa, Staphylococcus aureus
NKYDKVYIVPLDKLTKQELLELCE

SEQ ID NO: 1693047 - protein, 23 aa, Staphylococcus aureus
NKYDPTLTLAFKLARLFDTTVDE

SEQ ID NO: 1693048 - protein, 19 aa, Staphylococcus aureus
NKYGIEFNFDKYNSFMLFG

SEQ ID NO: 1693049 - protein, 26 aa, Staphylococcus aureus
NLGKMETLLLCARQFLWSTAKGYQQF

SEQ ID NO: 1693050 - protein, 24 aa, Staphylococcus aureus
NLHVDVVTLYFKKAKAWSEKHQFP

SEQ ID NO: 1693051 - protein, 26 aa, Staphylococcus aureus
NLIYEVFEMMNCFKFSFINENKELIL

SEQ ID NO: 1693052 - protein, 17 aa, Staphylococcus aureus
NLLGFELQPTNDGLIIH

SEQ ID NO: 1693053 - protein, 36 aa, Staphylococcus aureus
NLMIPDLSSDFTLFDFTYDLPLSTYLGQVLNMNAKV

SEQ ID NO: 1693054 - protein, 20 aa, Staphylococcus aureus
NLNVLDKLADALGVNVSELF

SEQ ID NO: 1693055 - protein, 17 aa, Staphylococcus aureus
NLQRITRHLLKKYQERF

SEQ ID NO: 1693056 - protein, 24 aa, Staphylococcus aureus
NLSLSLLTIIYLRKSWKIENLLKK

SEQ ID NO: 1693057 - protein, 25 aa, Staphylococcus aureus
NLYTAGQCTWYAYGMRQKMGKPVST

SEQ ID NO: 1693058 - protein, 23 aa, Staphylococcus aureus
NLYTSGQCTYYVFDRVGGKIGST

SEQ ID NO: 1693059 - protein, 24 aa, Staphylococcus aureus
NMESRGMVLYINRNTRTTKGNFVV

SEQ ID NO: 1693060 - protein, 18 aa, Staphylococcus aureus
NMGALWPTLGAIPTSSFT

SEQ ID NO: 1693061 - protein, 26 aa, Staphylococcus aureus
NNAMDQLKQAIADHDTIVASGNYTNA

SEQ ID NO: 1693062 - protein, 25 aa, Staphylococcus aureus
NNATLPYALMVANKGYREAFKSNQP

SEQ ID NO: 1693063 - protein, 20 aa, Staphylococcus aureus
NNFIENTYKYVLHHGLDKKE

SEQ ID NO: 1693064 - protein, 22 aa, Staphylococcus aureus
NNGFIAFVRVNFYDGKDALKPN

SEQ ID NO: 1693065 - protein, 32 aa, Staphylococcus aureus
NNNAPYQFVDIKTLVYPGFATDLQQPITPLLF

SEQ ID NO: 1693066 - protein, 33 aa, Staphylococcus aureus
NNNAPYQFVDIKTLVYPGFATDLQQPITPLLFM

SEQ ID NO: 1693067 - protein, 23 aa, Staphylococcus aureus
NNPNNYIFAIYKGKRKGMPFTQH

SEQ ID NO: 1693068 - protein, 22 aa, Staphylococcus aureus
NNPYPPNLPAIMRKEPKKVSIE

SEQ ID NO: 1693069 - protein, 22 aa, Staphylococcus aureus
NNRRWEGTPFYIRTGKRLGKKA

SEQ ID NO: 1693070 - protein, 23 aa, Staphylococcus aureus
NNYIGQILEYTYIKYIRTEDSVY

SEQ ID NO: 1693071 - protein, 18 aa, Staphylococcus aureus
NPDFFMYQAYAAQVNREI

SEQ ID NO: 1693072 - protein, 22 aa, Staphylococcus aureus
NPDLFFGFQCYDYANMFFMLAT

SEQ ID NO: 1693073 - protein, 31 aa, Staphylococcus aureus
NPFSISAVTYILSNPFYIGKIQFAKYKDWND

SEQ ID NO: 1693074 - protein, 26 aa, Staphylococcus aureus
NPGTFLITHFYYYYDFEYDCLILPND

SEQ ID NO: 1693075 - protein, 17 aa, Staphylococcus aureus
NPKILLCDEATSALDPA

SEQ ID NO: 1693076 - protein, 37 aa, Staphylococcus aureus
NPKNVIFLVGDGMGPSFNTAYRYYKNDPHAKEMTPTA

SEQ ID NO: 1693077 - protein, 24 aa, Staphylococcus aureus
NPKTERKPVITGYRAHNVFDVADT

SEQ ID NO: 1693078 - protein, 22 aa, Staphylococcus aureus
NPNVIFEHCLPSFHNADTKIGQ

SEQ ID NO: 1693079 - protein, 36 aa, Staphylococcus aureus
NPYLDKFYNDFERWSFHLQIYFLAERFKEQKRMFEY

SEQ ID NO: 1693080 - protein, 24 aa, Staphylococcus aureus
NPYPPNLPAIMRKAPKKVSIEPVD

SEQ ID NO: 1693081 - protein, 23 aa, Staphylococcus aureus
NQDNWTYPPFQLTEKDGKLYGRG

SEQ ID NO: 1693082 - protein, 21 aa, Staphylococcus aureus
NQIQALIRGVWLLSGIDKELS

SEQ ID NO: 1693083 - protein, 17 aa, Staphylococcus aureus
NQMLGHQTSFLTYEGLV

SEQ ID NO: 1693084 - protein, 26 aa, Staphylococcus aureus
NQMRLKLTTELLLNANLLSPEQIVQP

SEQ ID NO: 1693085 - protein, 18 aa, Staphylococcus aureus
NQSWVDVEDLPLILPNKN

SEQ ID NO: 1693086 - protein, 25 aa, Staphylococcus aureus
NRGSVPFTVFIDPPLSRVGLTSKEA

SEQ ID NO: 1693087 - protein, 29 aa, Staphylococcus aureus
NRHAKRRLTYHTFLALYQQILNDEGDLHF

SEQ ID NO: 1693088 - protein, 18 aa, Staphylococcus aureus
NRLIKIINVLGYEYNKDT

SEQ ID NO: 1693089 - protein, 29 aa, Staphylococcus aureus
NRNMIIINESGLYSLIFDASKQSKNENIR

SEQ ID NO: 1693090 - protein, 26 aa, Staphylococcus aureus
NSAKENINCRCKLLYYIDEDELPTVM

SEQ ID NO: 1693091 - protein, 20 aa, Staphylococcus aureus
NSIIVLQRFVAMKNITHIIS

SEQ ID NO: 1693092 - protein, 19 aa, Staphylococcus aureus
NTFDAVIANPPYSAKWTAD

SEQ ID NO: 1693093 - protein, 17 aa, Staphylococcus aureus
NTFLELVKIDSETGNES

SEQ ID NO: 1693094 - protein, 20 aa, Staphylococcus aureus
NTFNKNQLAIAPLIEGFDYE

SEQ ID NO: 1693095 - protein, 34 aa, Staphylococcus aureus
NTHFFNTILKYVKAGSLYPLSYYDGDWYGEDKVK

SEQ ID NO: 1693096 - protein, 25 aa, Staphylococcus aureus
NTINGLPHLTQLQKDNLKHQVEQAQ

SEQ ID NO: 1693097 - protein, 23 aa, Staphylococcus aureus
NTTLLSTFIYKIANERLFSREEY

SEQ ID NO: 1693098 - protein, 21 aa, Staphylococcus aureus
NTVCYMWLRFNMDQQFEDTAI

SEQ ID NO: 1693099 - protein, 20 aa, Staphylococcus aureus
NTWFGGHVAVLPGVTIGEGS

SEQ ID NO: 1693100 - protein, 26 aa, Staphylococcus aureus
NVDGFKALRFLRPRTAGRHYIIITLW

SEQ ID NO: 1693101 - protein, 19 aa, Staphylococcus aureus
NVFVNTNCYFMDGGQITIG

SEQ ID NO: 1693102 - protein, 26 aa, Staphylococcus aureus
NVLAARLGWLPSYPQFNKNSLLFAEE

SEQ ID NO: 1693103 - protein, 24 aa, Staphylococcus aureus
NVNRSYILEAIKDSLKRLIVPSIE

SEQ ID NO: 1693104 - protein, 18 aa, Staphylococcus aureus
NVPIFINIGEWDGDDEEL

SEQ ID NO: 1693105 - protein, 24 aa, Staphylococcus aureus
NVPLKSFHVIDLSELYIATDAMRD

SEQ ID NO: 1693106 - protein, 23 aa, Staphylococcus aureus
NVRAFYEFYSYLMEPWDGPTMIS

SEQ ID NO: 1693107 - protein, 23 aa, Staphylococcus aureus
NVSFDYIDWVNLEFGPLAKENYY

SEQ ID NO: 1693108 - protein, 28 aa, Staphylococcus aureus
NVSWQRCQVHFLRNIFTTIPKKNSKSFR

SEQ ID NO: 1693109 - protein, 26 aa, Staphylococcus aureus
NVSYADILEILKIKKAFNVKQCGNIL

SEQ ID NO: 1693110 - protein, 19 aa, Staphylococcus aureus
NVYIDFKIKNSAGIKNISY

SEQ ID NO: 1693111 - protein, 25 aa, Staphylococcus aureus
NWQVNPMLRLLKTDVLTASYLKSAY

SEQ ID NO: 1693112 - protein, 17 aa, Staphylococcus aureus
NYFVKKYSNIIFSAHCH

SEQ ID NO: 1693113 - protein, 18 aa, Staphylococcus aureus
NYKSFNWQVFQQVVDYLN

SEQ ID NO: 1693114 - protein, 18 aa, Staphylococcus aureus
NYRDDVESLYSKLDLIMG

SEQ ID NO: 1693115 - protein, 19 aa, Staphylococcus aureus
PAALRCSQFVYKEQKNQKT

SEQ ID NO: 1693116 - protein, 26 aa, Staphylococcus aureus
PAGSVYFIIIFYNKNGAKLSTEIVKS

SEQ ID NO: 1693117 - protein, 17 aa, Staphylococcus aureus
PAHQQAYVRAYPAVGKN

SEQ ID NO: 1693118 - protein, 24 aa, Staphylococcus aureus
PAIPKLFDYIHKRYAKLSLEDLIN

SEQ ID NO: 1693119 - protein, 17 aa, Staphylococcus aureus
PANIFYGTSIPTCILVF

SEQ ID NO: 1693120 - protein, 27 aa, Staphylococcus aureus
PDAYGSQLGLKYYIHQKFPQKQVFAVG

SEQ ID NO: 1693121 - protein, 17 aa, Staphylococcus aureus
PDKQEFLFVTELAPLTN

SEQ ID NO: 1693122 - protein, 19 aa, Staphylococcus aureus
PDSIFVQHLLITMPQSFGR

SEQ ID NO: 1693123 - protein, 23 aa, Staphylococcus aureus
PEEYLMLHKKFIKPINKNFIVKG

SEQ ID NO: 1693124 - protein, 19 aa, Staphylococcus aureus
PEKFVTLKHQHILGTLMSL

SEQ ID NO: 1693125 - protein, 19 aa, Staphylococcus aureus
PELIQWAWDNPKLSGNKRF

SEQ ID NO: 1693126 - protein, 18 aa, Staphylococcus aureus
PELRNMKIFPRPIDNTLP

SEQ ID NO: 1693127 - protein, 17 aa, Staphylococcus aureus
PENPVNDTLWYDTSNPD

SEQ ID NO: 1693128 - protein, 24 aa, Staphylococcus aureus
PENRKTVLIFYKIQPDNIYITNQY

SEQ ID NO: 1693129 - protein, 20 aa, Staphylococcus aureus
PEPIIMVKALEILGLDKSEV

SEQ ID NO: 1693130 - protein, 18 aa, Staphylococcus aureus
PFFICQILAFSFPTSPHI

SEQ ID NO: 1693131 - protein, 17 aa, Staphylococcus aureus
PFNQLGGYPYFDQIDPR

SEQ ID NO: 1693132 - protein, 17 aa, Staphylococcus aureus
PFNSRKLILRRAAQFLT

SEQ ID NO: 1693133 - protein, 22 aa, Staphylococcus aureus
PIDRQLFYQFIMKLPESVLRLK

SEQ ID NO: 1693134 - protein, 25 aa, Staphylococcus aureus
PKLDNLFEKDLYSTYLSYLASTDFS

SEQ ID NO: 1693135 - protein, 22 aa, Staphylococcus aureus
PKQFDVIVYENLFGDILSDEAS

SEQ ID NO: 1693136 - protein, 24 aa, Staphylococcus aureus
PKSWKLIAQMPFGDIREAAGEKTF

SEQ ID NO: 1693137 - protein, 22 aa, Staphylococcus aureus
PKVLNLVHMDFLNASSDFGNAH

SEQ ID NO: 1693138 - protein, 30 aa, Staphylococcus aureus
PLIIDDVVKGFLTYKIPKKVIKHAGYVRCK

SEQ ID NO: 1693139 - protein, 25 aa, Staphylococcus aureus
PLPSKDNLAILYGEGFHICKGELFG

SEQ ID NO: 1693140 - protein, 17 aa, Staphylococcus aureus
PLVLGGDHSIAVGSVSA

SEQ ID NO: 1693141 - protein, 18 aa, Staphylococcus aureus
PMIERLPRELKHISLIQL

SEQ ID NO: 1693142 - protein, 25 aa, Staphylococcus aureus
PPSYSSYIDFLYTCRQKIKLLDITY

SEQ ID NO: 1693143 - protein, 23 aa, Staphylococcus aureus
PQGRGKIKWQAFATLPQQFEILE

SEQ ID NO: 1693144 - protein, 27 aa, Staphylococcus aureus
PQKNSTLQLVIYYLMGKASQKPTFENI

SEQ ID NO: 1693145 - protein, 30 aa, Staphylococcus aureus
PQNNDIYSRPRGKFRFPMSVAYENENVKQS

SEQ ID NO: 1693146 - protein, 28 aa, Staphylococcus aureus
PQNVLYGKLRPYLNKYYFTKKSGVCSSE

SEQ ID NO: 1693147 - protein, 19 aa, Staphylococcus aureus
PQQREIGFPISTDNASWGG

SEQ ID NO: 1693148 - protein, 22 aa, Staphylococcus aureus
PSGYDHLCQFVMSGQLSDSEKL

SEQ ID NO: 1693149 - protein, 20 aa, Staphylococcus aureus
PSKNYGYLAAKKPLVLIMDK

SEQ ID NO: 1693150 - protein, 17 aa, Staphylococcus aureus
PSYTILSIDLLNELLRE

SEQ ID NO: 1693151 - protein, 22 aa, Staphylococcus aureus
PTAIRYAGLIPRLKQLDLDVND

SEQ ID NO: 1693152 - protein, 27 aa, Staphylococcus aureus
PTFENIRYIGIYNPRFNQIYKYDMTQA

SEQ ID NO: 1693153 - protein, 19 aa, Staphylococcus aureus
PTLYLAADTVWFEGVEKAL

SEQ ID NO: 1693154 - protein, 23 aa, Staphylococcus aureus
PTQKAPKLLLKGSGNLKGSSVGY

SEQ ID NO: 1693155 - protein, 18 aa, Staphylococcus aureus
PTQLLAWLKNDQGLDIPN

SEQ ID NO: 1693156 - protein, 20 aa, Staphylococcus aureus
PVELRRSIGYVIQQIGLMPH

SEQ ID NO: 1693157 - protein, 21 aa, Staphylococcus aureus
PVELRRSIGYVIQQIGLMPHM

SEQ ID NO: 1693158 - protein, 18 aa, Staphylococcus aureus
PVLQEALNFLRMGDRFVV

SEQ ID NO: 1693159 - protein, 25 aa, Staphylococcus aureus
PVNDKKVIPIPKKALFNPSQNKVRQ

SEQ ID NO: 1693160 - protein, 25 aa, Staphylococcus aureus
PVNIQNYIKHLYRQVLLDMKNNNNK

SEQ ID NO: 1693161 - protein, 19 aa, Staphylococcus aureus
PVVGFIGGQTAPPGKRMGH

SEQ ID NO: 1693162 - protein, 26 aa, Staphylococcus aureus
PYHLTYQMVGIFDPTKLKLVAKTIKD

SEQ ID NO: 1693163 - protein, 17 aa, Staphylococcus aureus
PYIKKKVKKYSMGMKQK

SEQ ID NO: 1693164 - protein, 31 aa, Staphylococcus aureus
PYSPQVRKLKEGFFFAALTPTLRHLGKLEAE

SEQ ID NO: 1693165 - protein, 18 aa, Staphylococcus aureus
QAFDRLKLNIFISLAELE

SEQ ID NO: 1693166 - protein, 22 aa, Staphylococcus aureus
QAPVYLYPNTDKVPGLNRFAFT

SEQ ID NO: 1693167 - protein, 17 aa, Staphylococcus aureus
QAYGLINAGLDSMIFNF

SEQ ID NO: 1693168 - protein, 25 aa, Staphylococcus aureus
QCYDYANMFFMLATGERLQGLYAYN

SEQ ID NO: 1693169 - protein, 17 aa, Staphylococcus aureus
QCYIEQLGFQHVSDFPR

SEQ ID NO: 1693170 - protein, 26 aa, Staphylococcus aureus
QDALANLDTLRDLNQPQRDALRNQIN

SEQ ID NO: 1693171 - protein, 26 aa, Staphylococcus aureus
QDLEKFQKILILKSFDFDIAKIKQYI

SEQ ID NO: 1693172 - protein, 19 aa, Staphylococcus aureus
QDMVLGNYYLTLERKDAVN

SEQ ID NO: 1693173 - protein, 24 aa, Staphylococcus aureus
QDWANMLFRMYQRYCEKKGFKVKT

SEQ ID NO: 1693174 - protein, 18 aa, Staphylococcus aureus
QELREILASLGLKRVEDL

SEQ ID NO: 1693175 - protein, 25 aa, Staphylococcus aureus
QEQFNLSYLFIAHDLSVVKYISDVI

SEQ ID NO: 1693176 - protein, 23 aa, Staphylococcus aureus
QERKRRLRPWLYDGTPQKHSRDP

SEQ ID NO: 1693177 - protein, 18 aa, Staphylococcus aureus
QESFTHIELPEHAFLSCY

SEQ ID NO: 1693178 - protein, 25 aa, Staphylococcus aureus
QETEVINVFPIRFIVDKENEVSDPK

SEQ ID NO: 1693179 - protein, 18 aa, Staphylococcus aureus
QETKKLLDRIYPYRKCDK

SEQ ID NO: 1693180 - protein, 17 aa, Staphylococcus aureus
QFSLPFGKDYADAHEKM

SEQ ID NO: 1693181 - protein, 17 aa, Staphylococcus aureus
QFTVPFVCGCRNLGEAA

SEQ ID NO: 1693182 - protein, 18 aa, Staphylococcus aureus
QFVGDIILSKNLSEIIKI

SEQ ID NO: 1693183 - protein, 20 aa, Staphylococcus aureus
QGIGLYRTEFLYMGRDQMPT

SEQ ID NO: 1693184 - protein, 20 aa, Staphylococcus aureus
QGKMAFRVYPKWCNQLNKTA

SEQ ID NO: 1693185 - protein, 24 aa, Staphylococcus aureus
QGYQDLLQPILKGKIAYSNPNTTT

SEQ ID NO: 1693186 - protein, 19 aa, Staphylococcus aureus
QHDGHELIFASARPIRDLL

SEQ ID NO: 1693187 - protein, 22 aa, Staphylococcus aureus
QHEARENLYNKLDLIVGRSDDE

SEQ ID NO: 1693188 - protein, 21 aa, Staphylococcus aureus
QHMKALFKCKNYLQIDTKIDM

SEQ ID NO: 1693189 - protein, 17 aa, Staphylococcus aureus
QHTLLPLADVVTPNLPE

SEQ ID NO: 1693190 - protein, 19 aa, Staphylococcus aureus
QIFISSTYLDLIEERQAVV

SEQ ID NO: 1693191 - protein, 18 aa, Staphylococcus aureus
QIHFLNYMKTKNLNHFIY

SEQ ID NO: 1693192 - protein, 18 aa, Staphylococcus aureus
QIVEILKNQINTLNNQIE

SEQ ID NO: 1693193 - protein, 21 aa, Staphylococcus aureus
QKAIMLPPGLAFVAYSHHAKE

SEQ ID NO: 1693194 - protein, 18 aa, Staphylococcus aureus
QKAITLKAAFELGERMGR

SEQ ID NO: 1693195 - protein, 19 aa, Staphylococcus aureus
QKIVRWRAAMFIFDEGNAE

SEQ ID NO: 1693196 - protein, 22 aa, Staphylococcus aureus
QKYLDFFVEKGHMVEPSAPLVP

SEQ ID NO: 1693197 - protein, 25 aa, Staphylococcus aureus
QKYPDESELLIYFIEGLMSENQTDE

SEQ ID NO: 1693198 - protein, 17 aa, Staphylococcus aureus
QLDDTWMAIFKDMNFEL

SEQ ID NO: 1693199 - protein, 21 aa, Staphylococcus aureus
QLEMQYDLDITRWSELEEIKE

SEQ ID NO: 1693200 - protein, 18 aa, Staphylococcus aureus
QLEVPIPAIISAFEIAKS

SEQ ID NO: 1693201 - protein, 20 aa, Staphylococcus aureus
QLFEDEYFMYGLQTYAESNN

SEQ ID NO: 1693202 - protein, 21 aa, Staphylococcus aureus
QLFEDEYFMYGLQTYAESNNS

SEQ ID NO: 1693203 - protein, 18 aa, Staphylococcus aureus
QLGFQHVSDFPRALFMST

SEQ ID NO: 1693204 - protein, 29 aa, Staphylococcus aureus
QLGVVLFETLQLPVIKKTKTGYSTAIDVL

SEQ ID NO: 1693205 - protein, 25 aa, Staphylococcus aureus
QLHHDAPIQIMPAPENLFVEYIEDG

SEQ ID NO: 1693206 - protein, 19 aa, Staphylococcus aureus
QLKPLPFISGYVGTCSFDL

SEQ ID NO: 1693207 - protein, 17 aa, Staphylococcus aureus
QLLMHMIHYVPRTYHSN

SEQ ID NO: 1693208 - protein, 20 aa, Staphylococcus aureus
QLLPGVITKIGLNTAVDPRY

SEQ ID NO: 1693209 - protein, 18 aa, Staphylococcus aureus
QLLSMLPIEVEEIPERFS

SEQ ID NO: 1693210 - protein, 17 aa, Staphylococcus aureus
QLNLLFVKDIKKIDVDV

SEQ ID NO: 1693211 - protein, 20 aa, Staphylococcus aureus
QLPQNVVFIFQPAEETGGGA

SEQ ID NO: 1693212 - protein, 24 aa, Staphylococcus aureus
QLSLENYYMYKKFGVIPEMEYEME

SEQ ID NO: 1693213 - protein, 17 aa, Staphylococcus aureus
QLTIMCKLAGPQHSEIG

SEQ ID NO: 1693214 - protein, 22 aa, Staphylococcus aureus
QLVGVLADLHFAPTKNAASHLL

SEQ ID NO: 1693215 - protein, 22 aa, Staphylococcus aureus
QMTPAFWVYFEFDLQKEEIIDI

SEQ ID NO: 1693216 - protein, 24 aa, Staphylococcus aureus
QNETLILSHYIFMNELKINLLEFR

SEQ ID NO: 1693217 - protein, 30 aa, Staphylococcus aureus
QNTNLNDEYVVSPGWTKDEQAKAFEEYKKG

SEQ ID NO: 1693218 - protein, 27 aa, Staphylococcus aureus
QNVDGFKALRFLRPRTAGRHYIIITLW

SEQ ID NO: 1693219 - protein, 24 aa, Staphylococcus aureus
QPHGGSYWKLINNKGKRIASLTKE

SEQ ID NO: 1693220 - protein, 23 aa, Staphylococcus aureus
QPRVKFEKVFAEHFLNLYEKTKD

SEQ ID NO: 1693221 - protein, 18 aa, Staphylococcus aureus
QQIALFPHMTIKENIAQV

SEQ ID NO: 1693222 - protein, 26 aa, Staphylococcus aureus
QQIANGTPTPVLAPDTVTKAVTTMNQ

SEQ ID NO: 1693223 - protein, 25 aa, Staphylococcus aureus
QQIDKLIENIPLLQARSKEILAFVY

SEQ ID NO: 1693224 - protein, 17 aa, Staphylococcus aureus
QREIIYNERNSIIDEED

SEQ ID NO: 1693225 - protein, 21 aa, Staphylococcus aureus
QRKKIFAMCRDIELHWGEPVE

SEQ ID NO: 1693226 - protein, 25 aa, Staphylococcus aureus
QRSADIFLGVPFNIASYALLTHLVA

SEQ ID NO: 1693227 - protein, 24 aa, Staphylococcus aureus
QRSQQLITTDLFLNVFGISSIEDL

SEQ ID NO: 1693228 - protein, 18 aa, Staphylococcus aureus
QRVMIARALMGQPQVLIL

SEQ ID NO: 1693229 - protein, 31 aa, Staphylococcus aureus
QSALSKLERNKKGFFLMVEGASIDKSAHSND

SEQ ID NO: 1693230 - protein, 28 aa, Staphylococcus aureus
QSGSIKVYKLFFIETYKTVFQMTSMVSG

SEQ ID NO: 1693231 - protein, 20 aa, Staphylococcus aureus
QSIKHVILISPTFGSQMIVE

SEQ ID NO: 1693232 - protein, 23 aa, Staphylococcus aureus
QSKKPVIIYFYGGSFENGHGTAE

SEQ ID NO: 1693233 - protein, 17 aa, Staphylococcus aureus
QSKWTRQKAFEEYEWLK

SEQ ID NO: 1693234 - protein, 18 aa, Staphylococcus aureus
QSNQLLPGVITKIGLNTA

SEQ ID NO: 1693235 - protein, 21 aa, Staphylococcus aureus
QSPRLMLGFKNKPLQEAPQKY

SEQ ID NO: 1693236 - protein, 31 aa, Staphylococcus aureus
QSYHYYMDDMLFKKYPYFNRKNIHIPNGDAD

SEQ ID NO: 1693237 - protein, 19 aa, Staphylococcus aureus
QTAIQNRIATQTATQTQTV

SEQ ID NO: 1693238 - protein, 22 aa, Staphylococcus aureus
QTIRLMEEFLRNGNKEEIAYHK

SEQ ID NO: 1693239 - protein, 28 aa, Staphylococcus aureus
QTKITLFEALRAWLYDEIVADSWLDAYQ

SEQ ID NO: 1693240 - protein, 18 aa, Staphylococcus aureus
QTQIVTQTQIVNQTQIAI

SEQ ID NO: 1693241 - protein, 25 aa, Staphylococcus aureus
QTQKRDWFMLINHGAKRTGKTILNN

SEQ ID NO: 1693242 - protein, 29 aa, Staphylococcus aureus
QTSPREAGLFHIALLLPTTEDLANFLYFV

SEQ ID NO: 1693243 - protein, 17 aa, Staphylococcus aureus
QVDKFIHYTPAYMYHEP

SEQ ID NO: 1693244 - protein, 29 aa, Staphylococcus aureus
QVFDDLWMDLYDLFKNLRNLFKEEGLEPW

SEQ ID NO: 1693245 - protein, 17 aa, Staphylococcus aureus
QVFNYFSTPSFVTNIYE

SEQ ID NO: 1693246 - protein, 25 aa, Staphylococcus aureus
QVFYYEIITLLNKRPLRQVDYGNKI

SEQ ID NO: 1693247 - protein, 25 aa, Staphylococcus aureus
QVIFDLLIEYDGELPFWDKSSPEAI

SEQ ID NO: 1693248 - protein, 19 aa, Staphylococcus aureus
QVPLAVRKAIPQLTKVIKK

SEQ ID NO: 1693249 - protein, 20 aa, Staphylococcus aureus
QVPVCCFTFGIPSESIIKRL

SEQ ID NO: 1693250 - protein, 20 aa, Staphylococcus aureus
QYDTFILISKHEGLPISIIE

SEQ ID NO: 1693251 - protein, 24 aa, Staphylococcus aureus
QYKKVVFNNLFYQFSKDANFEPIA

SEQ ID NO: 1693252 - protein, 25 aa, Staphylococcus aureus
QYKKVVFNNLFYQFSKDANFEPIAC

SEQ ID NO: 1693253 - protein, 21 aa, Staphylococcus aureus
QYMGAYHLQWHMIKYAKSHNI

SEQ ID NO: 1693254 - protein, 24 aa, Staphylococcus aureus
QYPHTVLFVTHDRYFLNEVSTRII

SEQ ID NO: 1693255 - protein, 19 aa, Staphylococcus aureus
QYQLPLFMDGARLGYGLMS

SEQ ID NO: 1693256 - protein, 26 aa, Staphylococcus aureus
QYRASQQLLYPLYKKGKFLSIQMYNA

SEQ ID NO: 1693257 - protein, 21 aa, Staphylococcus aureus
QYTDMPFLIMLDEDENGYKAG

SEQ ID NO: 1693258 - protein, 17 aa, Staphylococcus aureus
QYYALDKTLFVALNNKA

SEQ ID NO: 1693259 - protein, 30 aa, Staphylococcus aureus
RAAGKDVTIFFTFWGLNALKKAQTVNVKKQ

SEQ ID NO: 1693260 - protein, 19 aa, Staphylococcus aureus
RAAQLSEIFANRAFEGFKV

SEQ ID NO: 1693261 - protein, 18 aa, Staphylococcus aureus
RADALRHYLQADAAYLKE

SEQ ID NO: 1693262 - protein, 23 aa, Staphylococcus aureus
RASQMYYHELNLTTPIVNFNGAY

SEQ ID NO: 1693263 - protein, 24 aa, Staphylococcus aureus
RATNQPLYNKFKRYAKLLLKPEED

SEQ ID NO: 1693264 - protein, 35 aa, Staphylococcus aureus
RAYTPYSPQVRKLKGGFFFAALTPTLRHLGKLEAE

SEQ ID NO: 1693265 - protein, 18 aa, Staphylococcus aureus
RCHIEAYIEFLFEYAANK

SEQ ID NO: 1693266 - protein, 23 aa, Staphylococcus aureus
RCQDGIVLFWPIDGEIELQKFRK

SEQ ID NO: 1693267 - protein, 19 aa, Staphylococcus aureus
RDASIIKSEYPRLSDSEIS

SEQ ID NO: 1693268 - protein, 29 aa, Staphylococcus aureus
RDLLAAKGLELGCLFAFYGHTHVAKYEYI

SEQ ID NO: 1693269 - protein, 17 aa, Staphylococcus aureus
RDNAQTLNTAMKGLRDS

SEQ ID NO: 1693270 - protein, 26 aa, Staphylococcus aureus
RDNHSAYAFIKRLIKQFGKPQKVITD

SEQ ID NO: 1693271 - protein, 19 aa, Staphylococcus aureus
RDYYFFRSSDDGPPTNWHS

SEQ ID NO: 1693272 - protein, 25 aa, Staphylococcus aureus
READFINVIVFKKQAENVNKYLSKG

SEQ ID NO: 1693273 - protein, 18 aa, Staphylococcus aureus
REDEVIQWFYKEVDWFEA

SEQ ID NO: 1693274 - protein, 19 aa, Staphylococcus aureus
REFDYIKSLRRLTTKDIEV

SEQ ID NO: 1693275 - protein, 17 aa, Staphylococcus aureus
REGLPLRSEYHEQYLKD

SEQ ID NO: 1693276 - protein, 23 aa, Staphylococcus aureus
RENFEMVNLFLDNIFYFQQNVED

SEQ ID NO: 1693277 - protein, 18 aa, Staphylococcus aureus
RFGVHLRLEYYNESDLKE

SEQ ID NO: 1693278 - protein, 17 aa, Staphylococcus aureus
RFKTGMTLQKNPLTLLV

SEQ ID NO: 1693279 - protein, 17 aa, Staphylococcus aureus
RFLDKQKNKKTPVVSLE

SEQ ID NO: 1693280 - protein, 17 aa, Staphylococcus aureus
RFNVMRSLLVQPRVLIC

SEQ ID NO: 1693281 - protein, 18 aa, Staphylococcus aureus
RGMILKLDRNKRTAKGSY

SEQ ID NO: 1693282 - protein, 21 aa, Staphylococcus aureus
RGRKTLLFGPMKPVGLEDPKT

SEQ ID NO: 1693283 - protein, 24 aa, Staphylococcus aureus
RGSVPYTVFIDPPLSRVGLTSKEA

SEQ ID NO: 1693284 - protein, 23 aa, Staphylococcus aureus
RGTYYFRITYYDKSNTRKYITRK

SEQ ID NO: 1693285 - protein, 23 aa, Staphylococcus aureus
RHKHALLIDYLLHNIDLSIQMNE

SEQ ID NO: 1693286 - protein, 17 aa, Staphylococcus aureus
RHPFFICQILAFSFPTS

SEQ ID NO: 1693287 - protein, 27 aa, Staphylococcus aureus
RHSYHFNKIYFLRISTLPLSLGQESCV

SEQ ID NO: 1693288 - protein, 18 aa, Staphylococcus aureus
RHTHCSLLFEAGLSIQEV

SEQ ID NO: 1693289 - protein, 29 aa, Staphylococcus aureus
RHVHYYDNPMYFIRLNFPNNLSVGNKAKG

SEQ ID NO: 1693290 - protein, 17 aa, Staphylococcus aureus
RIGALYIGGKSTADIIL

SEQ ID NO: 1693291 - protein, 18 aa, Staphylococcus aureus
RIGALYIGGKSTADIIMS

SEQ ID NO: 1693292 - protein, 17 aa, Staphylococcus aureus
RIGFKRYAYRNDRYSFK

SEQ ID NO: 1693293 - protein, 27 aa, Staphylococcus aureus
RINNEFRFQILVKYKSEPGLLKAIQFL

SEQ ID NO: 1693294 - protein, 17 aa, Staphylococcus aureus
RINQILQQGHNGINNAM

SEQ ID NO: 1693295 - protein, 28 aa, Staphylococcus aureus
RISNPFLRQMLGYFIKYVGSSSYDAPAV

SEQ ID NO: 1693296 - protein, 21 aa, Staphylococcus aureus
RIYGTHLWSGYPTGTIHSRAG

SEQ ID NO: 1693297 - protein, 28 aa, Staphylococcus aureus
RKAKVAIQELLWFVFEHFDIKGEHKDVD

SEQ ID NO: 1693298 - protein, 18 aa, Staphylococcus aureus
RKVPKYIVYAFYKEYCDE

SEQ ID NO: 1693299 - protein, 19 aa, Staphylococcus aureus
RKVPKYIVYAFYKEYCDEN

SEQ ID NO: 1693300 - protein, 25 aa, Staphylococcus aureus
RKYLKKYFCLTLDNYLVLAYLDVFK

SEQ ID NO: 1693301 - protein, 24 aa, Staphylococcus aureus
RLESFIMLELQRIKGASVKLYTIP

SEQ ID NO: 1693302 - protein, 20 aa, Staphylococcus aureus
RLGFKRIWFTEHHNVPAFAC

SEQ ID NO: 1693303 - protein, 24 aa, Staphylococcus aureus
RLGLPEARIPLSQAVIELCLSPKS

SEQ ID NO: 1693304 - protein, 22 aa, Staphylococcus aureus
RLITNKAAYFKKSQLIEQFIRS

SEQ ID NO: 1693305 - protein, 24 aa, Staphylococcus aureus
RLNIKAFQFTLFDNTFLDEEYIES

SEQ ID NO: 1693306 - protein, 17 aa, Staphylococcus aureus
RLSPISLGLEPWKFVVI

SEQ ID NO: 1693307 - protein, 23 aa, Staphylococcus aureus
RMKMQGYMPVKRIEKPVFQEQKD

SEQ ID NO: 1693308 - protein, 17 aa, Staphylococcus aureus
RMPIEVVYGFAQLKRAA

SEQ ID NO: 1693309 - protein, 19 aa, Staphylococcus aureus
RNEQQLLDNFRSILNERHV

SEQ ID NO: 1693310 - protein, 33 aa, Staphylococcus aureus
RNIKRLLRLVLRLKIYLLKKQIDFINCFKWLKK

SEQ ID NO: 1693311 - protein, 19 aa, Staphylococcus aureus
RNKFCENIISVPLPWCQLA

SEQ ID NO: 1693312 - protein, 32 aa, Staphylococcus aureus
RNMKIFPRPIDNTLPIWRAVGGPPASAIKAGK

SEQ ID NO: 1693313 - protein, 22 aa, Staphylococcus aureus
RNMKPLIVNQIFEPSHYDDMFI

SEQ ID NO: 1693314 - protein, 20 aa, Staphylococcus aureus
RNRIELIEPLDALEFHNFTN

SEQ ID NO: 1693315 - protein, 17 aa, Staphylococcus aureus
RNTIFYNTLFDENAACH

SEQ ID NO: 1693316 - protein, 17 aa, Staphylococcus aureus
RPQIISGTHAITIALQS

SEQ ID NO: 1693317 - protein, 20 aa, Staphylococcus aureus
RPVHLHLPIDVAISEIEIPR

SEQ ID NO: 1693318 - protein, 26 aa, Staphylococcus aureus
RQGLNKPNLLYLLKPAITKNDIYEID

SEQ ID NO: 1693319 - protein, 21 aa, Staphylococcus aureus
RQGQLFLLDVFEGNIFKVNPE

SEQ ID NO: 1693320 - protein, 17 aa, Staphylococcus aureus
RQLKQETVLNLFYKLHP

SEQ ID NO: 1693321 - protein, 17 aa, Staphylococcus aureus
RQLMYTPDILLLDESTS

SEQ ID NO: 1693322 - protein, 26 aa, Staphylococcus aureus
RQNPSPYMYYLNIDKPYIVGSSPESF

SEQ ID NO: 1693323 - protein, 17 aa, Staphylococcus aureus
RQNQDMLRYALSNPFLS

SEQ ID NO: 1693324 - protein, 17 aa, Staphylococcus aureus
RQRYWGEPIPVIHWEDG

SEQ ID NO: 1693325 - protein, 21 aa, Staphylococcus aureus
RQTQQQIIYNAPKQLAGLNGE

SEQ ID NO: 1693326 - protein, 25 aa, Staphylococcus aureus
RQVFNQIRGLSPWPVAYTTMDDINL

SEQ ID NO: 1693327 - protein, 36 aa, Staphylococcus aureus; identical to SEQ ID NO: 1592633

SEQ ID NO: 1693328 - protein, 25 aa, Staphylococcus aureus
RRGLNKPNILYLMKPIVTERDIYKI

SEQ ID NO: 1693329 - protein, 22 aa, Staphylococcus aureus
RRKYKTIPYNYKNKTIVANGGN

SEQ ID NO: 1693330 - protein, 26 aa, Staphylococcus aureus
RRQHAYDFPMWFIRPNFKSEITPRSV

SEQ ID NO: 1693331 - protein, 26 aa, Staphylococcus aureus
RSAYHILDMVFWFGNLQILAAHQYPT

SEQ ID NO: 1693332 - protein, 29 aa, Staphylococcus aureus
RSFKENGQWYKLEKLWEKAIKSGKSIENV

SEQ ID NO: 1693333 - protein, 21 aa, Staphylococcus aureus
RSLALFLMAEVDISILSMVPR

SEQ ID NO: 1693334 - protein, 24 aa, Staphylococcus aureus
RTDHIRHLLEFKACTPIDIDQVEP

SEQ ID NO: 1693335 - protein, 19 aa, Staphylococcus aureus
RTHRIFMIGQRGILEILHS

SEQ ID NO: 1693336 - protein, 26 aa, Staphylococcus aureus
RTLSKLKKYFYRFSLKARKRVKTVSI

SEQ ID NO: 1693337 - protein, 30 aa, Staphylococcus aureus
RVEAPLIQAQLIETILLNIVNFHTLITTKA

SEQ ID NO: 1693338 - protein, 17 aa, Staphylococcus aureus
RVFKGQKMPGRMGGNTV

SEQ ID NO: 1693339 - protein, 20 aa, Staphylococcus aureus
RVIGYQNQLPWHLPNDLKHI

SEQ ID NO: 1693340 - protein, 17 aa, Staphylococcus aureus
RVSYKQDFDSRRYYQQH

SEQ ID NO: 1693341 - protein, 17 aa, Staphylococcus aureus
RVYFNDVQLPLLADQVR

SEQ ID NO: 1693342 - protein, 18 aa, Staphylococcus aureus
RYEHLFDYNPLFGVPNNK

SEQ ID NO: 1693343 - protein, 26 aa, Staphylococcus aureus
RYGMSLTRNTSRFYQYWLDHIDEDLT

SEQ ID NO: 1693344 - protein, 28 aa, Staphylococcus aureus
RYLNHNSRLFKLYKGYKGNITRIVSDKD

SEQ ID NO: 1693345 - protein, 28 aa, Staphylococcus aureus
RYTEFILEDLNSKLYHYWALGHIHERQQ

SEQ ID NO: 1693346 - protein, 17 aa, Staphylococcus aureus
RYVVDILQQLLQTKKLD

SEQ ID NO: 1693347 - protein, 19 aa, Staphylococcus aureus
SAGDIIRLLEGPITFVESI

SEQ ID NO: 1693348 - protein, 24 aa, Staphylococcus aureus
SAKERTRLRTLFPYINEASENHKK

SEQ ID NO: 1693349 - protein, 24 aa, Staphylococcus aureus
SANPKYDKYFNDPNFKDFRHSFSQ

SEQ ID NO: 1693350 - protein, 19 aa, Staphylococcus aureus
SAYFIYQLAQQQNIGTTLN

SEQ ID NO: 1693351 - protein, 23 aa, Staphylococcus aureus
SDDNLAERLAFISNSTGGILGPQ

SEQ ID NO: 1693352 - protein, 22 aa, Staphylococcus aureus
SDEQLNVSGFLTWAVGHLVELK

SEQ ID NO: 1693353 - protein, 23 aa, Staphylococcus aureus
SDHAYLPIYAIQNRLCDCGIAGE

SEQ ID NO: 1693354 - protein, 34 aa, Staphylococcus aureus
SDIPDNLIFYIYDSLIEGFMHWIKDEKIDWPGEE

SEQ ID NO: 1693355 - protein, 26 aa, Staphylococcus aureus
SDKDWLTNIIKGYTKYTYFGNEIVVH

SEQ ID NO: 1693356 - protein, 22 aa, Staphylococcus aureus
SDNKFSVITVVNWAIYQSMEEN

SEQ ID NO: 1693357 - protein, 24 aa, Staphylococcus aureus
SDRFPGFQLDYFKKTNYLDTDWKD

SEQ ID NO: 1693358 - protein, 23 aa, Staphylococcus aureus
SDSKYAYVLYPGLSKSDFKSKNN

SEQ ID NO: 1693359 - protein, 25 aa, Staphylococcus aureus
SDSSVLLFNITKNNQPLFLSEENIK

SEQ ID NO: 1693360 - protein, 18 aa, Staphylococcus aureus
SEFPRIVTLKDLNKIEVL

SEQ ID NO: 1693361 - protein, 27 aa, Staphylococcus aureus
SEIPKDFILLPIHPYQINVLRQHPQYM

SEQ ID NO: 1693362 - protein, 20 aa, Staphylococcus aureus
SELKNRIPLVLEVKSNQYQS

SEQ ID NO: 1693363 - protein, 22 aa, Staphylococcus aureus
SESLKYLLNVNHQRLSDFKSML

SEQ ID NO: 1693364 - protein, 20 aa, Staphylococcus aureus
SFITIYRPYLKLAEPILEKH

SEQ ID NO: 1693365 - protein, 19 aa, Staphylococcus aureus
SFKSFSMPKWSKLVNKLSV

SEQ ID NO: 1693366 - protein, 22 aa, Staphylococcus aureus
SFSPYKILGAILFEQTMDREVE

SEQ ID NO: 1693367 - protein, 18 aa, Staphylococcus aureus
SGLSYHVLTMLRIAKSIC

SEQ ID NO: 1693368 - protein, 24 aa, Staphylococcus aureus
SGSAAIYTARKGLRTGIVADRMGG

SEQ ID NO: 1693369 - protein, 27 aa, Staphylococcus aureus
SGVDHFKIVPLLIFSAMHYLKDIPDIV

SEQ ID NO: 1693370 - protein, 20 aa, Staphylococcus aureus
SHGAGFRLQNGEKLNFTVVD

SEQ ID NO: 1693371 - protein, 32 aa, Staphylococcus aureus
SHRGPLLDYFDAKLVCYFFKELSKFIYKNRGV

SEQ ID NO: 1693372 - protein, 29 aa, Staphylococcus aureus
SHSKEILKLPIRTWFDKYESEIMAKELES

SEQ ID NO: 1693373 - protein, 21 aa, Staphylococcus aureus
SHTSALARYLAEHFKTHDIEA

SEQ ID NO: 1693374 - protein, 20 aa, Staphylococcus aureus
SIDVEKLLCPFDGPNTKEIQ

SEQ ID NO: 1693375 - protein, 25 aa, Staphylococcus aureus
SIGCDLLVIRHPFNNYYEKLANINI

SEQ ID NO: 1693376 - protein, 22 aa, Staphylococcus aureus
SIIETLQPYLFEKTARKPMILP

SEQ ID NO: 1693377 - protein, 17 aa, Staphylococcus aureus
SILGYRNVPVNKDAIAK

SEQ ID NO: 1693378 - protein, 19 aa, Staphylococcus aureus
SILTSLFLTANNIPNNLSS

SEQ ID NO: 1693379 - protein, 25 aa, Staphylococcus aureus
SIMAELEALYPPSYSSYIDFLYTCR

SEQ ID NO: 1693380 - protein, 17 aa, Staphylococcus aureus
SIPLQYLVAAALEVTDV

SEQ ID NO: 1693381 - protein, 23 aa, Staphylococcus aureus
SITGYLLRRYVDPNLVYGLVSAW

SEQ ID NO: 1693382 - protein, 26 aa, Staphylococcus aureus
SKDIYDWLKPLLKRKYPNISFKYTYI

SEQ ID NO: 1693383 - protein, 23 aa, Staphylococcus aureus
SKEKFKQLFRILEDTFARPLSPY

SEQ ID NO: 1693384 - protein, 40 aa, Staphylococcus aureus
SKFDGILLVATNPVDILAYATWKFSGLPKERVIGSGTILD

SEQ ID NO: 1693385 - protein, 26 aa, Staphylococcus aureus
SKFGHQLRFDLTKGFPLLTTKKVSFK

SEQ ID NO: 1693386 - protein, 18 aa, Staphylococcus aureus
SKFLWSYVNGKPRDLQYE

SEQ ID NO: 1693387 - protein, 22 aa, Staphylococcus aureus
SKGNLYYHFKTKENLFLEILNI

SEQ ID NO: 1693388 - protein, 23 aa, Staphylococcus aureus
SKTRRHLIEFWMIEGEMAFTNHA

SEQ ID NO: 1693389 - protein, 21 aa, Staphylococcus aureus
SKVFTLPQDFTIIALTATATV

SEQ ID NO: 1693390 - protein, 20 aa, Staphylococcus aureus
SKVPWISIYDENITKESKDG

SEQ ID NO: 1693391 - protein, 29 aa, Staphylococcus aureus
SKVQPCCFKLYNDPFDMAYVMMNGKLFGH

SEQ ID NO: 1693392 - protein, 34 aa, Staphylococcus aureus
SKVQPYCFKLYNDPFDMVYVMMNGKLFGHVYIKD

SEQ ID NO: 1693393 - protein, 17 aa, Staphylococcus aureus
SKWTRQKAFEEYEWLKN

SEQ ID NO: 1693394 - protein, 22 aa, Staphylococcus aureus
SKYDEVTIYCKKAHVIFGGAKL

SEQ ID NO: 1693395 - protein, 24 aa, Staphylococcus aureus
SLEAPLDESLYPIIRDICQEVKVH

SEQ ID NO: 1693396 - protein, 26 aa, Staphylococcus aureus
SLGAFLAQYNLIKHNLANGTTYAAPN

SEQ ID NO: 1693397 - protein, 19 aa, Staphylococcus aureus
SLKEIRYTRDLFNKHLSMN

SEQ ID NO: 1693398 - protein, 23 aa, Staphylococcus aureus
SLKKAMELLIKKSVTASISLDFV

SEQ ID NO: 1693399 - protein, 18 aa, Staphylococcus aureus
SLNFKMRGNIFFEEGIEH

SEQ ID NO: 1693400 - protein, 21 aa, Staphylococcus aureus
SLPIYNLYFIKRNIEKLINAD

SEQ ID NO: 1693401 - protein, 33 aa, Staphylococcus aureus
SLQPSLDIKRMPFIGLQWIFTRTGAAASNHFEG

SEQ ID NO: 1693402 - protein, 25 aa, Staphylococcus aureus
SLTERMEEEMFLGLRLNEGVSSSRF

SEQ ID NO: 1693403 - protein, 32 aa, Staphylococcus aureus
SMIYVDTGAMYRALTYKYLKLNKTEDFAKLVD

SEQ ID NO: 1693404 - protein, 21 aa, Staphylococcus aureus
SMSIWTLLKIPDIEPYFHKVV

SEQ ID NO: 1693405 - protein, 19 aa, Staphylococcus aureus
SMVMIGSLFAAHEESPGET

SEQ ID NO: 1693406 - protein, 18 aa, Staphylococcus aureus
SMYPIKNLEDLYDKEGYR

SEQ ID NO: 1693407 - protein, 34 aa, Staphylococcus aureus
SNDALLYFNKLLQYDGYYLVYKDDKFILMERDKD

SEQ ID NO: 1693408 - protein, 27 aa, Staphylococcus aureus
SNKHYISIFINGRYIKNFMLNKAILEG

SEQ ID NO: 1693409 - protein, 20 aa, Staphylococcus aureus
SNMKLPNFILPYRFWENEDN

SEQ ID NO: 1693410 - protein, 17 aa, Staphylococcus aureus
SNQTHIEIIYLKSCDLT

SEQ ID NO: 1693411 - protein, 24 aa, Staphylococcus aureus
SNSDNLNYILNKLSLHNDDFVEKI

SEQ ID NO: 1693412 - protein, 25 aa, Staphylococcus aureus
SNSSVLLFNITKNNQPLLLSEENIK

SEQ ID NO: 1693413 - protein, 18 aa, Staphylococcus aureus
SPELLRYRYKHKMRGDEL

SEQ ID NO: 1693414 - protein, 18 aa, Staphylococcus aureus
SPETYLELLQKYQINVLC

SEQ ID NO: 1693415 - protein, 18 aa, Staphylococcus aureus
SPFCNYLIAHSGSSQPLV

SEQ ID NO: 1693416 - protein, 17 aa, Staphylococcus aureus
SPGFSYLTGLNKKLYIN

SEQ ID NO: 1693417 - protein, 19 aa, Staphylococcus aureus
SPILKLHIDGDIKGSSVGY

SEQ ID NO: 1693418 - protein, 31 aa, Staphylococcus aureus
SPKSNVIRVLFNEGFIALRPSGTEPKIKLYV

SEQ ID NO: 1693419 - protein, 22 aa, Staphylococcus aureus
SQDTFIIDNLYPFVKHLKGKGD

SEQ ID NO: 1693420 - protein, 27 aa, Staphylococcus aureus
SQFPARIKCATLAWKALEKGTVAKEGT

SEQ ID NO: 1693421 - protein, 18 aa, Staphylococcus aureus
SQLDDRFFRCHNSFVVNR

SEQ ID NO: 1693422 - protein, 24 aa, Staphylococcus aureus
SQNKVQPCYLLTKKGCDIVANKMT

SEQ ID NO: 1693423 - protein, 20 aa, Staphylococcus aureus
SQNTPIVYYTNNSKVTLFER

SEQ ID NO: 1693424 - protein, 17 aa, Staphylococcus aureus
SQVAREIIIGLPNEFDP

SEQ ID NO: 1693425 - protein, 19 aa, Staphylococcus aureus
SRDSLREWLPWVDATEQPS

SEQ ID NO: 1693426 - protein, 19 aa, Staphylococcus aureus
SRFFTGIEIHPGAKIGKRL

SEQ ID NO: 1693427 - protein, 19 aa, Staphylococcus aureus
SRFKTGMTLQKNPLTLLVS

SEQ ID NO: 1693428 - protein, 24 aa, Staphylococcus aureus
SRKTIVYKGWLRSDQIKKVYTDLS

SEQ ID NO: 1693429 - protein, 17 aa, Staphylococcus aureus
SRLFAFYCKLDDPKEVD

SEQ ID NO: 1693430 - protein, 24 aa, Staphylococcus aureus
SRTSGIFFMIKDDEQYIFGDCAIN

SEQ ID NO: 1693431 - protein, 17 aa, Staphylococcus aureus
SRTTIYRYLNKLNNQEN

SEQ ID NO: 1693432 - protein, 17 aa, Staphylococcus aureus
SRYNIPTEKAPILKMHI

SEQ ID NO: 1693433 - protein, 32 aa, Staphylococcus aureus
SSAWSNAKSVFNGFRKWLSKTYDWIRDIGKDM

SEQ ID NO: 1693434 - protein, 26 aa, Staphylococcus aureus
SSDWLSTNFGVRFRYNALGDLNTSNI

SEQ ID NO: 1693435 - protein, 25 aa, Staphylococcus aureus
SSEPLSHLRVIVRSLLGIAVPTQIA

SEQ ID NO: 1693436 - protein, 25 aa, Staphylococcus aureus
SSERYAFTLLYQNLKRKIIYASHAQ

SEQ ID NO: 1693437 - protein, 27 aa, Staphylococcus aureus
SSFVYKRRLPFHAKRFNDWLETMPNNV

SEQ ID NO: 1693438 - protein, 23 aa, Staphylococcus aureus
SSGAAIYAAIQKAEELGKGKTVV

SEQ ID NO: 1693439 - protein, 22 aa, Staphylococcus aureus
SSIRKAFKNILPKEKTYGFYKE

SEQ ID NO: 1693440 - protein, 23 aa, Staphylococcus aureus
SSNEKGWIAGWHTNLDIVADNTK

SEQ ID NO: 1693441 - protein, 21 aa, Staphylococcus aureus
STFRILIKNLIYNKIKQQPYN

SEQ ID NO: 1693442 - protein, 25 aa, Staphylococcus aureus
STGSWGKIPFIPFKNNDLEMSDIFM

SEQ ID NO: 1693443 - protein, 27 aa, Staphylococcus aureus
STKHQFVMIARFAYPKLPQNLIAAIEI

SEQ ID NO: 1693444 - protein, 24 aa, Staphylococcus aureus
STLCHLLLRFYDVNDGFIRIGGID

SEQ ID NO: 1693445 - protein, 21 aa, Staphylococcus aureus
STLLKALSRLLAVKEGEVFLD

SEQ ID NO: 1693446 - protein, 20 aa, Staphylococcus aureus
STNKPDAKLFILLVGERPEE

SEQ ID NO: 1693447 - protein, 22 aa, Staphylococcus aureus
STTKMLFIETPSNPLLRVTDIK

SEQ ID NO: 1693448 - protein, 20 aa, Staphylococcus aureus
STWDLIFGGYHNWVAKIQYK

SEQ ID NO: 1693449 - protein, 17 aa, Staphylococcus aureus
SVIDDLISKNQSVAEAI

SEQ ID NO: 1693450 - protein, 28 aa, Staphylococcus aureus
SVKPDTLKFMLKVFLDLNFVTQEDGLIR

SEQ ID NO: 1693451 - protein, 26 aa, Staphylococcus aureus
SVLDACLTPILAPFTTITHMIGVVDA

SEQ ID NO: 1693452 - protein, 26 aa, Staphylococcus aureus
SYIFESTFFADVLDDVNFAKKQNLQK

SEQ ID NO: 1693453 - protein, 19 aa, Staphylococcus aureus
SYIKPFPKSVTDDYMKHVQ

SEQ ID NO: 1693454 - protein, 21 aa, Staphylococcus aureus
SYRTYFCLDNMLHGRITSNNF

SEQ ID NO: 1693455 - protein, 19 aa, Staphylococcus aureus
TADVFIDRNLPFLIHHIAH

SEQ ID NO: 1693456 - protein, 17 aa, Staphylococcus aureus
TAKGYYFVKKFYEKDKL

SEQ ID NO: 1693457 - protein, 18 aa, Staphylococcus aureus
TDAIKWVLGEQSAKSLRG

SEQ ID NO: 1693458 - protein, 25 aa, Staphylococcus aureus
TDGNDNIKVILPKVQVKPAARQSVG

SEQ ID NO: 1693459 - protein, 23 aa, Staphylococcus aureus
TDIMNYLFEIIDPYSVNRQGNDI

SEQ ID NO: 1693460 - protein, 17 aa, Staphylococcus aureus
TDIVAPGGSFAYLNQFG

SEQ ID NO: 1693461 - protein, 24 aa, Staphylococcus aureus
TDKKRPLLFDLNLASHITYGNFDD

SEQ ID NO: 1693462 - protein, 25 aa, Staphylococcus aureus
TDLTQILISLFPCGSITGAPKLNTM

SEQ ID NO: 1693463 - protein, 17 aa, Staphylococcus aureus
TDMIKFKYPRLFENVRL

SEQ ID NO: 1693464 - protein, 31 aa, Staphylococcus aureus
TDPEYYKWTQWIFIQLYNKGLAYVDEVAVNW

SEQ ID NO: 1693465 - protein, 19 aa, Staphylococcus aureus
TDPKKFRHFQTVTFEDLSK

SEQ ID NO: 1693466 - protein, 22 aa, Staphylococcus aureus
TDVFKPSTYPPLSYTFDRIIIK

SEQ ID NO: 1693467 - protein, 25 aa, Staphylococcus aureus
TEARIFKFYKYFYSHRGPLLDYFDA

SEQ ID NO: 1693468 - protein, 26 aa, Staphylococcus aureus
TEAVRKIMFALNRFMGNKYSNIDLGL

SEQ ID NO: 1693469 - protein, 17 aa, Staphylococcus aureus
TEFAVLLFSTVGVSNGD

SEQ ID NO: 1693470 - protein, 17 aa, Staphylococcus aureus
TEGKYFKYFVYKDDSKH

SEQ ID NO: 1693471 - protein, 19 aa, Staphylococcus aureus
TEHHFVINSLALPFSVLYN

SEQ ID NO: 1693472 - protein, 18 aa, Staphylococcus aureus
TEIPFAFFKQHVTDFDIP

SEQ ID NO: 1693473 - protein, 29 aa, Staphylococcus aureus
TEQIVHKYIMKLAPYLQKHQYNHSLFGGL

SEQ ID NO: 1693474 - protein, 28 aa, Staphylococcus aureus
TEQVMGQLDFLIAKARYSRSIKGTKPIF

SEQ ID NO: 1693475 - protein, 21 aa, Staphylococcus aureus
TERMIRLVNDLLQLSKMDNES

SEQ ID NO: 1693476 - protein, 31 aa, Staphylococcus aureus
TETFETNVYPLFWTVQKALEYLKPGASITTT

SEQ ID NO: 1693477 - protein, 17 aa, Staphylococcus aureus
TETGIFVTIIRSFSHFS

SEQ ID NO: 1693478 - protein, 18 aa, Staphylococcus aureus
TEVIMHLIRRSKAPTFEE

SEQ ID NO: 1693479 - protein, 24 aa, Staphylococcus aureus
TEVKQWQTYIADYLYQCDIINDPT

SEQ ID NO: 1693480 - protein, 20 aa, Staphylococcus aureus
TEVLLPEQINRKLLGVLNMN

SEQ ID NO: 1693481 - protein, 20 aa, Staphylococcus aureus
TFDFINGHGGFLNEDFRLFS

SEQ ID NO: 1693482 - protein, 20 aa, Staphylococcus aureus
TFFEYFLRIVNKTHDYAILE

SEQ ID NO: 1693483 - protein, 30 aa, Staphylococcus aureus
TFINQRYIQSLEKIGFIDLLKSKKSYERIA

SEQ ID NO: 1693484 - protein, 34 aa, Staphylococcus aureus
TFNDFYMCYKYDTRLKYILFKYIMLIEQSLKTNL

SEQ ID NO: 1693485 - protein, 17 aa, Staphylococcus aureus
TFNPWSERHWLKPTFFD

SEQ ID NO: 1693486 - protein, 24 aa, Staphylococcus aureus
TFQECARLLKKWRLPANRNTIRLH

SEQ ID NO: 1693487 - protein, 43 aa, Staphylococcus aureus
TFVEDDPLYYAIFRTLAFTGFRRGELMALTWNDIDFTKQTISI

SEQ ID NO: 1693488 - protein, 21 aa, Staphylococcus aureus
TGAYILSRRQLETEKSYSYLQ

SEQ ID NO: 1693489 - protein, 31 aa, Staphylococcus aureus
TGDPVLVEFKNKPLYRATFKCTVIQSTNGMP

SEQ ID NO: 1693490 - protein, 28 aa, Staphylococcus aureus
TGFLSFQRIPIYIIWINPKSHKTPRYYF

SEQ ID NO: 1693491 - protein, 17 aa, Staphylococcus aureus
TGIFVTIIRSFSHFSNQ

SEQ ID NO: 1693492 - protein, 32 aa, Staphylococcus aureus
TGNESTIQPILKEKFIALGLDVKEDQAAKHPK

SEQ ID NO: 1693493 - protein, 23 aa, Staphylococcus aureus
TGQYLSPVEFRKALEDDDTVIID

SEQ ID NO: 1693494 - protein, 25 aa, Staphylococcus aureus
TGTDSNFQILLYDAKHFNPYLALDN

SEQ ID NO: 1693495 - protein, 19 aa, Staphylococcus aureus
THKQSMIKIVLLCGSGIGT

SEQ ID NO: 1693496 - protein, 19 aa, Staphylococcus aureus
THQLKQLDIVYYFGNVTVG

SEQ ID NO: 1693497 - protein, 33 aa, Staphylococcus aureus
THTLDIIKRHRLLELFLIEILKYNWEEVHQEAE

SEQ ID NO: 1693498 - protein, 29 aa, Staphylococcus aureus
TIDMYEPYVRLFRDLFPNAAIIFDRFHIV

SEQ ID NO: 1693499 - protein, 24 aa, Staphylococcus aureus
TIDNKDIIELIIFDSFISNTDRNK

SEQ ID NO: 1693500 - protein, 19 aa, Staphylococcus aureus
TIGYWLARLLKLDRQDQKA

SEQ ID NO: 1693501 - protein, 26 aa, Staphylococcus aureus
TIIKPSFFMDNFLRIAKVEDERITLP

SEQ ID NO: 1693502 - protein, 48 aa, Staphylococcus aureus
TIKRKYTLDFYLKPFVKTKIKAWVRQLLWMSIYQYVYLDKVPNHAIIN

SEQ ID NO: 1693503 - protein, 30 aa, Staphylococcus aureus
TINDGIINDLFIPLKPLRQLEIISGEYNDV

SEQ ID NO: 1693504 - protein, 24 aa, Staphylococcus aureus
TIQRGGTFLYSARCPEFKEQEVRR

SEQ ID NO: 1693505 - protein, 17 aa, Staphylococcus aureus
TIRVVIFEIKAQRYVLR

SEQ ID NO: 1693506 - protein, 25 aa, Staphylococcus aureus
TIVSPLPEKSSFTAKFQVLPKAVNP

SEQ ID NO: 1693507 - protein, 25 aa, Staphylococcus aureus
TIVSPLPEKSSFTAKFQVLPKTVNP

SEQ ID NO: 1693508 - protein, 20 aa, Staphylococcus aureus
TIVVWRLDRLGRNMEDLIIL

SEQ ID NO: 1693509 - protein, 17 aa, Staphylococcus aureus
TIYNHLHLKHIFESMPF

SEQ ID NO: 1693510 - protein, 24 aa, Staphylococcus aureus
TKDTTFIRDIPKKTIFTEFDPDKM

SEQ ID NO: 1693511 - protein, 25 aa, Staphylococcus aureus
TKEGKIRLRLLNGSNARDLNLKLSN

SEQ ID NO: 1693512 - protein, 21 aa, Staphylococcus aureus
TKIKEFWNGDIPWIQSSDVKV

SEQ ID NO: 1693513 - protein, 20 aa, Staphylococcus aureus
TKQNLQHTLLPLADVVTPNL

SEQ ID NO: 1693514 - protein, 18 aa, Staphylococcus aureus
TKSSFYYDLFDFKVKKRV

SEQ ID NO: 1693515 - protein, 24 aa, Staphylococcus aureus
TKTFHLYDELSKVAGYYIKSGVNA

SEQ ID NO: 1693516 - protein, 31 aa, Staphylococcus aureus
TKTQYTDLLFLYLEHAFLSQDFFDIPSIHSD

SEQ ID NO: 1693517 - protein, 27 aa, Staphylococcus aureus
TKVEVKAKGMFILKKKDDNTYECSFYN

SEQ ID NO: 1693518 - protein, 22 aa, Staphylococcus aureus
TKYKNLIKEISPVDLTDLMKST

SEQ ID NO: 1693519 - protein, 22 aa, Staphylococcus aureus
TKYNHYLFNAELFKHFKKGAVF

SEQ ID NO: 1693520 - protein, 25 aa, Staphylococcus aureus
TKYTVIVNDPLMRPIEACYARADKQ

SEQ ID NO: 1693521 - protein, 24 aa, Staphylococcus aureus
TLAQEVYQEWYLGSKLYEEVEKKT

SEQ ID NO: 1693522 - protein, 18 aa, Staphylococcus aureus
TLASLVLGLFKPAKGEIY

SEQ ID NO: 1693523 - protein, 19 aa, Staphylococcus aureus
TLASLVLGLFKPAKGEIYL

SEQ ID NO: 1693524 - protein, 28 aa, Staphylococcus aureus
TLIEGYPVTYFSLFATTMPIKLNHIIKF

SEQ ID NO: 1693525 - protein, 17 aa, Staphylococcus aureus
TLNQAMHGLRESIQDNA

SEQ ID NO: 1693526 - protein, 17 aa, Staphylococcus aureus
TLNQAMHGLRQSIQDNA

SEQ ID NO: 1693527 - protein, 29 aa, Staphylococcus aureus
TLNQSKIGGMPFLKSFKDIPLDENNVPMV

SEQ ID NO: 1693528 - protein, 33 aa, Staphylococcus aureus
TLTAKKSYFILNDKIVFLGTGIKSTDSSKNPVT

SEQ ID NO: 1693529 - protein, 20 aa, Staphylococcus aureus
TLVSLLEDLNIKATLNGSEL

SEQ ID NO: 1693530 - protein, 25 aa, Staphylococcus aureus
TMRLKECGLILGKDLLDHIIIGDNR

SEQ ID NO: 1693531 - protein, 20 aa, Staphylococcus aureus
TMTLIREMRLMWKEMMVILQ

SEQ ID NO: 1693532 - protein, 25 aa, Staphylococcus aureus
TNGVSYLAVTQWWVASLNPPHLKAM

SEQ ID NO: 1693533 - protein, 17 aa, Staphylococcus aureus
TNMPPYREFAWVQDKFG

SEQ ID NO: 1693534 - protein, 25 aa, Staphylococcus aureus
TPKVSGVLALIIDKYHLEKHPDKAI

SEQ ID NO: 1693535 - protein, 24 aa, Staphylococcus aureus
TPMGGYFIVGYINDDKKYKFQASI

SEQ ID NO: 1693536 - protein, 23 aa, Staphylococcus aureus
TPSKGMFQMIEPSFRAFAKPGHG

SEQ ID NO: 1693537 - protein, 25 aa, Staphylococcus aureus
TPSKKENIYWIKGEYVWVTPTDINN

SEQ ID NO: 1693538 - protein, 24 aa, Staphylococcus aureus
TQEEWVNLWQKALQVDYRPVVNIK

SEQ ID NO: 1693539 - protein, 23 aa, Staphylococcus aureus
TQFNPNAIYINCPLFNEMPEILE

SEQ ID NO: 1693540 - protein, 36 aa, Staphylococcus aureus
TQKSTLNIGIKYAEEPINFILKSSTKLKADIDFDDS

SEQ ID NO: 1693541 - protein, 22 aa, Staphylococcus aureus
TQMADIKFLSIERIVIELTKLM

SEQ ID NO: 1693542 - protein, 22 aa, Staphylococcus aureus
TQNLIIPIYGKAESLNVAIAGS

SEQ ID NO: 1693543 - protein, 19 aa, Staphylococcus aureus
TQVFLQTGFELYIGKHLTK

SEQ ID NO: 1693544 - protein, 17 aa, Staphylococcus aureus
TRIGASAGVQIMQGLEA

SEQ ID NO: 1693545 - protein, 28 aa, Staphylococcus aureus
TRIMDLVTPIGLGQRGLIVAPPKAGKTS

SEQ ID NO: 1693546 - protein, 28 aa, Staphylococcus aureus
TRKMMGEYIIYYDGVVIGGLYDNRLLVK

SEQ ID NO: 1693547 - protein, 23 aa, Staphylococcus aureus
TRYDKWFERMTEYGFENGIDFIS

SEQ ID NO: 1693548 - protein, 21 aa, Staphylococcus aureus
TRYNDWFERMINYGFEENIDY

SEQ ID NO: 1693549 - protein, 24 aa, Staphylococcus aureus
TSARLHPWLLKIYEKRGYEIYSEH

SEQ ID NO: 1693550 - protein, 24 aa, Staphylococcus aureus
TSDYSLGYLSGWGHNISDDELKAH

SEQ ID NO: 1693551 - protein, 24 aa, Staphylococcus aureus
TSLFNDKIPYIKEPKLTKQNIEQA

SEQ ID NO: 1693552 - protein, 21 aa, Staphylococcus aureus
TSPDKAIIGGAKFIRNEYFEN

SEQ ID NO: 1693553 - protein, 29 aa, Staphylococcus aureus
TSVFVPKITTPTYLYHDFDFATEVIDTLV

SEQ ID NO: 1693554 - protein, 26 aa, Staphylococcus aureus
TSYTQGQLLYQNDFQFLKDVLQSVDA

SEQ ID NO: 1693555 - protein, 25 aa, Staphylococcus aureus
TTNEATIAAITPDANVKHQAKQAIA

SEQ ID NO: 1693556 - protein, 27 aa, Staphylococcus aureus
TTNENIKALYFYQKNKYRITDVIFNAV

SEQ ID NO: 1693557 - protein, 24 aa, Staphylococcus aureus
TTNLTHIEIIYLKSCDLTTILHNL

SEQ ID NO: 1693558 - protein, 25 aa, Staphylococcus aureus
TTSRAYTLALPFGLAVQYYSIDQLI

SEQ ID NO: 1693559 - protein, 19 aa, Staphylococcus aureus
TVATLFPNRVDLGLGRAPG

SEQ ID NO: 1693560 - protein, 19 aa, Staphylococcus aureus
TVGMMLFNEQRQFLQPLIY

SEQ ID NO: 1693561 - protein, 29 aa, Staphylococcus aureus
TVILGCTHYPLLYKPIYDYFDGKKTVISS

SEQ ID NO: 1693562 - protein, 17 aa, Staphylococcus aureus
TVKGRYVVLKKKNSLFK

SEQ ID NO: 1693563 - protein, 47 aa, Staphylococcus aureus
TVKRKYTLDFYLKPFVKTKIKAWVRQLLWMSIYQYVYLDKVPNHAII

SEQ ID NO: 1693564 - protein, 22 aa, Staphylococcus aureus
TVMKLCEYFNITPNEFFGIIEK

SEQ ID NO: 1693565 - protein, 21 aa, Staphylococcus aureus
TVVGLGPRILRAETAPLYALS

SEQ ID NO: 1693566 - protein, 24 aa, Staphylococcus aureus
TVVSNFYDYLYRSKKLDVNFYDFM

SEQ ID NO: 1693567 - protein, 18 aa, Staphylococcus aureus
TVVSVYRKVIDAYAADPD

SEQ ID NO: 1693568 - protein, 20 aa, Staphylococcus aureus
TVWSTRYLNLGVNNKFIISS

SEQ ID NO: 1693569 - protein, 17 aa, Staphylococcus aureus
TVYALDHSLNLKNGFYL

SEQ ID NO: 1693570 - protein, 22 aa, Staphylococcus aureus
TYDWTILKHIKDVPYLIAGGIN

SEQ ID NO: 1693571 - protein, 17 aa, Staphylococcus aureus
TYKIPKKVIKHAGYVRC

SEQ ID NO: 1693572 - protein, 21 aa, Staphylococcus aureus
TYNTLLLEPSVINTLDKIKQA

SEQ ID NO: 1693573 - protein, 22 aa, Staphylococcus aureus
TYYFHGHIVPGWQGVKKTFDTA

SEQ ID NO: 1693574 - protein, 23 aa, Staphylococcus aureus
TYYFHGHIVPGWQGVKKTFDTAE

SEQ ID NO: 1693575 - protein, 20 aa, Staphylococcus aureus
VAFFFKALTSYLKKQNCLYV

SEQ ID NO: 1693576 - protein, 20 aa, Staphylococcus aureus
VAKHLISPELIKQPAAAVLV

SEQ ID NO: 1693577 - protein, 32 aa, Staphylococcus aureus
VAKRAQSFGMKILAFDPYLTYEKAKSLSITKA

SEQ ID NO: 1693578 - protein, 20 aa, Staphylococcus aureus
VAMRFGDGIKAIFNYPSQET

SEQ ID NO: 1693579 - protein, 25 aa, Staphylococcus aureus
VAQKLAEAKALDQAMQALRNSIQDQ

SEQ ID NO: 1693580 - protein, 25 aa, Staphylococcus aureus
VDAGTYWYNDPYTLDFMRKDLKEKL

SEQ ID NO: 1693581 - protein, 25 aa, Staphylococcus aureus
VDEGLRTLLDFRYQRHFKASKGENG

SEQ ID NO: 1693582 - protein, 17 aa, Staphylococcus aureus
VDQTTLDLTYKADKGQC

SEQ ID NO: 1693583 - protein, 18 aa, Staphylococcus aureus
VDRFRVAYGHYIEDFPRQ

SEQ ID NO: 1693584 - protein, 25 aa, Staphylococcus aureus
VDSVKNEFDLLWQNSTLLTQQWINS

SEQ ID NO: 1693585 - protein, 25 aa, Staphylococcus aureus
VDSVKNEFDLLWQNSTQLTQQWINS

SEQ ID NO: 1693586 - protein, 19 aa, Staphylococcus aureus
VDTLFYCTPKKETDILFIL

SEQ ID NO: 1693587 - protein, 18 aa, Staphylococcus aureus
VDVAFQYNDQYSESILSF

SEQ ID NO: 1693588 - protein, 17 aa, Staphylococcus aureus
VDYKIGGLEPSQLIVIA

SEQ ID NO: 1693589 - protein, 18 aa, Staphylococcus aureus
VDYLTTLDFVDNDRIGAL

SEQ ID NO: 1693590 - protein, 26 aa, Staphylococcus aureus
VEAYKQNMFALLGKPGFEDMKKDLEA

SEQ ID NO: 1693591 - protein, 18 aa, Staphylococcus aureus
VEDDFVFHPVLFDVVESE

SEQ ID NO: 1693592 - protein, 20 aa, Staphylococcus aureus
VEDLRIISCHIGNGASIAAI

SEQ ID NO: 1693593 - protein, 26 aa, Staphylococcus aureus
VEEYVDIVEIGTPIVINEGLPAVQHL

SEQ ID NO: 1693594 - protein, 17 aa, Staphylococcus aureus
VEKAQINRLKLFKQHGI

SEQ ID NO: 1693595 - protein, 24 aa, Staphylococcus aureus
VEKSLFSMIPSETKLQYIVEFQEL

SEQ ID NO: 1693596 - protein, 19 aa, Staphylococcus aureus
VELKIWERWLHTQGYKDIH

SEQ ID NO: 1693597 - protein, 18 aa, Staphylococcus aureus
VENALSQVTNAKGALNGN

SEQ ID NO: 1693598 - protein, 28 aa, Staphylococcus aureus
VERQTQQQIIYKAPKPLAGLNGESHDFT

SEQ ID NO: 1693599 - protein, 29 aa, Staphylococcus aureus
VEYHPYLTQHKLKLYLAAQHIVMESWSPL

SEQ ID NO: 1693600 - protein, 29 aa, Staphylococcus aureus
VFDDLWMDLYDLFEELRNLFKEEGLEPWT

SEQ ID NO: 1693601 - protein, 24 aa, Staphylococcus aureus
VFDELHLAILKYLNTVSIENISHS

SEQ ID NO: 1693602 - protein, 17 aa, Staphylococcus aureus
VFDKWLSTDLAKSLNCH

SEQ ID NO: 1693603 - protein, 21 aa, Staphylococcus aureus
VFEDLYREKLKDTNKLREYNY

SEQ ID NO: 1693604 - protein, 22 aa, Staphylococcus aureus
VFNASLPLYKDAIHQKGSMRSN

SEQ ID NO: 1693605 - protein, 17 aa, Staphylococcus aureus
VFNDGKLIIISYKLFKD

SEQ ID NO: 1693606 - protein, 35 aa, Staphylococcus aureus
VFTDVNGYPLVIKKLQLWIKAILKKTDITNKQIST

SEQ ID NO: 1693607 - protein, 30 aa, Staphylococcus aureus
VGAVVAWNFPMLLAAWKIAPAIAAGNTIVI

SEQ ID NO: 1693608 - protein, 17 aa, Staphylococcus aureus
VGCRIGCTFCASTLGGL

SEQ ID NO: 1693609 - protein, 26 aa, Staphylococcus aureus
VGDNAPALYPNYWGGNKYKVIEELRK

SEQ ID NO: 1693610 - protein, 17 aa, Staphylococcus aureus
VGEAWLMGYDVNSYRVP

SEQ ID NO: 1693611 - protein, 18 aa, Staphylococcus aureus
VGFIGELHPILAADNDLK

SEQ ID NO: 1693612 - protein, 19 aa, Staphylococcus aureus
VGRLPEEYLMLHKKFIKPI

SEQ ID NO: 1693613 - protein, 26 aa, Staphylococcus aureus
VGTASILIGSLMYLGTQQEAEAAENN

SEQ ID NO: 1693614 - protein, 24 aa, Staphylococcus aureus
VGTDLDLQLRRRGIDTLVLGGVAT

SEQ ID NO: 1693615 - protein, 18 aa, Staphylococcus aureus
VHGLKYWYNYTSDDLINF

SEQ ID NO: 1693616 - protein, 25 aa, Staphylococcus aureus
VHSHYKHLFALLELAKKQGVEKVYV

SEQ ID NO: 1693617 - protein, 19 aa, Staphylococcus aureus
VIEGFGLTALPNAIQLSKA

SEQ ID NO: 1693618 - protein, 18 aa, Staphylococcus aureus
VIELCKANHYTYGYRKIT

SEQ ID NO: 1693619 - protein, 17 aa, Staphylococcus aureus
VIFPDYHVIGISELILD

SEQ ID NO: 1693620 - protein, 21 aa, Staphylococcus aureus
VIIETVLLDHDEIVKASELTK

SEQ ID NO: 1693621 - protein, 20 aa, Staphylococcus aureus
VIIGLEDWKSIQETMYLVST

SEQ ID NO: 1693622 - protein, 18 aa, Staphylococcus aureus
VIKLIPGLENVDIVRYGV

SEQ ID NO: 1693623 - protein, 17 aa, Staphylococcus aureus
VILSIRYIQTELHLSEV

SEQ ID NO: 1693624 - protein, 18 aa, Staphylococcus aureus
VINPFGTFIAKGVIYPHP

SEQ ID NO: 1693625 - protein, 17 aa, Staphylococcus aureus
VIQLLMHMIHYVPRTYH

SEQ ID NO: 1693626 - protein, 21 aa, Staphylococcus aureus
VIQLLMHMIHYVPRTYHSNQS

SEQ ID NO: 1693627 - protein, 22 aa, Staphylococcus aureus
VITGIIKNNIPSRIAFAVSSQT

SEQ ID NO: 1693628 - protein, 19 aa, Staphylococcus aureus
VKCTKAQFIKRLACLPSHI

SEQ ID NO: 1693629 - protein, 23 aa, Staphylococcus aureus
VKDVLLIMAKFQEELVQPIADHQ

SEQ ID NO: 1693630 - protein, 21 aa, Staphylococcus aureus
VKFDINYSLKPLKLSNRQAKD

SEQ ID NO: 1693631 - protein, 25 aa, Staphylococcus aureus
VKMEDDKFYTFELTKKLQPHRMGDT

SEQ ID NO: 1693632 - protein, 19 aa, Staphylococcus aureus
VKRDAVIKVGQLYENIREC

SEQ ID NO: 1693633 - protein, 25 aa, Staphylococcus aureus
VKRELGFVLMALNIRKIVARRAVYY

SEQ ID NO: 1693634 - protein, 20 aa, Staphylococcus aureus
VKRGAVIKLGQLFENIRERG

SEQ ID NO: 1693635 - protein, 21 aa, Staphylococcus aureus
VKTMIFKVDDEYIMVLVRGHH

SEQ ID NO: 1693636 - protein, 24 aa, Staphylococcus aureus
VKTPYKKWFERMSDYGFEENIDYV

SEQ ID NO: 1693637 - protein, 18 aa, Staphylococcus aureus
VKTTFVTVPVDDKAFLNG

SEQ ID NO: 1693638 - protein, 19 aa, Staphylococcus aureus
VLDDAKILDALNGAVRGRQ

SEQ ID NO: 1693639 - protein, 17 aa, Staphylococcus aureus
VLDYRRQITNPYTGEVI

SEQ ID NO: 1693640 - protein, 21 aa, Staphylococcus aureus
VLEHPSVLEVVRYLEAHEGFK

SEQ ID NO: 1693641 - protein, 17 aa, Staphylococcus aureus
VLGLIEGKSQRKAYIDA

SEQ ID NO: 1693642 - protein, 26 aa, Staphylococcus aureus
VLITNKALLPRVPIDKLPNLKKIVVV

SEQ ID NO: 1693643 - protein, 17 aa, Staphylococcus aureus
VLLVNHIQNIEPIIQGG

SEQ ID NO: 1693644 - protein, 17 aa, Staphylococcus aureus
VLSTFEIKPKYDLNIMK

SEQ ID NO: 1693645 - protein, 21 aa, Staphylococcus aureus
VLYFEHKKAYRFLKEEVPEEY

SEQ ID NO: 1693646 - protein, 28 aa, Staphylococcus aureus
VMATITFQNLFKLFESFSGMTATGKLGE

SEQ ID NO: 1693647 - protein, 18 aa, Staphylococcus aureus
VMCAGTIVMSRIPRVVYG

SEQ ID NO: 1693648 - protein, 17 aa, Staphylococcus aureus
VMKKMIANLLIEKSLDV

SEQ ID NO: 1693649 - protein, 29 aa, Staphylococcus aureus
VMSQNLWYFRYFIYYLIKENVISKKEINS

SEQ ID NO: 1693650 - protein, 26 aa, Staphylococcus aureus
VNAAKALAFAYDKPLIPVHHIAGHIY

SEQ ID NO: 1693651 - protein, 19 aa, Staphylococcus aureus
VNDYIVYSFALLWGQFACK

SEQ ID NO: 1693652 - protein, 22 aa, Staphylococcus aureus
VNGGTLAIYMGVKRLGKIITQI

SEQ ID NO: 1693653 - protein, 21 aa, Staphylococcus aureus
VNKLRDGYLLSDKKYKDWTEH

SEQ ID NO: 1693654 - protein, 18 aa, Staphylococcus aureus
VPDHLSGLLFDDIPYLKV

SEQ ID NO: 1693655 - protein, 17 aa, Staphylococcus aureus
VPFIENWIKQYGSEAWT

SEQ ID NO: 1693656 - protein, 19 aa, Staphylococcus aureus
VPNIKLQWLAIDKDKVETT

SEQ ID NO: 1693657 - protein, 18 aa, Staphylococcus aureus
VPTTDCYEVFWGGDNELY

SEQ ID NO: 1693658 - protein, 18 aa, Staphylococcus aureus
VPVIIKEVGFGMSKELMH

SEQ ID NO: 1693659 - protein, 18 aa, Staphylococcus aureus
VPVISYPINYGPKSIIQN

SEQ ID NO: 1693660 - protein, 28 aa, Staphylococcus aureus
VQETYNNYFEPVLNYILEVIHSVETAVR

SEQ ID NO: 1693661 - protein, 17 aa, Staphylococcus aureus
VQGPTTFLPSLTVQVAM

SEQ ID NO: 1693662 - protein, 18 aa, Staphylococcus aureus
VQHAIDQLPNLNQAQRDE

SEQ ID NO: 1693663 - protein, 21 aa, Staphylococcus aureus
VQIWIADYVLSTYGTGAIMAV

SEQ ID NO: 1693664 - protein, 25 aa, Staphylococcus aureus
VQNAESIIAGLNNPTINKGNVSSAT

SEQ ID NO: 1693665 - protein, 25 aa, Staphylococcus aureus
VQNAESIIAGLNNPTINKGNVTSAT

SEQ ID NO: 1693666 - protein, 33 aa, Staphylococcus aureus
VQPCCFKLYNDPFDMVYVMMNSKLFSHVYIKDC

SEQ ID NO: 1693667 - protein, 25 aa, Staphylococcus aureus
VQQLLKSFGFLIYFKNPEDMYEMIQ

SEQ ID NO: 1693668 - protein, 21 aa, Staphylococcus aureus
VQYDDIMFFESSTKSHRLIAH

SEQ ID NO: 1693669 - protein, 18 aa, Staphylococcus aureus
VRLVKFDDYWQGKPALDK

SEQ ID NO: 1693670 - protein, 25 aa, Staphylococcus aureus
VSELANPFMAIYYTDAKSDVNQTPV

SEQ ID NO: 1693671 - protein, 23 aa, Staphylococcus aureus
VSELLSVFGFKVVDADKAAREAV

SEQ ID NO: 1693672 - protein, 24 aa, Staphylococcus aureus
VSGNFHLLENLLNGSMKRVPQIPL

SEQ ID NO: 1693673 - protein, 19 aa, Staphylococcus aureus
VSIESLIEFCRLAQLPKNE

SEQ ID NO: 1693674 - protein, 22 aa, Staphylococcus aureus
VSNQLLYQIAYYMLHTSQLKNI

SEQ ID NO: 1693675 - protein, 17 aa, Staphylococcus aureus
VSRLVGAPLGYVGHDDG

SEQ ID NO: 1693676 - protein, 26 aa, Staphylococcus aureus
VSVAEHAVMDLLILLRNYEEGHRQSV

SEQ ID NO: 1693677 - protein, 23 aa, Staphylococcus aureus
VTGEGALAGIYKAYEEKGNNLNT

SEQ ID NO: 1693678 - protein, 27 aa, Staphylococcus aureus
VTGKNALLSDSLLRDIKILSSNAKGDA

SEQ ID NO: 1693679 - protein, 33 aa, Staphylococcus aureus
VTLLNKDKVEWIILAGYMRLIGPDLLASFEGKI

SEQ ID NO: 1693680 - protein, 27 aa, Staphylococcus aureus
VTQQQKLFFKLLFYSGARKGEIRALTW

SEQ ID NO: 1693681 - protein, 18 aa, Staphylococcus aureus
VTVKGKAPNTLYIEKRNL

SEQ ID NO: 1693682 - protein, 23 aa, Staphylococcus aureus
VVAQLEVPIPAIISAFEIAKAHG

SEQ ID NO: 1693683 - protein, 18 aa, Staphylococcus aureus
VVGKFVEFFGPGVQHLPL

SEQ ID NO: 1693684 - protein, 18 aa, Staphylococcus aureus
VVGRPLVARVQAMRRRKV

SEQ ID NO: 1693685 - protein, 20 aa, Staphylococcus aureus
VVPFENLGLLPYFEADFIAT

SEQ ID NO: 1693686 - protein, 31 aa, Staphylococcus aureus
VVSQFLTKDLFIDWTWGEKFFRKHLIDYDAA

SEQ ID NO: 1693687 - protein, 33 aa, Staphylococcus aureus
VVTEKPKPWDVYAFPYYYVYNDFSDHYPIKAYS

SEQ ID NO: 1693688 - protein, 20 aa, Staphylococcus aureus
VYECRFLTIATGYYGQHNTL

SEQ ID NO: 1693689 - protein, 17 aa, Staphylococcus aureus
WEDLSIFERRRFYQGDV

SEQ ID NO: 1693690 - protein, 17 aa, Staphylococcus aureus
WFMNAHIYLELADDYQA

SEQ ID NO: 1693691 - protein, 23 aa, Staphylococcus aureus
WGEFIPFFLERMDEALFTEHLNH

SEQ ID NO: 1693692 - protein, 18 aa, Staphylococcus aureus
WHTGAGMSYLYNSDVKHY

SEQ ID NO: 1693693 - protein, 27 aa, Staphylococcus aureus
WIDTEGNIYFIYTVADLEVILNCGNKK

SEQ ID NO: 1693694 - protein, 17 aa, Staphylococcus aureus
WTAILAGDALLTKAFEL

SEQ ID NO: 1693695 - protein, 21 aa, Staphylococcus aureus
WTRQKAFEEYEWLKNVAKNDI

SEQ ID NO: 1693696 - protein, 20 aa, Staphylococcus aureus
WTTFFEYLKERGLQGTELVI

SEQ ID NO: 1693697 - protein, 17 aa, Staphylococcus aureus
WVNMLEAGIVDPTKVTR

SEQ ID NO: 1693698 - protein, 33 aa, Staphylococcus aureus
YAAVPPLTHFITNSTYFLWDVLTTAYVGNKDLV

SEQ ID NO: 1693699 - protein, 24 aa, Staphylococcus aureus
YAEENLIDYIYFATKNLSSNKEEF

SEQ ID NO: 1693700 - protein, 30 aa, Staphylococcus aureus
YAEEYGNMVYIYRWPNLFGKWCKPNYNSVI

SEQ ID NO: 1693701 - protein, 18 aa, Staphylococcus aureus
YAFIKRLIKQFGKPQKVV

SEQ ID NO: 1693702 - protein, 17 aa, Staphylococcus aureus
YAKLLDDTKRKAFESVI

SEQ ID NO: 1693703 - protein, 23 aa, Staphylococcus aureus
YARRHGFISAVPLREIVEAHNYG

SEQ ID NO: 1693704 - protein, 24 aa, Staphylococcus aureus
YCINGYRWITYIANSGQCRYIATG

SEQ ID NO: 1693705 - protein, 26 aa, Staphylococcus aureus
YCTENRLPFILFSASGGARMQEGIIS

SEQ ID NO: 1693706 - protein, 26 aa, Staphylococcus aureus
YDEQKERIIIYMKYNVKGFKEIQFEE

SEQ ID NO: 1693707 - protein, 23 aa, Staphylococcus aureus
YDKNFINQIGWYLNYNQEINLIG

SEQ ID NO: 1693708 - protein, 27 aa, Staphylococcus aureus
YDLMFNQTWGLLYDPQSTIAAFKAKNG

SEQ ID NO: 1693709 - protein, 20 aa, Staphylococcus aureus
YDLVSIFEYCLNAAVDRSIE

SEQ ID NO: 1693710 - protein, 18 aa, Staphylococcus aureus
YDNKSGLYNLKLFAQVLG

SEQ ID NO: 1693711 - protein, 17 aa, Staphylococcus aureus
YDNLYKFFKENEKKYQY

SEQ ID NO: 1693712 - protein, 21 aa, Staphylococcus aureus
YDSMSQIRWLSVLDLKDKTED

SEQ ID NO: 1693713 - protein, 20 aa, Staphylococcus aureus
YEGWKQIIKGKATGSLGCLS

SEQ ID NO: 1693714 - protein, 17 aa, Staphylococcus aureus
YEIYHPLESVGIYVPGG

SEQ ID NO: 1693715 - protein, 17 aa, Staphylococcus aureus
YEMFMGPLDAAIAWSEK

SEQ ID NO: 1693716 - protein, 20 aa, Staphylococcus aureus
YEVLKQLCTTYKMVLDFYIE

SEQ ID NO: 1693717 - protein, 19 aa, Staphylococcus aureus
YEYALKLVHNGLFNILAEL

SEQ ID NO: 1693718 - protein, 18 aa, Staphylococcus aureus
YFAFGAYAQNLMLLLYEA

SEQ ID NO: 1693719 - protein, 18 aa, Staphylococcus aureus
YFDAKLVCYFFKELSKFI

SEQ ID NO: 1693720 - protein, 36 aa, Staphylococcus aureus
YFKQEAIEFAWEFLTSDKWMGMEPDKLYVTIHPEDM

SEQ ID NO: 1693721 - protein, 20 aa, Staphylococcus aureus
YGDNPLMRWFTNNVAVKVKP

SEQ ID NO: 1693722 - protein, 21 aa, Staphylococcus aureus
YGDNPLMRWFTNNVAVKVKPD

SEQ ID NO: 1693723 - protein, 18 aa, Staphylococcus aureus
YGMRLAEYKEIVLSKIME

SEQ ID NO: 1693724 - protein, 29 aa, Staphylococcus aureus
YGNARKYSNIYLYLALKGFLEKLMNDMYS

SEQ ID NO: 1693725 - protein, 18 aa, Staphylococcus aureus
YGSPLPLMHLYKMFRPFV

SEQ ID NO: 1693726 - protein, 18 aa, Staphylococcus aureus
YGTHLWSGYPTGTIHSRA

SEQ ID NO: 1693727 - protein, 26 aa, Staphylococcus aureus
YHGQVYHVFYHPLITDPKVAFTGDTH

SEQ ID NO: 1693728 - protein, 23 aa, Staphylococcus aureus
YHQPSKLFLLNPNVVEMLIENQS

SEQ ID NO: 1693729 - protein, 17 aa, Staphylococcus aureus
YIDEILITKSKTLMGIY

SEQ ID NO: 1693730 - protein, 23 aa, Staphylococcus aureus
YIDLWEYYAAIAEKDFRDVMDQI

SEQ ID NO: 1693731 - protein, 24 aa, Staphylococcus aureus
YIDLWEYYAAIAEKDFRDVMDQIK

SEQ ID NO: 1693732 - protein, 19 aa, Staphylococcus aureus
YIEDDFVFHPVLFDVVDSE

SEQ ID NO: 1693733 - protein, 18 aa, Staphylococcus aureus
YIFLTDFTSRNQYQPMGL

SEQ ID NO: 1693734 - protein, 17 aa, Staphylococcus aureus
YIKNLLVVDYPQSVKGA

SEQ ID NO: 1693735 - protein, 27 aa, Staphylococcus aureus
YIKNPQVLEYVLYKAINLDFETFDIPD

SEQ ID NO: 1693736 - protein, 19 aa, Staphylococcus aureus
YIRDIDPTLLLLEIDKESK

SEQ ID NO: 1693737 - protein, 19 aa, Staphylococcus aureus
YISTFSKSIFPSCRVAYMV

SEQ ID NO: 1693738 - protein, 17 aa, Staphylococcus aureus
YITTLLDRILDKYKDKS

SEQ ID NO: 1693739 - protein, 18 aa, Staphylococcus aureus
YITYTRLLEQFTMEDIAA

SEQ ID NO: 1693740 - protein, 27 aa, Staphylococcus aureus
YKEAMDTYRKKLFAELDALNKFLDEER

SEQ ID NO: 1693741 - protein, 24 aa, Staphylococcus aureus
YKKMGPYIKGMPFGHEFSGVVDAI

SEQ ID NO: 1693742 - protein, 41 aa, Staphylococcus aureus
YKNHPEELRLLLIDPKMVELAPYNGLPHLVAPVITDVKAAT

SEQ ID NO: 1693743 - protein, 24 aa, Staphylococcus aureus
YKSAPSLPILRRGQHYKLHFDFDA

SEQ ID NO: 1693744 - protein, 24 aa, Staphylococcus aureus
YKVAMFLVPTMIKSLLLVYNNEHT

SEQ ID NO: 1693745 - protein, 21 aa, Staphylococcus aureus
YKYSALFKIINKDVGELLSVL

SEQ ID NO: 1693746 - protein, 23 aa, Staphylococcus aureus
YLDEYFRNVLGEKSYLILIDDFS

SEQ ID NO: 1693747 - protein, 21 aa, Staphylococcus aureus
YLFEAVYGAGIIRMYELNTYT

SEQ ID NO: 1693748 - protein, 17 aa, Staphylococcus aureus
YLLKKFIERNISEFDDI

SEQ ID NO: 1693749 - protein, 23 aa, Staphylococcus aureus
YLRNNILKFSLFTGENHIVINAD

SEQ ID NO: 1693750 - protein, 20 aa, Staphylococcus aureus
YLRPETLFGNKFEGYLNQKA

SEQ ID NO: 1693751 - protein, 27 aa, Staphylococcus aureus
YLSIIDRIVNWISQKLLITCQPVNLNF

SEQ ID NO: 1693752 - protein, 26 aa, Staphylococcus aureus
YLSKFEIREIRIIKSVLLKGKKSFNT

SEQ ID NO: 1693753 - protein, 22 aa, Staphylococcus aureus
YMRHMFIEYVRTYYGYDERISL

SEQ ID NO: 1693754 - protein, 23 aa, Staphylococcus aureus
YNEIYSILKDWLSFVRQTTEVSD

SEQ ID NO: 1693755 - protein, 17 aa, Staphylococcus aureus
YNVFYDDGKYNKKIIKN

SEQ ID NO: 1693756 - protein, 27 aa, Staphylococcus aureus
YNVSEKLFYDLWTDLYRLFKNLREVFK

SEQ ID NO: 1693757 - protein, 31 aa, Staphylococcus aureus
YNVSEKVFYDLWTDLYRLFKKLRNAFKEEGH

SEQ ID NO: 1693758 - protein, 19 aa, Staphylococcus aureus
YPNALLHWEDFGRGHAKNI

SEQ ID NO: 1693759 - protein, 20 aa, Staphylococcus aureus
YPVVVRPSYVLGGRAMEIVD

SEQ ID NO: 1693760 - protein, 21 aa, Staphylococcus aureus
YPYISFIPMTDDVELSLAGFK

SEQ ID NO: 1693761 - protein, 18 aa, Staphylococcus aureus
YQCYIEQLGFQHVSDFPR

SEQ ID NO: 1693762 - protein, 20 aa, Staphylococcus aureus
YQELFDFYYDLFKSDDDTYT

SEQ ID NO: 1693763 - protein, 18 aa, Staphylococcus aureus
YQFIMKLPESVLRLKGYV

SEQ ID NO: 1693764 - protein, 24 aa, Staphylococcus aureus
YQFNIFLYVLHYSKMKYITLTWDR

SEQ ID NO: 1693765 - protein, 25 aa, Staphylococcus aureus
YQFNIFLYVLHYSKMKYITLTWDRK

SEQ ID NO: 1693766 - protein, 26 aa, Staphylococcus aureus
YQPKPGTDLAWLSAVTKYIIDHDLHD

SEQ ID NO: 1693767 - protein, 23 aa, Staphylococcus aureus
YQSGIIITQLFAIEPARLDQQII

SEQ ID NO: 1693768 - protein, 19 aa, Staphylococcus aureus
YQTRYEVLKQLCTTYKMVL

SEQ ID NO: 1693769 - protein, 17 aa, Staphylococcus aureus
YREQYDKILLYSGNMGQ

SEQ ID NO: 1693770 - protein, 18 aa, Staphylococcus aureus
YREQYDKILLYSGNMGQL

SEQ ID NO: 1693771 - protein, 27 aa, Staphylococcus aureus
YRLGALGYLDWSYFNKGFHSNNGLSDQ

SEQ ID NO: 1693772 - protein, 18 aa, Staphylococcus aureus
YRSDYITTQMLRVAKRES

SEQ ID NO: 1693773 - protein, 18 aa, Staphylococcus aureus
YSSIKLISIQLPLLEEQQ

SEQ ID NO: 1693774 - protein, 17 aa, Staphylococcus aureus
YSTRIMDLVTPIGLGQR

SEQ ID NO: 1693775 - protein, 20 aa, Staphylococcus aureus
YTEHQLLVSAIPRHKINNDP

SEQ ID NO: 1693776 - protein, 21 aa, Staphylococcus aureus
YTHIFPGECIWFDVLKRGNPS

SEQ ID NO: 1693777 - protein, 24 aa, Staphylococcus aureus
YTIEEAISTFIPDLYEKHSTNRYT

SEQ ID NO: 1693778 - protein, 18 aa, Staphylococcus aureus
YTKYLLTEGIEKITKKYG

SEQ ID NO: 1693779 - protein, 22 aa, Staphylococcus aureus
YVKVDGEWLYKLISYIESNDEY

SEQ ID NO: 1693780 - protein, 18 aa, Staphylococcus aureus
YVLPDAVTRFRQGLGRLI

SEQ ID NO: 1693781 - protein, 18 aa, Staphylococcus aureus
YVMSLQDQLELEDCEKYT

SEQ ID NO: 1693782 - protein, 19 aa, Staphylococcus aureus
YVPACLLLVLNSLSTLKPP

SEQ ID NO: 1693783 - protein, 22 aa, Staphylococcus aureus
YVREQYLYLTGRQHDMLIIGGQ

SEQ ID NO: 1693784 - protein, 20 aa, Staphylococcus aureus
YVYVKGYDDLQFFESFILHG

SEQ ID NO: 1693785 - protein, 19 aa, Staphylococcus aureus
YYDNFAIWSIQTNAMHQFA

SEQ ID NO: 1693786 - protein, 20 aa, Staphylococcus aureus
YYEFKYHSTVLYGCRCISLD

SEQ ID NO: 1693787 - protein, 19 aa, Staphylococcus aureus
YYKYRKFGILPETEYEINK

SEQ ID NO: 1693788 - protein, 17 aa, Staphylococcus aureus
YYLDLRRYGSVPHCGFG

SEQ ID NO: 1693789 - protein, 18 aa, Staphylococcus aureus
YYLDLRRYGSVPHCGFGL

SEQ ID NO: 1693790 - protein, 27 aa, Staphylococcus aureus
YYTQRHLTFSNKWLWQKDNGTIHATLL

SEQ ID NO: 1693791 - protein, 18 aa, Staphylococcus aureus
YYVRVNMKAFVEAVNELG

SEQ ID NO: 1693792 - protein, 17 aa, Staphylococcus aureus
YYYPLQNAIIEFYTEYY

SEQ ID NO: 1693793 - protein, 25 aa, Staphylococcus aureus
AADIAPIFGLNKRQGRQLLAYLGVP

SEQ ID NO: 1693794 - protein, 26 aa, Staphylococcus aureus
AADLLDQPLYKYLGGFNGKQLPVPMM

SEQ ID NO: 1693795 - protein, 25 aa, Staphylococcus aureus
AADNKTLGRFQLTDIPPAERGKPQI

SEQ ID NO: 1693796 - protein, 20 aa, Staphylococcus aureus
AAICMYALKTAGYQSALMVP

SEQ ID NO: 1693797 - protein, 21 aa, Staphylococcus aureus
AAIKDFWEKVGLKTNVKLVEF

SEQ ID NO: 1693798 - protein, 18 aa, Staphylococcus aureus
AAIKQWLPDPETNSAIMV

SEQ ID NO: 1693799 - protein, 22 aa, Staphylococcus aureus
AAILGMHSIITRPIAIDQDTIE

SEQ ID NO: 1693800 - protein, 19 aa, Staphylococcus aureus
AAKAILTKASGQNVDKAAV

SEQ ID NO: 1693801 - protein, 17 aa, Staphylococcus aureus
AAKYYFNKDLKDLNLAE

SEQ ID NO: 1693802 - protein, 22 aa, Staphylococcus aureus
AALEKFKIFIKNQGGDETVIDH

SEQ ID NO: 1693803 - protein, 18 aa, Staphylococcus aureus
AALKQVPSCEFFPVEAVK

SEQ ID NO: 1693804 - protein, 27 aa, Staphylococcus aureus
AALQHALDVWLLGKLQFAEFEHFPSVD

SEQ ID NO: 1693805 - protein, 19 aa, Staphylococcus aureus
AARAIDALPHLNNAQKADV

SEQ ID NO: 1693806 - protein, 32 aa, Staphylococcus aureus
AARATIVMALYQMFHVLLSFSVAYGATASGLS

SEQ ID NO: 1693807 - protein, 19 aa, Staphylococcus aureus
AARDVAMHIAAINPKYVSS

SEQ ID NO: 1693808 - protein, 28 aa, Staphylococcus aureus
AARQGLDILRKKGFYSQIGIFKDAEIPF

SEQ ID NO: 1693809 - protein, 27 aa, Staphylococcus aureus
AAVDLKVILEYGESAPKIFRKVTELVK

SEQ ID NO: 1693810 - protein, 18 aa, Staphylococcus aureus
AAYDLTLNGSAKLNNMTS

SEQ ID NO: 1693811 - protein, 18 aa, Staphylococcus aureus
ACCHDFIMKLPDGYKTLL

SEQ ID NO: 1693812 - protein, 19 aa, Staphylococcus aureus
ACNNFLREVNIYDYPIIKD

SEQ ID NO: 1693813 - protein, 17 aa, Staphylococcus aureus
ACSTLLTTFFKNLRANK

SEQ ID NO: 1693814 - protein, 30 aa, Staphylococcus aureus
ACYQLNVLQLIRLCRYFVDVLRQSDNGKNY

SEQ ID NO: 1693815 - protein, 23 aa, Staphylococcus aureus
ADAIMLITPYYNKTNQRGLVKHF

SEQ ID NO: 1693816 - protein, 18 aa, Staphylococcus aureus
ADCKRFLECLNDKNVKTI

SEQ ID NO: 1693817 - protein, 18 aa, Staphylococcus aureus
ADFALTPDVAIIDPQFVM

SEQ ID NO: 1693818 - protein, 26 aa, Staphylococcus aureus
ADGNNNIKVILPKVQVKPAARQSVSA

SEQ ID NO: 1693819 - protein, 25 aa, Staphylococcus aureus
ADINRGTFYLHYEDKYMLLGDMEDE

SEQ ID NO: 1693820 - protein, 19 aa, Staphylococcus aureus
ADLEDLAIPYAAFKDIVKM

SEQ ID NO: 1693821 - protein, 28 aa, Staphylococcus aureus
ADLVKEYVFVIMIKTLQYWSAHKDEVDI

SEQ ID NO: 1693822 - protein, 26 aa, Staphylococcus aureus
ADMDEHTPIFVWSGDAIGAGTSKIKL

SEQ ID NO: 1693823 - protein, 31 aa, Staphylococcus aureus
ADMEVFDYITPEFLIKRSHLLKKAKCIIVDL

SEQ ID NO: 1693824 - protein, 26 aa, Staphylococcus aureus
ADPLGDPIILIAPTQSTFQLEQSFVN

SEQ ID NO: 1693825 - protein, 26 aa, Staphylococcus aureus
ADQLQLYYQVLHGNDLFINKYWVQRT

SEQ ID NO: 1693826 - protein, 28 aa, Staphylococcus aureus
ADVLVEPDWLVLLDILVESLSDVDVDVD

SEQ ID NO: 1693827 - protein, 17 aa, Staphylococcus aureus
ADYQRVGFFYPEIAMYF

SEQ ID NO: 1693828 - protein, 17 aa, Staphylococcus aureus
AEAIRYLERIGFDAIHK

SEQ ID NO: 1693829 - protein, 21 aa, Staphylococcus aureus
AEDIFEVVWAKIEAAYQSQKD

SEQ ID NO: 1693830 - protein, 29 aa, Staphylococcus aureus
AEDKQKIIITLYDKFFKTAFNSTTKKLGI

SEQ ID NO: 1693831 - protein, 17 aa, Staphylococcus aureus
AEDTPYIAYKLMGILEE

SEQ ID NO: 1693832 - protein, 19 aa, Staphylococcus aureus
AEDYWFTDPITLEHLRSKL

SEQ ID NO: 1693833 - protein, 24 aa, Staphylococcus aureus
AEEFEILIIAYSIDGGAISAIDMT

SEQ ID NO: 1693834 - protein, 20 aa, Staphylococcus aureus
AEEIAFNRKNWVFPIQTHEN

SEQ ID NO: 1693835 - protein, 23 aa, Staphylococcus aureus
AEERKARFLDNQKIKKTPVVSLE

SEQ ID NO: 1693836 - protein, 24 aa, Staphylococcus aureus
AEERKARFLDNQKIKKTPVVSLEY

SEQ ID NO: 1693837 - protein, 28 aa, Staphylococcus aureus
AEGFEGYYMMKRMNAPFLLIGDPRVEGG

SEQ ID NO: 1693838 - protein, 29 aa, Staphylococcus aureus
AEGFEGYYMMKRMNAPFLLIGDPRVEGGS

SEQ ID NO: 1693839 - protein, 28 aa, Staphylococcus aureus
AEHVMGQLDFLIAKARYSRSIKGTKPIF

SEQ ID NO: 1693840 - protein, 18 aa, Staphylococcus aureus
AEIFLKQQFERLQNEQIF

SEQ ID NO: 1693841 - protein, 18 aa, Staphylococcus aureus
AEIIAQAQALNEAMKALK

SEQ ID NO: 1693842 - protein, 23 aa, Staphylococcus aureus
AEIKNFKFFVQYGNFKDLKNYKD

SEQ ID NO: 1693843 - protein, 35 aa, Staphylococcus aureus
AEIVINAHWFDGVFYIPNCDKITPGMILAAMRTNV

SEQ ID NO: 1693844 - protein, 21 aa, Staphylococcus aureus
AEKCLQILKSILKPEGILCFQ

SEQ ID NO: 1693845 - protein, 22 aa, Staphylococcus aureus
AEKCLQILKSILKPEGILCFQE

SEQ ID NO: 1693846 - protein, 24 aa, Staphylococcus aureus
AELAKGRPLFEAVYKAKKFISMSI

SEQ ID NO: 1693847 - protein, 26 aa, Staphylococcus aureus
AEPYIRRRAIRHLEKKRIVIFAAGIG

SEQ ID NO: 1693848 - protein, 25 aa, Staphylococcus aureus
AEQARELGCLFAFYGHTHVAKYEYI

SEQ ID NO: 1693849 - protein, 25 aa, Staphylococcus aureus
AEQLDQAMERLINGIQDKDQVKQSV

SEQ ID NO: 1693850 - protein, 25 aa, Staphylococcus aureus
AEQLHSIFLEVIIAPKFTDKALNIL

SEQ ID NO: 1693851 - protein, 19 aa, Staphylococcus aureus
AEQVIKLNDAVTAAKKALN

SEQ ID NO: 1693852 - protein, 19 aa, Staphylococcus aureus
AESLMALFADSMNVALLTG

SEQ ID NO: 1693853 - protein, 21 aa, Staphylococcus aureus
AESLNTAMGNLINAIADHQTV

SEQ ID NO: 1693854 - protein, 21 aa, Staphylococcus aureus
AEVLKYIDFNAGNIAKQLLNQ

SEQ ID NO: 1693855 - protein, 25 aa, Staphylococcus aureus
AEYFSKVLFQMDIPNNLLIAQNVAK

SEQ ID NO: 1693856 - protein, 17 aa, Staphylococcus aureus
AFDVLTLAPQGLYSDFV

SEQ ID NO: 1693857 - protein, 17 aa, Staphylococcus aureus
AFEKAIIYAFNILNMHK

SEQ ID NO: 1693858 - protein, 17 aa, Staphylococcus aureus
AFFKQELSTYHFNDSPL

SEQ ID NO: 1693859 - protein, 19 aa, Staphylococcus aureus
AFIKRLIKQFGKPQKVITD

SEQ ID NO: 1693860 - protein, 19 aa, Staphylococcus aureus
AFIMNIYDEYRSYVIEELD

SEQ ID NO: 1693861 - protein, 20 aa, Staphylococcus aureus
AFLTAIADKMKAINGYFVID

SEQ ID NO: 1693862 - protein, 18 aa, Staphylococcus aureus
AFNKKAPYDERMPKIVIV

SEQ ID NO: 1693863 - protein, 22 aa, Staphylococcus aureus
AFNKKAPYDERMPKIVIVIDEL

SEQ ID NO: 1693864 - protein, 18 aa, Staphylococcus aureus
AFNYMPYFEHLDMNQINV

SEQ ID NO: 1693865 - protein, 17 aa, Staphylococcus aureus
AFQELLPVLTAHQARVM

SEQ ID NO: 1693866 - protein, 19 aa, Staphylococcus aureus
AFTCIQMVKLVAEEDLQLD

SEQ ID NO: 1693867 - protein, 18 aa, Staphylococcus aureus
AFTCLQMVKLVAEEDLQL

SEQ ID NO: 1693868 - protein, 24 aa, Staphylococcus aureus
AFTEGKYSVLDFGSGTTIIDTYQN

SEQ ID NO: 1693869 - protein, 18 aa, Staphylococcus aureus
AFYHFKYPYADVEGFIEI

SEQ ID NO: 1693870 - protein, 19 aa, Staphylococcus aureus
AFYIMINAIKYPYPDSNKK

SEQ ID NO: 1693871 - protein, 23 aa, Staphylococcus aureus
AGAKNLYDVYISKGLDTPKKIGP

SEQ ID NO: 1693872 - protein, 19 aa, Staphylococcus aureus
AGASMILLIVNILSDKHNY

SEQ ID NO: 1693873 - protein, 18 aa, Staphylococcus aureus
AGCDLLKQAFARAAILSN

SEQ ID NO: 1693874 - protein, 24 aa, Staphylococcus aureus
AGDETAIPLLLGLGLDEFSMSATS

SEQ ID NO: 1693875 - protein, 23 aa, Staphylococcus aureus
AGDETAIPLLLGSGLDEFSMSAT

SEQ ID NO: 1693876 - protein, 20 aa, Staphylococcus aureus
AGDLYVVFRVKPSEKFKRDG

SEQ ID NO: 1693877 - protein, 19 aa, Staphylococcus aureus
AGDLYVVFRVKPSETFKRD

SEQ ID NO: 1693878 - protein, 17 aa, Staphylococcus aureus
AGDVWYPQPAPADHPWR

SEQ ID NO: 1693879 - protein, 18 aa, Staphylococcus aureus
AGDVWYPQPAPADHPWRT

SEQ ID NO: 1693880 - protein, 26 aa, Staphylococcus aureus
AGENYIDIVWLARKNAYQVALKDDGL

SEQ ID NO: 1693881 - protein, 23 aa, Staphylococcus aureus
AGEWQSVYPYLKDGTLDEVMEHK

SEQ ID NO: 1693882 - protein, 18 aa, Staphylococcus aureus
AGGCFWCMVKPFTSYPGI

SEQ ID NO: 1693883 - protein, 20 aa, Staphylococcus aureus
AGGCFWCMVKPFTSYPGIRS

SEQ ID NO: 1693884 - protein, 19 aa, Staphylococcus aureus
AGHMPGMKGAEATVKGAYK

SEQ ID NO: 1693885 - protein, 32 aa, Staphylococcus aureus
AGIEVISRLFKLNKIFIIKEKVSLFKEEIYNY

SEQ ID NO: 1693886 - protein, 17 aa, Staphylococcus aureus
AGIIRMYELNTHTGEII

SEQ ID NO: 1693887 - protein, 30 aa, Staphylococcus aureus
AGKGYFLVEGFLLPPVMFTAAEVGALITAG

SEQ ID NO: 1693888 - protein, 25 aa, Staphylococcus aureus
AGKNALLSDSLLRDIKVLSSNAKDD

SEQ ID NO: 1693889 - protein, 28 aa, Staphylococcus aureus
AGKSTLLKLVLGLLPLQSGEIFVEGIDF

SEQ ID NO: 1693890 - protein, 25 aa, Staphylococcus aureus
AGKSTLLSAICRLIRFDNGEVKIDG

SEQ ID NO: 1693891 - protein, 17 aa, Staphylococcus aureus
AGLPKRPFKPFNEAHRQ

SEQ ID NO: 1693892 - protein, 17 aa, Staphylococcus aureus
AGLYDYEANYKAHLSHR

SEQ ID NO: 1693893 - protein, 17 aa, Staphylococcus aureus
AGNIQIWKKPSSFVIKP

SEQ ID NO: 1693894 - protein, 25 aa, Staphylococcus aureus
AGNMGVIPPIEGFLQGLRDITTEYG

SEQ ID NO: 1693895 - protein, 27 aa, Staphylococcus aureus
AGQNFLPTHQMPLLARGNFNPEFISVL

SEQ ID NO: 1693896 - protein, 27 aa, Staphylococcus aureus
AGRDVTIFCTFWGLNALKKIQSQRIKK

SEQ ID NO: 1693897 - protein, 24 aa, Staphylococcus aureus
AGRGGSMLLFAKDLPTAKNIVKAV

SEQ ID NO: 1693898 - protein, 18 aa, Staphylococcus aureus
AGRRILLKEVRDSIFREK

SEQ ID NO: 1693899 - protein, 17 aa, Staphylococcus aureus
AGSFMVATKIKGMIAAE

SEQ ID NO: 1693900 - protein, 17 aa, Staphylococcus aureus
AGSNILGVILNKAKVDK

SEQ ID NO: 1693901 - protein, 24 aa, Staphylococcus aureus
AGTDMTFFDFPNITKGQGGTNSIT

SEQ ID NO: 1693902 - protein, 24 aa, Staphylococcus aureus
AHEDYYRLILLSRHQNDIPMWLRE

SEQ ID NO: 1693903 - protein, 17 aa, Staphylococcus aureus
AHFIERDALRTYLNQVY

SEQ ID NO: 1693904 - protein, 17 aa, Staphylococcus aureus
AHFIHQYMKQATPFIEA

SEQ ID NO: 1693905 - protein, 18 aa, Staphylococcus aureus
AHFVKYTPNLPFIVVGKK

SEQ ID NO: 1693906 - protein, 20 aa, Staphylococcus aureus
AHGKALLKMRRNIGMIFQHF

SEQ ID NO: 1693907 - protein, 22 aa, Staphylococcus aureus
AHHCEAFKANFKGAAQGDWVKS

SEQ ID NO: 1693908 - protein, 22 aa, Staphylococcus aureus
AHQIALKYNLPTIAVLAFGHQT

SEQ ID NO: 1693909 - protein, 21 aa, Staphylococcus aureus
AHSITAIWNFEKQNYYLKDLK

SEQ ID NO: 1693910 - protein, 30 aa, Staphylococcus aureus
AHTLIINKEFKRMLAKFFIFVGDGGNGKGT

SEQ ID NO: 1693911 - protein, 25 aa, Staphylococcus aureus
AIAANRYHLKCKIFAPYGFSEEKIN

SEQ ID NO: 1693912 - protein, 20 aa, Staphylococcus aureus
AIATKILLASQFYKAEDYHQ

SEQ ID NO: 1693913 - protein, 19 aa, Staphylococcus aureus
AICMYALKTAGYQSALMVP

SEQ ID NO: 1693914 - protein, 28 aa, Staphylococcus aureus
AIDFSNPNLLFPLLDEEFHLPLVVATTG

SEQ ID NO: 1693915 - protein, 28 aa, Staphylococcus aureus
AIDGLNLFEFKYKLKPFFNPENVYSKQD

SEQ ID NO: 1693916 - protein, 22 aa, Staphylococcus aureus
AIDNLTHLNTPQKTALKQQVNA

SEQ ID NO: 1693917 - protein, 30 aa, Staphylococcus aureus
AIEKGYNTIISHHPLIFKGVTALKANGYGL

SEQ ID NO: 1693918 - protein, 24 aa, Staphylococcus aureus
AIEKLVRRIFENPQATFKKVVAIE

SEQ ID NO: 1693919 - protein, 22 aa, Staphylococcus aureus
AIERIKRAIVNDEKILVYGDYD

SEQ ID NO: 1693920 - protein, 20 aa, Staphylococcus aureus
AIESGEIFKYFPIPEQPSDT

SEQ ID NO: 1693921 - protein, 29 aa, Staphylococcus aureus
AIETLKESKPYLFAPSKPVGNSPQQGDNP

SEQ ID NO: 1693922 - protein, 27 aa, Staphylococcus aureus
AIETLKESKPYLFASSKPVGKTPQGGG

SEQ ID NO: 1693923 - protein, 22 aa, Staphylococcus aureus
AIHRIKFDMLQPNPLRQEVMHR

SEQ ID NO: 1693924 - protein, 38 aa, Staphylococcus aureus
AIIEIERIILLMYAEITKELLAFYAKYAKDTGLNIQEV

SEQ ID NO: 1693925 - protein, 18 aa, Staphylococcus aureus
AIILLTKSFSEELGPKGI

SEQ ID NO: 1693926 - protein, 17 aa, Staphylococcus aureus
AIKAYLTIAPKNTVLIT

SEQ ID NO: 1693927 - protein, 36 aa, Staphylococcus aureus
AIKERLFKKGLMKRYKLLFHILNLTGVHKYDYSTID

SEQ ID NO: 1693928 - protein, 18 aa, Staphylococcus aureus
AIKHIDGLITSDNVFFNQ

SEQ ID NO: 1693929 - protein, 19 aa, Staphylococcus aureus
AIKIIQPETKIKPAAREKI

SEQ ID NO: 1693930 - protein, 21 aa, Staphylococcus aureus
AIKNLYASEYIWNSIKDNKTV

SEQ ID NO: 1693931 - protein, 23 aa, Staphylococcus aureus
AIKYVVKFYNYPNEYLLTNVKIP

SEQ ID NO: 1693932 - protein, 29 aa, Staphylococcus aureus
AILEELGLPYRCVILCTGDIGFSASKTYD

SEQ ID NO: 1693933 - protein, 18 aa, Staphylococcus aureus
AIMTMPGLPKKTSSIKHG

SEQ ID NO: 1693934 - protein, 17 aa, Staphylococcus aureus
AINAQWVEYPEDWASEV

SEQ ID NO: 1693935 - protein, 20 aa, Staphylococcus aureus
AINQVHAKYFDISCVPILTR

SEQ ID NO: 1693936 - protein, 23 aa, Staphylococcus aureus
AINRVNTLKNRALTDIGVTSTTA

SEQ ID NO: 1693937 - protein, 26 aa, Staphylococcus aureus
AIPVCGFAWIHWSVANVGVSGNSISI

SEQ ID NO: 1693938 - protein, 26 aa, Staphylococcus aureus
AIQFADIYLMALPTKAMREVASQIND

SEQ ID NO: 1693939 - protein, 25 aa, Staphylococcus aureus
AIQIPIAIQIPTVTQIPIVTRIQRV

SEQ ID NO: 1693940 - protein, 23 aa, Staphylococcus aureus
AIQIQIVIQIQTVTQIPTAIQIP

SEQ ID NO: 1693941 - protein, 17 aa, Staphylococcus aureus
AIRIQTVTRIQIATRIQ

SEQ ID NO: 1693942 - protein, 18 aa, Staphylococcus aureus
AIRTQIATPIQIVTPIQT

SEQ ID NO: 1693943 - protein, 18 aa, Staphylococcus aureus
AIRTQTVTPIQIAIQNQT

SEQ ID NO: 1693944 - protein, 17 aa, Staphylococcus aureus
AITAWYDLAKIANKYVL

SEQ ID NO: 1693945 - protein, 36 aa, Staphylococcus aureus
AITDARGIYQLKDGYKYYSFVDSIGLHSGSHVFVER

SEQ ID NO: 1693946 - protein, 18 aa, Staphylococcus aureus
AIVGRRVLMYLPDAEKCL

SEQ ID NO: 1693947 - protein, 19 aa, Staphylococcus aureus
AIVVGNAYGRIRAMVNDLG

SEQ ID NO: 1693948 - protein, 23 aa, Staphylococcus aureus
AIYGLNFLIQHDIERLKAHYKID

SEQ ID NO: 1693949 - protein, 27 aa, Staphylococcus aureus
AKAHELKPDLILMDLLMEDMDGVEATT

SEQ ID NO: 1693950 - protein, 18 aa, Staphylococcus aureus
AKDLTKFEYLSRKSIRVI

SEQ ID NO: 1693951 - protein, 17 aa, Staphylococcus aureus
AKDLVSKAKEKAYQDIL

SEQ ID NO: 1693952 - protein, 23 aa, Staphylococcus aureus
AKDYKNFQNLYLFIYCFSGDIEE

SEQ ID NO: 1693953 - protein, 24 aa, Staphylococcus aureus
AKEAAKRALASYSNLNNAQSTAAT

SEQ ID NO: 1693954 - protein, 24 aa, Staphylococcus aureus
AKEMILIPDFVKVINITNLFECIK

SEQ ID NO: 1693955 - protein, 25 aa, Staphylococcus aureus
AKENINCRCKLLYYIDKDELPTVMR

SEQ ID NO: 1693956 - protein, 18 aa, Staphylococcus aureus
AKENVAFTAGVRQSDQLN

SEQ ID NO: 1693957 - protein, 24 aa, Staphylococcus aureus
AKENYYMYIKFGILPETEYEINKV

SEQ ID NO: 1693958 - protein, 22 aa, Staphylococcus aureus
AKENYYMYKKFGVIPEMEYEIN

SEQ ID NO: 1693959 - protein, 17 aa, Staphylococcus aureus
AKENYYMYKKFGVLPEM

SEQ ID NO: 1693960 - protein, 20 aa, Staphylococcus aureus
AKERTRLRTLFPYINEASEN

SEQ ID NO: 1693961 - protein, 24 aa, Staphylococcus aureus
AKESAKRALASYSNLNNAQSTAAT

SEQ ID NO: 1693962 - protein, 25 aa, Staphylococcus aureus
AKESAKRALASYSNLNNAQSTAATS

SEQ ID NO: 1693963 - protein, 18 aa, Staphylococcus aureus
AKETDALRIKWVEKGNIE

SEQ ID NO: 1693964 - protein, 26 aa, Staphylococcus aureus
AKFAGAALRFLTGPIGATITAITIAY

SEQ ID NO: 1693965 - protein, 17 aa, Staphylococcus aureus
AKFICQEYHIVRYPDAD

SEQ ID NO: 1693966 - protein, 23 aa, Staphylococcus aureus
AKGAYSLLKKKLIDKVKSWFEDF

SEQ ID NO: 1693967 - protein, 17 aa, Staphylococcus aureus
AKGGIYVWLETPSGYDS

SEQ ID NO: 1693968 - protein, 24 aa, Staphylococcus aureus
AKHEALINGKRYPIRALMMSHMFV

SEQ ID NO: 1693969 - protein, 28 aa, Staphylococcus aureus
AKIAMEKARLFALKHELKNEIQSMISDE

SEQ ID NO: 1693970 - protein, 28 aa, Staphylococcus aureus
AKINAVKTFSEYKKDALAKIEDAYNAKV

SEQ ID NO: 1693971 - protein, 32 aa, Staphylococcus aureus
AKKLVIQTYFERAHLKFLSSLPVGGIGLDFVH

SEQ ID NO: 1693972 - protein, 22 aa, Staphylococcus aureus
AKKNKIPPKLFIAIVASESEWG

SEQ ID NO: 1693973 - protein, 24 aa, Staphylococcus aureus
AKKPNWPVTPWPTAYSEIYDYQWI

SEQ ID NO: 1693974 - protein, 31 aa, Staphylococcus aureus
AKKPNWPVTPWPTAYSEIYDYQWSEKLIPYW

SEQ ID NO: 1693975 - protein, 19 aa, Staphylococcus aureus
AKLADRLGFKRIWFTEHHN

SEQ ID NO: 1693976 - protein, 25 aa, Staphylococcus aureus
AKLADRLGFKRIWFTEHHNVPAFAC

SEQ ID NO: 1693977 - protein, 19 aa, Staphylococcus aureus
AKLMIGIEKVKYGEIFYNN

SEQ ID NO: 1693978 - protein, 30 aa, Staphylococcus aureus
AKLRYHQVGQRPVLIFIPGANGTGDIFLPL

SEQ ID NO: 1693979 - protein, 19 aa, Staphylococcus aureus
AKLYKQIGLKGIYFTRDKY

SEQ ID NO: 1693980 - protein, 22 aa, Staphylococcus aureus
AKPPVARIMDYGKFKFEQQKKE

SEQ ID NO: 1693981 - protein, 19 aa, Staphylococcus aureus
AKPRLPFDHVFHHNKYRAD

SEQ ID NO: 1693982 - protein, 25 aa, Staphylococcus aureus
AKQYFDRIILLNQTLRYFGESEEAM

SEQ ID NO: 1693983 - protein, 30 aa, Staphylococcus aureus
AKRAGKTYVFILLFLMHIATYKDKGLNFII

SEQ ID NO: 1693984 - protein, 23 aa, Staphylococcus aureus
AKRGEQFFMDNFGLKVKATNVVG

SEQ ID NO: 1693985 - protein, 24 aa, Staphylococcus aureus
AKRGEQFFMDNFGLKVKATNVVGS

SEQ ID NO: 1693986 - protein, 22 aa, Staphylococcus aureus
AKRQQIYYEVFPFEGNRVSLKE

SEQ ID NO: 1693987 - protein, 21 aa, Staphylococcus aureus
AKSDIGRLTDLNNAQRTAANA

SEQ ID NO: 1693988 - protein, 22 aa, Staphylococcus aureus
AKSDIGRLTDLNNAQRTAANAE

SEQ ID NO: 1693989 - protein, 18 aa, Staphylococcus aureus
AKTNFTEMLGKKLKAKTT

SEQ ID NO: 1693990 - protein, 23 aa, Staphylococcus aureus
AKVFYSALGFDILSFEKNAIKIG

SEQ ID NO: 1693991 - protein, 18 aa, Staphylococcus aureus
AKWFLQDVEVLINGVRET

SEQ ID NO: 1693992 - protein, 26 aa, Staphylococcus aureus
AKYDVIYNGHTFATSLPAKFVVKNVQ

SEQ ID NO: 1693993 - protein, 21 aa, Staphylococcus aureus
ALAAKDIRIEAPIPGTSRVGI

SEQ ID NO: 1693994 - protein, 18 aa, Staphylococcus aureus
ALCVYYLEKLIKDNKNSI

SEQ ID NO: 1693995 - protein, 20 aa, Staphylococcus aureus
ALCVYYLEKLIKDSKDSIMI

SEQ ID NO: 1693996 - protein, 18 aa, Staphylococcus aureus
ALDFQDWICDVLVELRTS

SEQ ID NO: 1693997 - protein, 25 aa, Staphylococcus aureus
ALDIKIIMPMFDDALPYYNQFITEV

SEQ ID NO: 1693998 - protein, 29 aa, Staphylococcus aureus
ALDIKVIMPIFDDALPYYKQFITEVTTFL

SEQ ID NO: 1693999 - protein, 18 aa, Staphylococcus aureus
ALDILKQSVYEWIENNTD

SEQ ID NO: 1694000 - protein, 23 aa, Staphylococcus aureus
ALEIGATFHIVSLPDSGTRIEVK

SEQ ID NO: 1694001 - protein, 17 aa, Staphylococcus aureus
ALEQLKAQRINPEVKKN

SEQ ID NO: 1694002 - protein, 17 aa, Staphylococcus aureus
ALFEKMSFATTLNHILS

SEQ ID NO: 1694003 - protein, 22 aa, Staphylococcus aureus
ALHAIQLLSIGFLGQDAIIISN

SEQ ID NO: 1694004 - protein, 22 aa, Staphylococcus aureus
ALHEALLCLDATTGQNALSQAR

SEQ ID NO: 1694005 - protein, 18 aa, Staphylococcus aureus
ALHWHEDMFQIPQQAELL

SEQ ID NO: 1694006 - protein, 28 aa, Staphylococcus aureus
ALILPGNDQIFWLPIQKINNSEYSVYFQ

SEQ ID NO: 1694007 - protein, 26 aa, Staphylococcus aureus
ALKIELDFYFPLLKSWSKKKKSEMVG

SEQ ID NO: 1694008 - protein, 24 aa, Staphylococcus aureus
ALKIKGMVLYMNRNTKTTKGYYYV

SEQ ID NO: 1694009 - protein, 23 aa, Staphylococcus aureus
ALKYLIEGSNFTTGWIFFINSVG

SEQ ID NO: 1694010 - protein, 18 aa, Staphylococcus aureus
ALNRAMDQLSQEITGNEG

SEQ ID NO: 1694011 - protein, 22 aa, Staphylococcus aureus
ALNRVMDQLSQGITGNEGRTKG

SEQ ID NO: 1694012 - protein, 25 aa, Staphylococcus aureus
ALNVNEAWLMGFDISKNRKIENNDI

SEQ ID NO: 1694013 - protein, 21 aa, Staphylococcus aureus
ALPGKYFIFKDLQIEEYQSKE

SEQ ID NO: 1694014 - protein, 20 aa, Staphylococcus aureus
ALPLHQSAIQWIWETVKQEG

SEQ ID NO: 1694015 - protein, 17 aa, Staphylococcus aureus
ALQKLKSLGLKDVTIEK

SEQ ID NO: 1694016 - protein, 22 aa, Staphylococcus aureus
ALQNMLNQYPGFKVAMEPFGEY

SEQ ID NO: 1694017 - protein, 19 aa, Staphylococcus aureus
ALQQIQNIATNKINLIKAN

SEQ ID NO: 1694018 - protein, 20 aa, Staphylococcus aureus
ALQQIQNIATNKINLIKANN

SEQ ID NO: 1694019 - protein, 20 aa, Staphylococcus aureus
ALREGLPLRSEYHEQYLKDA

SEQ ID NO: 1694020 - protein, 31 aa, Staphylococcus aureus
ALRQELDLFTCLRPVRWFKGVPSPVKRPQDV

SEQ ID NO: 1694021 - protein, 25 aa, Staphylococcus aureus
ALSENDYFEYIDKKSFLRYDCEVKG

SEQ ID NO: 1694022 - protein, 23 aa, Staphylococcus aureus
ALSFGMYPKVAMLSFSTKGSAKS

SEQ ID NO: 1694023 - protein, 27 aa, Staphylococcus aureus
ALTNIVLNRMRGTFTVVAVKAPGFGDR

SEQ ID NO: 1694024 - protein, 20 aa, Staphylococcus aureus
ALTPLKYKDTFIINNKFINC

SEQ ID NO: 1694025 - protein, 19 aa, Staphylococcus aureus
ALTVYELLMNKCYLGLHSH

SEQ ID NO: 1694026 - protein, 17 aa, Staphylococcus aureus
ALVEKLKTLIPRQQFEV

SEQ ID NO: 1694027 - protein, 26 aa, Staphylococcus aureus
ALVSTPSYDVYPFMYGMSNEEYNKLT

SEQ ID NO: 1694028 - protein, 20 aa, Staphylococcus aureus
ALVTPMTFNNPRRMATGIDH

SEQ ID NO: 1694029 - protein, 19 aa, Staphylococcus aureus
ALYHNFAGFGLNIFDNHKA

SEQ ID NO: 1694030 - protein, 23 aa, Staphylococcus aureus
ALYIKTYLPIFNQIDAKYLHDTQ

SEQ ID NO: 1694031 - protein, 24 aa, Staphylococcus aureus
ALYKLETLQLQYVSSGLQSAVVVV

SEQ ID NO: 1694032 - protein, 30 aa, Staphylococcus aureus
ALYRQQMVGFVFQYFNLLPTMTNKENIMMP

SEQ ID NO: 1694033 - protein, 17 aa, Staphylococcus aureus
AMAPCPYIYAELAKRSQ

SEQ ID NO: 1694034 - protein, 25 aa, Staphylococcus aureus
AMDAAKAMWMFFEHPETSFFGAKQK

SEQ ID NO: 1694035 - protein, 28 aa, Staphylococcus aureus
AMEKKNVQRLIFVTALGIYDEVPGAFGK

SEQ ID NO: 1694036 - protein, 20 aa, Staphylococcus aureus
AMGNLRQAVADKDQVKRTED

SEQ ID NO: 1694037 - protein, 22 aa, Staphylococcus aureus
AMGNLRQAVADKDQVKRTEDYA

SEQ ID NO: 1694038 - protein, 23 aa, Staphylococcus aureus
AMGRDCGDLTLWAGLSVGAETIV

SEQ ID NO: 1694039 - protein, 17 aa, Staphylococcus aureus
AMHLADFFDVPYEMFLE

SEQ ID NO: 1694040 - protein, 24 aa, Staphylococcus aureus
AMHYSDIYSLFKRLKHKTSINVHP

SEQ ID NO: 1694041 - protein, 18 aa, Staphylococcus aureus
AMISYFNGVAQLRQHIKK

SEQ ID NO: 1694042 - protein, 20 aa, Staphylococcus aureus
AMITDILPNFQFIGNGKGLA

SEQ ID NO: 1694043 - protein, 24 aa, Staphylococcus aureus
AMLKLAYIDLNEYLKTLQLKQQQL

SEQ ID NO: 1694044 - protein, 28 aa, Staphylococcus aureus
AMLNEGYQFFGVLYIGAILTKDGPKVIE

SEQ ID NO: 1694045 - protein, 21 aa, Staphylococcus aureus
AMLPKSIWENFKSQNFKNMIN

SEQ ID NO: 1694046 - protein, 26 aa, Staphylococcus aureus
AMPGFTAFSMYPKLWGNMGLSYPELI

SEQ ID NO: 1694047 - protein, 25 aa, Staphylococcus aureus
AMRESFHTVLPLNRNFLSAFTQQNM

SEQ ID NO: 1694048 - protein, 18 aa, Staphylococcus aureus
AMSNLQRGINDEAATKAA

SEQ ID NO: 1694049 - protein, 19 aa, Staphylococcus aureus
AMVNAIRLGEQFDSLLPDS

SEQ ID NO: 1694050 - protein, 21 aa, Staphylococcus aureus
ANCPKQYLAYVLSKHGFTCKK

SEQ ID NO: 1694051 - protein, 26 aa, Staphylococcus aureus
ANIQCDQLIILTAIDYVYINFNTENQ

SEQ ID NO: 1694052 - protein, 23 aa, Staphylococcus aureus
ANIRDFASVGLLFRKNDDYIWLG

SEQ ID NO: 1694053 - protein, 19 aa, Staphylococcus aureus
ANLTHLNDAQKQSFESQIT

SEQ ID NO: 1694054 - protein, 24 aa, Staphylococcus aureus
ANNRFSHVAFIKPNNGKTTSVTVT

SEQ ID NO: 1694055 - protein, 20 aa, Staphylococcus aureus
ANRIGALYIGGKSTADIIMS

SEQ ID NO: 1694056 - protein, 19 aa, Staphylococcus aureus
ANRVLKLYNLTMKISREQL

SEQ ID NO: 1694057 - protein, 17 aa, Staphylococcus aureus
ANTAIDGLTSLNGPQKA

SEQ ID NO: 1694058 - protein, 24 aa, Staphylococcus aureus
ANTAIDQLPNLNQPQKTALKDQVS

SEQ ID NO: 1694059 - protein, 23 aa, Staphylococcus aureus
ANTLNLAMHGLRESIQDNAATKA

SEQ ID NO: 1694060 - protein, 19 aa, Staphylococcus aureus
ANVVLYYKINRNNNLFVQD

SEQ ID NO: 1694061 - protein, 18 aa, Staphylococcus aureus
APFLLIGDPRVEGGSFYI

SEQ ID NO: 1694062 - protein, 24 aa, Staphylococcus aureus
APGMKYKHYSPNTPLTIIADIESK

SEQ ID NO: 1694063 - protein, 30 aa, Staphylococcus aureus
APGPLSHSLTLYALLFALSSGRNFIGQTTF

SEQ ID NO: 1694064 - protein, 26 aa, Staphylococcus aureus
APIKETLAASLIRLANWKGDTPLIDP

SEQ ID NO: 1694065 - protein, 17 aa, Staphylococcus aureus
APLANPNVKLSANALFK

SEQ ID NO: 1694066 - protein, 24 aa, Staphylococcus aureus
APSFNKPVLVLRRVTERPEGVEAG

SEQ ID NO: 1694067 - protein, 17 aa, Staphylococcus aureus
APSNLAIMGRYVLTPEI

SEQ ID NO: 1694068 - protein, 26 aa, Staphylococcus aureus
APTVKAIFHYYLQDYGYKKIAQYLET

SEQ ID NO: 1694069 - protein, 17 aa, Staphylococcus aureus
AQALNEAMKALKESIKD

SEQ ID NO: 1694070 - protein, 23 aa, Staphylococcus aureus
AQDRHIPALLKLKDTVALVAVQD

SEQ ID NO: 1694071 - protein, 25 aa, Staphylococcus aureus
AQEHYQMTIVFITHDINLVKDYATH

SEQ ID NO: 1694072 - protein, 17 aa, Staphylococcus aureus
AQGLEAFDNIQIDSTEK

SEQ ID NO: 1694073 - protein, 17 aa, Staphylococcus aureus
AQHMNFQFVGTYGPNKD

SEQ ID NO: 1694074 - protein, 24 aa, Staphylococcus aureus
AQHPQYVVRPFIDKIKHFQEIANG

SEQ ID NO: 1694075 - protein, 23 aa, Staphylococcus aureus
AQHPQYVVRPFIDKIKHFQETAN

SEQ ID NO: 1694076 - protein, 24 aa, Staphylococcus aureus
AQIENRYQQIDLLWQEIESFDDDN

SEQ ID NO: 1694077 - protein, 20 aa, Staphylococcus aureus
AQISYHFNYYGPIGNQRDLY

SEQ ID NO: 1694078 - protein, 23 aa, Staphylococcus aureus
AQIYGFIVGSGLRGPLHKGLPTI

SEQ ID NO: 1694079 - protein, 26 aa, Staphylococcus aureus
AQKLSFNQLFLMFDQLTEAHKKLNQN

SEQ ID NO: 1694080 - protein, 26 aa, Staphylococcus aureus
AQKLSFNQLILMFDKLTEAHKKLNQN

SEQ ID NO: 1694081 - protein, 22 aa, Staphylococcus aureus
AQKNNLISQISSATRVSGVDTV

SEQ ID NO: 1694082 - protein, 18 aa, Staphylococcus aureus
AQKNNLISQITSATRVSG

SEQ ID NO: 1694083 - protein, 22 aa, Staphylococcus aureus
AQNDFLFDRVKVVVATNAFGMG

SEQ ID NO: 1694084 - protein, 24 aa, Staphylococcus aureus
AQNETLHQFPIDNLFPLMGQTITT

SEQ ID NO: 1694085 - protein, 23 aa, Staphylococcus aureus
AQNIKYILYVRQQLQVFPMCVEF

SEQ ID NO: 1694086 - protein, 27 aa, Staphylococcus aureus
AQQTYAKFKAIATPEQLAKVKALIDQY

SEQ ID NO: 1694087 - protein, 20 aa, Staphylococcus aureus
AQRILYSAFDLVEQRSGRDA

SEQ ID NO: 1694088 - protein, 18 aa, Staphylococcus aureus
AQRINPEVKKNALEAIRE

SEQ ID NO: 1694089 - protein, 21 aa, Staphylococcus aureus
AQSHPVCHYIYDLVGLEHHLQ

SEQ ID NO: 1694090 - protein, 17 aa, Staphylococcus aureus
AQSPGLKIVIPSGPYDA

SEQ ID NO: 1694091 - protein, 26 aa, Staphylococcus aureus
AQSQFNLPMRYIWGIYEPQSDDQNMN

SEQ ID NO: 1694092 - protein, 22 aa, Staphylococcus aureus
ARELIRLIQQLRKKKNLPINQR

SEQ ID NO: 1694093 - protein, 26 aa, Staphylococcus aureus
ARFAGAALRFLTGPIGATITAITIAY

SEQ ID NO: 1694094 - protein, 25 aa, Staphylococcus aureus
ARFAGVALRFLTGPIGSTITAITIA

SEQ ID NO: 1694095 - protein, 25 aa, Staphylococcus aureus
ARGLGIALRFITGPIGATITAITIA

SEQ ID NO: 1694096 - protein, 17 aa, Staphylococcus aureus
ARIDELIDEDVFKLITN

SEQ ID NO: 1694097 - protein, 25 aa, Staphylococcus aureus
ARIGRSLGIHLILATQKPSGVVDDQ

SEQ ID NO: 1694098 - protein, 22 aa, Staphylococcus aureus
ARLNPWLLKIYEKRGYEIYREH

SEQ ID NO: 1694099 - protein, 18 aa, Staphylococcus aureus
ARLRWYQGRYIDFDGWHG

SEQ ID NO: 1694100 - protein, 30 aa, Staphylococcus aureus
ARMDEYVVLRLYGPGTWYGKDGMIYNQFMD

SEQ ID NO: 1694101 - protein, 23 aa, Staphylococcus aureus
ARQGLTLDRQPAFTTLHGASNLN

SEQ ID NO: 1694102 - protein, 19 aa, Staphylococcus aureus
ARSIIAIAVGYPNKLKGAP

SEQ ID NO: 1694103 - protein, 27 aa, Staphylococcus aureus
ARTKIQEIDRVLASHPDVATIRQNVTA

SEQ ID NO: 1694104 - protein, 17 aa, Staphylococcus aureus
ARVFANLDLNITKARAQ

SEQ ID NO: 1694105 - protein, 18 aa, Staphylococcus aureus
ARWIPTVEKIMKDLGGSE

SEQ ID NO: 1694106 - protein, 25 aa, Staphylococcus aureus
ASARPIRDLLPVLPSVFHQHTLIGA

SEQ ID NO: 1694107 - protein, 26 aa, Staphylococcus aureus
ASDGVAIAKAYLLVEPDLTFDKNEKV

SEQ ID NO: 1694108 - protein, 17 aa, Staphylococcus aureus
ASDLKIYELLDEKGKPT

SEQ ID NO: 1694109 - protein, 17 aa, Staphylococcus aureus
ASDYAIRLLEDKALYNK

SEQ ID NO: 1694110 - protein, 17 aa, Staphylococcus aureus
ASDYILRKMVASMQKQV

SEQ ID NO: 1694111 - protein, 25 aa, Staphylococcus aureus
ASEFETLRFYQLPKFLFEDEYFSKM

SEQ ID NO: 1694112 - protein, 24 aa, Staphylococcus aureus
ASFDMGFIDTGYERLGFGPSTNGV

SEQ ID NO: 1694113 - protein, 17 aa, Staphylococcus aureus
ASFIRLANPSKNTAKEM

SEQ ID NO: 1694114 - protein, 20 aa, Staphylococcus aureus
ASFNPKPVASLTALTTLILD

SEQ ID NO: 1694115 - protein, 32 aa, Staphylococcus aureus
ASFVEKFANFFKMLWLRLKAMKHYKALNKESK

SEQ ID NO: 1694116 - protein, 17 aa, Staphylococcus aureus
ASGDYIKLVMKLGIEYF

SEQ ID NO: 1694117 - protein, 22 aa, Staphylococcus aureus
ASGDYIKLVMKLGIEYFLPVKD

SEQ ID NO: 1694118 - protein, 19 aa, Staphylococcus aureus
ASGFLALIEAGPDKINNYS

SEQ ID NO: 1694119 - protein, 20 aa, Staphylococcus aureus
ASGFLALIEAGPDKINNYSK

SEQ ID NO: 1694120 - protein, 18 aa, Staphylococcus aureus
ASGLPSYVYTFLGFLPRK

SEQ ID NO: 1694121 - protein, 30 aa, Staphylococcus aureus
ASGLPSYVYTFLGFLPRKEKEKSAVLEQRM

SEQ ID NO: 1694122 - protein, 23 aa, Staphylococcus aureus
ASIYHFHFNYIDNAYDLAYYHYW

SEQ ID NO: 1694123 - protein, 18 aa, Staphylococcus aureus
ASKIAQYIRKDILEKTHL

SEQ ID NO: 1694124 - protein, 18 aa, Staphylococcus aureus
ASKIAQYIRKDILENTHL

SEQ ID NO: 1694125 - protein, 18 aa, Staphylococcus aureus
ASKRWIRYIHEVEEPDSL

SEQ ID NO: 1694126 - protein, 23 aa, Staphylococcus aureus
ASNDWFFDKMSNLGFEHTGFHKG

SEQ ID NO: 1694127 - protein, 31 aa, Staphylococcus aureus
ASNLANMNFLRWVNFPQDYTVTWTNAKIANR

SEQ ID NO: 1694128 - protein, 38 aa, Staphylococcus aureus; identical to SEQ ID NO: 1592509

SEQ ID NO: 1694129 - protein, 18 aa, Staphylococcus aureus
ASNLLGEPLTIGGPNSVL

SEQ ID NO: 1694130 - protein, 22 aa, Staphylococcus aureus
ASPDKQGAYTDAYNAAKNIVNG

SEQ ID NO: 1694131 - protein, 22 aa, Staphylococcus aureus
ASRLFIPLTVGGGIQSLDDITQ

SEQ ID NO: 1694132 - protein, 27 aa, Staphylococcus aureus
ASRREHLVLKVIPALKEGKIVLCDRYI

SEQ ID NO: 1694133 - protein, 21 aa, Staphylococcus aureus
ASRREHLVLKVVPALKEGKVV

SEQ ID NO: 1694134 - protein, 24 aa, Staphylococcus aureus
ASSDGIWMPIDEKGYFNFDFKTKR

SEQ ID NO: 1694135 - protein, 25 aa, Staphylococcus aureus
ASTYRKQFCKLLLKSTKVSVIKGNA

SEQ ID NO: 1694136 - protein, 20 aa, Staphylococcus aureus
ASVILNNLYKQTPLQTSFGV

SEQ ID NO: 1694137 - protein, 18 aa, Staphylococcus aureus
ASVSGRYYAMDRDKRWER

SEQ ID NO: 1694138 - protein, 17 aa, Staphylococcus aureus
ASVYGKLNIMFPMVATI

SEQ ID NO: 1694139 - protein, 25 aa, Staphylococcus aureus
ASYISDFINGYFLGNPIQCQDDDKD

SEQ ID NO: 1694140 - protein, 26 aa, Staphylococcus aureus
ATADLTIGLVLAIARRIVEGDQLSRT

SEQ ID NO: 1694141 - protein, 28 aa, Staphylococcus aureus
ATAKLNAKTYLNTLTSITDAQKNNLISQ

SEQ ID NO: 1694142 - protein, 23 aa, Staphylococcus aureus
ATALTFSLISITGVTTLPCSTGL

SEQ ID NO: 1694143 - protein, 25 aa, Staphylococcus aureus
ATEEQMLYFGLPRINKYYTAERATV

SEQ ID NO: 1694144 - protein, 28 aa, Staphylococcus aureus
ATEFEIITAMMFLYFGETHPVDFVIVEA

SEQ ID NO: 1694145 - protein, 30 aa, Staphylococcus aureus; identical to SEQ ID NO: 1593576

SEQ ID NO: 1694146 - protein, 30 aa, Staphylococcus aureus; identical to SEQ ID NO: 1595267

SEQ ID NO: 1694147 - protein, 28 aa, Staphylococcus aureus
ATELNTAMTALKRAIADKAETKASGNYV

SEQ ID NO: 1694148 - protein, 29 aa, Staphylococcus aureus
ATELNTAMTALKRAIADKAETKASGNYVN

SEQ ID NO: 1694149 - protein, 23 aa, Staphylococcus aureus
ATETLNNLSNLNTPQRQALENQI

SEQ ID NO: 1694150 - protein, 17 aa, Staphylococcus aureus
ATFIRGYGNYSGEETFE

SEQ ID NO: 1694151 - protein, 28 aa, Staphylococcus aureus
ATIVMALYQMFHLLPSFSVAYGATASGL

SEQ ID NO: 1694152 - protein, 21 aa, Staphylococcus aureus
ATKALVNFTDADQAKQQAYNT

SEQ ID NO: 1694153 - protein, 25 aa, Staphylococcus aureus
ATKDDFLIFKKINHQHWEAFQQNKL

SEQ ID NO: 1694154 - protein, 22 aa, Staphylococcus aureus
ATLNLQTIHDLDVHPIKKPDAE

SEQ ID NO: 1694155 - protein, 24 aa, Staphylococcus aureus
ATMPLYLNALSVKVTYLITTNDYL

SEQ ID NO: 1694156 - protein, 20 aa, Staphylococcus aureus
ATPFLLGKIVEKTNGKSLAA

SEQ ID NO: 1694157 - protein, 27 aa, Staphylococcus aureus
ATPKVSGALALIIDKYHLEKHPDKAIE

SEQ ID NO: 1694158 - protein, 17 aa, Staphylococcus aureus
ATPNACWVANKLGLKSM

SEQ ID NO: 1694159 - protein, 21 aa, Staphylococcus aureus
ATQKYNIIKPFILGNQSLSSI

SEQ ID NO: 1694160 - protein, 19 aa, Staphylococcus aureus
ATRIGASAGVQIMQGLEAD

SEQ ID NO: 1694161 - protein, 30 aa, Staphylococcus aureus
ATSLNTAMGNLKHALAEKDNTKRSVNYTDA

SEQ ID NO: 1694162 - protein, 25 aa, Staphylococcus aureus
ATTNSAFLIYLFAKDLPNHDELMTQ

SEQ ID NO: 1694163 - protein, 24 aa, Staphylococcus aureus
ATTSFNVTIKPLRDKYRVGTSSTA

SEQ ID NO: 1694164 - protein, 18 aa, Staphylococcus aureus
ATTYIFKMHKLNKKGRKK

SEQ ID NO: 1694165 - protein, 22 aa, Staphylococcus aureus
ATVFKNVAMPLILSKKSKTEIK

SEQ ID NO: 1694166 - protein, 21 aa, Staphylococcus aureus
ATVISGLKGPLSTLGGGVMNS

SEQ ID NO: 1694167 - protein, 36 aa, Staphylococcus aureus
ATVWSTRYLNLGLNNKFIISSWLGTMGCGLPGAMAS

SEQ ID NO: 1694168 - protein, 20 aa, Staphylococcus aureus
ATYDIPRFDKSPYDGFAIRS

SEQ ID NO: 1694169 - protein, 20 aa, Staphylococcus aureus
AVAEMKLAVGLLVDKKLSYM

SEQ ID NO: 1694170 - protein, 26 aa, Staphylococcus aureus
AVAGNVLRFQPPLVITYEQLDTALNT

SEQ ID NO: 1694171 - protein, 27 aa, Staphylococcus aureus
AVASSRDIILFSLLLAAKGIKGAVSDS

SEQ ID NO: 1694172 - protein, 25 aa, Staphylococcus aureus
AVDLKVILEYGESAPKIFRKVTELV

SEQ ID NO: 1694173 - protein, 26 aa, Staphylococcus aureus
AVEGIPAGLLTYPPLMAADIVLYNTN

SEQ ID NO: 1694174 - protein, 17 aa, Staphylococcus aureus
AVEYLIKDCYIWLYIFF

SEQ ID NO: 1694175 - protein, 32 aa, Staphylococcus aureus
AVEYLIKDCYIWLYIFFLKKDKNFFEDHIYIK

SEQ ID NO: 1694176 - protein, 17 aa, Staphylococcus aureus
AVFISHESIGYLADCYG

SEQ ID NO: 1694177 - protein, 22 aa, Staphylococcus aureus
AVFQKVYLFNDTIENNILFGNP

SEQ ID NO: 1694178 - protein, 19 aa, Staphylococcus aureus
AVGLFFSKERILGSEHEAI

SEQ ID NO: 1694179 - protein, 32 aa, Staphylococcus aureus
AVHTSKPMIRKGPNIKLPSVSLLEEPQVIESD

SEQ ID NO: 1694180 - protein, 21 aa, Staphylococcus aureus
AVKPPIIYGDVKWTAPLTVDE

SEQ ID NO: 1694181 - protein, 19 aa, Staphylococcus aureus
AVLLLIMEKDMAYELDFEH

SEQ ID NO: 1694182 - protein, 24 aa, Staphylococcus aureus
AVMQSFWVDPKTKIIYMTQARPGN

SEQ ID NO: 1694183 - protein, 25 aa, Staphylococcus aureus
AVMTNLNAYFKPEILNRMDDIVLFK

SEQ ID NO: 1694184 - protein, 26 aa, Staphylococcus aureus
AVMVGIIYQFIVANALFDSKYDINHY

SEQ ID NO: 1694185 - protein, 19 aa, Staphylococcus aureus
AVNITRLRKKLQKLGLTDF

SEQ ID NO: 1694186 - protein, 27 aa, Staphylococcus aureus
AVPAIPKLFDYIHKRYAKLSLEDLINP

SEQ ID NO: 1694187 - protein, 28 aa, Staphylococcus aureus
AVRAGHHCAQPLMKWLNVSSTARASLYI

SEQ ID NO: 1694188 - protein, 26 aa, Staphylococcus aureus
AVRKNLNIIQLIWNDGKYNMVEFQEE

SEQ ID NO: 1694189 - protein, 19 aa, Staphylococcus aureus
AVSRLIGAPLGYIGHDEGG

SEQ ID NO: 1694190 - protein, 22 aa, Staphylococcus aureus
AVSTSVLYLIEDIPQHAQDLKE

SEQ ID NO: 1694191 - protein, 34 aa, Staphylococcus aureus
AVVDQIHTGCYYIQRFLARAFGFEVDDIKAMSEV

SEQ ID NO: 1694192 - protein, 19 aa, Staphylococcus aureus
AVVKQLLEDGWYVSALTRN

SEQ ID NO: 1694193 - protein, 17 aa, Staphylococcus aureus
AVVTLDPKNRRIAAGPE

SEQ ID NO: 1694194 - protein, 19 aa, Staphylococcus aureus
AVVYSWLNGMPTEDILIAG

SEQ ID NO: 1694195 - protein, 19 aa, Staphylococcus aureus
AVVYSWLNGMSTEDILIAG

SEQ ID NO: 1694196 - protein, 20 aa, Staphylococcus aureus
AVYGLNFLIQNDLARLKAHY

SEQ ID NO: 1694197 - protein, 20 aa, Staphylococcus aureus
AWHRFKYYVVVNHLGHLVST

SEQ ID NO: 1694198 - protein, 20 aa, Staphylococcus aureus
AYAFIKRLIKQFGKPQKVIT

SEQ ID NO: 1694199 - protein, 25 aa, Staphylococcus aureus
AYAQNLMLLLYEAGIGTCWKSPLYI

SEQ ID NO: 1694200 - protein, 17 aa, Staphylococcus aureus
AYDLTLNGSAKLNNMTS

SEQ ID NO: 1694201 - protein, 21 aa, Staphylococcus aureus
AYEFLIGRFAATAGKKAGEFY

SEQ ID NO: 1694202 - protein, 17 aa, Staphylococcus aureus
AYELGVSKAFKPIMENT

SEQ ID NO: 1694203 - protein, 20 aa, Staphylococcus aureus
AYELYKQFQKLRNIFKEEGH

SEQ ID NO: 1694204 - protein, 21 aa, Staphylococcus aureus
AYHKDTEDFYISLKIVDVKQP

SEQ ID NO: 1694205 - protein, 21 aa, Staphylococcus aureus
AYLKVAYQFSLPFGKDYADAH

SEQ ID NO: 1694206 - protein, 21 aa, Staphylococcus aureus
AYLPIYAIQNHLCECGIAGEV

SEQ ID NO: 1694207 - protein, 25 aa, Staphylococcus aureus
AYLVDLLENFVLERGIYGKRWLDDE

SEQ ID NO: 1694208 - protein, 18 aa, Staphylococcus aureus
AYLVMTYLEGGASGSQRQ

SEQ ID NO: 1694209 - protein, 24 aa, Staphylococcus aureus
AYNDFVQPLKPYLRQDPENGHIAD

SEQ ID NO: 1694210 - protein, 21 aa, Staphylococcus aureus
AYPILKKYKIPATGFIITGHV

SEQ ID NO: 1694211 - protein, 20 aa, Staphylococcus aureus
AYRYLERYTDPLTGKYKTVS

SEQ ID NO: 1694212 - protein, 20 aa, Staphylococcus aureus
AYTAKLYYNIPNGYKYYSLY

SEQ ID NO: 1694213 - protein, 19 aa, Staphylococcus aureus
CAFYVLHTRVMCLLTCVYF

SEQ ID NO: 1694214 - protein, 26 aa, Staphylococcus aureus
CEADDWKPFYEAYGSHFEDIEIEMDR

SEQ ID NO: 1694215 - protein, 29 aa, Staphylococcus aureus
CEELFKAKLLLLVYLKIIPNINSFYQSDL

SEQ ID NO: 1694216 - protein, 17 aa, Staphylococcus aureus
CETIYEIKNFLTSNIRV

SEQ ID NO: 1694217 - protein, 17 aa, Staphylococcus aureus
CEYRRHFLSYKPDYAIM

SEQ ID NO: 1694218 - protein, 18 aa, Staphylococcus aureus
CEYTYAMPIAILIRHTMS

SEQ ID NO: 1694219 - protein, 17 aa, Staphylococcus aureus
CFELLSMVTYADKLKSL

SEQ ID NO: 1694220 - protein, 17 aa, Staphylococcus aureus
CFFKGKLPDNRKKKRTD

SEQ ID NO: 1694221 - protein, 25 aa, Staphylococcus aureus
CGDTKVIDYCPIDQIKLSLPGVNIH

SEQ ID NO: 1694222 - protein, 18 aa, Staphylococcus aureus
CGKFMIKVKTKNGQMLVC

SEQ ID NO: 1694223 - protein, 24 aa, Staphylococcus aureus
CGSPMVIKMGRYGKFMACSNFPDC

SEQ ID NO: 1694224 - protein, 27 aa, Staphylococcus aureus
CHDEIDLLRLLHSQGLSFILLNQFNDI

SEQ ID NO: 1694225 - protein, 24 aa, Staphylococcus aureus
CHVNDYIIYSFALLWGQFACKPPM

SEQ ID NO: 1694226 - protein, 25 aa, Staphylococcus aureus
CINSAAIQFIPYEKLEELGYVDLIS

SEQ ID NO: 1694227 - protein, 17 aa, Staphylococcus aureus
CIYKDSLIQLKRGLSFE

SEQ ID NO: 1694228 - protein, 25 aa, Staphylococcus aureus
CKELSTILKFSFGIAPRKVEYGDIK

SEQ ID NO: 1694229 - protein, 22 aa, Staphylococcus aureus
CKIAFLINDLNITAIQKLKRLI

SEQ ID NO: 1694230 - protein, 23 aa, Staphylococcus aureus
CKIAFLINDLNITAIQKLKRLIV

SEQ ID NO: 1694231 - protein, 19 aa, Staphylococcus aureus
CKIAFLINDLNTTAIQKLK

SEQ ID NO: 1694232 - protein, 18 aa, Staphylococcus aureus
CKTFYYMYRRNRDSELIE

SEQ ID NO: 1694233 - protein, 17 aa, Staphylococcus aureus
CKVTPLHMFYTEETYEE

SEQ ID NO: 1694234 - protein, 17 aa, Staphylococcus aureus
CLAKYFNKQMPPEEWIC

SEQ ID NO: 1694235 - protein, 31 aa, Staphylococcus aureus
CLAQQDIFRPQLRALLRASVYGKLNIMFPMV

SEQ ID NO: 1694236 - protein, 21 aa, Staphylococcus aureus
CLKIKYMFPKAHAAAYVLMAV

SEQ ID NO: 1694237 - protein, 29 aa, Staphylococcus aureus
CLLTEARIFKFYKYFYSHRGPLFDYFDAK

SEQ ID NO: 1694238 - protein, 19 aa, Staphylococcus aureus
CLLTKHAHLNFSNIFILIA

SEQ ID NO: 1694239 - protein, 22 aa, Staphylococcus aureus
CLNLAQLIYDTGFLTGIYHGDM

SEQ ID NO: 1694240 - protein, 17 aa, Staphylococcus aureus
CLQILKSILKPEGILCF

SEQ ID NO: 1694241 - protein, 17 aa, Staphylococcus aureus
CPHGRPIIINFSKYELE

SEQ ID NO: 1694242 - protein, 17 aa, Staphylococcus aureus
CPNRNIFVVGGPGSYKS

SEQ ID NO: 1694243 - protein, 23 aa, Staphylococcus aureus
CPTGKVLFFHEGVSMNMILAKKE

SEQ ID NO: 1694244 - protein, 23 aa, Staphylococcus aureus
CQINYVKPILINENIKFIEEHEQ

SEQ ID NO: 1694245 - protein, 19 aa, Staphylococcus aureus
CQTHPFSQLLHDAIHLAFD

SEQ ID NO: 1694246 - protein, 25 aa, Staphylococcus aureus
CQTHPFSQLLHDAIHLAFDNGITCV

SEQ ID NO: 1694247 - protein, 24 aa, Staphylococcus aureus
CREELKMARLYRQAKFPVRRTLDN

SEQ ID NO: 1694248 - protein, 31 aa, Staphylococcus aureus
CSGLAQKGFKPYFSTFAPFVALRCAESLKLS

SEQ ID NO: 1694249 - protein, 30 aa, Staphylococcus aureus
CSIKGDKFLYYFLEWFATQNKWIRFSQGST

SEQ ID NO: 1694250 - protein, 21 aa, Staphylococcus aureus
CSNNRWLQRYDLISERNHFNY

SEQ ID NO: 1694251 - protein, 25 aa, Staphylococcus aureus
CTAREIPIDKLMIDRIYVNVTGSFT

SEQ ID NO: 1694252 - protein, 23 aa, Staphylococcus aureus
CTKNLGLYQKWNMKWKKLKKSNN

SEQ ID NO: 1694253 - protein, 28 aa, Staphylococcus aureus
CWDVPNYILERYWGFRTWGNANAMAQKS

SEQ ID NO: 1694254 - protein, 18 aa, Staphylococcus aureus
CWGPPQLAHYCKLTFRQL

SEQ ID NO: 1694255 - protein, 21 aa, Staphylococcus aureus
CWKSPLYIYDLKVRKTLGIKK

SEQ ID NO: 1694256 - protein, 18 aa, Staphylococcus aureus
CWKSPLYIYDPKVRKTLG

SEQ ID NO: 1694257 - protein, 18 aa, Staphylococcus aureus
CYDYANMFFMLATGERLQ

SEQ ID NO: 1694258 - protein, 21 aa, Staphylococcus aureus
CYHLLRLITTLYTKGGINMMQ

SEQ ID NO: 1694259 - protein, 17 aa, Staphylococcus aureus
CYQFNVPFVVVRAVSDL

SEQ ID NO: 1694260 - protein, 18 aa, Staphylococcus aureus
CYQFNVPFVVVRAVSDLA

SEQ ID NO: 1694261 - protein, 20 aa, Staphylococcus aureus
DAAIQLMINIKYVNAGTVEF

SEQ ID NO: 1694262 - protein, 19 aa, Staphylococcus aureus
DAAMDKLRQSIADNATTKQ

SEQ ID NO: 1694263 - protein, 18 aa, Staphylococcus aureus
DAARYFLTMRSPDSHFDF

SEQ ID NO: 1694264 - protein, 23 aa, Staphylococcus aureus
DAEDIFEVVWAKIEVAYQSQKDI

SEQ ID NO: 1694265 - protein, 24 aa, Staphylococcus aureus
DAFGAYLHMGGRIGVLAVVEGSTD

SEQ ID NO: 1694266 - protein, 21 aa, Staphylococcus aureus
DAFGAYLHMGGRIGVLTVVEG

SEQ ID NO: 1694267 - protein, 30 aa, Staphylococcus aureus
DAFNKTLEQPVLYPGWNRFKSNKVMKQITF

SEQ ID NO: 1694268 - protein, 19 aa, Staphylococcus aureus
DAIALILAGAIDSPLEILA

SEQ ID NO: 1694269 - protein, 25 aa, Staphylococcus aureus
DAIYQLKKFIGLCNQSIKYNEDILD

SEQ ID NO: 1694270 - protein, 24 aa, Staphylococcus aureus
DAKKGFLLDGFPRTIEQAEALNNI

SEQ ID NO: 1694271 - protein, 33 aa, Staphylococcus aureus
DAKKSTPIKVYLNGNFEGITYPESFKVFGSEQS

SEQ ID NO: 1694272 - protein, 18 aa, Staphylococcus aureus
DALKAITALKLQMDKELK

SEQ ID NO: 1694273 - protein, 19 aa, Staphylococcus aureus
DALMLCERLYDKGYGCLLN

SEQ ID NO: 1694274 - protein, 20 aa, Staphylococcus aureus
DALPHLYMIGNDTIGLGAIA

SEQ ID NO: 1694275 - protein, 17 aa, Staphylococcus aureus
DALQQSIADKDATRASS

SEQ ID NO: 1694276 - protein, 17 aa, Staphylococcus aureus
DALRQMTHLSDAQKQSI

SEQ ID NO: 1694277 - protein, 20 aa, Staphylococcus aureus
DALRQMTHLSDAQKQSITGQ

SEQ ID NO: 1694278 - protein, 20 aa, Staphylococcus aureus
DALRQMTHLSDAQKQSITVQ

SEQ ID NO: 1694279 - protein, 20 aa, Staphylococcus aureus
DALYQFLFEFIFDIEERYIR

SEQ ID NO: 1694280 - protein, 25 aa, Staphylococcus aureus
DAMTQLKQGIANKAQIKVSENYHDA

SEQ ID NO: 1694281 - protein, 20 aa, Staphylococcus aureus
DANKLFNFTPSNSKKVYTRS

SEQ ID NO: 1694282 - protein, 27 aa, Staphylococcus aureus
DANTEQYYFHLFSKKQPDLNWDNPEVR

SEQ ID NO: 1694283 - protein, 28 aa, Staphylococcus aureus
DANVRAFYEFYSYLMEPWDGPTMISFCN

SEQ ID NO: 1694284 - protein, 24 aa, Staphylococcus aureus
DAQKNNLISQITSATRVSGVDTVK

SEQ ID NO: 1694285 - protein, 23 aa, Staphylococcus aureus
DARRQAVYAGIFQWQNGQLVTIL

SEQ ID NO: 1694286 - protein, 24 aa, Staphylococcus aureus
DARRQAVYTGMFQWQNGQLVTILE

SEQ ID NO: 1694287 - protein, 26 aa, Staphylococcus aureus
DASLQGLLRIFPEMIVFSDSKNHASI

SEQ ID NO: 1694288 - protein, 17 aa, Staphylococcus aureus
DASNKVLELMIHNPNID

SEQ ID NO: 1694289 - protein, 30 aa, Staphylococcus aureus
DATGHIVNLYFPFVEVETLLTLLDMAQIYV

SEQ ID NO: 1694290 - protein, 24 aa, Staphylococcus aureus
DATIFLMNAVYEFDLVREHQIHMT

SEQ ID NO: 1694291 - protein, 32 aa, Staphylococcus aureus
DATLTARLIDRPIRPLFPKGYKHDVQIMNMVL

SEQ ID NO: 1694292 - protein, 20 aa, Staphylococcus aureus
DAVQFVNKLFNVSSAIILLE

SEQ ID NO: 1694293 - protein, 18 aa, Staphylococcus aureus
DAVRDLIHFYEVSGVLKK

SEQ ID NO: 1694294 - protein, 17 aa, Staphylococcus aureus
DAWFNYFSTGNSKYYFE

SEQ ID NO: 1694295 - protein, 20 aa, Staphylococcus aureus
DCEYTYAMPIAILIRHMMSF

SEQ ID NO: 1694296 - protein, 26 aa, Staphylococcus aureus
DCNNFKLLLVNYLSKKIYCLENKRIN

SEQ ID NO: 1694297 - protein, 25 aa, Staphylococcus aureus
DCVIHTPLMWLNKAETWKLSDELEV

SEQ ID NO: 1694298 - protein, 21 aa, Staphylococcus aureus
DCWPDLIFPESEIAFIILHFG

SEQ ID NO: 1694299 - protein, 26 aa, Staphylococcus aureus
DDAEIIAWFDAIGKKRGLIRRGNEID

SEQ ID NO: 1694300 - protein, 32 aa, Staphylococcus aureus
DDAKRTAYSQAVNAAATILNKTAGGNTPKADV

SEQ ID NO: 1694301 - protein, 31 aa, Staphylococcus aureus
DDALFILGETLYNFGLIPQGLEVFRVLYHKY

SEQ ID NO: 1694302 - protein, 27 aa, Staphylococcus aureus
DDAYYGLFYEDVYTQSLFTALSNLNSN

SEQ ID NO: 1694303 - protein, 27 aa, Staphylococcus aureus
DDAYYGLFYEDVYTQSLFTALTNLNSN

SEQ ID NO: 1694304 - protein, 19 aa, Staphylococcus aureus
DDDGYFWFEGRRDDIIISS

SEQ ID NO: 1694305 - protein, 24 aa, Staphylococcus aureus
DDEDALKPLIFKTKVTSLEDIEKA

SEQ ID NO: 1694306 - protein, 17 aa, Staphylococcus aureus
DDELFIYNSKNQALTNY

SEQ ID NO: 1694307 - protein, 26 aa, Staphylococcus aureus
DDEPEYQPFIDYINDIFLQEGDITED

SEQ ID NO: 1694308 - protein, 24 aa, Staphylococcus aureus
DDEQLIYLTPSFPQRYTSNTWIYK

SEQ ID NO: 1694309 - protein, 31 aa, Staphylococcus aureus
DDETKYHYFIKLLNLLKYEQVTYLIDANPSI

SEQ ID NO: 1694310 - protein, 25 aa, Staphylococcus aureus
DDFNEYVIVILDKSTIGEKIRLDIK

SEQ ID NO: 1694311 - protein, 24 aa, Staphylococcus aureus
DDHKSLIYRYDATLGTQITTNDIL

SEQ ID NO: 1694312 - protein, 21 aa, Staphylococcus aureus
DDIFQVYLNKIYCSDGVTGIK

SEQ ID NO: 1694313 - protein, 26 aa, Staphylococcus aureus
DDIIISDFLTRYLIYKEKQDSYVKKD

SEQ ID NO: 1694314 - protein, 17 aa, Staphylococcus aureus
DDIIVFHKLTKEELKEI

SEQ ID NO: 1694315 - protein, 29 aa, Staphylococcus aureus
DDIVKNMKPLIVQMLFEPSHYDDIFISRK

SEQ ID NO: 1694316 - protein, 34 aa, Staphylococcus aureus
DDKEILLQEFPEQLTNYLLKYDYRDLEIIKAVIL

SEQ ID NO: 1694317 - protein, 17 aa, Staphylococcus aureus
DDKYHLHDSWLKVDGRL

SEQ ID NO: 1694318 - protein, 21 aa, Staphylococcus aureus
DDLKEEGYITHILGVNAEEGD

SEQ ID NO: 1694319 - protein, 24 aa, Staphylococcus aureus
DDLNSIIDDFFMETKQNRPKSITK

SEQ ID NO: 1694320 - protein, 22 aa, Staphylococcus aureus
DDLPLGIYKFLMTQDKVYARTL

SEQ ID NO: 1694321 - protein, 26 aa, Staphylococcus aureus
DDLWMDLYDLFEELRNLFKEEGLEPW

SEQ ID NO: 1694322 - protein, 25 aa, Staphylococcus aureus
DDNLTMILHEFLPFIEIKQIPSSSA

SEQ ID NO: 1694323 - protein, 25 aa, Staphylococcus aureus
DDNLTMILHEFLPFIEIKQVPTSSA

SEQ ID NO: 1694324 - protein, 23 aa, Staphylococcus aureus
DDNMLFYNFDIYDTNVLYKEIDE

SEQ ID NO: 1694325 - protein, 17 aa, Staphylococcus aureus
DDNQLELLLQHLSNFDL

SEQ ID NO: 1694326 - protein, 25 aa, Staphylococcus aureus
DDQVPDILFIERCYQFLKNKGKMAI

SEQ ID NO: 1694327 - protein, 26 aa, Staphylococcus aureus
DDRCFPIKAFYILNDDLNMTLIWKDG

SEQ ID NO: 1694328 - protein, 17 aa, Staphylococcus aureus
DDRIPINVWTGDSIART

SEQ ID NO: 1694329 - protein, 19 aa, Staphylococcus aureus
DDTALKNMFENYGLIALKD

SEQ ID NO: 1694330 - protein, 29 aa, Staphylococcus aureus
DDTIYYRYFIEETMLYNIHLFMYKGDSME

SEQ ID NO: 1694331 - protein, 24 aa, Staphylococcus aureus
DDTNKLFNFTPYNSKKIYTRSITN

SEQ ID NO: 1694332 - protein, 22 aa, Staphylococcus aureus
DDVDTYHWLPVTFTISKKEMEC

SEQ ID NO: 1694333 - protein, 23 aa, Staphylococcus aureus
DDVENILLRLIQAADFDIDKAEK

SEQ ID NO: 1694334 - protein, 17 aa, Staphylococcus aureus
DDVKNYKFFNSKSNILF

SEQ ID NO: 1694335 - protein, 25 aa, Staphylococcus aureus
DDVVKGFLTYKISKKVIKHAGYVRC

SEQ ID NO: 1694336 - protein, 22 aa, Staphylococcus aureus
DDYIWLGHSFVRKGVLDDVKLE

SEQ ID NO: 1694337 - protein, 23 aa, Staphylococcus aureus
DEAKEYWLCWVTTERNEQGPYYA

SEQ ID NO: 1694338 - protein, 30 aa, Staphylococcus aureus
DEAQSQFNLPMRYIWGIYEPQSDDQNMNET

SEQ ID NO: 1694339 - protein, 31 aa, Staphylococcus aureus
DEAQSQFNLPTRYIWGIYEPQSDDQNMNETR

SEQ ID NO: 1694340 - protein, 24 aa, Staphylococcus aureus
DECIKNMLLYSFIGLINKYSTELN

SEQ ID NO: 1694341 - protein, 24 aa, Staphylococcus aureus
DEDFLNNVINYISGLNLSIENVTH

SEQ ID NO: 1694342 - protein, 27 aa, Staphylococcus aureus
DEDKIEWLLPFLQQSGPTIIYVSSKKV

SEQ ID NO: 1694343 - protein, 23 aa, Staphylococcus aureus
DEEDALKPLIFKTKVTSLEDIDK

SEQ ID NO: 1694344 - protein, 26 aa, Staphylococcus aureus
DEELSGYFLFPRELLIEKGILTTFEH

SEQ ID NO: 1694345 - protein, 28 aa, Staphylococcus aureus
DEERYQIFKPYWDYIQPNGNISVSASVS

SEQ ID NO: 1694346 - protein, 19 aa, Staphylococcus aureus
DEFLIAGFNYEGQLAAALE

SEQ ID NO: 1694347 - protein, 18 aa, Staphylococcus aureus
DEFLIAGFNYEGQLAATL

SEQ ID NO: 1694348 - protein, 20 aa, Staphylococcus aureus
DEFYRLPHALFENPKYQSLA

SEQ ID NO: 1694349 - protein, 31 aa, Staphylococcus aureus
DEIIIPGPIYAGYIPLIEVLGGKPIYIDTTA

SEQ ID NO: 1694350 - protein, 26 aa, Staphylococcus aureus
DEIRESINAQWVEYPEDWASEVLREV

SEQ ID NO: 1694351 - protein, 18 aa, Staphylococcus aureus
DEIVLLEGFMDVIKSDTA

SEQ ID NO: 1694352 - protein, 24 aa, Staphylococcus aureus
DEKKFLETYIKIEKYNESNIYLKD

SEQ ID NO: 1694353 - protein, 23 aa, Staphylococcus aureus
DEKQIYIYNSTWGRGLDIVHDAF

SEQ ID NO: 1694354 - protein, 33 aa, Staphylococcus aureus
DELDDALNYYLFYLKNWNYAYAYSLKLIDAYAS

SEQ ID NO: 1694355 - protein, 22 aa, Staphylococcus aureus
DELIELPQWVLWRAEWNEKQQQ

SEQ ID NO: 1694356 - protein, 23 aa, Staphylococcus aureus
DELIELPQWVLWRAEWNEKQQQY

SEQ ID NO: 1694357 - protein, 18 aa, Staphylococcus aureus
DELQNVTIPAIEAIVPQK

SEQ ID NO: 1694358 - protein, 17 aa, Staphylococcus aureus
DELSICSDYLFVKIKGR

SEQ ID NO: 1694359 - protein, 27 aa, Staphylococcus aureus
DEMQPFYKQLNMKGYFYDFDSLKGMQK

SEQ ID NO: 1694360 - protein, 35 aa, Staphylococcus aureus; identical to SEQ ID NO: 1590301

SEQ ID NO: 1694361 - protein, 21 aa, Staphylococcus aureus
DENYFAFGAYAQNLMLLLYEA

SEQ ID NO: 1694362 - protein, 35 aa, Staphylococcus aureus
DEPILYLEGFNFDNGKAKLFPLSFDNYFKQDEIYD

SEQ ID NO: 1694363 - protein, 24 aa, Staphylococcus aureus
DEQKERIIIYMKYNVKGYKEINFE

SEQ ID NO: 1694364 - protein, 19 aa, Staphylococcus aureus
DEQNIIINFYNEKTIKDVI

SEQ ID NO: 1694365 - protein, 26 aa, Staphylococcus aureus
DERGDLFFELLRFINEKSPQAIFIEN

SEQ ID NO: 1694366 - protein, 26 aa, Staphylococcus aureus
DERITLPEFINPNIKFTMISSIDIAK

SEQ ID NO: 1694367 - protein, 18 aa, Staphylococcus aureus
DERMLSILSLYTQQDIRN

SEQ ID NO: 1694368 - protein, 20 aa, Staphylococcus aureus
DETFISWTRGLTQKFSKGSV

SEQ ID NO: 1694369 - protein, 17 aa, Staphylococcus aureus
DETNAPLYTLNIQTTVS

SEQ ID NO: 1694370 - protein, 26 aa, Staphylococcus aureus
DEVGYYNIPIMSYGVKYASSFFGPFR

SEQ ID NO: 1694371 - protein, 22 aa, Staphylococcus aureus
DEWDSMIDVNIKGTLYTHRLHY

SEQ ID NO: 1694372 - protein, 31 aa, Staphylococcus aureus
DEYIIEMLKNVKTPVFLVLNKIDLVHPDELM

SEQ ID NO: 1694373 - protein, 26 aa, Staphylococcus aureus
DEYKDVVFIYPMHRNLKVRAIAEKYL

SEQ ID NO: 1694374 - protein, 18 aa, Staphylococcus aureus
DEYKKYFQPLIKEDDKTF

SEQ ID NO: 1694375 - protein, 18 aa, Staphylococcus aureus
DEYKRYFQPLIKEDDKSF

SEQ ID NO: 1694376 - protein, 25 aa, Staphylococcus aureus
DEYSDDWYTNAFVDLVLSMKGYSYH

SEQ ID NO: 1694377 - protein, 28 aa, Staphylococcus aureus
DEYTKYKIGGTWYQFYKKVDEELTKKFV

SEQ ID NO: 1694378 - protein, 29 aa, Staphylococcus aureus
DEYTKYKIGGTWYQFYKKVDEELTKKFVE

SEQ ID NO: 1694379 - protein, 26 aa, Staphylococcus aureus
DFAELCEACQLKFIGPSYQSIQKMGI

SEQ ID NO: 1694380 - protein, 19 aa, Staphylococcus aureus
DFAFGLSMTSKNIARYENI

SEQ ID NO: 1694381 - protein, 18 aa, Staphylococcus aureus
DFDYLPEIYKSVKAEVLF

SEQ ID NO: 1694382 - protein, 18 aa, Staphylococcus aureus
DFETVIYALLKLEEAKYV

SEQ ID NO: 1694383 - protein, 18 aa, Staphylococcus aureus
DFFKQITVTFNPWSERHW

SEQ ID NO: 1694384 - protein, 17 aa, Staphylococcus aureus
DFFQDNGFGFITPYNLD

SEQ ID NO: 1694385 - protein, 26 aa, Staphylococcus aureus
DFGKKYIIFPNPMYGSWEATIYNNNY

SEQ ID NO: 1694386 - protein, 20 aa, Staphylococcus aureus
DFIKARWNQDFRLEDFKKVI

SEQ ID NO: 1694387 - protein, 18 aa, Staphylococcus aureus
DFILHGSIEKYKFKNSKA

SEQ ID NO: 1694388 - protein, 22 aa, Staphylococcus aureus
DFITLLENYYDIEWKRSVKYTE

SEQ ID NO: 1694389 - protein, 22 aa, Staphylococcus aureus
DFKHWRLVAILEVIEIKSCHYA

SEQ ID NO: 1694390 - protein, 22 aa, Staphylococcus aureus
DFKKEHMVFPGMVYISHPTEYG

SEQ ID NO: 1694391 - protein, 23 aa, Staphylococcus aureus
DFNQSWFKVKLNNDSLLEKNSYK

SEQ ID NO: 1694392 - protein, 24 aa, Staphylococcus aureus
DFNTVRYVYNRNLPKSLIEELKAY

SEQ ID NO: 1694393 - protein, 17 aa, Staphylococcus aureus
DFQLYMNVVAHKCIFFL

SEQ ID NO: 1694394 - protein, 17 aa, Staphylococcus aureus
DFRAVGLAIKEARMKRG

SEQ ID NO: 1694395 - protein, 21 aa, Staphylococcus aureus
DFRFEDLFSKEEWLSMSLAER

SEQ ID NO: 1694396 - protein, 17 aa, Staphylococcus aureus
DFVTPFGTYQVKSPYVG

SEQ ID NO: 1694397 - protein, 25 aa, Staphylococcus aureus
DFYQVIIDYLVAEFKKENGVDLSQD

SEQ ID NO: 1694398 - protein, 18 aa, Staphylococcus aureus
DFYYFVKHNQKLTKQQFL

SEQ ID NO: 1694399 - protein, 17 aa, Staphylococcus aureus
DGAAMILVMSEDKAKEL

SEQ ID NO: 1694400 - protein, 19 aa, Staphylococcus aureus
DGAMQRLQSAIANKDQTKA

SEQ ID NO: 1694401 - protein, 25 aa, Staphylococcus aureus
DGATKEFFAWGFRVGFITFGTSDQT

SEQ ID NO: 1694402 - protein, 18 aa, Staphylococcus aureus
DGAYCINGYRWITYIANS

SEQ ID NO: 1694403 - protein, 29 aa, Staphylococcus aureus
DGAYCINGYRWITYIANSGQRRYIATGEV

SEQ ID NO: 1694404 - protein, 19 aa, Staphylococcus aureus
DGEDFKRPSSVSGSIPSIN

SEQ ID NO: 1694405 - protein, 23 aa, Staphylococcus aureus
DGEHALLFVSKIREILMKEGIDI

SEQ ID NO: 1694406 - protein, 35 aa, Staphylococcus aureus
DGEIQGVAQLLFKKVPKLPYTLCYISRGFVVDYSN

SEQ ID NO: 1694407 - protein, 24 aa, Staphylococcus aureus
DGFIIYKGVRIINTEDLVLPGEHN

SEQ ID NO: 1694408 - protein, 25 aa, Staphylococcus aureus
DGFLLNFNTWAPNLYHFLNLKHFKR

SEQ ID NO: 1694409 - protein, 19 aa, Staphylococcus aureus
DGFYWCRKMREVSNVPILF

SEQ ID NO: 1694410 - protein, 34 aa, Staphylococcus aureus
DGGINEAFLRRCPNLKWIAWFATGVNTLPLDYIS

SEQ ID NO: 1694411 - protein, 35 aa, Staphylococcus aureus
DGGINEVFLRRCPNLKWIAWFATGVNILPLDYIAD

SEQ ID NO: 1694412 - protein, 25 aa, Staphylococcus aureus
DGGINLFPFEIYEPRFGAIFESKAN

SEQ ID NO: 1694413 - protein, 26 aa, Staphylococcus aureus
DGGIPGYIMIYLVPSTRTINSMKSLI

SEQ ID NO: 1694414 - protein, 26 aa, Staphylococcus aureus
DGGIPGYIMIYLVPSTSTINSMKSLI

SEQ ID NO: 1694415 - protein, 29 aa, Staphylococcus aureus
DGGKPMKPFLGVRGWYLSEYSKHKYWAKD

SEQ ID NO: 1694416 - protein, 20 aa, Staphylococcus aureus
DGIFIAVVTLDPKNRRIAAG

SEQ ID NO: 1694417 - protein, 23 aa, Staphylococcus aureus
DGIFIAVVTLDPKNRRIAAGPEI

SEQ ID NO: 1694418 - protein, 17 aa, Staphylococcus aureus
DGIHFAMDYLTEQTQLL

SEQ ID NO: 1694419 - protein, 23 aa, Staphylococcus aureus
DGILAIDLLRRPEMTYDIVLEIL

SEQ ID NO: 1694420 - protein, 21 aa, Staphylococcus aureus
DGITKLVYIKSIQDTIEAVGK

SEQ ID NO: 1694421 - protein, 24 aa, Staphylococcus aureus
DGKDALISSLKRRVKSLENEKKRL

SEQ ID NO: 1694422 - protein, 24 aa, Staphylococcus aureus
DGKDALISSLKRRVNSLEKEKKML

SEQ ID NO: 1694423 - protein, 24 aa, Staphylococcus aureus
DGKFHGQRLNDVILTYVASTGKMR

SEQ ID NO: 1694424 - protein, 24 aa, Staphylococcus aureus
DGKVIVIGIQLYKDREKMYYFAYE

SEQ ID NO: 1694425 - protein, 23 aa, Staphylococcus aureus
DGLKPVQRRMLYAMYSSGNTHDK

SEQ ID NO: 1694426 - protein, 28 aa, Staphylococcus aureus
DGLLIGEALMRCDNLSEFLPQLKMQKVK

SEQ ID NO: 1694427 - protein, 28 aa, Staphylococcus aureus
DGNGFAMPMLLAISHVHQLLIKADLRMS

SEQ ID NO: 1694428 - protein, 27 aa, Staphylococcus aureus
DGNKFKFYEFALFLYEEYHGCYIDNRP

SEQ ID NO: 1694429 - protein, 29 aa, Staphylococcus aureus
DGNLGYITAILLRKLYPEAKIYVFGKTNY

SEQ ID NO: 1694430 - protein, 17 aa, Staphylococcus aureus
DGTINWVTDVETGAFGV

SEQ ID NO: 1694431 - protein, 31 aa, Staphylococcus aureus
DGTLIEFDRSWEKIGVRFVESLLDTFPVQNK

SEQ ID NO: 1694432 - protein, 24 aa, Staphylococcus aureus
DGTMDEILVFDIEPSYDAIITLKD

SEQ ID NO: 1694433 - protein, 19 aa, Staphylococcus aureus
DGVIGNLLLISNDEDDRQV

SEQ ID NO: 1694434 - protein, 37 aa, Staphylococcus aureus
DGWYGFQCFDYANAGWKALFGLLLKGVGAKDIPFANN

SEQ ID NO: 1694435 - protein, 25 aa, Staphylococcus aureus
DGWYSLHLFYAVDWASLRLAPKDER

SEQ ID NO: 1694436 - protein, 26 aa, Staphylococcus aureus
DGWYSLHLFYAVNWASLRLVPKDERD

SEQ ID NO: 1694437 - protein, 26 aa, Staphylococcus aureus
DGYIFKESGFIITLQAINNALKSACR

SEQ ID NO: 1694438 - protein, 19 aa, Staphylococcus aureus
DGYIYSIQCYINKIDELNG

SEQ ID NO: 1694439 - protein, 17 aa, Staphylococcus aureus
DGYLMRIENLTPSNFFN

SEQ ID NO: 1694440 - protein, 19 aa, Staphylococcus aureus
DHDTIVASGNYTNASPDKQ

SEQ ID NO: 1694441 - protein, 19 aa, Staphylococcus aureus
DHDYAYWDQAIKLAITWMV

SEQ ID NO: 1694442 - protein, 27 aa, Staphylococcus aureus
DHGIVFNASLPLYKDAIHQKGSMRSND

SEQ ID NO: 1694443 - protein, 24 aa, Staphylococcus aureus
DHHKAMPIIIHGDGAYPGQGINFE

SEQ ID NO: 1694444 - protein, 17 aa, Staphylococcus aureus
DHIARNIILEKGYGEYF

SEQ ID NO: 1694445 - protein, 22 aa, Staphylococcus aureus
DHIRHLLEFKACTPIDIDRVEP

SEQ ID NO: 1694446 - protein, 18 aa, Staphylococcus aureus
DHKKREIKFLYDEQKLSG

SEQ ID NO: 1694447 - protein, 27 aa, Staphylococcus aureus
DHLNICREMLLLMLAWDKGHLLDYKVN

SEQ ID NO: 1694448 - protein, 22 aa, Staphylococcus aureus
DHNDIVMLQYATNGYIVGPSED

SEQ ID NO: 1694449 - protein, 33 aa, Staphylococcus aureus
DHPQWETFVDAFNFDCTFLAKAIARDGEGATKL

SEQ ID NO: 1694450 - protein, 25 aa, Staphylococcus aureus
DHTREYIPVIMYSPKFKGGHALESD

SEQ ID NO: 1694451 - protein, 18 aa, Staphylococcus aureus
DHVWGQPLYDSKALFKLL

SEQ ID NO: 1694452 - protein, 19 aa, Staphylococcus aureus
DHYRIGLNKAIQYLSYKKR

SEQ ID NO: 1694453 - protein, 23 aa, Staphylococcus aureus
DIAFEFASWISAEFKLYIIQDYQ

SEQ ID NO: 1694454 - protein, 24 aa, Staphylococcus aureus
DIASVLYLGIVGDTGRFLFNNTSE

SEQ ID NO: 1694455 - protein, 18 aa, Staphylococcus aureus
DIATMYKYHSIISNSDND

SEQ ID NO: 1694456 - protein, 26 aa, Staphylococcus aureus
DIAYHLIALLRYGGGISYQLLDDHSN

SEQ ID NO: 1694457 - protein, 27 aa, Staphylococcus aureus
DIEIAARFLYLNKTGFNGLYRVNSQGK

SEQ ID NO: 1694458 - protein, 19 aa, Staphylococcus aureus
DIEIIGHFKNYINTELHGT

SEQ ID NO: 1694459 - protein, 20 aa, Staphylococcus aureus
DIEIIGHFKNYINTELHGTK

SEQ ID NO: 1694460 - protein, 18 aa, Staphylococcus aureus
DIEIVGHFKNYINTELHG

SEQ ID NO: 1694461 - protein, 27 aa, Staphylococcus aureus
DIFIDNNILIYLFNPNTVNDYGYSNFL

SEQ ID NO: 1694462 - protein, 24 aa, Staphylococcus aureus
DIGAPYEILKQIKDNGRLPVVNFA

SEQ ID NO: 1694463 - protein, 36 aa, Staphylococcus aureus
DIGINGIRLIKFKGGTIGLEFIWIDIENPPNDVIGW

SEQ ID NO: 1694464 - protein, 17 aa, Staphylococcus aureus
DIHYLLKRFEGEKNHKG

SEQ ID NO: 1694465 - protein, 17 aa, Staphylococcus aureus
DIICLSNNLLNQEAYLI

SEQ ID NO: 1694466 - protein, 25 aa, Staphylococcus aureus
DIIHHMKALFKCKNYLQIDTKIDMI

SEQ ID NO: 1694467 - protein, 27 aa, Staphylococcus aureus
DIIIFSTPLYWYSMSASLKLFIDRWTE

SEQ ID NO: 1694468 - protein, 30 aa, Staphylococcus aureus
DIKLEFGDAPLLVKYLWDNLTDAPHGIVKF

SEQ ID NO: 1694469 - protein, 20 aa, Staphylococcus aureus
DILLQVLLHTSIGKKEGYID

SEQ ID NO: 1694470 - protein, 34 aa, Staphylococcus aureus
DIMQEMKKFFRPEFLNRFNGIVEFLHLDKDALQD

SEQ ID NO: 1694471 - protein, 26 aa, Staphylococcus aureus
DINILEKHWFNWLTANNIPIKRRSST

SEQ ID NO: 1694472 - protein, 28 aa, Staphylococcus aureus
DINNPHAHVLLTQRPFNADGTWGKKTKT

SEQ ID NO: 1694473 - protein, 20 aa, Staphylococcus aureus
DINNYDWLSGIGSLPSLINH

SEQ ID NO: 1694474 - protein, 20 aa, Staphylococcus aureus
DIPPIIKISGSYIAADILVT

SEQ ID NO: 1694475 - protein, 17 aa, Staphylococcus aureus
DIPTKKAPKLLIKGDGD

SEQ ID NO: 1694476 - protein, 26 aa, Staphylococcus aureus
DIPTNKAPKFILKGTGDLKGSSVGYK

SEQ ID NO: 1694477 - protein, 22 aa, Staphylococcus aureus
DIPVAPNTLGKSGVLVVYVVDD

SEQ ID NO: 1694478 - protein, 24 aa, Staphylococcus aureus
DIRQKLTTIFNQFNQMSLSHFPIQ

SEQ ID NO: 1694479 - protein, 31 aa, Staphylococcus aureus
DISAGRIPLEVKTLRILHFVSRDGGKLKIHY

SEQ ID NO: 1694480 - protein, 25 aa, Staphylococcus aureus
DISTTQILEIPFPQAKQTLYAPITG

SEQ ID NO: 1694481 - protein, 25 aa, Staphylococcus aureus
DITAPYYRDLVFVTYMGISAYDTFL

SEQ ID NO: 1694482 - protein, 25 aa, Staphylococcus aureus
DITGQILTNIFGLEIFAEYQPFDNA

SEQ ID NO: 1694483 - protein, 21 aa, Staphylococcus aureus
DITISLLPRALDRHKLHNEWQ

SEQ ID NO: 1694484 - protein, 22 aa, Staphylococcus aureus
DITKDFLLSLLKTKFKDNLQTF

SEQ ID NO: 1694485 - protein, 21 aa, Staphylococcus aureus
DITPKLMLQGSVDLLNEVATS

SEQ ID NO: 1694486 - protein, 20 aa, Staphylococcus aureus
DITSTLLEQGGINASKFGVF

SEQ ID NO: 1694487 - protein, 18 aa, Staphylococcus aureus
DITTGTYIAYIRKSKTEK

SEQ ID NO: 1694488 - protein, 26 aa, Staphylococcus aureus
DITVNQLMKYIKGPDFPTGGIIQGVD

SEQ ID NO: 1694489 - protein, 20 aa, Staphylococcus aureus
DITWRKVIDGFFSSFKQDVE

SEQ ID NO: 1694490 - protein, 17 aa, Staphylococcus aureus
DITYFRDDIEHMSSLST

SEQ ID NO: 1694491 - protein, 18 aa, Staphylococcus aureus
DIVKFRTRMGLENYTREG

SEQ ID NO: 1694492 - protein, 24 aa, Staphylococcus aureus
DIVSLNHQILDLLSKRGELAQKIG

SEQ ID NO: 1694493 - protein, 17 aa, Staphylococcus aureus
DIWKHFKAVKNNHVYDI

SEQ ID NO: 1694494 - protein, 33 aa, Staphylococcus aureus
DIWRHLSKIWYTDRQLLINNLISQAIPVIKYPQ

SEQ ID NO: 1694495 - protein, 17 aa, Staphylococcus aureus
DIYPRDGLEVSEERFTE

SEQ ID NO: 1694496 - protein, 28 aa, Staphylococcus aureus
DIYVKWQKYMNDELPGLPMFQGKSITIE

SEQ ID NO: 1694497 - protein, 25 aa, Staphylococcus aureus
DKAIETLGYPFIVKTRFGGYDGKGQ

SEQ ID NO: 1694498 - protein, 23 aa, Staphylococcus aureus
DKANAFVDTLNGLNQQQQDLAHQ

SEQ ID NO: 1694499 - protein, 30 aa, Staphylococcus aureus
DKANLVIWDAPNHEYIPYHFGINHAEKVIK

SEQ ID NO: 1694500 - protein, 25 aa, Staphylococcus aureus
DKAWAHSKSIWKGTSKWFSNSYKSL

SEQ ID NO: 1694501 - protein, 31 aa, Staphylococcus aureus
DKAWAHSKSIWRGTSKWFSNAYKSAKGWPDM

SEQ ID NO: 1694502 - protein, 35 aa, Staphylococcus aureus
DKAWAHSKSIWRGTSKWFSSAYKSAKGWLTDMTNK

SEQ ID NO: 1694503 - protein, 23 aa, Staphylococcus aureus
DKDENIVFWSGWNKITMLALIEL

SEQ ID NO: 1694504 - protein, 20 aa, Staphylococcus aureus
DKDEVINGMIWSEILAKPKQ

SEQ ID NO: 1694505 - protein, 17 aa, Staphylococcus aureus
DKEARKALNGHFKENIF

SEQ ID NO: 1694506 - protein, 25 aa, Staphylococcus aureus
DKEKLADWHIALPEIVQLQYDFEQK

SEQ ID NO: 1694507 - protein, 32 aa, Staphylococcus aureus
DKEMLLQEFPEQLTNYLLKYDYRDLEIIKAVI

SEQ ID NO: 1694508 - protein, 26 aa, Staphylococcus aureus
DKENYKLLIGSIIPRPIAFVTTLNQD

SEQ ID NO: 1694509 - protein, 24 aa, Staphylococcus aureus
DKETKFLKWLGIKISNTPEYLERL

SEQ ID NO: 1694510 - protein, 18 aa, Staphylococcus aureus
DKFLHLSVKETSGIKWEY

SEQ ID NO: 1694511 - protein, 31 aa, Staphylococcus aureus
DKGDSRFYLSLQDELMIRFGSERLQKMMSRL

SEQ ID NO: 1694512 - protein, 28 aa, Staphylococcus aureus
DKHYPHLRFGFIHVPYIPEQVDGKSDKP

SEQ ID NO: 1694513 - protein, 29 aa, Staphylococcus aureus
DKHYPHLRFGFIHVPYIPEQVIRKPDTPS

SEQ ID NO: 1694514 - protein, 27 aa, Staphylococcus aureus
DKHYPHLRFGFIHVPYIPEQVVGKSDT

SEQ ID NO: 1694515 - protein, 21 aa, Staphylococcus aureus
DKIFELDGDLPLFPGHGPYTT

SEQ ID NO: 1694516 - protein, 18 aa, Staphylococcus aureus
DKIIDFLSTDDPSLVRAI

SEQ ID NO: 1694517 - protein, 19 aa, Staphylococcus aureus
DKIIDFLSTDDPSLVRAIH

SEQ ID NO: 1694518 - protein, 30 aa, Staphylococcus aureus
DKKEGIHYKNLLGTYLHGPILPKNYEITDY

SEQ ID NO: 1694519 - protein, 24 aa, Staphylococcus aureus
DKKHYLPLQNIVFKTSLSILNKTV

SEQ ID NO: 1694520 - protein, 26 aa, Staphylococcus aureus
DKKKDRYKFVLTPFSNQKASYFISDE

SEQ ID NO: 1694521 - protein, 19 aa, Staphylococcus aureus
DKKLYTYGDNWGRGGEVLY

SEQ ID NO: 1694522 - protein, 23 aa, Staphylococcus aureus
DKLEQDLIKKFKLSGLVNADQAV

SEQ ID NO: 1694523 - protein, 21 aa, Staphylococcus aureus
DKLPLFNPFKVINKGNQLQGV

SEQ ID NO: 1694524 - protein, 20 aa, Staphylococcus aureus
DKMKSWYERFGFGKSTEGMF

SEQ ID NO: 1694525 - protein, 24 aa, Staphylococcus aureus
DKMKSWYERFGFGKSTKGMFDGEA

SEQ ID NO: 1694526 - protein, 24 aa, Staphylococcus aureus
DKNDPRFDNPTKPIGPFYTKEEVE

SEQ ID NO: 1694527 - protein, 32 aa, Staphylococcus aureus
DKNFTVINIKKYLMNRQVGFTRKILGVLEDNN

SEQ ID NO: 1694528 - protein, 23 aa, Staphylococcus aureus
DKNTSRIYAKFGKEIYVAAKSGE

SEQ ID NO: 1694529 - protein, 20 aa, Staphylococcus aureus
DKQAFELDYVDGRQLFVGLV

SEQ ID NO: 1694530 - protein, 26 aa, Staphylococcus aureus
DKQKAYALMSIPRHNLPESEKAIYDK

SEQ ID NO: 1694531 - protein, 20 aa, Staphylococcus aureus
DKQVQALIDEIDRNPILTDK

SEQ ID NO: 1694532 - protein, 29 aa, Staphylococcus aureus
DKQVQALIDEIDRNPILTDKEKQALKDRI

SEQ ID NO: 1694533 - protein, 18 aa, Staphylococcus aureus
DKQYLGELSLVDRLNHHK

SEQ ID NO: 1694534 - protein, 23 aa, Staphylococcus aureus
DKRDFMLNILNNLFKDIAHWEVS

SEQ ID NO: 1694535 - protein, 24 aa, Staphylococcus aureus
DKRKNIFFRIKSENLNLEFKYLFL

SEQ ID NO: 1694536 - protein, 24 aa, Staphylococcus aureus
DKRYLFEAVYGAGIIRMYELNTHT

SEQ ID NO: 1694537 - protein, 22 aa, Staphylococcus aureus
DKSYPFIKITKEKYPRLLVTRT

SEQ ID NO: 1694538 - protein, 21 aa, Staphylococcus aureus
DKTETLNSINFTDADQAKKDD

SEQ ID NO: 1694539 - protein, 22 aa, Staphylococcus aureus
DKTIRDVFGYSVDKGWMCIQVF

SEQ ID NO: 1694540 - protein, 21 aa, Staphylococcus aureus
DKTIYMINDYGQLQAINKDLS

SEQ ID NO: 1694541 - protein, 23 aa, Staphylococcus aureus
DKTLIQNYYPSLFALEEISFMLN

SEQ ID NO: 1694542 - protein, 24 aa, Staphylococcus aureus
DKVEARMDLYNKLDMIVGYSEDER

SEQ ID NO: 1694543 - protein, 37 aa, Staphylococcus aureus
DKVGSKRYLFIEYIPDNVLNCKPDFWKTLKYKKDKVT

SEQ ID NO: 1694544 - protein, 30 aa, Staphylococcus aureus
DKVHLETDVLFKYIENILNKDKDQLSVDKL

SEQ ID NO: 1694545 - protein, 26 aa, Staphylococcus aureus
DKVHLETDVLFKYVENILNKDKDPLS

SEQ ID NO: 1694546 - protein, 22 aa, Staphylococcus aureus
DKVLELIDYPSFFSMQNLNLPT

SEQ ID NO: 1694547 - protein, 20 aa, Staphylococcus aureus
DKWVYEMLGMDSTCPKDVLT

SEQ ID NO: 1694548 - protein, 23 aa, Staphylococcus aureus
DKYFKDSVLFKQVNYYIDTPDFK

SEQ ID NO: 1694549 - protein, 23 aa, Staphylococcus aureus
DKYRTWAWNYGRNPKYNFEREEK

SEQ ID NO: 1694550 - protein, 25 aa, Staphylococcus aureus
DLAEQLVTFIPHSLLTLHNEKYNIQ

SEQ ID NO: 1694551 - protein, 23 aa, Staphylococcus aureus
DLALNLSIYGRAYEIVYRDTDDK

SEQ ID NO: 1694552 - protein, 18 aa, Staphylococcus aureus
DLALWNKVNPSFALKSMF

SEQ ID NO: 1694553 - protein, 21 aa, Staphylococcus aureus
DLARVTALVQNYRKVSDRNKA

SEQ ID NO: 1694554 - protein, 19 aa, Staphylococcus aureus
DLEFIFVQNKRENIYFTDS

SEQ ID NO: 1694555 - protein, 27 aa, Staphylococcus aureus
DLEKGLYRKRMLSYGGLLKQKHKILNL

SEQ ID NO: 1694556 - protein, 24 aa, Staphylococcus aureus
DLEMSLFFELIFGEETDFLSEFIK

SEQ ID NO: 1694557 - protein, 18 aa, Staphylococcus aureus
DLGDIFHSVLKYISERVN

SEQ ID NO: 1694558 - protein, 24 aa, Staphylococcus aureus
DLHDTLGHVFASLSLKSELAYKII

SEQ ID NO: 1694559 - protein, 21 aa, Staphylococcus aureus
DLIDYSLYIKKGLVEPFIVFY

SEQ ID NO: 1694560 - protein, 24 aa, Staphylococcus aureus
DLIESKISFIDKTRVLFNDINKYQ

SEQ ID NO: 1694561 - protein, 19 aa, Staphylococcus aureus
DLIHFYEVSGVLKKEILKI

SEQ ID NO: 1694562 - protein, 17 aa, Staphylococcus aureus
DLIILQGTDDDWLHDYW

SEQ ID NO: 1694563 - protein, 18 aa, Staphylococcus aureus
DLIILQGTDDDWLHDYWA

SEQ ID NO: 1694564 - protein, 19 aa, Staphylococcus aureus
DLINQTNNPTLDKAQVEQL

SEQ ID NO: 1694565 - protein, 29 aa, Staphylococcus aureus
DLKAHGLTPRLHLFMEDGSIFKNEPLIID

SEQ ID NO: 1694566 - protein, 20 aa, Staphylococcus aureus
DLKRTYVFELNFDALMSVSV

SEQ ID NO: 1694567 - protein, 21 aa, Staphylococcus aureus
DLKVIVYARFLCDSLKNEMKQ

SEQ ID NO: 1694568 - protein, 17 aa, Staphylococcus aureus
DLLHMHYAVPHAICGIL

SEQ ID NO: 1694569 - protein, 24 aa, Staphylococcus aureus
DLLNDIALLDCNVIILSSYDDFEY

SEQ ID NO: 1694570 - protein, 27 aa, Staphylococcus aureus
DLMHQLKQLDIVYYFGNVMVESLVEMI

SEQ ID NO: 1694571 - protein, 18 aa, Staphylococcus aureus
DLMLVNTNRHYGKTLVLN

SEQ ID NO: 1694572 - protein, 19 aa, Staphylococcus aureus
DLNELYIATDAMRDVINEW

SEQ ID NO: 1694573 - protein, 18 aa, Staphylococcus aureus
DLNEYVIVMLDKSTIGNK

SEQ ID NO: 1694574 - protein, 19 aa, Staphylococcus aureus
DLNQPFIYIGKDTVKLQYE

SEQ ID NO: 1694575 - protein, 26 aa, Staphylococcus aureus
DLNSANWVFKKLDAITTKENEVKELA

SEQ ID NO: 1694576 - protein, 20 aa, Staphylococcus aureus
DLPDYIQIWPGHGAGSPCGK

SEQ ID NO: 1694577 - protein, 17 aa, Staphylococcus aureus
DLPVFITNYPTKIKPFY

SEQ ID NO: 1694578 - protein, 17 aa, Staphylococcus aureus
DLRSRVKLETDGKLLTG

SEQ ID NO: 1694579 - protein, 32 aa, Staphylococcus aureus
DLSHEYLKQHNIHVIPLSLTIDGKSYTDQVDI

SEQ ID NO: 1694580 - protein, 24 aa, Staphylococcus aureus
DLSKGFPRIPILKDVYGFVEIGRE

SEQ ID NO: 1694581 - protein, 18 aa, Staphylococcus aureus
DLSNIRLGFKQEIEARKN

SEQ ID NO: 1694582 - protein, 26 aa, Staphylococcus aureus
DLTEAQALDQLMDALQQSIADKDATR

SEQ ID NO: 1694583 - protein, 23 aa, Staphylococcus aureus
DLTKVFHYFKEAHPYFDQDVVII

SEQ ID NO: 1694584 - protein, 17 aa, Staphylococcus aureus
DLTLLPLEELDNYLKGD

SEQ ID NO: 1694585 - protein, 35 aa, Staphylococcus aureus
DLTPKKLKFKSQNWYWFAYFDGPLKLPKNPRGSVK

SEQ ID NO: 1694586 - protein, 18 aa, Staphylococcus aureus
DLTRTWEILGEIIGETAS

SEQ ID NO: 1694587 - protein, 17 aa, Staphylococcus aureus
DLVILTHLHIDHFDPKA

SEQ ID NO: 1694588 - protein, 19 aa, Staphylococcus aureus
DLVRIVHVKTIRGINNVIV

SEQ ID NO: 1694589 - protein, 17 aa, Staphylococcus aureus
DLVSLLHVSIDEFFLPT

SEQ ID NO: 1694590 - protein, 17 aa, Staphylococcus aureus
DLVVWTAGIQPVEVVRN

SEQ ID NO: 1694591 - protein, 21 aa, Staphylococcus aureus
DLWMDLYDLFEELRDLFKEED

SEQ ID NO: 1694592 - protein, 22 aa, Staphylococcus aureus
DLWMDLYDLFEELRDLFKEEDL

SEQ ID NO: 1694593 - protein, 24 aa, Staphylococcus aureus
DLWMDLYDLFEELRNLFKEEGLEP

SEQ ID NO: 1694594 - protein, 25 aa, Staphylococcus aureus
DLYGGTFRLFQFYEQQYDIKFKYVD

SEQ ID NO: 1694595 - protein, 17 aa, Staphylococcus aureus
DLYSKLIAGAIHGKPIG

SEQ ID NO: 1694596 - protein, 25 aa, Staphylococcus aureus
DLYYNTMIELIKPLGHITTIVAFNE

SEQ ID NO: 1694597 - protein, 22 aa, Staphylococcus aureus
DMDKAFDRLKLNIFMSLAELES

SEQ ID NO: 1694598 - protein, 23 aa, Staphylococcus aureus
DMETRGMVLYINRNTRTTKGYYF

SEQ ID NO: 1694599 - protein, 30 aa, Staphylococcus aureus
DMEVFDYITPEFLIKRSHLLKKAKCIIVDL

SEQ ID NO: 1694600 - protein, 19 aa, Staphylococcus aureus
DMFKALLHETFKANGVLFI

SEQ ID NO: 1694601 - protein, 20 aa, Staphylococcus aureus
DMFKALLHETFKAYGVLFVD

SEQ ID NO: 1694602 - protein, 19 aa, Staphylococcus aureus
DMLIPWEMIPRCSKCDAPM

SEQ ID NO: 1694603 - protein, 19 aa, Staphylococcus aureus
DMMKNGKQRPWREKKVLLQ

SEQ ID NO: 1694604 - protein, 18 aa, Staphylococcus aureus
DMPRIFERGFTSTANRNE

SEQ ID NO: 1694605 - protein, 27 aa, Staphylococcus aureus
DMQRKYPLFVNHLKTFKYVTLDYKNPS

SEQ ID NO: 1694606 - protein, 18 aa, Staphylococcus aureus
DMRIGELLAIKRENINYE

SEQ ID NO: 1694607 - protein, 25 aa, Staphylococcus aureus
DMVDRILFNNSLKYYMNEHPAVTHM

SEQ ID NO: 1694608 - protein, 25 aa, Staphylococcus aureus
DMYVTDFQLFTLYGLRINVESDLLS

SEQ ID NO: 1694609 - protein, 17 aa, Staphylococcus aureus
DNAFFYTQLKKPYFQRD

SEQ ID NO: 1694610 - protein, 17 aa, Staphylococcus aureus
DNAITQAESYLNKDHGT

SEQ ID NO: 1694611 - protein, 22 aa, Staphylococcus aureus
DNAYDLAYYHYWQSLEISQFNN

SEQ ID NO: 1694612 - protein, 26 aa, Staphylococcus aureus
DNDLAWLVDIMLPRMKAHGVINDDFS

SEQ ID NO: 1694613 - protein, 26 aa, Staphylococcus aureus
DNDLAWLVDVMLPRMKAHGVINDDFS

SEQ ID NO: 1694614 - protein, 26 aa, Staphylococcus aureus
DNDLAWLVDVMLQRMKAHGVINDDFS

SEQ ID NO: 1694615 - protein, 25 aa, Staphylococcus aureus
DNDLAWLVGVMLQRMKAHGVINDDF

SEQ ID NO: 1694616 - protein, 18 aa, Staphylococcus aureus
DNEIAYITMLFGGSLRRQ

SEQ ID NO: 1694617 - protein, 24 aa, Staphylococcus aureus
DNELYNYHYLYPHQRYAIDLVIKE

SEQ ID NO: 1694618 - protein, 18 aa, Staphylococcus aureus
DNEMSYTAQLVRTLAYLP

SEQ ID NO: 1694619 - protein, 23 aa, Staphylococcus aureus
DNESKLGGFDWFKRKTNKKDTHE

SEQ ID NO: 1694620 - protein, 18 aa, Staphylococcus aureus
DNETVYFVYAGTDKYEPA

SEQ ID NO: 1694621 - protein, 21 aa, Staphylococcus aureus
DNGFGFITPYNLDDLNYYLDS

SEQ ID NO: 1694622 - protein, 17 aa, Staphylococcus aureus
DNHSHLSILQNLATILG

SEQ ID NO: 1694623 - protein, 24 aa, Staphylococcus aureus
DNIIGVFHSKYLLAWSNKKEDQIT

SEQ ID NO: 1694624 - protein, 25 aa, Staphylococcus aureus
DNIIGVFHSKYLLAWSNKKENQITN

SEQ ID NO: 1694625 - protein, 21 aa, Staphylococcus aureus
DNKFSVITVVNWAIYQSMEEN

SEQ ID NO: 1694626 - protein, 22 aa, Staphylococcus aureus
DNKHMLTLFRGGPTVWISNEDA

SEQ ID NO: 1694627 - protein, 23 aa, Staphylococcus aureus
DNKSYAAVWQILNALRSTDERFN

SEQ ID NO: 1694628 - protein, 21 aa, Staphylococcus aureus
DNKVCYQVFYDEKGYPYISRN

SEQ ID NO: 1694629 - protein, 26 aa, Staphylococcus aureus
DNLKANYDNAITNAAHELDKVQGSAI

SEQ ID NO: 1694630 - protein, 36 aa, Staphylococcus aureus
DNLKPKKLKFKSQNWYWFAYFDGPLKLPKNPRGSVK

SEQ ID NO: 1694631 - protein, 25 aa, Staphylococcus aureus
DNQLPPLIQSGFNPSFITTLSHEKG

SEQ ID NO: 1694632 - protein, 19 aa, Staphylococcus aureus
DNRISVGVMYMLKLVHMVD

SEQ ID NO: 1694633 - protein, 22 aa, Staphylococcus aureus
DNTKRSVNYTDADQPKQQAYDT

SEQ ID NO: 1694634 - protein, 17 aa, Staphylococcus aureus
DNVEAEVVIKPKAIADI

SEQ ID NO: 1694635 - protein, 28 aa, Staphylococcus aureus
DNVYFVVLGHYQLLDALLDKSLQTPDIL

SEQ ID NO: 1694636 - protein, 18 aa, Staphylococcus aureus
DNWKTRLRMLNHFPKPTF

SEQ ID NO: 1694637 - protein, 18 aa, Staphylococcus aureus
DPFAILNKKDKLFESNDL

SEQ ID NO: 1694638 - protein, 17 aa, Staphylococcus aureus
DPKLRQQIWQQFKQMTK

SEQ ID NO: 1694639 - protein, 24 aa, Staphylococcus aureus
DPMGKMFFTMMSAFAELEANLLSE

SEQ ID NO: 1694640 - protein, 29 aa, Staphylococcus aureus
DPTQDDILMYNYLKHFDIPTLVICTKEDK

SEQ ID NO: 1694641 - protein, 20 aa, Staphylococcus aureus
DPVIVLAQLINRIQSIVSRN

SEQ ID NO: 1694642 - protein, 23 aa, Staphylococcus aureus
DQDKSWDGILYKNSFEGLAQYKS

SEQ ID NO: 1694643 - protein, 24 aa, Staphylococcus aureus
DQDVATHLPYIYLSAGVSAELFQE

SEQ ID NO: 1694644 - protein, 21 aa, Staphylococcus aureus
DQERFLMYAHFQDPKYRILDY

SEQ ID NO: 1694645 - protein, 24 aa, Staphylococcus aureus
DQHFTMFETDAELFGYCYGVTGTV

SEQ ID NO: 1694646 - protein, 21 aa, Staphylococcus aureus
DQIIDEAKAYHFKSVCVNPTH

SEQ ID NO: 1694647 - protein, 18 aa, Staphylococcus aureus
DQKLYFYFSSPGKDQIIY

SEQ ID NO: 1694648 - protein, 24 aa, Staphylococcus aureus
DQLEQPIRLEPMNTFPVIRDLQVD

SEQ ID NO: 1694649 - protein, 20 aa, Staphylococcus aureus
DQLHRQILEQAIVDGLKIYF

SEQ ID NO: 1694650 - protein, 20 aa, Staphylococcus aureus
DQLTHLNNAQRQLAIQQINN

SEQ ID NO: 1694651 - protein, 26 aa, Staphylococcus aureus
DQMNGIPFSYFMSYVSGAGLSLIRHW

SEQ ID NO: 1694652 - protein, 25 aa, Staphylococcus aureus
DQQSKKVLSVRFLTKEMLADIEPYR

SEQ ID NO: 1694653 - protein, 25 aa, Staphylococcus aureus
DQRIDIPLRIEKGKTASYIVKVDGK

SEQ ID NO: 1694654 - protein, 30 aa, Staphylococcus aureus
DQRVINHYGSLIPLTPLDNSLLRKEQNDTT

SEQ ID NO: 1694655 - protein, 30 aa, Staphylococcus aureus
DQRVINHYGSLIPLTPLDSSLLRKEQNDTT

SEQ ID NO: 1694656 - protein, 24 aa, Staphylococcus aureus
DQTAIINSLTFTSNAPNRNYATAS

SEQ ID NO: 1694657 - protein, 25 aa, Staphylococcus aureus
DQTRGWFYSLLVISTILKGKSSYKR

SEQ ID NO: 1694658 - protein, 27 aa, Staphylococcus aureus
DQVIKKDGYWWIRFKYQREGSSTNDFY

SEQ ID NO: 1694659 - protein, 20 aa, Staphylococcus aureus
DQYPLMNEKDIRAVLGRFLF

SEQ ID NO: 1694660 - protein, 29 aa, Staphylococcus aureus
DRHDIKMTAWMPLMRNRGLLDDPVIVKIA

SEQ ID NO: 1694661 - protein, 18 aa, Staphylococcus aureus
DRHFLYTQIITALDEYRE

SEQ ID NO: 1694662 - protein, 18 aa, Staphylococcus aureus
DRINQILQQGHNDINNAM

SEQ ID NO: 1694663 - protein, 18 aa, Staphylococcus aureus
DRINQILQQGHNGINNAM

SEQ ID NO: 1694664 - protein, 22 aa, Staphylococcus aureus
DRIRNWFKRYLSESEHIFIDKT

SEQ ID NO: 1694665 - protein, 18 aa, Staphylococcus aureus
DRKNYFYPDNPKAYQISQ

SEQ ID NO: 1694666 - protein, 17 aa, Staphylococcus aureus
DRLDKRIYDLQLSRQIA

SEQ ID NO: 1694667 - protein, 30 aa, Staphylococcus aureus
DRLKARDMLGKYHKLFIDKHDINGNVPIFI

SEQ ID NO: 1694668 - protein, 26 aa, Staphylococcus aureus
DRNLYTPYHIPITNKTLFNYEGKTYK

SEQ ID NO: 1694669 - protein, 24 aa, Staphylococcus aureus
DRQNQDLLRYALNNPFLSPTRRDK

SEQ ID NO: 1694670 - protein, 24 aa, Staphylococcus aureus
DRRTKMYNVFEYFKQISNNKHFKS

SEQ ID NO: 1694671 - protein, 30 aa, Staphylococcus aureus
DRSDDQFRMIIKQLYFFSVANPDPTNWLDQ

SEQ ID NO: 1694672 - protein, 31 aa, Staphylococcus aureus
DRSDDQFRMIIKQLYFFSVANPDPTNWLDQL

SEQ ID NO: 1694673 - protein, 31 aa, Staphylococcus aureus
DRSDDQFRMIIKQLYFFSVANPNPTNWLDQL

SEQ ID NO: 1694674 - protein, 20 aa, Staphylococcus aureus
DRYFLDKIVTQIYDVALGDV

SEQ ID NO: 1694675 - protein, 23 aa, Staphylococcus aureus
DRYLDLVYSDTWLEKMKSRQGVK

SEQ ID NO: 1694676 - protein, 21 aa, Staphylococcus aureus
DSATNSIIGTPTKIGQSTVTV

SEQ ID NO: 1694677 - protein, 26 aa, Staphylococcus aureus
DSDDILVNMFLYLPNFFQNQNSEDNM

SEQ ID NO: 1694678 - protein, 18 aa, Staphylococcus aureus
DSDKYLRPETLFGNKFEG

SEQ ID NO: 1694679 - protein, 25 aa, Staphylococcus aureus
DSDNQPILYLISKESHIKTSVTEFD

SEQ ID NO: 1694680 - protein, 21 aa, Staphylococcus aureus
DSEHYGLWAFKKVWGTYLSEK

SEQ ID NO: 1694681 - protein, 17 aa, Staphylococcus aureus
DSEIWKAIQLLGIPVEK

SEQ ID NO: 1694682 - protein, 24 aa, Staphylococcus aureus
DSELSKLFFNPISGHGIGTFEFSG

SEQ ID NO: 1694683 - protein, 24 aa, Staphylococcus aureus
DSFEYNVELQFIKEKEKEIDSYKE

SEQ ID NO: 1694684 - protein, 27 aa, Staphylococcus aureus
DSHNTFQLIKLFQKRINLGLSIVMVTH

SEQ ID NO: 1694685 - protein, 17 aa, Staphylococcus aureus
DSIALEKMFGAIDKYFL

SEQ ID NO: 1694686 - protein, 24 aa, Staphylococcus aureus
DSIALVTPDHIVRAAARDAVKQQY

SEQ ID NO: 1694687 - protein, 17 aa, Staphylococcus aureus
DSKFKLNTPYGKVTARK

SEQ ID NO: 1694688 - protein, 31 aa, Staphylococcus aureus
DSKPDWKIFQAIANRLGFDWNYKHPSEIMDE

SEQ ID NO: 1694689 - protein, 17 aa, Staphylococcus aureus
DSKQLVISLTDHIIFAY

SEQ ID NO: 1694690 - protein, 21 aa, Staphylococcus aureus
DSKTKLVYIKSIQDLTESVKE

SEQ ID NO: 1694691 - protein, 18 aa, Staphylococcus aureus
DSKTLFKLLALESQHAGL

SEQ ID NO: 1694692 - protein, 26 aa, Staphylococcus aureus
DSKVNVLQELKLWMARTIAATRNQAI

SEQ ID NO: 1694693 - protein, 30 aa, Staphylococcus aureus
DSLANEKTRVRLYKSGKNWVKSGIKEIEMF

SEQ ID NO: 1694694 - protein, 36 aa, Staphylococcus aureus
DSLTAKVEVTLLDGSKVIVNVPVKVVEKELSVVKQQ

SEQ ID NO: 1694695 - protein, 21 aa, Staphylococcus aureus
DSMCLLYQLLNDYKDNYRKLT

SEQ ID NO: 1694696 - protein, 17 aa, Staphylococcus aureus
DSMNALVDLNIIKSNSG

SEQ ID NO: 1694697 - protein, 18 aa, Staphylococcus aureus
DSMNALVDLNIIKSNSGT

SEQ ID NO: 1694698 - protein, 33 aa, Staphylococcus aureus
DSNAEDLILFRTIPSYYRSLPGKLARELEEMDK

SEQ ID NO: 1694699 - protein, 25 aa, Staphylococcus aureus
DSNKSFHFSGKVNLGNKYEGHGNGG

SEQ ID NO: 1694700 - protein, 21 aa, Staphylococcus aureus
DSNWPICGIPEKFYTDHGKDY

SEQ ID NO: 1694701 - protein, 23 aa, Staphylococcus aureus
DSPEFVNESPYEKAWMVKVEVSD

SEQ ID NO: 1694702 - protein, 24 aa, Staphylococcus aureus
DSPEFVNESPYEKAWMVKVGISDE

SEQ ID NO: 1694703 - protein, 17 aa, Staphylococcus aureus
DSQFLYKSAQRGDLGDI

SEQ ID NO: 1694704 - protein, 20 aa, Staphylococcus aureus
DSQVAREIIIGLPNEFDPNK

SEQ ID NO: 1694705 - protein, 21 aa, Staphylococcus aureus
DSRKSRWPVYQEWSRFIKGAD

SEQ ID NO: 1694706 - protein, 25 aa, Staphylococcus aureus
DSRTKMYNVFEYFKQISNSKHFKSN

SEQ ID NO: 1694707 - protein, 20 aa, Staphylococcus aureus
DSVEDYLTYLNGRFSNMIIG

SEQ ID NO: 1694708 - protein, 20 aa, Staphylococcus aureus
DSVEDYLTYLNGRFSNMILG

SEQ ID NO: 1694709 - protein, 25 aa, Staphylococcus aureus
DSVEDYLTYLNGRFSNMILGHNGDG

SEQ ID NO: 1694710 - protein, 25 aa, Staphylococcus aureus
DSVFDIRDYFAARSLLSETICNLDN

SEQ ID NO: 1694711 - protein, 18 aa, Staphylococcus aureus
DSVILLEQIRTLDKKRLK

SEQ ID NO: 1694712 - protein, 32 aa, Staphylococcus aureus
DSVKEGDTFKFKYGQYFRPGSVRLPSQTQNLY

SEQ ID NO: 1694713 - protein, 33 aa, Staphylococcus aureus; identical to SEQ ID NO: 1592521

SEQ ID NO: 1694714 - protein, 25 aa, Staphylococcus aureus
DSVKVGASVFTGFGPRIVRINNFSV

SEQ ID NO: 1694715 - protein, 22 aa, Staphylococcus aureus
DSVYELYKQFDKLRDLFKEEGH

SEQ ID NO: 1694716 - protein, 23 aa, Staphylococcus aureus
DSVYELYKQFQDLRNLFKEEGHE

SEQ ID NO: 1694717 - protein, 19 aa, Staphylococcus aureus
DSYSQLLEFAYPTDRTEVY

SEQ ID NO: 1694718 - protein, 20 aa, Staphylococcus aureus
DTAAAFFEGTPGYEEQMFGQ

SEQ ID NO: 1694719 - protein, 25 aa, Staphylococcus aureus
DTDMPHVVFFTFNQPDEWDSPCNIY

SEQ ID NO: 1694720 - protein, 26 aa, Staphylococcus aureus
DTEIERLRYLVDNDFYFNVFDIYSEA

SEQ ID NO: 1694721 - protein, 19 aa, Staphylococcus aureus
DTEYILLDEPLNNLDMKHA

SEQ ID NO: 1694722 - protein, 19 aa, Staphylococcus aureus
DTFIINNKFINCEGGIRYL

SEQ ID NO: 1694723 - protein, 26 aa, Staphylococcus aureus
DTGGYYKVKKIIPYAGSEDLAIVQVE

SEQ ID NO: 1694724 - protein, 26 aa, Staphylococcus aureus
DTGVYGLIIPDLPFELSQRLKQQFSH

SEQ ID NO: 1694725 - protein, 17 aa, Staphylococcus aureus
DTHYLLGSALGPDPFPT

SEQ ID NO: 1694726 - protein, 17 aa, Staphylococcus aureus
DTILSKRPSLACLVTII

SEQ ID NO: 1694727 - protein, 21 aa, Staphylococcus aureus
DTIVVWRLDRLGRNMEDLITL

SEQ ID NO: 1694728 - protein, 22 aa, Staphylococcus aureus
DTKTVLTLCDYFGITLNEFFGI

SEQ ID NO: 1694729 - protein, 27 aa, Staphylococcus aureus
DTKVIMPMFDDALPYYKQFITEVTTFL

SEQ ID NO: 1694730 - protein, 31 aa, Staphylococcus aureus
DTKVMTVTYAGQTWTRNISDWIAKSGTTNFS

SEQ ID NO: 1694731 - protein, 17 aa, Staphylococcus aureus
DTKWRFENHFKTDDMKE

SEQ ID NO: 1694732 - protein, 19 aa, Staphylococcus aureus
DTLAYFIASSLKAPIYVLS

SEQ ID NO: 1694733 - protein, 17 aa, Staphylococcus aureus
DTLFYCTPKKETDILFI

SEQ ID NO: 1694734 - protein, 19 aa, Staphylococcus aureus
DTLLEFYNQFKEKYSELKK

SEQ ID NO: 1694735 - protein, 19 aa, Staphylococcus aureus
DTMSIVRHEPIGVVGAVVA

SEQ ID NO: 1694736 - protein, 20 aa, Staphylococcus aureus
DTPIKIILLNIEPSQITSIL

SEQ ID NO: 1694737 - protein, 23 aa, Staphylococcus aureus
DTPSKILIFQEDYPKVPKALPRY

SEQ ID NO: 1694738 - protein, 27 aa, Staphylococcus aureus
DTPYIAYKLMEILEEAGLPKGVVNFVP

SEQ ID NO: 1694739 - protein, 27 aa, Staphylococcus aureus
DTPYIAYKLMGILEEAGLPKGVVNFVP

SEQ ID NO: 1694740 - protein, 19 aa, Staphylococcus aureus
DTRILKLTQAIPNDTISVR

SEQ ID NO: 1694741 - protein, 31 aa, Staphylococcus aureus
DTRTLIPFLTMIQNTFGYLPEYIVADAGYGS

SEQ ID NO: 1694742 - protein, 25 aa, Staphylococcus aureus
DTSLRILDFSFYNPGIEKIYGSPII

SEQ ID NO: 1694743 - protein, 22 aa, Staphylococcus aureus
DTSVAVQWLIDKGYDVVACCLD

SEQ ID NO: 1694744 - protein, 27 aa, Staphylococcus aureus
DTTSFPTPKIFDWLQQQGNIETNEMYN

SEQ ID NO: 1694745 - protein, 33 aa, Staphylococcus aureus
DTTSQALDSIALVTPEHIVRAGARDAVKQQYEA

SEQ ID NO: 1694746 - protein, 28 aa, Staphylococcus aureus
DTWDVYFNDRRYRNLLGDFEDLITETKS

SEQ ID NO: 1694747 - protein, 17 aa, Staphylococcus aureus
DTYHHILKIIQKYELDY

SEQ ID NO: 1694748 - protein, 23 aa, Staphylococcus aureus
DVDAVLKRFNVALGDIEAVITEK

SEQ ID NO: 1694749 - protein, 17 aa, Staphylococcus aureus
DVDKLPKKGIDITHGDK

SEQ ID NO: 1694750 - protein, 28 aa, Staphylococcus aureus
DVDNALNAVTRAKAALNGAENLRNTKTS

SEQ ID NO: 1694751 - protein, 27 aa, Staphylococcus aureus
DVELYIGAFIYLYFKNQPRNVTKKQIT

SEQ ID NO: 1694752 - protein, 21 aa, Staphylococcus aureus
DVETLSLLYADVDALPLIDVE

SEQ ID NO: 1694753 - protein, 18 aa, Staphylococcus aureus
DVFIVLEDNKYQLKKYSV

SEQ ID NO: 1694754 - protein, 21 aa, Staphylococcus aureus
DVFKPSTYPPLSYTFDHIIIK

SEQ ID NO: 1694755 - protein, 25 aa, Staphylococcus aureus
DVGLKYRCKLPNTTFARDLYENMRV

SEQ ID NO: 1694756 - protein, 29 aa, Staphylococcus aureus
DVGQHQMWAALFYPFKNHGQWVTSGGLGT

SEQ ID NO: 1694757 - protein, 28 aa, Staphylococcus aureus
DVGTHQHLGLRALLEIASLPVPERTKEH

SEQ ID NO: 1694758 - protein, 19 aa, Staphylococcus aureus
DVHQPELAIIFGRTKRRVD

SEQ ID NO: 1694759 - protein, 22 aa, Staphylococcus aureus
DVIANIEMLYQLATGINEPVPE

SEQ ID NO: 1694760 - protein, 31 aa, Staphylococcus aureus
DVIRSYSSGFIFTTALPPVIAAGCLTSIKIV

SEQ ID NO: 1694761 - protein, 23 aa, Staphylococcus aureus
DVKGTINVFKLVPVVTNVTQSLY

SEQ ID NO: 1694762 - protein, 22 aa, Staphylococcus aureus
DVKNYVMYLYNNTELSGNEIAR

SEQ ID NO: 1694763 - protein, 24 aa, Staphylococcus aureus
DVKQYILNLIKQNKLEYGDQLPSN

SEQ ID NO: 1694764 - protein, 25 aa, Staphylococcus aureus
DVLIPLQMLVLFDKTIFKDEKQFTN

SEQ ID NO: 1694765 - protein, 30 aa, Staphylococcus aureus
DVLKEPDALVLVDWLCDIESLNDVDVLVEL

SEQ ID NO: 1694766 - protein, 18 aa, Staphylococcus aureus
DVLLYMFQEYEKGVSFQY

SEQ ID NO: 1694767 - protein, 18 aa, Staphylococcus aureus
DVLVPWVTIKDEPLVYFV

SEQ ID NO: 1694768 - protein, 22 aa, Staphylococcus aureus
DVLVQTFFKAHPPGPSKRIADV

SEQ ID NO: 1694769 - protein, 26 aa, Staphylococcus aureus
DVMAHLTMEFFTKGLVPITSLSFGYK

SEQ ID NO: 1694770 - protein, 24 aa, Staphylococcus aureus
DVNQKHFDLIKSDKNLSIIRKNGR

SEQ ID NO: 1694771 - protein, 23 aa, Staphylococcus aureus
DVPEQFSIMRYHSLISNPDNFPE

SEQ ID NO: 1694772 - protein, 29 aa, Staphylococcus aureus
DVPEYAEILAWFDAIGKKRGLIRRGNEID

SEQ ID NO: 1694773 - protein, 19 aa, Staphylococcus aureus
DVPQFKTNPILVSGVSFTP

SEQ ID NO: 1694774 - protein, 20 aa, Staphylococcus aureus
DVPQFKTNPILVSGVSFTPE

SEQ ID NO: 1694775 - protein, 22 aa, Staphylococcus aureus
DVPVYVYKLFPEGPITMTLIRE

SEQ ID NO: 1694776 - protein, 26 aa, Staphylococcus aureus
DVQFLPGYCVLLPKREVRLLNDLTLE

SEQ ID NO: 1694777 - protein, 23 aa, Staphylococcus aureus
DVRSTMKVVLPKGWTLKNVVNHF

SEQ ID NO: 1694778 - protein, 23 aa, Staphylococcus aureus
DVSALTVYELLMDKCYLGLHSHI

SEQ ID NO: 1694779 - protein, 19 aa, Staphylococcus aureus
DVSGIGLDLFAGSGALGIE

SEQ ID NO: 1694780 - protein, 17 aa, Staphylococcus aureus
DVSRVALDYALTGLEFA

SEQ ID NO: 1694781 - protein, 28 aa, Staphylococcus aureus
DVTIEPSPIWMQAHLIKAGIRPINNVVD

SEQ ID NO: 1694782 - protein, 21 aa, Staphylococcus aureus
DVTQLLRLLHDKYPQAFIHMI

SEQ ID NO: 1694783 - protein, 25 aa, Staphylococcus aureus
DVTTGKDIIPPKTYSGNVDQVVTID

SEQ ID NO: 1694784 - protein, 17 aa, Staphylococcus aureus
DVVLLNAGLSLYVAEKV

SEQ ID NO: 1694785 - protein, 24 aa, Staphylococcus aureus
DVVSNIVYIRWFEDLRTAFINQHM

SEQ ID NO: 1694786 - protein, 19 aa, Staphylococcus aureus
DVYGILPTNLQRYQCLVVS

SEQ ID NO: 1694787 - protein, 23 aa, Staphylococcus aureus
DWANMLFRMYQRYCEKKGFKVET

SEQ ID NO: 1694788 - protein, 20 aa, Staphylococcus aureus
DWEGQFANKVKDVLLIMAKF

SEQ ID NO: 1694789 - protein, 25 aa, Staphylococcus aureus
DWRTKKPVIFRATPQWFASISKVRK

SEQ ID NO: 1694790 - protein, 24 aa, Staphylococcus aureus
DWRTKKPVIFRATSQWFASISKVR

SEQ ID NO: 1694791 - protein, 25 aa, Staphylococcus aureus
DWYNASYIIMWGSNVPLTRTPDAHF

SEQ ID NO: 1694792 - protein, 20 aa, Staphylococcus aureus
DYAIRLLEDKALYNKLQKNM

SEQ ID NO: 1694793 - protein, 25 aa, Staphylococcus aureus
DYATNIAMVLTKIAKRNPCEIAQAI

SEQ ID NO: 1694794 - protein, 24 aa, Staphylococcus aureus
DYDEKLIIPGFFGVSHEGYIVTFP

SEQ ID NO: 1694795 - protein, 17 aa, Staphylococcus aureus
DYDIDFITGHSLGGRDT

SEQ ID NO: 1694796 - protein, 29 aa, Staphylococcus aureus
DYDIVFSPMFVLTHKKLFITKVALSENEQ

SEQ ID NO: 1694797 - protein, 21 aa, Staphylococcus aureus
DYEGWWLFSDWPENIVEKYQY

SEQ ID NO: 1694798 - protein, 25 aa, Staphylococcus aureus
DYEILKPKIVFNGSNPYLALNHIIV

SEQ ID NO: 1694799 - protein, 25 aa, Staphylococcus aureus
DYEKYVISDAVHIGWKGWVYMDEQI

SEQ ID NO: 1694800 - protein, 23 aa, Staphylococcus aureus
DYETFILDFTGLGFGPAAVIITD

SEQ ID NO: 1694801 - protein, 24 aa, Staphylococcus aureus
DYETWRTYMLAQETFTGGVTPVAK

SEQ ID NO: 1694802 - protein, 28 aa, Staphylococcus aureus
DYHDIKSPMVGTFFLQDSKELNEPIVNV

SEQ ID NO: 1694803 - protein, 28 aa, Staphylococcus aureus
DYHDIKSPMVGTFFLQDSKELTESIVKV

SEQ ID NO: 1694804 - protein, 22 aa, Staphylococcus aureus
DYIFVDDFHPLIYTVRFRPSQE

SEQ ID NO: 1694805 - protein, 20 aa, Staphylococcus aureus
DYKDKLRREYLKQSDRIEGD

SEQ ID NO: 1694806 - protein, 24 aa, Staphylococcus aureus
DYKKLILEVLAHTLIINKEFKRML

SEQ ID NO: 1694807 - protein, 22 aa, Staphylococcus aureus
DYKNIVLAGKYNSRMTSFGTTK

SEQ ID NO: 1694808 - protein, 23 aa, Staphylococcus aureus
DYKQVIEFIIDFIETHDLNVKAV

SEQ ID NO: 1694809 - protein, 18 aa, Staphylococcus aureus
DYLVLIYLNEFKNRQGKY

SEQ ID NO: 1694810 - protein, 19 aa, Staphylococcus aureus
DYMDIIKKRGGFNKINAVK

SEQ ID NO: 1694811 - protein, 23 aa, Staphylococcus aureus
DYMRHMFIEFVRTYYGYDERVSL

SEQ ID NO: 1694812 - protein, 23 aa, Staphylococcus aureus
DYNNFIMISYIKDKVNALYTNQN

SEQ ID NO: 1694813 - protein, 29 aa, Staphylococcus aureus
DYPNQINNVLAFPGIFRGALEAEATHINE

SEQ ID NO: 1694814 - protein, 18 aa, Staphylococcus aureus
DYQEVLTLLRNDSLDESY

SEQ ID NO: 1694815 - protein, 20 aa, Staphylococcus aureus
DYQLFIDPSILLNTNYNWKN

SEQ ID NO: 1694816 - protein, 22 aa, Staphylococcus aureus
DYREPVYERPQPKDDYYDVPKY

SEQ ID NO: 1694817 - protein, 27 aa, Staphylococcus aureus
DYSNLFNYLIKFLEDCNNFKLLLVNYL

SEQ ID NO: 1694818 - protein, 34 aa, Staphylococcus aureus
DYSSLIYEYAVFKKPMIFYAFDLEYYITTRDFYE

SEQ ID NO: 1694819 - protein, 25 aa, Staphylococcus aureus
DYVLNQPLYQLIEQVKPRLTKAKIK

SEQ ID NO: 1694820 - protein, 20 aa, Staphylococcus aureus
EAAIIFATAKFKPFHNRIKN

SEQ ID NO: 1694821 - protein, 17 aa, Staphylococcus aureus
EAALQRVKTAKNALNGD

SEQ ID NO: 1694822 - protein, 17 aa, Staphylococcus aureus
EAARTRNPIRLMIGFDY

SEQ ID NO: 1694823 - protein, 23 aa, Staphylococcus aureus
EADASLAMLLYRDDYYNRDEDDG

SEQ ID NO: 1694824 - protein, 24 aa, Staphylococcus aureus
EADFINCVVFRRQADNVNNYLSKG

SEQ ID NO: 1694825 - protein, 22 aa, Staphylococcus aureus
EAEDYYEMIEWAAKQPWSNGNI

SEQ ID NO: 1694826 - protein, 23 aa, Staphylococcus aureus
EAEGRFDFIYIQAPYSETLTNLL

SEQ ID NO: 1694827 - protein, 22 aa, Staphylococcus aureus
EAFIETAKIVLHWLKEHNIQVD

SEQ ID NO: 1694828 - protein, 24 aa, Staphylococcus aureus
EAFKDRILIPKNNLDYVPKKIKYY

SEQ ID NO: 1694829 - protein, 25 aa, Staphylococcus aureus
EAINRVNTLKNRALNDIGVTSTTAM

SEQ ID NO: 1694830 - protein, 25 aa, Staphylococcus aureus
EAISSALINVAWFWHTSYSHRTEQA

SEQ ID NO: 1694831 - protein, 27 aa, Staphylococcus aureus
EAKNYAHRLLMDLGFSRDVMSQSPFQM

SEQ ID NO: 1694832 - protein, 26 aa, Staphylococcus aureus
EAKNYAHRLLMDLGFSREVMSQSPFQ

SEQ ID NO: 1694833 - protein, 17 aa, Staphylococcus aureus
EALALSDFLFVLKDGKI

SEQ ID NO: 1694834 - protein, 18 aa, Staphylococcus aureus
EALKALGYKVYIGSRNDV

SEQ ID NO: 1694835 - protein, 19 aa, Staphylococcus aureus
EALNAPYGMRLAEYKEIVL

SEQ ID NO: 1694836 - protein, 21 aa, Staphylococcus aureus
EALNAPYGMRLAEYKEIVLSK

SEQ ID NO: 1694837 - protein, 32 aa, Staphylococcus aureus
EALPERDTIITIWVKLLILSGKYNEQGYIMLS

SEQ ID NO: 1694838 - protein, 26 aa, Staphylococcus aureus
EALVKALQAWDIDHLYGIPGDSIDAV

SEQ ID NO: 1694839 - protein, 18 aa, Staphylococcus aureus
EAMISKRPVVAFDIKYGP

SEQ ID NO: 1694840 - protein, 18 aa, Staphylococcus aureus
EAMVRMAQDFSYRYPLVD

SEQ ID NO: 1694841 - protein, 25 aa, Staphylococcus aureus
EANANRYTFVWKKSIQNHESKLNEN

SEQ ID NO: 1694842 - protein, 23 aa, Staphylococcus aureus
EANVKYLALDLGSDNIRVNAISA

SEQ ID NO: 1694843 - protein, 18 aa, Staphylococcus aureus
EAPCYIAWSGKNRSPLIR

SEQ ID NO: 1694844 - protein, 22 aa, Staphylococcus aureus
EAPMFKKILKKHQLFDDAFRAT

SEQ ID NO: 1694845 - protein, 22 aa, Staphylococcus aureus
EAQALDQLMDALQQSIADKDAT

SEQ ID NO: 1694846 - protein, 29 aa, Staphylococcus aureus
EAREALNGYFRENIFTSYINGNDLPYEHN

SEQ ID NO: 1694847 - protein, 23 aa, Staphylococcus aureus
EARGFIIGCPVAYSMGIGFAPVR

SEQ ID NO: 1694848 - protein, 17 aa, Staphylococcus aureus
EARSIRIDLPPFTLVGA

SEQ ID NO: 1694849 - protein, 25 aa, Staphylococcus aureus
EARVAPHPFTNFMNYAFLEKSGADV

SEQ ID NO: 1694850 - protein, 17 aa, Staphylococcus aureus
EATAVAGYKAWKNKFDR

SEQ ID NO: 1694851 - protein, 25 aa, Staphylococcus aureus
EATRTYNLHFFTPSSIGAFGDSTPK

SEQ ID NO: 1694852 - protein, 26 aa, Staphylococcus aureus
EATTNSAFLIYLFAKDLSNHDELMTQ

SEQ ID NO: 1694853 - protein, 21 aa, Staphylococcus aureus
EAVAYYIEQGFTILRSYQPEM

SEQ ID NO: 1694854 - protein, 27 aa, Staphylococcus aureus
EAVDEFLLNILDDKKFIEWIANKRSNK

SEQ ID NO: 1694855 - protein, 23 aa, Staphylococcus aureus
EAVDLFGCIIYPNDTEIGFYSPE

SEQ ID NO: 1694856 - protein, 20 aa, Staphylococcus aureus
EAVRRNPYSVILLDEVEKAH

SEQ ID NO: 1694857 - protein, 20 aa, Staphylococcus aureus
EAYVIIFMVNVREGLTQSDE

SEQ ID NO: 1694858 - protein, 21 aa, Staphylococcus aureus
ECKIGIMPGYIHKKGHVGVVS

SEQ ID NO: 1694859 - protein, 26 aa, Staphylococcus aureus
EDAEILAWFDAIGKKRGLIRRGNEID

SEQ ID NO: 1694860 - protein, 20 aa, Staphylococcus aureus
EDALRMIRCLRFQSQLSFEI

SEQ ID NO: 1694861 - protein, 27 aa, Staphylococcus aureus
EDCNNFKLLLVNYLSKKIYCLENKRIN

SEQ ID NO: 1694862 - protein, 22 aa, Staphylococcus aureus
EDCRRTMDIFRLLGVDIKEYED

SEQ ID NO: 1694863 - protein, 23 aa, Staphylococcus aureus
EDCRRTMDIFRLLGVDIKEYEDK

SEQ ID NO: 1694864 - protein, 18 aa, Staphylococcus aureus
EDDLAMIFVVINQHSKKA

SEQ ID NO: 1694865 - protein, 26 aa, Staphylococcus aureus
EDDLRKIIPRIPLLKNVKKFVNIGKK

SEQ ID NO: 1694866 - protein, 20 aa, Staphylococcus aureus
EDDNIFPTKAFYILNDDMTM

SEQ ID NO: 1694867 - protein, 25 aa, Staphylococcus aureus
EDELALIRILSPNDDYFYQSIVNYI

SEQ ID NO: 1694868 - protein, 33 aa, Staphylococcus aureus
EDGIPNTFVPARNLLFLSFAGALAYQIGAKHII

SEQ ID NO: 1694869 - protein, 23 aa, Staphylococcus aureus
EDGIYIDVYCALKHGVNISKTAN

SEQ ID NO: 1694870 - protein, 18 aa, Staphylococcus aureus
EDIALIYREFEQRIQNEF

SEQ ID NO: 1694871 - protein, 17 aa, Staphylococcus aureus
EDIITTMRLKESGLILG

SEQ ID NO: 1694872 - protein, 18 aa, Staphylococcus aureus
EDIQGYALTPLKYKDTFI

SEQ ID NO: 1694873 - protein, 22 aa, Staphylococcus aureus
EDKKQAIIEIFDKRIRHYDFEK

SEQ ID NO: 1694874 - protein, 24 aa, Staphylococcus aureus
EDKLEQDLIKKFKLIGLVNADQTV

SEQ ID NO: 1694875 - protein, 28 aa, Staphylococcus aureus
EDKQKIIITLYDKFFSTAFKSTTERLGI

SEQ ID NO: 1694876 - protein, 24 aa, Staphylococcus aureus
EDKQKVLLYANKDNDMYYLNSGST

SEQ ID NO: 1694877 - protein, 24 aa, Staphylococcus aureus
EDKRYLFEAVYGDGIIRMYELNTH

SEQ ID NO: 1694878 - protein, 29 aa, Staphylococcus aureus
EDKVYNLDPKLWYFAAGSTTTTIKQIDEL

SEQ ID NO: 1694879 - protein, 21 aa, Staphylococcus aureus
EDKWVYEMLGMDSTCPKDVLT

SEQ ID NO: 1694880 - protein, 23 aa, Staphylococcus aureus
EDLDPTFMWHLAFAYGQEERDKE

SEQ ID NO: 1694881 - protein, 19 aa, Staphylococcus aureus
EDLRIISCHIGNGASIAAI

SEQ ID NO: 1694882 - protein, 27 aa, Staphylococcus aureus
EDLRQTIHTFLPLAHIIKVSDEELEFI

SEQ ID NO: 1694883 - protein, 24 aa, Staphylococcus aureus
EDLRSEIMTPWIPADTNIGGEFVP

SEQ ID NO: 1694884 - protein, 23 aa, Staphylococcus aureus
EDNRHVYLKGHVYPRKGYNPTDE

SEQ ID NO: 1694885 - protein, 21 aa, Staphylococcus aureus
EDNYRLILLTRHQNDIPMWLR

SEQ ID NO: 1694886 - protein, 22 aa, Staphylococcus aureus
EDSAFGFIKMKNGATIMLESAW

SEQ ID NO: 1694887 - protein, 25 aa, Staphylococcus aureus
EDSKYILNLLLSVINLSLKTLDLID

SEQ ID NO: 1694888 - protein, 20 aa, Staphylococcus aureus
EDSLKIDYYTSKLEVLRNAE

SEQ ID NO: 1694889 - protein, 25 aa, Staphylococcus aureus
EDTELNLFSFVKQLSDIPLGGIIYT

SEQ ID NO: 1694890 - protein, 18 aa, Staphylococcus aureus
EDVHILDPFTGTGTFIVR

SEQ ID NO: 1694891 - protein, 22 aa, Staphylococcus aureus
EDVKIAISDRFKLLQSQYTDEK

SEQ ID NO: 1694892 - protein, 21 aa, Staphylococcus aureus
EDVKMAISDRFKLLQSQYTDE

SEQ ID NO: 1694893 - protein, 23 aa, Staphylococcus aureus
EDYCIPRPFDKRVAPSVARNVAK

SEQ ID NO: 1694894 - protein, 19 aa, Staphylococcus aureus
EDYLLFINAIEQEFKDIAN

SEQ ID NO: 1694895 - protein, 22 aa, Staphylococcus aureus
EEDALKPLIFKTKVTSLEDIDK

SEQ ID NO: 1694896 - protein, 26 aa, Staphylococcus aureus
EEEDFVVEGPLWIQVHAFDKGVEVTI

SEQ ID NO: 1694897 - protein, 26 aa, Staphylococcus aureus
EEEKKVPINLWIDGKQNTVPLGTVKT

SEQ ID NO: 1694898 - protein, 17 aa, Staphylococcus aureus
EEELSQDIAVLVKEKEK

SEQ ID NO: 1694899 - protein, 18 aa, Staphylococcus aureus
EEERQLSYSFDKSTNDRE

SEQ ID NO: 1694900 - protein, 40 aa, Staphylococcus aureus
EEFNSKQIYLIAKLFTYFVEHPIIFIGYSLNDSNIKSILG

SEQ ID NO: 1694901 - protein, 23 aa, Staphylococcus aureus
EEGVDALLFETYYDLEELTNVIS

SEQ ID NO: 1694902 - protein, 25 aa, Staphylococcus aureus
EEIEWQNYWKTFASDWLTSLNMSSD

SEQ ID NO: 1694903 - protein, 30 aa, Staphylococcus aureus
EEIFDDLWMNLYYLFMNLRDLFKEEDLEPW

SEQ ID NO: 1694904 - protein, 30 aa, Staphylococcus aureus
EEIFDDLWMNLYYLFMNLRDLFKEEGLEPW

SEQ ID NO: 1694905 - protein, 29 aa, Staphylococcus aureus
EEIFDDLWMNLYYLFMNLRDLFKKEDLEP

SEQ ID NO: 1694906 - protein, 33 aa, Staphylococcus aureus
EEILLDLQERGLKNVLLFITDGLKGMVGAISRF

SEQ ID NO: 1694907 - protein, 24 aa, Staphylococcus aureus
EEKGFSYLMLFDDYNKIDLTLLPL

SEQ ID NO: 1694908 - protein, 31 aa, Staphylococcus aureus
EEKKKEYEKFGRWFFNKFNVNRSADAKKIIN

SEQ ID NO: 1694909 - protein, 26 aa, Staphylococcus aureus
EEKNYLEAVIGLPANIFYGTSIPTCI

SEQ ID NO: 1694910 - protein, 29 aa, Staphylococcus aureus
EEKNYLEAVIGLPANIFYGTSIPTCILVF

SEQ ID NO: 1694911 - protein, 24 aa, Staphylococcus aureus
EEKQVALNQLANNEKLALQNINQA

SEQ ID NO: 1694912 - protein, 24 aa, Staphylococcus aureus
EEKSYPLYILLDKEFEVIEPVKRF

SEQ ID NO: 1694913 - protein, 17 aa, Staphylococcus aureus
EEKTLYRVAYQYETQYN

SEQ ID NO: 1694914 - protein, 29 aa, Staphylococcus aureus
EELPISRLLQWGADFVKPLARLAYNGGGE

SEQ ID NO: 1694915 - protein, 19 aa, Staphylococcus aureus
EEMRLVYVALTRAKEQLYL

SEQ ID NO: 1694916 - protein, 26 aa, Staphylococcus aureus
EENYKERFYQLPKVFFTNPNYKDLSN

SEQ ID NO: 1694917 - protein, 17 aa, Staphylococcus aureus
EEPDSLIVIYHGGLNKI

SEQ ID NO: 1694918 - protein, 25 aa, Staphylococcus aureus
EEQLKSVVIAYEPIWAIGTGKSSTS

SEQ ID NO: 1694919 - protein, 19 aa, Staphylococcus aureus
EEQQKIFEPFYTGSNKYFK

SEQ ID NO: 1694920 - protein, 22 aa, Staphylococcus aureus
EERKRRLRPWLYDGTPQKHSRD

SEQ ID NO: 1694921 - protein, 23 aa, Staphylococcus aureus
EERKRRLRPWLYDGTPQKHSRDP

SEQ ID NO: 1694922 - protein, 20 aa, Staphylococcus aureus
EERNNRMSNYSKNNLRNVVT

SEQ ID NO: 1694923 - protein, 17 aa, Staphylococcus aureus
EERQLNYSFDTVTNNRE

SEQ ID NO: 1694924 - protein, 17 aa, Staphylococcus aureus
EESKVIAPFNGLVSMIV

SEQ ID NO: 1694925 - protein, 25 aa, Staphylococcus aureus
EETKKYNDKLQDILDKEKQVKDEKA

SEQ ID NO: 1694926 - protein, 23 aa, Staphylococcus aureus
EETPIVMSSRIRLARNLENHVHP

SEQ ID NO: 1694927 - protein, 29 aa, Staphylococcus aureus
EEVEKLIYRPIREMYIPIPNSKKFHESNP

SEQ ID NO: 1694928 - protein, 33 aa, Staphylococcus aureus
EEVRALNEFAINGLYPDLTIYLNVSAEVGRERI

SEQ ID NO: 1694929 - protein, 24 aa, Staphylococcus aureus
EEYAKLPLVLPNKLEQQKIAEFLD

SEQ ID NO: 1694930 - protein, 24 aa, Staphylococcus aureus
EEYKNAIFTYLFTSKGKLKEHVLL

SEQ ID NO: 1694931 - protein, 23 aa, Staphylococcus aureus
EEYKYLRALIFNETELEEAYKWM

SEQ ID NO: 1694932 - protein, 17 aa, Staphylococcus aureus
EEYWTIDGEFRYKKSKF

SEQ ID NO: 1694933 - protein, 42 aa, Staphylococcus aureus
EFEKQFGFMLKPWTTVRFMNVIPNRFIYKIALVGKDEKKYKD

SEQ ID NO: 1694934 - protein, 23 aa, Staphylococcus aureus
EFEVRRFFIKLIDQRLNHDITKS

SEQ ID NO: 1694935 - protein, 17 aa, Staphylococcus aureus
EFFKKVFVGYTDSEDHS

SEQ ID NO: 1694936 - protein, 17 aa, Staphylococcus aureus
EFGEHYARLRPKKLKAN

SEQ ID NO: 1694937 - protein, 22 aa, Staphylococcus aureus
EFHHPIFAVSPILKCLILKGLV

SEQ ID NO: 1694938 - protein, 18 aa, Staphylococcus aureus
EFIGRVPIVANLETLDVT

SEQ ID NO: 1694939 - protein, 24 aa, Staphylococcus aureus
EFKEGAFYITFSNVTELLSENDDI

SEQ ID NO: 1694940 - protein, 27 aa, Staphylococcus aureus
EFKGFLGNNIVKFFDYTFASVGVKPNE

SEQ ID NO: 1694941 - protein, 21 aa, Staphylococcus aureus
EFKNNLALCVYYLEKLIKDNK

SEQ ID NO: 1694942 - protein, 21 aa, Staphylococcus aureus
EFKNNLALCVYYLEKLIKDSK

SEQ ID NO: 1694943 - protein, 22 aa, Staphylococcus aureus
EFKQFELFKQSELFVQYPHLKS

SEQ ID NO: 1694944 - protein, 28 aa, Staphylococcus aureus
EFKSIDFINLYFLHILSTARTFYQYTEN

SEQ ID NO: 1694945 - protein, 26 aa, Staphylococcus aureus
EFLDDYLYTAWIIPVLLNEHATSQLE

SEQ ID NO: 1694946 - protein, 19 aa, Staphylococcus aureus
EFMRDLQGAVFLSQLTFWA

SEQ ID NO: 1694947 - protein, 33 aa, Staphylococcus aureus
EFNQLINWVMDVSDIQYLAIASWGRHIYQNTSR

SEQ ID NO: 1694948 - protein, 17 aa, Staphylococcus aureus
EFRKEILQAMRVGVWAP

SEQ ID NO: 1694949 - protein, 22 aa, Staphylococcus aureus
EFSGLMDNMRYLYDDKHVSETN

SEQ ID NO: 1694950 - protein, 29 aa, Staphylococcus aureus
EFSKLLNVLETYLFQWNLYIHEIDEDEEI

SEQ ID NO: 1694951 - protein, 19 aa, Staphylococcus aureus
EFVENAKEKATDFIDKVKG

SEQ ID NO: 1694952 - protein, 17 aa, Staphylococcus aureus
EFYHTILQLERTSQLEL

SEQ ID NO: 1694953 - protein, 32 aa, Staphylococcus aureus
EGANIEIGYLPGRLKWLVAELLTKQGLKVVND

SEQ ID NO: 1694954 - protein, 25 aa, Staphylococcus aureus
EGAQKIYDLFKPILEKKDKKLSDDI

SEQ ID NO: 1694955 - protein, 17 aa, Staphylococcus aureus
EGEMIMLSIKHLTKIYS

SEQ ID NO: 1694956 - protein, 31 aa, Staphylococcus aureus
EGFGKEVKRRIFLGTFALSSGYYDAYYKKSH

SEQ ID NO: 1694957 - protein, 17 aa, Staphylococcus aureus
EGFINFCHKRLLFVDTM

SEQ ID NO: 1694958 - protein, 17 aa, Staphylococcus aureus
EGGFIDIPYLTGHEFGA

SEQ ID NO: 1694959 - protein, 20 aa, Staphylococcus aureus
EGGFIDIPYLTGHEFGARLP

SEQ ID NO: 1694960 - protein, 19 aa, Staphylococcus aureus
EGHYKVNFPVTLGHEFSGE

SEQ ID NO: 1694961 - protein, 19 aa, Staphylococcus aureus
EGIAQIQVMYDPGLILIGG

SEQ ID NO: 1694962 - protein, 23 aa, Staphylococcus aureus
EGIAQIQVMYDPGLILIGGGISE

SEQ ID NO: 1694963 - protein, 17 aa, Staphylococcus aureus
EGIYLSLNQGWSKISNM

SEQ ID NO: 1694964 - protein, 26 aa, Staphylococcus aureus
EGKFRGDTFFPPYTFEDWEVASSVEG

SEQ ID NO: 1694965 - protein, 24 aa, Staphylococcus aureus
EGKHSPIIIQDLWDKVQLRKKQVS

SEQ ID NO: 1694966 - protein, 23 aa, Staphylococcus aureus
EGKYTADYLADKGVVPFLKVDKG

SEQ ID NO: 1694967 - protein, 18 aa, Staphylococcus aureus
EGLAIKASKFPYAANGRA

SEQ ID NO: 1694968 - protein, 24 aa, Staphylococcus aureus
EGLFWVLSNLLIQELVLTKKFAHL

SEQ ID NO: 1694969 - protein, 17 aa, Staphylococcus aureus
EGLLKEIEDVYKKARAF

SEQ ID NO: 1694970 - protein, 18 aa, Staphylococcus aureus
EGLLKEIEDVYKKARAFD

SEQ ID NO: 1694971 - protein, 17 aa, Staphylococcus aureus
EGLPISIIEAMAIGLPV

SEQ ID NO: 1694972 - protein, 17 aa, Staphylococcus aureus
EGLRLQNRKLRRPNLTF

SEQ ID NO: 1694973 - protein, 28 aa, Staphylococcus aureus
EGLTTIGLDLPFPIKINQMLGHQTSFLT

SEQ ID NO: 1694974 - protein, 21 aa, Staphylococcus aureus
EGRFDFIYIQAPYSETLMNLL

SEQ ID NO: 1694975 - protein, 19 aa, Staphylococcus aureus
EGRLRKYLQEICAVDQDFV

SEQ ID NO: 1694976 - protein, 24 aa, Staphylococcus aureus
EGSQKLMIIKRGPIVEIENQKYMF

SEQ ID NO: 1694977 - protein, 31 aa, Staphylococcus aureus
EGTEAFIETAKIVLRWLKEQGIQVDLLNLGG

SEQ ID NO: 1694978 - protein, 30 aa, Staphylococcus aureus
EGTEAFIETAKIVLRWLKEQGIQVELLNLG

SEQ ID NO: 1694979 - protein, 22 aa, Staphylococcus aureus
EGTKYLAWSLIDYDAIPVCGFA

SEQ ID NO: 1694980 - protein, 25 aa, Staphylococcus aureus
EGTMPQTRFVLKKALEQNLKPVVVV

SEQ ID NO: 1694981 - protein, 25 aa, Staphylococcus aureus
EGTRPLLIEVQALVTPMTFNNPRRM

SEQ ID NO: 1694982 - protein, 26 aa, Staphylococcus aureus
EGTYYPRTFIQQLFVDGYFGEAALRK

SEQ ID NO: 1694983 - protein, 17 aa, Staphylococcus aureus
EGVLYNLYTVYLALIEV

SEQ ID NO: 1694984 - protein, 26 aa, Staphylococcus aureus
EGVYIVPAFVGLGTPYWDSEARGAIF

SEQ ID NO: 1694985 - protein, 22 aa, Staphylococcus aureus
EGWIIFFLNATERMINSILKKI

SEQ ID NO: 1694986 - protein, 26 aa, Staphylococcus aureus
EHALKIELDFYFPLLKSWSKKKKSEM

SEQ ID NO: 1694987 - protein, 18 aa, Staphylococcus aureus
EHDFRWEPTILSKSIKDL

SEQ ID NO: 1694988 - protein, 17 aa, Staphylococcus aureus
EHDIIYTTNGRLGFDYL

SEQ ID NO: 1694989 - protein, 25 aa, Staphylococcus aureus
EHDIYVYDRFCSLWEVEVVEKLNKD

SEQ ID NO: 1694990 - protein, 19 aa, Staphylococcus aureus
EHDVQPILDIGIFGGFVGS

SEQ ID NO: 1694991 - protein, 19 aa, Staphylococcus aureus
EHFILKKVRKKFKKLNEIN

SEQ ID NO: 1694992 - protein, 24 aa, Staphylococcus aureus
EHFSKLDVPFIYRVHEQPKSDRLR

SEQ ID NO: 1694993 - protein, 24 aa, Staphylococcus aureus
EHFSKLNVPFIYRVHEQPKSDRLR

SEQ ID NO: 1694994 - protein, 23 aa, Staphylococcus aureus
EHHLKKRLQEQLFLVVEEGNDIV

SEQ ID NO: 1694995 - protein, 17 aa, Staphylococcus aureus
EHIKSLYEEIIELQNEK

SEQ ID NO: 1694996 - protein, 29 aa, Staphylococcus aureus
EHPEGIYLSGALLMFAGSKSYYLYGASSN

SEQ ID NO: 1694997 - protein, 19 aa, Staphylococcus aureus
EHPNVVRIIVLSGGYSREK

SEQ ID NO: 1694998 - protein, 18 aa, Staphylococcus aureus
EHTINKLFIIVDNRVGKN

SEQ ID NO: 1694999 - protein, 23 aa, Staphylococcus aureus
EIAGVFGIPLHKFGIETANMSIT

SEQ ID NO: 1695000 - protein, 17 aa, Staphylococcus aureus
EIAIRIFRAAAELDIST

SEQ ID NO: 1695001 - protein, 20 aa, Staphylococcus aureus
EIAPYKRPLSNMAPTIVMHH

SEQ ID NO: 1695002 - protein, 23 aa, Staphylococcus aureus
EIAQYFTDKIIGLSISDLGEYAK

SEQ ID NO: 1695003 - protein, 27 aa, Staphylococcus aureus
EIDNHQIIWVILNYEFNEARPTIGQSD

SEQ ID NO: 1695004 - protein, 28 aa, Staphylococcus aureus
EIDPDVLRFFMISVHYRSPINYNLELVE

SEQ ID NO: 1695005 - protein, 19 aa, Staphylococcus aureus
EIDYPEKFVTLKHQHILGT

SEQ ID NO: 1695006 - protein, 24 aa, Staphylococcus aureus
EIEDKLIQLSQRKLIEQNNLNHYE

SEQ ID NO: 1695007 - protein, 24 aa, Staphylococcus aureus
EIEDKLMQLSQRKLIEQNNLNHYE

SEQ ID NO: 1695008 - protein, 28 aa, Staphylococcus aureus
EIEDVYKKAQAFDRLLEDINNFTQSPTK

SEQ ID NO: 1695009 - protein, 19 aa, Staphylococcus aureus
EIEEFKKIILKTIFGETEV

SEQ ID NO: 1695010 - protein, 26 aa, Staphylococcus aureus
EIEEFLERPIPSDYWYRTLEEKRVSA

SEQ ID NO: 1695011 - protein, 19 aa, Staphylococcus aureus
EIEYPEKFVTLKHQHILGT

SEQ ID NO: 1695012 - protein, 25 aa, Staphylococcus aureus
EIFDDLWMELYRSFKKLRNIFKEES

SEQ ID NO: 1695013 - protein, 29 aa, Staphylococcus aureus
EIFDDLWMNLYYLFKNLRNLFKTEEHEPW

SEQ ID NO: 1695014 - protein, 29 aa, Staphylococcus aureus
EIFDDLWMNLYYLFMNLRDLFKEEDLEPW

SEQ ID NO: 1695015 - protein, 26 aa, Staphylococcus aureus
EIFEKSFDLLFVKWIPREQNKEANQH

SEQ ID NO: 1695016 - protein, 19 aa, Staphylococcus aureus
EIFHNLKSILSKRGLETAV

SEQ ID NO: 1695017 - protein, 18 aa, Staphylococcus aureus
EIFRSMGVAVPEGRVAFT

SEQ ID NO: 1695018 - protein, 17 aa, Staphylococcus aureus
EIGKGISTYWWNANNWD

SEQ ID NO: 1695019 - protein, 19 aa, Staphylococcus aureus
EIGMVCDGYLMRIENLTPS

SEQ ID NO: 1695020 - protein, 18 aa, Staphylococcus aureus
EIHIDYQAQGREARVSAV

SEQ ID NO: 1695021 - protein, 26 aa, Staphylococcus aureus
EIHIQQYNYLLKRYLLNIERENDISM

SEQ ID NO: 1695022 - protein, 30 aa, Staphylococcus aureus
EIIKGIIDGLNLLITMLYEKRIIDGLKESS

SEQ ID NO: 1695023 - protein, 18 aa, Staphylococcus aureus
EIISIHLSSGLSGTYNTA

SEQ ID NO: 1695024 - protein, 17 aa, Staphylococcus aureus
EIKFLYDEQKLSGEEIA

SEQ ID NO: 1695025 - protein, 26 aa, Staphylococcus aureus
EIKKDIGMIFQHFNLLNSATVFKNVA

SEQ ID NO: 1695026 - protein, 22 aa, Staphylococcus aureus
EIKMLEKKLTKWINQKIIHKKQ

SEQ ID NO: 1695027 - protein, 34 aa, Staphylococcus aureus
EIKNISPLRLQKTLYFLFAYYGASYGQLSKSKEY

SEQ ID NO: 1695028 - protein, 25 aa, Staphylococcus aureus
EIKNWEFPFVIKPGDDLPAAGGYGV

SEQ ID NO: 1695029 - protein, 31 aa, Staphylococcus aureus
EILLDLQERGLKNVLLFITDGLKGMVGAISR

SEQ ID NO: 1695030 - protein, 17 aa, Staphylococcus aureus
EILLQEFPEQLTNYLLK

SEQ ID NO: 1695031 - protein, 30 aa, Staphylococcus aureus
EILLQEFPEQLTNYLLKYDYRDLEIIKAVI

SEQ ID NO: 1695032 - protein, 18 aa, Staphylococcus aureus
EILLRKDSINQEIIKIEN

SEQ ID NO: 1695033 - protein, 19 aa, Staphylococcus aureus
EILMCDTSIKKLLSNEVEV

SEQ ID NO: 1695034 - protein, 21 aa, Staphylococcus aureus
EILQGLIFVSSKKEAYDLADK

SEQ ID NO: 1695035 - protein, 19 aa, Staphylococcus aureus
EILVNLKKIPLPLFEMEKV

SEQ ID NO: 1695036 - protein, 17 aa, Staphylococcus aureus
EILYNTELGYYRGSNHL

SEQ ID NO: 1695037 - protein, 29 aa, Staphylococcus aureus
EINLTRLSIFIFIINILKQLRGIVIYQND

SEQ ID NO: 1695038 - protein, 23 aa, Staphylococcus aureus
EIPKDFILLPTHPYQINVLRQHP

SEQ ID NO: 1695039 - protein, 24 aa, Staphylococcus aureus
EIPKNFILLPTHPYQINVLRQHPQ

SEQ ID NO: 1695040 - protein, 19 aa, Staphylococcus aureus
EIQKLILAYEKTEIGFGEE

SEQ ID NO: 1695041 - protein, 23 aa, Staphylococcus aureus
EIQNRIIPRILKKTNLIGQSQTG

SEQ ID NO: 1695042 - protein, 19 aa, Staphylococcus aureus
EIQPKFELLPKLDKQRKIE

SEQ ID NO: 1695043 - protein, 17 aa, Staphylococcus aureus
EIRYALENKIGYFVIDS

SEQ ID NO: 1695044 - protein, 28 aa, Staphylococcus aureus
EISNIFYDIDLCLDFLLDHNFSLTMHLN

SEQ ID NO: 1695045 - protein, 29 aa, Staphylococcus aureus
EISNIFYDIDLCLDFLLDNNFSLTMHLDH

SEQ ID NO: 1695046 - protein, 20 aa, Staphylococcus aureus
EITKQMMRILRKIATGETIS

SEQ ID NO: 1695047 - protein, 22 aa, Staphylococcus aureus
EITSIFYPKMFKAHPELLNMFN

SEQ ID NO: 1695048 - protein, 19 aa, Staphylococcus aureus
EITVYIKAHYPDIKVLVLT

SEQ ID NO: 1695049 - protein, 18 aa, Staphylococcus aureus
EIYDDYFLKNDEWHISAF

SEQ ID NO: 1695050 - protein, 26 aa, Staphylococcus aureus
EIYPHHHPKFNISEKSLLISAEVVGT

SEQ ID NO: 1695051 - protein, 24 aa, Staphylococcus aureus
EIYVFEEYILFDLEINKVINELDI

SEQ ID NO: 1695052 - protein, 18 aa, Staphylococcus aureus
EIYYCSISYLSTVYLEYI

SEQ ID NO: 1695053 - protein, 19 aa, Staphylococcus aureus
EKAWKLLDLPEEIKQYGTP

SEQ ID NO: 1695054 - protein, 24 aa, Staphylococcus aureus
EKCDMITLDFGAYYNGYCSDITRT

SEQ ID NO: 1695055 - protein, 19 aa, Staphylococcus aureus
EKDAYIVRLVFAGSTTTEP

SEQ ID NO: 1695056 - protein, 26 aa, Staphylococcus aureus
EKDIYNYYFAGFLIKFEINEQNSPLF

SEQ ID NO: 1695057 - protein, 18 aa, Staphylococcus aureus
EKEHLLNPLFKDWHKYNT

SEQ ID NO: 1695058 - protein, 17 aa, Staphylococcus aureus
EKEHPEGIYLSGALLMF

SEQ ID NO: 1695059 - protein, 24 aa, Staphylococcus aureus
EKEKLAGWHIGLPDIVQLQYDFEQ

SEQ ID NO: 1695060 - protein, 23 aa, Staphylococcus aureus
EKELILKTVIDLVDKRVPVIAGT

SEQ ID NO: 1695061 - protein, 26 aa, Staphylococcus aureus
EKENGINYIKDNDYLKIIEKITKKEK

SEQ ID NO: 1695062 - protein, 20 aa, Staphylococcus aureus
EKFKYITIKDYLNLLEYFKK

SEQ ID NO: 1695063 - protein, 18 aa, Staphylococcus aureus
EKFMRKYSYHLSSSRLIS

SEQ ID NO: 1695064 - protein, 18 aa, Staphylococcus aureus
EKFVLGLIEGKSQRKAYI

SEQ ID NO: 1695065 - protein, 20 aa, Staphylococcus aureus
EKFVLGLIEGKSQRKAYIDA

SEQ ID NO: 1695066 - protein, 21 aa, Staphylococcus aureus
EKFVLGLIEGKSQRKAYIDAG

SEQ ID NO: 1695067 - protein, 26 aa, Staphylococcus aureus
EKGIKGVYVILKDSNGKELDRTTTDE

SEQ ID NO: 1695068 - protein, 22 aa, Staphylococcus aureus
EKGLYRKRMLSYGGLLKQKHKI

SEQ ID NO: 1695069 - protein, 18 aa, Staphylococcus aureus
EKGMFVIKKKDDKAYKCS

SEQ ID NO: 1695070 - protein, 17 aa, Staphylococcus aureus
EKHGLNFDLLVDEDFKL

SEQ ID NO: 1695071 - protein, 22 aa, Staphylococcus aureus
EKHLELIMKWCAQELKNNFQLG

SEQ ID NO: 1695072 - protein, 25 aa, Staphylococcus aureus
EKHQITDFMFFKSVVMTLLSRYARK

SEQ ID NO: 1695073 - protein, 22 aa, Staphylococcus aureus
EKIFITRTILNDRDVLPANHEL

SEQ ID NO: 1695074 - protein, 22 aa, Staphylococcus aureus
EKIFITRTILNDRDVLPANNEL

SEQ ID NO: 1695075 - protein, 26 aa, Staphylococcus aureus
EKIFKEMGLVFLAHNFRKLVTRVRKY

SEQ ID NO: 1695076 - protein, 26 aa, Staphylococcus aureus
EKIIGTFSIIPMIADAIKIPVIAAGG

SEQ ID NO: 1695077 - protein, 25 aa, Staphylococcus aureus
EKILPLPHIIDIPKRVFAKLDIPAN

SEQ ID NO: 1695078 - protein, 17 aa, Staphylococcus aureus
EKINGRMFRYLYPLTKE

SEQ ID NO: 1695079 - protein, 35 aa, Staphylococcus aureus
EKIQSSILTSIPLWKNQMAIALTLMRQRNAVAAQR

SEQ ID NO: 1695080 - protein, 19 aa, Staphylococcus aureus
EKKFYRQCELGRGPNIEAG

SEQ ID NO: 1695081 - protein, 22 aa, Staphylococcus aureus
EKLAKDIGYPVVIKAASGGGGK

SEQ ID NO: 1695082 - protein, 27 aa, Staphylococcus aureus
EKLGADPMTFLGLGGIGDLIVTCTSTH

SEQ ID NO: 1695083 - protein, 21 aa, Staphylococcus aureus
EKLYDLIMCHLQRYKNKNDQI

SEQ ID NO: 1695084 - protein, 21 aa, Staphylococcus aureus
EKLYDLIMCHLQRYKNKNDQM

SEQ ID NO: 1695085 - protein, 24 aa, Staphylococcus aureus
EKNPILAWDLNMGGLMNALEATRT

SEQ ID NO: 1695086 - protein, 24 aa, Staphylococcus aureus
EKNVAPLELALSSGVTFVAQGFSS

SEQ ID NO: 1695087 - protein, 25 aa, Staphylococcus aureus
EKNVTPLELALSSGATFVAQGFSSD

SEQ ID NO: 1695088 - protein, 22 aa, Staphylococcus aureus
EKPKARWLFLTLSTKNAIDGDT

SEQ ID NO: 1695089 - protein, 24 aa, Staphylococcus aureus
EKPLKLFHPVHTYKMKFIKSFEAI

SEQ ID NO: 1695090 - protein, 25 aa, Staphylococcus aureus
EKQKLRYLYGMTERQFRNTFDIAGK

SEQ ID NO: 1695091 - protein, 21 aa, Staphylococcus aureus
EKSYTKYLLTEGIEKITKKYG

SEQ ID NO: 1695092 - protein, 30 aa, Staphylococcus aureus
EKTLNLIDILNPYLCIIFCNSRDNANDLAS

SEQ ID NO: 1695093 - protein, 41 aa, Staphylococcus aureus
EKTVEGGPTLRLFKVPDNVRNLKIQFVPKNDAITDARGIYQ

SEQ ID NO: 1695094 - protein, 20 aa, Staphylococcus aureus
EKVATPFPRISYDDAIEFLK

SEQ ID NO: 1695095 - protein, 22 aa, Staphylococcus aureus
EKVKTLLPLYKEVFESLIDAGA

SEQ ID NO: 1695096 - protein, 26 aa, Staphylococcus aureus
EKVRRKPYSVILFDEIEKAHPDVFNI

SEQ ID NO: 1695097 - protein, 26 aa, Staphylococcus aureus
EKVTKLKRLPYWRSKGDANYYWADID

SEQ ID NO: 1695098 - protein, 26 aa, Staphylococcus aureus
EKVTKLKRLPYWRSKGDTNYYWADID

SEQ ID NO: 1695099 - protein, 17 aa, Staphylococcus aureus
EKWNIIRPPFNVTRISE

SEQ ID NO: 1695100 - protein, 19 aa, Staphylococcus aureus
EKYDVTPISHLKLLEGQKK

SEQ ID NO: 1695101 - protein, 24 aa, Staphylococcus aureus
EKYKSYFIGDWYVSGDSAYKDEDG

SEQ ID NO: 1695102 - protein, 30 aa, Staphylococcus aureus
EKYNSLKQAIAGLTPDLAPLQTAKTQLQND

SEQ ID NO: 1695103 - protein, 20 aa, Staphylococcus aureus
EKYTLMTMHGLFNQLKLGII

SEQ ID NO: 1695104 - protein, 25 aa, Staphylococcus aureus
ELADQLVTFIPHSLLTLHNEKYNIQ

SEQ ID NO: 1695105 - protein, 23 aa, Staphylococcus aureus
ELAIQLMYNAPSSIKITYGGDLA

SEQ ID NO: 1695106 - protein, 31 aa, Staphylococcus aureus
ELAVDILAGVGIIALTIVNPVAGAVAAGAYT

SEQ ID NO: 1695107 - protein, 17 aa, Staphylococcus aureus
ELCHYHLHISGKGYQHK

SEQ ID NO: 1695108 - protein, 21 aa, Staphylococcus aureus
ELDFKLRKQLIEQHNLYGNIG

SEQ ID NO: 1695109 - protein, 18 aa, Staphylococcus aureus
ELEFLIELFISHNNIHSF

SEQ ID NO: 1695110 - protein, 28 aa, Staphylococcus aureus
ELEIPQELKLVPNWVLWRAEWNEKQQNF

SEQ ID NO: 1695111 - protein, 24 aa, Staphylococcus aureus
ELENKVLMLGQAFPDKVEARMDLY

SEQ ID NO: 1695112 - protein, 22 aa, Staphylococcus aureus
ELEPWTSCEFDFTRDGKLNVSF

SEQ ID NO: 1695113 - protein, 23 aa, Staphylococcus aureus
ELESLTLVEPDIESLKLVDVETD

SEQ ID NO: 1695114 - protein, 23 aa, Staphylococcus aureus
ELEYYLSEYVGRTTPLTYAASYT

SEQ ID NO: 1695115 - protein, 19 aa, Staphylococcus aureus
ELFDAVLMTIKYIMRESKV

SEQ ID NO: 1695116 - protein, 20 aa, Staphylococcus aureus
ELFDAVLMTIKYIMRESKVN

SEQ ID NO: 1695117 - protein, 18 aa, Staphylococcus aureus
ELFDFYYDLFKSDDDIFT

SEQ ID NO: 1695118 - protein, 26 aa, Staphylococcus aureus
ELFGRYEFYRFRLSELQIESRANKEV

SEQ ID NO: 1695119 - protein, 28 aa, Staphylococcus aureus
ELFIDSRTTIFPILGGGERLGTLVLGRV

SEQ ID NO: 1695120 - protein, 17 aa, Staphylococcus aureus
ELGGIYYDVPYDLNEPN

SEQ ID NO: 1695121 - protein, 22 aa, Staphylococcus aureus
ELGPYIVIAPEIAIAHARPNNN

SEQ ID NO: 1695122 - protein, 18 aa, Staphylococcus aureus
ELIIVEMHDFFKNALLSD

SEQ ID NO: 1695123 - protein, 22 aa, Staphylococcus aureus
ELIKFNLLTQERVGLNKPNRLY

SEQ ID NO: 1695124 - protein, 18 aa, Staphylococcus aureus
ELILEELLHKDFLTLQEL

SEQ ID NO: 1695125 - protein, 18 aa, Staphylococcus aureus
ELISLKKDIGYLLLDVNQ

SEQ ID NO: 1695126 - protein, 22 aa, Staphylococcus aureus
ELKHQFTHLTWKIKVYAVSGTI

SEQ ID NO: 1695127 - protein, 25 aa, Staphylococcus aureus
ELKKTRLFSPPFIPINSTHSFNMFR

SEQ ID NO: 1695128 - protein, 26 aa, Staphylococcus aureus
ELKLYDMIVERFLEALMPPHEYDVIT

SEQ ID NO: 1695129 - protein, 17 aa, Staphylococcus aureus
ELKNRIPLVLEVKSDQY

SEQ ID NO: 1695130 - protein, 21 aa, Staphylococcus aureus
ELKPFYEDILGLNIINETLTS

SEQ ID NO: 1695131 - protein, 17 aa, Staphylococcus aureus
ELKVVIVVSRFNDFITG

SEQ ID NO: 1695132 - protein, 19 aa, Staphylococcus aureus
ELLGRYEHYCFKFRELHPE

SEQ ID NO: 1695133 - protein, 23 aa, Staphylococcus aureus
ELLGRYEHYCFKFRELHPESKAN

SEQ ID NO: 1695134 - protein, 17 aa, Staphylococcus aureus
ELLGRYENYCFKIRELH

SEQ ID NO: 1695135 - protein, 25 aa, Staphylococcus aureus
ELLNFIGDYTIVTILTVVDIEESKT

SEQ ID NO: 1695136 - protein, 27 aa, Staphylococcus aureus
ELNISIERQYFKQLYRFNNQDLKHLEQ

SEQ ID NO: 1695137 - protein, 17 aa, Staphylococcus aureus
ELNTAMSNLQRGINDEA

SEQ ID NO: 1695138 - protein, 31 aa, Staphylococcus aureus
ELPISRLLQWGTDFVKPLARLAYNGGGEFKA

SEQ ID NO: 1695139 - protein, 17 aa, Staphylococcus aureus
ELPMKYDELIVDPLSFV

SEQ ID NO: 1695140 - protein, 25 aa, Staphylococcus aureus
ELQHKTIGIFGFGRIGQLVAERLAP

SEQ ID NO: 1695141 - protein, 28 aa, Staphylococcus aureus
ELQPDNMYQILRKLPPREYSISSSFMAT

SEQ ID NO: 1695142 - protein, 25 aa, Staphylococcus aureus
ELRDTLHFEMLWDTSKIYKKELISK

SEQ ID NO: 1695143 - protein, 19 aa, Staphylococcus aureus
ELRKHLIEKYSIGVIALNA

SEQ ID NO: 1695144 - protein, 24 aa, Staphylococcus aureus
ELRKKGVIGKFVEFFGPGVQHLPL

SEQ ID NO: 1695145 - protein, 19 aa, Staphylococcus aureus
ELRLLARAVFVLDADNKVV

SEQ ID NO: 1695146 - protein, 23 aa, Staphylococcus aureus
ELRMHGITAKILVLGVLPAKDSD

SEQ ID NO: 1695147 - protein, 22 aa, Staphylococcus aureus
ELSDSLIRRTMGPTRQAMKDAG

SEQ ID NO: 1695148 - protein, 23 aa, Staphylococcus aureus
ELSDYLPLMLQFLQVAEWRNDPI

SEQ ID NO: 1695149 - protein, 21 aa, Staphylococcus aureus
ELSLAGFKYNLARQMLNIGST

SEQ ID NO: 1695150 - protein, 21 aa, Staphylococcus aureus
ELSPLLFEDSLSYLKEEFINE

SEQ ID NO: 1695151 - protein, 24 aa, Staphylococcus aureus
ELSQNMPVFFSANMSYGVHALTKI

SEQ ID NO: 1695152 - protein, 22 aa, Staphylococcus aureus
ELSTILKFSFGIAPRKVEYGDI

SEQ ID NO: 1695153 - protein, 27 aa, Staphylococcus aureus
ELTTIGLDLPFPIKINQMLGHQTSFLT

SEQ ID NO: 1695154 - protein, 19 aa, Staphylococcus aureus
ELVDFSIYIIAVAQGEKIP

SEQ ID NO: 1695155 - protein, 17 aa, Staphylococcus aureus
ELVDLFNKRYDIIIVDT

SEQ ID NO: 1695156 - protein, 19 aa, Staphylococcus aureus
ELVPMLQRTITIAAKEGIK

SEQ ID NO: 1695157 - protein, 17 aa, Staphylococcus aureus
ELVSCFLLEVDDSLNSI

SEQ ID NO: 1695158 - protein, 25 aa, Staphylococcus aureus
ELYNRVRNLLLDKTLRDTFSQECIK

SEQ ID NO: 1695159 - protein, 19 aa, Staphylococcus aureus
EMEFLSFAFFKICHDEIDL

SEQ ID NO: 1695160 - protein, 26 aa, Staphylococcus aureus
EMIFSKNLFRRPTPARLTRIEKSLLQ

SEQ ID NO: 1695161 - protein, 22 aa, Staphylococcus aureus
EMLMANYLFNTSDNPRFKRWVI

SEQ ID NO: 1695162 - protein, 19 aa, Staphylococcus aureus
EMMIIFVTNGKKWPQKNAV

SEQ ID NO: 1695163 - protein, 27 aa, Staphylococcus aureus
EMQQKYPLFINHLKTFKYVTLNYEDST

SEQ ID NO: 1695164 - protein, 25 aa, Staphylococcus aureus
EMRKLFPENEKLLRWLDLAEEKISY

SEQ ID NO: 1695165 - protein, 28 aa, Staphylococcus aureus
EMRLMWKEMMAILQAFRVPSVNLLQFMV

SEQ ID NO: 1695166 - protein, 26 aa, Staphylococcus aureus
EMRRKYPLFVSHLETFKYVTLDYNKS

SEQ ID NO: 1695167 - protein, 17 aa, Staphylococcus aureus
EMTLRYAKLLDDTKRKA

SEQ ID NO: 1695168 - protein, 23 aa, Staphylococcus aureus
EMWFRNFSYFIHKIDSEFILEEY

SEQ ID NO: 1695169 - protein, 20 aa, Staphylococcus aureus
EMYDLRLMLESFAFSRVKNR

SEQ ID NO: 1695170 - protein, 20 aa, Staphylococcus aureus
ENAACHLAIGSAYAFNIQGG

SEQ ID NO: 1695171 - protein, 26 aa, Staphylococcus aureus
ENAKEDLALSLGLTATALKGNINISS

SEQ ID NO: 1695172 - protein, 23 aa, Staphylococcus aureus
ENANGLLRQYYPKGTDFANITQK

SEQ ID NO: 1695173 - protein, 29 aa, Staphylococcus aureus
ENAQTIDQLNRGLNLGLDDIRNTHVWEVD

SEQ ID NO: 1695174 - protein, 35 aa, Staphylococcus aureus
ENDALLIQKRRGLNKPNILYLMKPIVTERDIYKIE

SEQ ID NO: 1695175 - protein, 33 aa, Staphylococcus aureus
ENDELTENLKKYKHFMFFGNDIVLKNGKGHSMD

SEQ ID NO: 1695176 - protein, 17 aa, Staphylococcus aureus
ENDGIIIYLNFKDVNYQ

SEQ ID NO: 1695177 - protein, 18 aa, Staphylococcus aureus
ENDILDKMKSKYAKNIYL

SEQ ID NO: 1695178 - protein, 36 aa, Staphylococcus aureus
ENDNAKLCYIYKFRARFAVLAHLLTQREGLPAKQDV

SEQ ID NO: 1695179 - protein, 17 aa, Staphylococcus aureus
ENEGQLIAFIWGHFSNE

SEQ ID NO: 1695180 - protein, 18 aa, Staphylococcus aureus
ENERISIVGYPEPYINKF

SEQ ID NO: 1695181 - protein, 30 aa, Staphylococcus aureus
ENERISIVGYPEPYINKFQMYESTGKVLSV

SEQ ID NO: 1695182 - protein, 20 aa, Staphylococcus aureus
ENFKFFGQYADFKSLKSYNN

SEQ ID NO: 1695183 - protein, 18 aa, Staphylococcus aureus
ENFKFFSQYANLKELKNY

SEQ ID NO: 1695184 - protein, 17 aa, Staphylococcus aureus
ENFKFFSQYGSFRGLKN

SEQ ID NO: 1695185 - protein, 18 aa, Staphylococcus aureus
ENFKKKFYRQCKLGNNEI

SEQ ID NO: 1695186 - protein, 28 aa, Staphylococcus aureus
ENIDFLREGGLGLFLIESLMDEVTVYKE

SEQ ID NO: 1695187 - protein, 26 aa, Staphylococcus aureus
ENIPGELIMKILAFDGNLEKIDKASK

SEQ ID NO: 1695188 - protein, 23 aa, Staphylococcus aureus
ENIPSAILMIDRNGKIVVANKAY

SEQ ID NO: 1695189 - protein, 25 aa, Staphylococcus aureus
ENKDYGYIILPIVIPAGEKPETILD

SEQ ID NO: 1695190 - protein, 26 aa, Staphylococcus aureus
ENKDYGYIILPIVIPAGEKPETILDN

SEQ ID NO: 1695191 - protein, 23 aa, Staphylococcus aureus
ENKKNLCMTILDFIVELERETEL

SEQ ID NO: 1695192 - protein, 19 aa, Staphylococcus aureus
ENKLYDLFVQKLAERHTRP

SEQ ID NO: 1695193 - protein, 23 aa, Staphylococcus aureus
ENKPYPLYLLLDKEYQLIEPVMK

SEQ ID NO: 1695194 - protein, 18 aa, Staphylococcus aureus
ENLAIPRAAFKDIVKMMD

SEQ ID NO: 1695195 - protein, 24 aa, Staphylococcus aureus
ENLIKKIYRMLKAGGNLVFTVEHP

SEQ ID NO: 1695196 - protein, 27 aa, Staphylococcus aureus
ENLKKYKHYVFFGNDKVFKNGKGHEMK

SEQ ID NO: 1695197 - protein, 29 aa, Staphylococcus aureus
ENLNLEFKYLFLKLIVKEDWSLSNVFNTG

SEQ ID NO: 1695198 - protein, 17 aa, Staphylococcus aureus
ENLYFVGGSVNPGGGIP

SEQ ID NO: 1695199 - protein, 25 aa, Staphylococcus aureus
ENMNAWLKPYRRALNLEEPVVKITE

SEQ ID NO: 1695200 - protein, 22 aa, Staphylococcus aureus
ENMYQILRKLPPREYSISSSFM

SEQ ID NO: 1695201 - protein, 19 aa, Staphylococcus aureus
ENNVFLRGFRRNLSAEIQD

SEQ ID NO: 1695202 - protein, 17 aa, Staphylococcus aureus
ENNVPMVLLAQINLDNL

SEQ ID NO: 1695203 - protein, 19 aa, Staphylococcus aureus
ENPIPMCGVPYHSADSYID

SEQ ID NO: 1695204 - protein, 19 aa, Staphylococcus aureus
ENQKYMFDYSACKYPIGVA

SEQ ID NO: 1695205 - protein, 18 aa, Staphylococcus aureus
ENQLPWHLPNDLKHVKEL

SEQ ID NO: 1695206 - protein, 24 aa, Staphylococcus aureus
ENSMVTDFEDLKELGKGMEQISDQ

SEQ ID NO: 1695207 - protein, 22 aa, Staphylococcus aureus
ENVIFIGLLCKHGHWHAVIYDI

SEQ ID NO: 1695208 - protein, 25 aa, Staphylococcus aureus
ENVKKLREVYPITTKKSPVLKLHID

SEQ ID NO: 1695209 - protein, 17 aa, Staphylococcus aureus
ENYIRRLERLETLSESY

SEQ ID NO: 1695210 - protein, 18 aa, Staphylococcus aureus
ENYIRRLERLETLSESYD

SEQ ID NO: 1695211 - protein, 26 aa, Staphylococcus aureus
ENYITQVEWVDLWQKALQVNYRPVAN

SEQ ID NO: 1695212 - protein, 19 aa, Staphylococcus aureus
ENYYMYKKFGVIPEMEYEM

SEQ ID NO: 1695213 - protein, 20 aa, Staphylococcus aureus
ENYYMYKKFGVIPEMEYEMK

SEQ ID NO: 1695214 - protein, 20 aa, Staphylococcus aureus
ENYYMYKKFGVLPEMEYEIN

SEQ ID NO: 1695215 - protein, 19 aa, Staphylococcus aureus
ENYYMYKKFGVLPEMEYEM

SEQ ID NO: 1695216 - protein, 41 aa, Staphylococcus aureus; identical to SEQ ID NO: 1595533

SEQ ID NO: 1695217 - protein, 34 aa, Staphylococcus aureus
EPHESEYQYFKKNQIIWGFLHLASSKEIVEKMQG

SEQ ID NO: 1695218 - protein, 18 aa, Staphylococcus aureus
EPKIKLYVSLKCPDFDDV

SEQ ID NO: 1695219 - protein, 25 aa, Staphylococcus aureus
EPLDVIDFHNFAKKSYFILTDSGGI

SEQ ID NO: 1695220 - protein, 26 aa, Staphylococcus aureus
EPLDVVDFHNFAKKSYFILTDSGGIQ

SEQ ID NO: 1695221 - protein, 33 aa, Staphylococcus aureus
EPMPLMEFQKFIVGSLYGWRRGQYRMFTKAYIS

SEQ ID NO: 1695222 - protein, 29 aa, Staphylococcus aureus
EPNDPIIHFALAEMLYYDGQYLRATSEYE

SEQ ID NO: 1695223 - protein, 19 aa, Staphylococcus aureus
EPRLVEIYISVIKSMAIKY

SEQ ID NO: 1695224 - protein, 25 aa, Staphylococcus aureus
EPVAFLLQSTLGYKVLYVTDTKYLK

SEQ ID NO: 1695225 - protein, 25 aa, Staphylococcus aureus
EPYIGAFIYLYFKNQPRNVTKKQIT

SEQ ID NO: 1695226 - protein, 22 aa, Staphylococcus aureus
EPYSNSIWLFDVGEGTQHQILH

SEQ ID NO: 1695227 - protein, 17 aa, Staphylococcus aureus
EQCIYRSLLECVTVLEY

SEQ ID NO: 1695228 - protein, 25 aa, Staphylococcus aureus
EQDIQRIEHMLRNALIIEDTGDNNI

SEQ ID NO: 1695229 - protein, 24 aa, Staphylococcus aureus
EQEKRDVWIKENVFKIIVNEEGKR

SEQ ID NO: 1695230 - protein, 20 aa, Staphylococcus aureus
EQFEEWWKLYDRKKDKKISF

SEQ ID NO: 1695231 - protein, 24 aa, Staphylococcus aureus
EQFLRATVRNNIKHYLLTLDEKMK

SEQ ID NO: 1695232 - protein, 19 aa, Staphylococcus aureus
EQFRDEFHFAKRRSTEALY

SEQ ID NO: 1695233 - protein, 24 aa, Staphylococcus aureus
EQFRDEFHFAKRRSTEALYEQQQQ

SEQ ID NO: 1695234 - protein, 23 aa, Staphylococcus aureus
EQGFTILRSYQPEMYGEKLDLAL

SEQ ID NO: 1695235 - protein, 24 aa, Staphylococcus aureus
EQGKYFVRLSYVKVWNKGDEVVNK

SEQ ID NO: 1695236 - protein, 30 aa, Staphylococcus aureus
EQHIDLIDMVVVNLYPFQQTVANPDVRMDE

SEQ ID NO: 1695237 - protein, 25 aa, Staphylococcus aureus
EQINKRLHIIPFNYSFKDDQERLSV

SEQ ID NO: 1695238 - protein, 26 aa, Staphylococcus aureus
EQINKRLHIIPFNYSFKDDQERLSVT

SEQ ID NO: 1695239 - protein, 27 aa, Staphylococcus aureus
EQIVHKYIMKLAPYLQKHQYNHALFGG

SEQ ID NO: 1695240 - protein, 27 aa, Staphylococcus aureus
EQKHLDAIIILSDYNRRYLSGFTGASG

SEQ ID NO: 1695241 - protein, 27 aa, Staphylococcus aureus
EQKHLDAIIILSDYNRRYLSGFTGTSG

SEQ ID NO: 1695242 - protein, 18 aa, Staphylococcus aureus
EQLDLLLLEIPKSRKIHS

SEQ ID NO: 1695243 - protein, 21 aa, Staphylococcus aureus
EQLKIRYIEQFGLSNSLKRKV

SEQ ID NO: 1695244 - protein, 23 aa, Staphylococcus aureus
EQLLFDNLDYKKHTLKLVYKGQD

SEQ ID NO: 1695245 - protein, 18 aa, Staphylococcus aureus
EQLRDEFHFAKRRSTEAL

SEQ ID NO: 1695246 - protein, 22 aa, Staphylococcus aureus
EQMRQAIEFVKKHKLKHLLVET

SEQ ID NO: 1695247 - protein, 22 aa, Staphylococcus aureus
EQPIEFIRLVPTLQKHRDEVLK

SEQ ID NO: 1695248 - protein, 19 aa, Staphylococcus aureus
EQQDVMRYMLSSGKVKNEG

SEQ ID NO: 1695249 - protein, 20 aa, Staphylococcus aureus
EQQDVMRYMLSSGKVKNEGV

SEQ ID NO: 1695250 - protein, 28 aa, Staphylococcus aureus
EQQELFPVNVGILQFWISSEDQMYGMSE

SEQ ID NO: 1695251 - protein, 25 aa, Staphylococcus aureus
EQQNAFYEILNMPNLNEEQRNGFIQ

SEQ ID NO: 1695252 - protein, 19 aa, Staphylococcus aureus
EQRGLNDYVKLTKKLSQSE

SEQ ID NO: 1695253 - protein, 23 aa, Staphylococcus aureus
EQRKKIFAMCRDIELHWGEPVES

SEQ ID NO: 1695254 - protein, 25 aa, Staphylococcus aureus
EQSLDIRVVITRPANDPALFESTVK

SEQ ID NO: 1695255 - protein, 39 aa, Staphylococcus aureus
EQTEVRLVLSFLRAIDNPLQDIYLVGLMRSVIYQFKEDE

SEQ ID NO: 1695256 - protein, 23 aa, Staphylococcus aureus
EQTIHNIYGQCAIFVEGVAHLPG

SEQ ID NO: 1695257 - protein, 19 aa, Staphylococcus aureus
EQTKLNVEAFSNAVKKAVN

SEQ ID NO: 1695258 - protein, 19 aa, Staphylococcus aureus
EQTKLNVEAFSNAVKKAVS

SEQ ID NO: 1695259 - protein, 25 aa, Staphylococcus aureus
EQTRLKLLPIIDNPFEEIKKMEDEQ

SEQ ID NO: 1695260 - protein, 25 aa, Staphylococcus aureus
EQYQGPMVLQLKKAGHIALIGSPGY

SEQ ID NO: 1695261 - protein, 27 aa, Staphylococcus aureus
ERAAKVLGSWRLARLHIICNLRTMCHV

SEQ ID NO: 1695262 - protein, 24 aa, Staphylococcus aureus
ERAHRLIRKGAMLEKYFECEHLSP

SEQ ID NO: 1695263 - protein, 17 aa, Staphylococcus aureus
ERALEIGATFHIVSLPD

SEQ ID NO: 1695264 - protein, 21 aa, Staphylococcus aureus
ERAVYKVYFKNGSSKYVDLKT

SEQ ID NO: 1695265 - protein, 22 aa, Staphylococcus aureus
ERDFIRKYITPNIAKYLRHAGH

SEQ ID NO: 1695266 - protein, 23 aa, Staphylococcus aureus
ERDFIRKYITPNIAKYLRHAGHE

SEQ ID NO: 1695267 - protein, 17 aa, Staphylococcus aureus
EREAILKGYDFISVLGW

SEQ ID NO: 1695268 - protein, 21 aa, Staphylococcus aureus
ERFIEMIQYFKDKITEGDMFQ

SEQ ID NO: 1695269 - protein, 21 aa, Staphylococcus aureus
ERFIEMIQYFKEKIAEGDMFQ

SEQ ID NO: 1695270 - protein, 23 aa, Staphylococcus aureus
ERGITFGLFRLSVGLEDPDELIA

SEQ ID NO: 1695271 - protein, 25 aa, Staphylococcus aureus
ERKQALLFEWSRINSMLDTQLYITR

SEQ ID NO: 1695272 - protein, 19 aa, Staphylococcus aureus
ERKRAIIAPNYYEPKESDF

SEQ ID NO: 1695273 - protein, 19 aa, Staphylococcus aureus
ERLYIKLSTTERAPYPYRL

SEQ ID NO: 1695274 - protein, 18 aa, Staphylococcus aureus
ERNKELENMWRTLKNELL

SEQ ID NO: 1695275 - protein, 17 aa, Staphylococcus aureus
ERNVAIAALNKIVNAIK

SEQ ID NO: 1695276 - protein, 23 aa, Staphylococcus aureus
ERPKRKVNIIDIGRISELDFKEN

SEQ ID NO: 1695277 - protein, 27 aa, Staphylococcus aureus
ERQTQQQIVYKTPKPLARLNGESHDFT

SEQ ID NO: 1695278 - protein, 18 aa, Staphylococcus aureus
ERSLQRLNLDYLDLVLIH

SEQ ID NO: 1695279 - protein, 34 aa, Staphylococcus aureus
ERVQKLLETFLEDGLIPAIIMWESNEGDLLIIDG

SEQ ID NO: 1695280 - protein, 25 aa, Staphylococcus aureus
ERVSYLYQPYNPSILRLVKQVIEAS

SEQ ID NO: 1695281 - protein, 25 aa, Staphylococcus aureus
ESATTDLYAYADQKKNNILADTNAT

SEQ ID NO: 1695282 - protein, 21 aa, Staphylococcus aureus
ESDEPILYSLNYMKNSLVQFK

SEQ ID NO: 1695283 - protein, 26 aa, Staphylococcus aureus
ESEGIFEPFFDYILIDESQDFNEAFF

SEQ ID NO: 1695284 - protein, 20 aa, Staphylococcus aureus
ESEKAIYDKVISTAIQNINN

SEQ ID NO: 1695285 - protein, 20 aa, Staphylococcus aureus
ESEKNFGVYFTPQLKEFIQN

SEQ ID NO: 1695286 - protein, 20 aa, Staphylococcus aureus
ESFDFVMLRQMLGKHFISQD

SEQ ID NO: 1695287 - protein, 21 aa, Staphylococcus aureus
ESFELFSQYGNFNHFDRNEIT

SEQ ID NO: 1695288 - protein, 17 aa, Staphylococcus aureus
ESGLDGPKLPSTPSRQA

SEQ ID NO: 1695289 - protein, 24 aa, Staphylococcus aureus
ESGRLFPSSLGLEPWKFVVIQDQA

SEQ ID NO: 1695290 - protein, 24 aa, Staphylococcus aureus
ESGRLYPSSLGLEPWKFVVIQDQA

SEQ ID NO: 1695291 - protein, 25 aa, Staphylococcus aureus
ESHFQRTFDEKTYLSWLAQVGFKHV

SEQ ID NO: 1695292 - protein, 25 aa, Staphylococcus aureus
ESHYYEVIVVNNLKLKIISIEDYYI

SEQ ID NO: 1695293 - protein, 17 aa, Staphylococcus aureus
ESIIAGLNNPTINKGNV

SEQ ID NO: 1695294 - protein, 32 aa, Staphylococcus aureus
ESILSNDHLLTFYDFPLAIRKSIYSTNLIESF

SEQ ID NO: 1695295 - protein, 25 aa, Staphylococcus aureus
ESISAIKHLLPDFALDALKERINEL

SEQ ID NO: 1695296 - protein, 25 aa, Staphylococcus aureus
ESIYNYPTHQTFFSSSDKLSIGDVP

SEQ ID NO: 1695297 - protein, 18 aa, Staphylococcus aureus
ESKKKPPGITKWNRKMIL

SEQ ID NO: 1695298 - protein, 25 aa, Staphylococcus aureus
ESKSLKLYLFSFRNHGDFHEDCMNI

SEQ ID NO: 1695299 - protein, 24 aa, Staphylococcus aureus
ESKWTRQKAFEEYEWLKNVAKNDI

SEQ ID NO: 1695300 - protein, 23 aa, Staphylococcus aureus
ESLDMFLNIILKESNRIESLVTD

SEQ ID NO: 1695301 - protein, 21 aa, Staphylococcus aureus
ESLISVPALMTHASIPADIRA

SEQ ID NO: 1695302 - protein, 25 aa, Staphylococcus aureus
ESLKFPTKYLLKNNDILFAMSGGTT

SEQ ID NO: 1695303 - protein, 18 aa, Staphylococcus aureus
ESLKYLLNVNHQRLSDFK

SEQ ID NO: 1695304 - protein, 24 aa, Staphylococcus aureus
ESMASFLNSFLMFKDDTRNTHPKF

SEQ ID NO: 1695305 - protein, 17 aa, Staphylococcus aureus
ESNGIATLKGVEPHIVV

SEQ ID NO: 1695306 - protein, 17 aa, Staphylococcus aureus
ESNVGVVILGPYAGITE

SEQ ID NO: 1695307 - protein, 22 aa, Staphylococcus aureus
ESQDFLNEFRILAGYYDNIDEN

SEQ ID NO: 1695308 - protein, 19 aa, Staphylococcus aureus
ESQIKWLKSHDAKFLTLKE

SEQ ID NO: 1695309 - protein, 18 aa, Staphylococcus aureus
ESQLTIMCKLGWAPNTEN

SEQ ID NO: 1695310 - protein, 24 aa, Staphylococcus aureus
ESQQQWLSGFLLAKSNDTTSDSNQ

SEQ ID NO: 1695311 - protein, 24 aa, Staphylococcus aureus
ESTKKLHLNFENTKIFLQLAKSTI

SEQ ID NO: 1695312 - protein, 21 aa, Staphylococcus aureus
ESVFGFMKAILGFTRMSVRGI

SEQ ID NO: 1695313 - protein, 23 aa, Staphylococcus aureus
ESVRYMPVWAYDASNWSNEETAY

SEQ ID NO: 1695314 - protein, 23 aa, Staphylococcus aureus
ESYCSILFVRYLSMNFKDYFTSI

SEQ ID NO: 1695315 - protein, 27 aa, Staphylococcus aureus
ESYKRRVMWLPIYTKPAKKEKNFIQKL

SEQ ID NO: 1695316 - protein, 24 aa, Staphylococcus aureus
ESYKVTYQLLDKLGFGGNDLGSDA

SEQ ID NO: 1695317 - protein, 19 aa, Staphylococcus aureus
ESYSVIIQVLRGESTDYIK

SEQ ID NO: 1695318 - protein, 24 aa, Staphylococcus aureus
ETADGIITLILLSGSLVKNIQLIK

SEQ ID NO: 1695319 - protein, 29 aa, Staphylococcus aureus
ETAEKYMIFLTWIFSTTNNKLRDLGTKSL

SEQ ID NO: 1695320 - protein, 17 aa, Staphylococcus aureus
ETALDTLLNLKSTGRMV

SEQ ID NO: 1695321 - protein, 32 aa, Staphylococcus aureus
ETAVRHIYEISSLIYKVTMKIKIKAMGINVDE

SEQ ID NO: 1695322 - protein, 26 aa, Staphylococcus aureus
ETAVSGIFPFKFLKSGKFYYKQTANG

SEQ ID NO: 1695323 - protein, 21 aa, Staphylococcus aureus
ETFEIPYRENLNVIACLMEIR

SEQ ID NO: 1695324 - protein, 24 aa, Staphylococcus aureus
ETFGDLYFMGVDEKYKYEDGEKTD

SEQ ID NO: 1695325 - protein, 23 aa, Staphylococcus aureus
ETGAYILSRRQLETEKSYSYLQE

SEQ ID NO: 1695326 - protein, 26 aa, Staphylococcus aureus
ETGERKLYRVWFCKSRLCPMCNWRRA

SEQ ID NO: 1695327 - protein, 30 aa, Staphylococcus aureus
ETGKVEELFYYPKHPYTWGLLASMPTLESN

SEQ ID NO: 1695328 - protein, 20 aa, Staphylococcus aureus
ETIDPIVIMAEFIFKCTKNN

SEQ ID NO: 1695329 - protein, 26 aa, Staphylococcus aureus
ETIGVDFRLIEPRAFYHTLQHFTGSK

SEQ ID NO: 1695330 - protein, 29 aa, Staphylococcus aureus
ETISRRISNLIKFGYLKIEIIKEGNEVKQ

SEQ ID NO: 1695331 - protein, 19 aa, Staphylococcus aureus
ETKFNGRRWYLDDYELNTL

SEQ ID NO: 1695332 - protein, 17 aa, Staphylococcus aureus
ETLIFGNLKDAIVLFDR

SEQ ID NO: 1695333 - protein, 17 aa, Staphylococcus aureus
ETLIPPFISVPGLGENV

SEQ ID NO: 1695334 - protein, 28 aa, Staphylococcus aureus
ETNYDYTKLVFAKPIYNDPSLVKSDTND

SEQ ID NO: 1695335 - protein, 24 aa, Staphylococcus aureus
ETQITMIRLLSKQGFILAGDETLQ

SEQ ID NO: 1695336 - protein, 21 aa, Staphylococcus aureus
ETRLLQKEENLERKSDLLDKK

SEQ ID NO: 1695337 - protein, 26 aa, Staphylococcus aureus
ETTYQAKLLLQVHDELIFEVPKSEVD

SEQ ID NO: 1695338 - protein, 24 aa, Staphylococcus aureus
ETVRFTIKKGSQGGIYKLILDGKQ

SEQ ID NO: 1695339 - protein, 23 aa, Staphylococcus aureus
ETYDFTPFLFDGNKTLLVPKLFT

SEQ ID NO: 1695340 - protein, 21 aa, Staphylococcus aureus
ETYTIVIPPPNVTGKLHLGHA

SEQ ID NO: 1695341 - protein, 17 aa, Staphylococcus aureus
EVAKIFQEVLPNGVVNI

SEQ ID NO: 1695342 - protein, 17 aa, Staphylococcus aureus
EVALALYIRNDHYGAQT

SEQ ID NO: 1695343 - protein, 27 aa, Staphylococcus aureus
EVAQKLAEAKALDQAMQALRNSIQDQQ

SEQ ID NO: 1695344 - protein, 24 aa, Staphylococcus aureus
EVDKFNWYQILRKIESYADIKVER

SEQ ID NO: 1695345 - protein, 26 aa, Staphylococcus aureus
EVDMSIKEFILLTYLFHQQENTLPFK

SEQ ID NO: 1695346 - protein, 25 aa, Staphylococcus aureus
EVEEFIDIVEIGTPIVINEGLSAVE

SEQ ID NO: 1695347 - protein, 21 aa, Staphylococcus aureus
EVEFFGTMKPFILKPKGDDSV

SEQ ID NO: 1695348 - protein, 23 aa, Staphylococcus aureus
EVEFIKVIREVCRNGVIELGVGS

SEQ ID NO: 1695349 - protein, 26 aa, Staphylococcus aureus
EVEYKYNIIWVWHYSDDYLGKIASIN

SEQ ID NO: 1695350 - protein, 20 aa, Staphylococcus aureus
EVGYLLYRPTENTTFEQRAA

SEQ ID NO: 1695351 - protein, 20 aa, Staphylococcus aureus
EVIAGFDFTFGKFGKGNMTV

SEQ ID NO: 1695352 - protein, 17 aa, Staphylococcus aureus
EVIGFVNTGGLRNSLDV

SEQ ID NO: 1695353 - protein, 21 aa, Staphylococcus aureus
EVIQWFYKEVDWFEAKLKDDK

SEQ ID NO: 1695354 - protein, 29 aa, Staphylococcus aureus
EVISNPLLDKFMKDLIIQILAMVSEQERN

SEQ ID NO: 1695355 - protein, 31 aa, Staphylococcus aureus
EVKFKQFIFDQFMVQVCFLGEAPWGYKKVSV

SEQ ID NO: 1695356 - protein, 29 aa, Staphylococcus aureus
EVKFKQFIFDQFMVQVCFLGQAPWGYKKV

SEQ ID NO: 1695357 - protein, 25 aa, Staphylococcus aureus
EVKLKTILRILDLYEITLYEFIEDN

SEQ ID NO: 1695358 - protein, 18 aa, Staphylococcus aureus
EVKMYPEIAIREAVANAI

SEQ ID NO: 1695359 - protein, 24 aa, Staphylococcus aureus
EVKQRKMYPLTQTSIPIDAKINTP

SEQ ID NO: 1695360 - protein, 22 aa, Staphylococcus aureus
EVKQWQTYIADYLYQCDAIKDP

SEQ ID NO: 1695361 - protein, 19 aa, Staphylococcus aureus
EVLDFIHHQLMKSIDDVQT

SEQ ID NO: 1695362 - protein, 27 aa, Staphylococcus aureus
EVLKEREHFAIFPASHFVTREEKMKVA

SEQ ID NO: 1695363 - protein, 19 aa, Staphylococcus aureus
EVNLPELIQWAWDNPKLSG

SEQ ID NO: 1695364 - protein, 25 aa, Staphylococcus aureus
EVNTLNYIKSLFYLGEKLEDFMSDN

SEQ ID NO: 1695365 - protein, 24 aa, Staphylococcus aureus
EVNYIMNLPVNFLETFLPELIEKN

SEQ ID NO: 1695366 - protein, 23 aa, Staphylococcus aureus
EVNYIMNLPVNFLKTFLSELIEK

SEQ ID NO: 1695367 - protein, 17 aa, Staphylococcus aureus
EVQKIIVYYANKQYFFN

SEQ ID NO: 1695368 - protein, 23 aa, Staphylococcus aureus
EVQLRNYLNEKYKLYEQGGDIVK

SEQ ID NO: 1695369 - protein, 22 aa, Staphylococcus aureus
EVRIQWRVADIKIPTSEIKNIT

SEQ ID NO: 1695370 - protein, 27 aa, Staphylococcus aureus
EVRPERRTTLGLRWLVNYARLRGEKTM

SEQ ID NO: 1695371 - protein, 36 aa, Staphylococcus aureus
EVVECAIPMIQGILAKIPFFGICLGHQLFALSQGAS

SEQ ID NO: 1695372 - protein, 36 aa, Staphylococcus aureus
EVVECAIPMIQGILGKIPFFGICLGHQLFALSQGAR

SEQ ID NO: 1695373 - protein, 18 aa, Staphylococcus aureus
EVVIKPKAIADIEKAVKE

SEQ ID NO: 1695374 - protein, 23 aa, Staphylococcus aureus
EVYKTLPFDFLSDIVYQWERFAQ

SEQ ID NO: 1695375 - protein, 17 aa, Staphylococcus aureus
EWFMFVEETRRIFRGTE

SEQ ID NO: 1695376 - protein, 18 aa, Staphylococcus aureus
EWLMLKQFSQYKSAPSLP

SEQ ID NO: 1695377 - protein, 27 aa, Staphylococcus aureus
EWQNRVLPHHLPFINKIGFGNNYPFTL

SEQ ID NO: 1695378 - protein, 17 aa, Staphylococcus aureus
EYAVMPGVLITEALAQT

SEQ ID NO: 1695379 - protein, 25 aa, Staphylococcus aureus
EYDALTKFFIAGQKDGWISLEAEKE

SEQ ID NO: 1695380 - protein, 17 aa, Staphylococcus aureus
EYDLNYIKGYLPVHNNE

SEQ ID NO: 1695381 - protein, 22 aa, Staphylococcus aureus
EYENFVFTNDKKKSIILAFKKK

SEQ ID NO: 1695382 - protein, 19 aa, Staphylococcus aureus
EYFMYGLQTYAESNNSDVF

SEQ ID NO: 1695383 - protein, 23 aa, Staphylococcus aureus
EYFSKVLFQMDIPNNLLIAQNVA

SEQ ID NO: 1695384 - protein, 22 aa, Staphylococcus aureus
EYGEILVYERLSGGGEARLHGQ

SEQ ID NO: 1695385 - protein, 23 aa, Staphylococcus aureus
EYGQIPQMPVAFQSSKPLIEKVS

SEQ ID NO: 1695386 - protein, 22 aa, Staphylococcus aureus
EYHATYNWKTRLRMLNHFPKPT

SEQ ID NO: 1695387 - protein, 17 aa, Staphylococcus aureus
EYILLRETIYNDLTDIE

SEQ ID NO: 1695388 - protein, 32 aa, Staphylococcus aureus
EYKEAMDTYRKKLFAELDALNKFLDEERTITI

SEQ ID NO: 1695389 - protein, 26 aa, Staphylococcus aureus
EYKGGKCFFYYAKLIYTPEVCPNCNC

SEQ ID NO: 1695390 - protein, 28 aa, Staphylococcus aureus
EYKKVELRLRYEVPKIAYASHLKSDIQT

SEQ ID NO: 1695391 - protein, 30 aa, Staphylococcus aureus
EYLIKDCYIWLYIFFLKKDKNFFEDHIYIK

SEQ ID NO: 1695392 - protein, 18 aa, Staphylococcus aureus
EYLIPYIADVVKEVDVEN

SEQ ID NO: 1695393 - protein, 32 aa, Staphylococcus aureus
EYNLAAKFYRDIKNYYLYIYEKRVSELTIDDF

SEQ ID NO: 1695394 - protein, 22 aa, Staphylococcus aureus
EYPHFYVDRHNIWAPRRAVFEV

SEQ ID NO: 1695395 - protein, 18 aa, Staphylococcus aureus
EYPLFFMVTKNLSRKQEL

SEQ ID NO: 1695396 - protein, 17 aa, Staphylococcus aureus
EYRKYYEPLIHKKDKEF

SEQ ID NO: 1695397 - protein, 18 aa, Staphylococcus aureus
EYSKDDIFQVYLNKIYCS

SEQ ID NO: 1695398 - protein, 22 aa, Staphylococcus aureus
EYSKQITQATLVPNVNAIQQAA

SEQ ID NO: 1695399 - protein, 26 aa, Staphylococcus aureus
EYSKQITQATLVPNVNAIQQAATTLN

SEQ ID NO: 1695400 - protein, 27 aa, Staphylococcus aureus
EYSPLRIKYPYIRGKLWDLWTEALEEN

SEQ ID NO: 1695401 - protein, 17 aa, Staphylococcus aureus
EYTESAVTQVRYVDVTT

SEQ ID NO: 1695402 - protein, 29 aa, Staphylococcus aureus
EYTKYKIGGTWYPFYKKNDGDLTKRFVEE

SEQ ID NO: 1695403 - protein, 29 aa, Staphylococcus aureus
EYTKYKISGTWYPFYKKNDGDLTKEFVEE

SEQ ID NO: 1695404 - protein, 20 aa, Staphylococcus aureus
EYVIVILDKSTIGEKIRLDI

SEQ ID NO: 1695405 - protein, 20 aa, Staphylococcus aureus
EYVIVMLDKSTIGNKIKLSI

SEQ ID NO: 1695406 - protein, 23 aa, Staphylococcus aureus
FAELCEACQLKFIGPSYQSIQKM

SEQ ID NO: 1695407 - protein, 20 aa, Staphylococcus aureus
FAENDYFYIMHRFDEKARIP

SEQ ID NO: 1695408 - protein, 25 aa, Staphylococcus aureus
FAHAIGFGLLERPVVRWLSDEEWEA

SEQ ID NO: 1695409 - protein, 26 aa, Staphylococcus aureus
FAIDIDKVLFQLNLKVKYIKMESNTS

SEQ ID NO: 1695410 - protein, 22 aa, Staphylococcus aureus
FAKTLDMYPIKNLEDLYDKEGY

SEQ ID NO: 1695411 - protein, 18 aa, Staphylococcus aureus
FALNMMLNIAQNGYKTSF

SEQ ID NO: 1695412 - protein, 25 aa, Staphylococcus aureus
FANIRDFASVGLLFRKNDDYIWLGH

SEQ ID NO: 1695413 - protein, 25 aa, Staphylococcus aureus
FASARPIRDLLPVLPEVFHQHTLIG

SEQ ID NO: 1695414 - protein, 25 aa, Staphylococcus aureus
FDAASLGLGILLKEQGHDLADYIFA

SEQ ID NO: 1695415 - protein, 18 aa, Staphylococcus aureus
FDDAKRLANALINSDNTN

SEQ ID NO: 1695416 - protein, 19 aa, Staphylococcus aureus
FDDFWKQRQVPLSQIKTPL

SEQ ID NO: 1695417 - protein, 20 aa, Staphylococcus aureus
FDDLWMNLYYLFMNLRDLFK

SEQ ID NO: 1695418 - protein, 27 aa, Staphylococcus aureus
FDEIRESINAQWVEYPEDWASEVLREV

SEQ ID NO: 1695419 - protein, 25 aa, Staphylococcus aureus
FDENGDIFFIFTNENLKTILNCHDG

SEQ ID NO: 1695420 - protein, 28 aa, Staphylococcus aureus
FDFFQDNGFGFITPYNLDDLNYYLDSFE

SEQ ID NO: 1695421 - protein, 34 aa, Staphylococcus aureus
FDFGHVERFIQNPPHGATVAWHDNPDTWKNTVGN

SEQ ID NO: 1695422 - protein, 31 aa, Staphylococcus aureus
FDHDTNWLSVLPIYHISGLSVLLRAVIEGFT

SEQ ID NO: 1695423 - protein, 21 aa, Staphylococcus aureus
FDIKKEDIIYYVYALLHHEEF

SEQ ID NO: 1695424 - protein, 28 aa, Staphylococcus aureus
FDLGPSILTMPYIFEKLFEYSKKQMSDY

SEQ ID NO: 1695425 - protein, 19 aa, Staphylococcus aureus
FDMVYVMMNSKLFSHVYIK

SEQ ID NO: 1695426 - protein, 23 aa, Staphylococcus aureus
FDNWFNMYIDEVKDHLLLELTVI

SEQ ID NO: 1695427 - protein, 23 aa, Staphylococcus aureus
FDQVIIDYLVAEFKKENGVDLSQ

SEQ ID NO: 1695428 - protein, 29 aa, Staphylococcus aureus
FDQVIKKDGYWWIRFKYQREGSSTNDFYC

SEQ ID NO: 1695429 - protein, 24 aa, Staphylococcus aureus
FDTELNIPMSQWQYAMNRTLPVDI

SEQ ID NO: 1695430 - protein, 27 aa, Staphylococcus aureus
FDTNDFPITWFYPLGEKKVERTTPKLE

SEQ ID NO: 1695431 - protein, 17 aa, Staphylococcus aureus
FDYSACKYPIGVAEDEI

SEQ ID NO: 1695432 - protein, 31 aa, Staphylococcus aureus
FDYYKNRWGLFGYCRFIPYLKKRLNNKIVLM

SEQ ID NO: 1695433 - protein, 17 aa, Staphylococcus aureus
FEALRSWLDDEIVADSW

SEQ ID NO: 1695434 - protein, 24 aa, Staphylococcus aureus
FEATPEQILVNGELIVHRDDIITE

SEQ ID NO: 1695435 - protein, 19 aa, Staphylococcus aureus
FEDDLAMIFVVINQHSKKV

SEQ ID NO: 1695436 - protein, 24 aa, Staphylococcus aureus
FEDEFSLNAFNLYGALSMANSGPN

SEQ ID NO: 1695437 - protein, 25 aa, Staphylococcus aureus
FEDEFSLNVFNLYGALSMANSGPNT

SEQ ID NO: 1695438 - protein, 21 aa, Staphylococcus aureus
FEDLWELYRGLANVRPALHVS

SEQ ID NO: 1695439 - protein, 26 aa, Staphylococcus aureus
FEDNTSFDGFIYSAGLGYFKSISDHS

SEQ ID NO: 1695440 - protein, 45 aa, Staphylococcus aureus
FEFEKQFGFMLKPWTTVRFMNVIPNRFIYKIALVGKDEKKYKDGP

SEQ ID NO: 1695441 - protein, 19 aa, Staphylococcus aureus
FEGCMPFEVMAERGRKTLL

SEQ ID NO: 1695442 - protein, 18 aa, Staphylococcus aureus
FEGEGLSILGYRNVPVNK

SEQ ID NO: 1695443 - protein, 17 aa, Staphylococcus aureus
FEGTPGYEEQMFGQQQS

SEQ ID NO: 1695444 - protein, 17 aa, Staphylococcus aureus
FEIIAGERRFRAIQSLN

SEQ ID NO: 1695445 - protein, 17 aa, Staphylococcus aureus
FEKLEPKYLERYSRRIN

SEQ ID NO: 1695446 - protein, 28 aa, Staphylococcus aureus
FEKVTKLKRLPYWRSKGDANYYWADIDT

SEQ ID NO: 1695447 - protein, 19 aa, Staphylococcus aureus
FELRKKHILGIVGESGSGK

SEQ ID NO: 1695448 - protein, 18 aa, Staphylococcus aureus
FELRKKLFLKLQRIKNNA

SEQ ID NO: 1695449 - protein, 22 aa, Staphylococcus aureus
FEMAELKLGLKTISFETSASSV

SEQ ID NO: 1695450 - protein, 27 aa, Staphylococcus aureus
FENKVAGWLWAWKAVPFKLLGINTSLP

SEQ ID NO: 1695451 - protein, 24 aa, Staphylococcus aureus
FENNQYIVTWALGHLVTNATSEQY

SEQ ID NO: 1695452 - protein, 23 aa, Staphylococcus aureus
FENRYFLNMLQRIKIHLVAFDEA

SEQ ID NO: 1695453 - protein, 28 aa, Staphylococcus aureus
FENSSFRGLYQFIGFIDELIERGKDFGE

SEQ ID NO: 1695454 - protein, 22 aa, Staphylococcus aureus
FEPRKFVFTNGEIKYNNNFEKE

SEQ ID NO: 1695455 - protein, 18 aa, Staphylococcus aureus
FEQTEVRLALSFLRAIDN

SEQ ID NO: 1695456 - protein, 17 aa, Staphylococcus aureus
FERDDVIIIASVSCIYG

SEQ ID NO: 1695457 - protein, 32 aa, Staphylococcus aureus
FERFMNLEEKKKLLIFPRYHQLDVVKKLISDT

SEQ ID NO: 1695458 - protein, 25 aa, Staphylococcus aureus
FETARGVLYPGVSDMYDAKQYVKPV

SEQ ID NO: 1695459 - protein, 20 aa, Staphylococcus aureus
FEYLVDRKATKRRKLFNGYI

SEQ ID NO: 1695460 - protein, 19 aa, Staphylococcus aureus
FFGHDIGRFKVNSSKLLLP

SEQ ID NO: 1695461 - protein, 19 aa, Staphylococcus aureus
FFICQILVFLFPTSPHVNL

SEQ ID NO: 1695462 - protein, 19 aa, Staphylococcus aureus
FFIYPGQKLKVSGTASSSN

SEQ ID NO: 1695463 - protein, 19 aa, Staphylococcus aureus
FFIYPGQKLKVTGNASTNS

SEQ ID NO: 1695464 - protein, 17 aa, Staphylococcus aureus
FFLDPTKTYVFVGSQTL

SEQ ID NO: 1695465 - protein, 17 aa, Staphylococcus aureus
FFMDNFGLKVKATNVVG

SEQ ID NO: 1695466 - protein, 22 aa, Staphylococcus aureus
FFQTVNLMFLEVLPGYTKNKKS

SEQ ID NO: 1695467 - protein, 20 aa, Staphylococcus aureus
FGAPFFPLHPTVYADLLGEL

SEQ ID NO: 1695468 - protein, 18 aa, Staphylococcus aureus
FGDTFLMCTIISFKTFEI

SEQ ID NO: 1695469 - protein, 26 aa, Staphylococcus aureus
FGEKLQGFLVTKFGWVQSYGSRAVKP

SEQ ID NO: 1695470 - protein, 24 aa, Staphylococcus aureus
FGEPAIAVPFNAGKIKVLIEALES

SEQ ID NO: 1695471 - protein, 23 aa, Staphylococcus aureus
FGESLPVYKPTLPPMVFGNRDKK

SEQ ID NO: 1695472 - protein, 17 aa, Staphylococcus aureus
FGETHPVDFVIVEAGLG

SEQ ID NO: 1695473 - protein, 24 aa, Staphylococcus aureus
FGGQLFRNTTFPDEKYLKELMDNY

SEQ ID NO: 1695474 - protein, 23 aa, Staphylococcus aureus
FGHVERFIQNPPHGATVAWHDSP

SEQ ID NO: 1695475 - protein, 18 aa, Staphylococcus aureus
FGLGLERTVAWISGVEHV

SEQ ID NO: 1695476 - protein, 18 aa, Staphylococcus aureus
FGLSIQYGLAKKAINNVQ

SEQ ID NO: 1695477 - protein, 17 aa, Staphylococcus aureus
FGMTETCSQFLTATPQM

SEQ ID NO: 1695478 - protein, 19 aa, Staphylococcus aureus
FGRIGRLAFRRIQEVEGLE

SEQ ID NO: 1695479 - protein, 24 aa, Staphylococcus aureus
FGRKFRHCAYFNKRLRTTGGRYLL

SEQ ID NO: 1695480 - protein, 18 aa, Staphylococcus aureus
FGSPIKWNFTKFIIDRQA

SEQ ID NO: 1695481 - protein, 18 aa, Staphylococcus aureus
FGVIAKTLAANERKYREI

SEQ ID NO: 1695482 - protein, 18 aa, Staphylococcus aureus
FHEKYLKLLFTNLETHND

SEQ ID NO: 1695483 - protein, 19 aa, Staphylococcus aureus
FHHPIFAVSPILKCLILKG

SEQ ID NO: 1695484 - protein, 37 aa, Staphylococcus aureus
FHKESLGFIFQDYSILPTLTVKENIMLPLSVQKMSKA

SEQ ID NO: 1695485 - protein, 30 aa, Staphylococcus aureus
FHKKSLPIPKYRYFKLNNNKIQKMLYRILQ

SEQ ID NO: 1695486 - protein, 18 aa, Staphylococcus aureus
FHSYWLDKNLTSNDVLIL

SEQ ID NO: 1695487 - protein, 19 aa, Staphylococcus aureus
FICRFNVAILDDGYYLPMD

SEQ ID NO: 1695488 - protein, 25 aa, Staphylococcus aureus
FIDAIKKYILTLKKEIIIFCIHITE

SEQ ID NO: 1695489 - protein, 25 aa, Staphylococcus aureus
FIDAQFEPLRKMEAPMFKKILKKHQ

SEQ ID NO: 1695490 - protein, 17 aa, Staphylococcus aureus
FIDLITDFPTIELQPDN

SEQ ID NO: 1695491 - protein, 22 aa, Staphylococcus aureus
FIDRLDKRIYDLQLSRQIALQT

SEQ ID NO: 1695492 - protein, 26 aa, Staphylococcus aureus
FIDSRTTIFPILGGGERIGTLVLGRV

SEQ ID NO: 1695493 - protein, 37 aa, Staphylococcus aureus
FIEDKKALFIVYANPLALGLLTPPGLFGADIVVGDTQ

SEQ ID NO: 1695494 - protein, 19 aa, Staphylococcus aureus
FIEKPFNLSLTIAKIQALL

SEQ ID NO: 1695495 - protein, 18 aa, Staphylococcus aureus
FIEKTYKYVLHLGLGKKE

SEQ ID NO: 1695496 - protein, 17 aa, Staphylococcus aureus
FIGTFTVEFFIDSNNQL

SEQ ID NO: 1695497 - protein, 34 aa, Staphylococcus aureus
FIHDSNISWKAKGILLYLLSRPDNWQIYETELEQ

SEQ ID NO: 1695498 - protein, 20 aa, Staphylococcus aureus
FIHEGISIGLSINLARDFSN

SEQ ID NO: 1695499 - protein, 17 aa, Staphylococcus aureus
FIHQYMKQATPFIEADI

SEQ ID NO: 1695500 - protein, 19 aa, Staphylococcus aureus
FIHYTPAYMYHEPLVRLAK

SEQ ID NO: 1695501 - protein, 19 aa, Staphylococcus aureus
FIIDPLQIDVAKQAGASMI

SEQ ID NO: 1695502 - protein, 19 aa, Staphylococcus aureus
FIIELLGVNADQFRQLFIL

SEQ ID NO: 1695503 - protein, 18 aa, Staphylococcus aureus
FIMKIYDEYRSYVIEELD

SEQ ID NO: 1695504 - protein, 26 aa, Staphylococcus aureus
FINNEDTFMGQFLIKMGIQPEVTKDK

SEQ ID NO: 1695505 - protein, 20 aa, Staphylococcus aureus
FINPNLKGQLFKLLEFSNME

SEQ ID NO: 1695506 - protein, 18 aa, Staphylococcus aureus
FIQAVPHMSFVIGEDNVA

SEQ ID NO: 1695507 - protein, 20 aa, Staphylococcus aureus
FITLLENYYDIEWKRSVKYT

SEQ ID NO: 1695508 - protein, 24 aa, Staphylococcus aureus
FKCRKAFDLFEFPEKIDLKTGIKD

SEQ ID NO: 1695509 - protein, 17 aa, Staphylococcus aureus
FKDIAHWEVSSGGYFVW

SEQ ID NO: 1695510 - protein, 20 aa, Staphylococcus aureus
FKDLVECSIGLLAREVPEEV

SEQ ID NO: 1695511 - protein, 25 aa, Staphylococcus aureus
FKDNNYIMYKKWINGQLSHIDYFQN

SEQ ID NO: 1695512 - protein, 22 aa, Staphylococcus aureus
FKEGAFYITFSNVTELISENDD

SEQ ID NO: 1695513 - protein, 18 aa, Staphylococcus aureus
FKFFAQYGNFKDLTKYKG

SEQ ID NO: 1695514 - protein, 17 aa, Staphylococcus aureus
FKFFSQYGSFRGLKNYK

SEQ ID NO: 1695515 - protein, 18 aa, Staphylococcus aureus
FKGILKFQIPNDVIKRDG

SEQ ID NO: 1695516 - protein, 24 aa, Staphylococcus aureus
FKGQDAFEFKPYVKLIFASNELPM

SEQ ID NO: 1695517 - protein, 18 aa, Staphylococcus aureus
FKIIMTEALSLYIWGCNI

SEQ ID NO: 1695518 - protein, 29 aa, Staphylococcus aureus
FKKRDEESYIFLYILGITGARYSDVINMT

SEQ ID NO: 1695519 - protein, 26 aa, Staphylococcus aureus
FKKVVKQINVPGFRKGKVPRSIFEQR

SEQ ID NO: 1695520 - protein, 20 aa, Staphylococcus aureus
FKLLKRRILGIGFVLPEGQV

SEQ ID NO: 1695521 - protein, 24 aa, Staphylococcus aureus
FKNNKMFHSYWLDKNLTSNDVLIL

SEQ ID NO: 1695522 - protein, 17 aa, Staphylococcus aureus
FKNQLLFTKHNLRGIEF

SEQ ID NO: 1695523 - protein, 17 aa, Staphylococcus aureus
FKNSWFKVYRMFDELRE

SEQ ID NO: 1695524 - protein, 29 aa, Staphylococcus aureus
FKQFKSKRMLLYAGLIPILRDHIAPVAVK

SEQ ID NO: 1695525 - protein, 21 aa, Staphylococcus aureus
FKSLRRFFKIYVRGIRALANF

SEQ ID NO: 1695526 - protein, 19 aa, Staphylococcus aureus
FKTLPAKAKLLYALISERQ

SEQ ID NO: 1695527 - protein, 20 aa, Staphylococcus aureus
FKVYPRGTIVYAKLGVNIGS

SEQ ID NO: 1695528 - protein, 18 aa, Staphylococcus aureus
FLAIVKYNSFNKAAQFLH

SEQ ID NO: 1695529 - protein, 17 aa, Staphylococcus aureus
FLCRFNVAILDDGYYLP

SEQ ID NO: 1695530 - protein, 24 aa, Staphylococcus aureus
FLKESNLYRLLREISMESVKCIEP

SEQ ID NO: 1695531 - protein, 18 aa, Staphylococcus aureus
FLKFMNANYMMRGRILTN

SEQ ID NO: 1695532 - protein, 19 aa, Staphylococcus aureus
FLKYYQWKMKKEHIIPISK

SEQ ID NO: 1695533 - protein, 17 aa, Staphylococcus aureus
FLNIIEVLGTTPSEFFK

SEQ ID NO: 1695534 - protein, 32 aa, Staphylococcus aureus
FLNLMMYTMYFKNIIKKHLTLSFVEFTILAII

SEQ ID NO: 1695535 - protein, 18 aa, Staphylococcus aureus
FLNNFLRNGTHAGGILKM

SEQ ID NO: 1695536 - protein, 19 aa, Staphylococcus aureus
FLQLIKKRNIYQYFVCYTA

SEQ ID NO: 1695537 - protein, 22 aa, Staphylococcus aureus
FLQTMQVGVWAPTQRISKRNST

SEQ ID NO: 1695538 - protein, 18 aa, Staphylococcus aureus
FLREVNIYDYPIIKDSYQ

SEQ ID NO: 1695539 - protein, 19 aa, Staphylococcus aureus
FLTAIADKMKSLNGYFVID

SEQ ID NO: 1695540 - protein, 17 aa, Staphylococcus aureus
FLTLKEFLYYKKKGKFP

SEQ ID NO: 1695541 - protein, 19 aa, Staphylococcus aureus
FMHALKRRAFANKLVYLFS

SEQ ID NO: 1695542 - protein, 25 aa, Staphylococcus aureus
FNDLTPDEIFPYASPQGIEELRDLW

SEQ ID NO: 1695543 - protein, 27 aa, Staphylococcus aureus
FNDLTPDEIFPYVPPQGIEELRDLWQQ

SEQ ID NO: 1695544 - protein, 20 aa, Staphylococcus aureus
FNEAYLWTQSVLNNGNYKHA

SEQ ID NO: 1695545 - protein, 20 aa, Staphylococcus aureus
FNELFQFIFNEYYDINFEHL

SEQ ID NO: 1695546 - protein, 23 aa, Staphylococcus aureus
FNEYGTKWYTYYDDDYNNFIMVS

SEQ ID NO: 1695547 - protein, 24 aa, Staphylococcus aureus
FNEYGTKWYTYYDDDYNNFIMVSY

SEQ ID NO: 1695548 - protein, 23 aa, Staphylococcus aureus
FNGPLDLLMHLIQKFEIDIYDIP

SEQ ID NO: 1695549 - protein, 40 aa, Staphylococcus aureus
FNIDFWYAFQCFDYANAGWKALFGLLLKGVGAKDIPFANN

SEQ ID NO: 1695550 - protein, 18 aa, Staphylococcus aureus
FNIIKSYRGKNLKLHHMD

SEQ ID NO: 1695551 - protein, 26 aa, Staphylococcus aureus
FNNKHDLAALSYLTFVALDDDGKPKH

SEQ ID NO: 1695552 - protein, 26 aa, Staphylococcus aureus
FNNKHDLAALSYLTFVALDDEGKPKH

SEQ ID NO: 1695553 - protein, 21 aa, Staphylococcus aureus
FNPLYAMFDIPYSIMGHVHFR

SEQ ID NO: 1695554 - protein, 21 aa, Staphylococcus aureus
FNQELLCIYIDFDSGLRHSNM

SEQ ID NO: 1695555 - protein, 24 aa, Staphylococcus aureus
FNTRQFIFKAIFNTTKFFHLKKGN

SEQ ID NO: 1695556 - protein, 21 aa, Staphylococcus aureus
FNTSQLLRQLNDKSLPLIVTT

SEQ ID NO: 1695557 - protein, 22 aa, Staphylococcus aureus
FNTVRYVYNRNLPKSLIEELKA

SEQ ID NO: 1695558 - protein, 21 aa, Staphylococcus aureus
FNVHIEEDLLPLVLEKMDVTG

SEQ ID NO: 1695559 - protein, 19 aa, Staphylococcus aureus
FNWILKHKEKFDVEVQNVS

SEQ ID NO: 1695560 - protein, 18 aa, Staphylococcus aureus
FNYLGENLKFEKSRQKYS

SEQ ID NO: 1695561 - protein, 24 aa, Staphylococcus aureus
FNYYQDHIFFLMDLHYLHDNHHPE

SEQ ID NO: 1695562 - protein, 19 aa, Staphylococcus aureus
FPESEIAFIILHFGGSIKN

SEQ ID NO: 1695563 - protein, 31 aa, Staphylococcus aureus
FPFSDVLTILSVFYFRYLYIDSNTHAKHKNA

SEQ ID NO: 1695564 - protein, 23 aa, Staphylococcus aureus
FPGKFIINTLNNSAIQSNFIEVD

SEQ ID NO: 1695565 - protein, 17 aa, Staphylococcus aureus
FPLLKSWSKKKKSEMVG

SEQ ID NO: 1695566 - protein, 19 aa, Staphylococcus aureus
FPQDYTVTWTNAKIANRPT

SEQ ID NO: 1695567 - protein, 21 aa, Staphylococcus aureus
FPRQCVFIGTTNKVDFLRDET

SEQ ID NO: 1695568 - protein, 23 aa, Staphylococcus aureus
FPSAHQFLVRNFGTGGVGKWSLF

SEQ ID NO: 1695569 - protein, 20 aa, Staphylococcus aureus
FPTATLLALHPLISERIVDL

SEQ ID NO: 1695570 - protein, 21 aa, Staphylococcus aureus
FPTFLEMLMATYRLVQKAKDT

SEQ ID NO: 1695571 - protein, 18 aa, Staphylococcus aureus
FQCGIWYVGTLVGVIGLH

SEQ ID NO: 1695572 - protein, 26 aa, Staphylococcus aureus
FQCYDYANMFFMIATGERLQGLYAYN

SEQ ID NO: 1695573 - protein, 23 aa, Staphylococcus aureus
FQGSKYLVDGSIGNLLLISNDKD

SEQ ID NO: 1695574 - protein, 18 aa, Staphylococcus aureus
FQNKLVGFNTNRDFWSFN

SEQ ID NO: 1695575 - protein, 31 aa, Staphylococcus aureus
FQNYALYPHMTVFENMAFGLKLRKVNKKEIE

SEQ ID NO: 1695576 - protein, 17 aa, Staphylococcus aureus
FQSIFINPITRKLHTFN

SEQ ID NO: 1695577 - protein, 20 aa, Staphylococcus aureus
FQSIVPRKGVLDSYYVYTIS

SEQ ID NO: 1695578 - protein, 18 aa, Staphylococcus aureus
FRAFYALPLLSNKAGIHT

SEQ ID NO: 1695579 - protein, 34 aa, Staphylococcus aureus
FRDIDRALVWGFTWKLGPFQLWDAMGYERVKTRM

SEQ ID NO: 1695580 - protein, 19 aa, Staphylococcus aureus
FRHDYVNILTTLSEYIRED

SEQ ID NO: 1695581 - protein, 20 aa, Staphylococcus aureus
FRHKYRNIKLNWICKAPKYT

SEQ ID NO: 1695582 - protein, 18 aa, Staphylococcus aureus
FRSMNEVFRYLVFEKKNG

SEQ ID NO: 1695583 - protein, 17 aa, Staphylococcus aureus
FRYFGKPIPAIQGLYSR

SEQ ID NO: 1695584 - protein, 22 aa, Staphylococcus aureus
FSDDQEHRYLLKKKWDSEKQTI

SEQ ID NO: 1695585 - protein, 25 aa, Staphylococcus aureus
FSEDPNYILNLLLSVITVSMKTLRL

SEQ ID NO: 1695586 - protein, 19 aa, Staphylococcus aureus
FSEFFGLNMLVKNITRIEY

SEQ ID NO: 1695587 - protein, 23 aa, Staphylococcus aureus
FSEYDLFTFFKHPSIKSMTIVTN

SEQ ID NO: 1695588 - protein, 23 aa, Staphylococcus aureus
FSEYKKDALAKIADAYNAKVNEA

SEQ ID NO: 1695589 - protein, 25 aa, Staphylococcus aureus
FSEYKMFSYHFKKYLQMAPSDYCKQ

SEQ ID NO: 1695590 - protein, 29 aa, Staphylococcus aureus
FSFSSNLNNKALLGDLWAAKFAPTQMDES

SEQ ID NO: 1695591 - protein, 24 aa, Staphylococcus aureus
FSHFSNQLFPPHVSTLYVDDGPDA

SEQ ID NO: 1695592 - protein, 28 aa, Staphylococcus aureus
FSIETRRYYLMLMLFSKENAMSLNHFSI

SEQ ID NO: 1695593 - protein, 24 aa, Staphylococcus aureus
FSIRNAFYRVFTKELRLSDAHHFI

SEQ ID NO: 1695594 - protein, 17 aa, Staphylococcus aureus
FSNAYKSAKGWPDMANK

SEQ ID NO: 1695595 - protein, 18 aa, Staphylococcus aureus
FSQHLDIDFIFKARKPMG

SEQ ID NO: 1695596 - protein, 22 aa, Staphylococcus aureus
FSQNLFRRPTPARLTRIEKSLL

SEQ ID NO: 1695597 - protein, 18 aa, Staphylococcus aureus
FSSDFYYFVKHNQKLTKQ

SEQ ID NO: 1695598 - protein, 18 aa, Staphylococcus aureus
FSSPSGMLYVTISDVYSG

SEQ ID NO: 1695599 - protein, 17 aa, Staphylococcus aureus
FSTAFKSTTERLGIVFT

SEQ ID NO: 1695600 - protein, 26 aa, Staphylococcus aureus
FSTTADFLYAVLNYPLYHDGDAKDVD

SEQ ID NO: 1695601 - protein, 27 aa, Staphylococcus aureus
FTDINPYIKNMMYVLADNRHISLIADV

SEQ ID NO: 1695602 - protein, 26 aa, Staphylococcus aureus
FTGMRKGEVLALHWSDINFVNKDLYV

SEQ ID NO: 1695603 - protein, 25 aa, Staphylococcus aureus
FTHENGIPVYLGMPIGIVFEVEGKT

SEQ ID NO: 1695604 - protein, 21 aa, Staphylococcus aureus
FTHIELPEHAYLSCYPNASLL

SEQ ID NO: 1695605 - protein, 21 aa, Staphylococcus aureus
FTKSIHVPVLFEAAEEGDDIA

SEQ ID NO: 1695606 - protein, 27 aa, Staphylococcus aureus
FTNLMTHPRYQIKKKYVAKLKGYIMRE

SEQ ID NO: 1695607 - protein, 18 aa, Staphylococcus aureus
FTREYNYQIDIWWSEDEP

SEQ ID NO: 1695608 - protein, 19 aa, Staphylococcus aureus
FTRLNFYLIDLFRQQNQLK

SEQ ID NO: 1695609 - protein, 17 aa, Staphylococcus aureus
FTRLNYYLIDLFRQQNQ

SEQ ID NO: 1695610 - protein, 18 aa, Staphylococcus aureus
FTTIQRYDWKDTPSKILI

SEQ ID NO: 1695611 - protein, 24 aa, Staphylococcus aureus
FTVERYFNIVFQGTGMIFEVEGKV

SEQ ID NO: 1695612 - protein, 19 aa, Staphylococcus aureus
FTVNMLHDQQAFAASDAPL

SEQ ID NO: 1695613 - protein, 17 aa, Staphylococcus aureus
FTVTLYDKDRLIGMGRV

SEQ ID NO: 1695614 - protein, 20 aa, Staphylococcus aureus
FVDAQFEPLRKMEAPMFKKI

SEQ ID NO: 1695615 - protein, 18 aa, Staphylococcus aureus
FVELIKQMSPKDAILFKF

SEQ ID NO: 1695616 - protein, 18 aa, Staphylococcus aureus
FVENAKEKATDFIDKVKG

SEQ ID NO: 1695617 - protein, 31 aa, Staphylococcus aureus
FVILSYANQPFIKAFNFLTNLLDITYTLAFY

SEQ ID NO: 1695618 - protein, 19 aa, Staphylococcus aureus
FVINKTDLAPYVGASLEQM

SEQ ID NO: 1695619 - protein, 19 aa, Staphylococcus aureus
FVITFIHKEEGEFTHYANG

SEQ ID NO: 1695620 - protein, 28 aa, Staphylococcus aureus
FVKAYIVQLISMLDMIGGKKLKIVNYIL

SEQ ID NO: 1695621 - protein, 19 aa, Staphylococcus aureus
FVKLFTDIDLNDDEVISIF

SEQ ID NO: 1695622 - protein, 17 aa, Staphylococcus aureus
FVKLITLKEDDTLIGAQ

SEQ ID NO: 1695623 - protein, 20 aa, Staphylococcus aureus
FVKVKQLVYQLIKLYRTNDM

SEQ ID NO: 1695624 - protein, 19 aa, Staphylococcus aureus
FVLGSVSHKVAKRATIPVL

SEQ ID NO: 1695625 - protein, 20 aa, Staphylococcus aureus
FVLSYDLFQNPTDTRTLIPF

SEQ ID NO: 1695626 - protein, 22 aa, Staphylococcus aureus
FVLSYDLFQNPTDTRTLIPFLT

SEQ ID NO: 1695627 - protein, 22 aa, Staphylococcus aureus
FVPNIKLQWLAIDKGKVETTVS

SEQ ID NO: 1695628 - protein, 18 aa, Staphylococcus aureus
FVRGAHLHFQLMQGSHPG

SEQ ID NO: 1695629 - protein, 18 aa, Staphylococcus aureus
FVVFSTYQSIEVIGKAQK

SEQ ID NO: 1695630 - protein, 36 aa, Staphylococcus aureus
FVVIRAEEFMYPYYLTAFLRYRLGLDQIVMNQSGTT

SEQ ID NO: 1695631 - protein, 17 aa, Staphylococcus aureus
FWTQMNQAPSLAKEDEK

SEQ ID NO: 1695632 - protein, 24 aa, Staphylococcus aureus
FYAWKRQAMIFLKETYSDWDMLTI

SEQ ID NO: 1695633 - protein, 19 aa, Staphylococcus aureus
FYEKHKIIEFDNKYGKYQL

SEQ ID NO: 1695634 - protein, 19 aa, Staphylococcus aureus
FYEYFYLQCKNDSSSHYNI

SEQ ID NO: 1695635 - protein, 20 aa, Staphylococcus aureus
FYFPLLKSWSKKKKSEMVGQ

SEQ ID NO: 1695636 - protein, 17 aa, Staphylococcus aureus
FYGAFCSAINIIKENNP

SEQ ID NO: 1695637 - protein, 18 aa, Staphylococcus aureus
FYIMINAIKYPYPDSNKK

SEQ ID NO: 1695638 - protein, 19 aa, Staphylococcus aureus
FYIPCKEIVDYFSLIQTEE

SEQ ID NO: 1695639 - protein, 34 aa, Staphylococcus aureus
FYKSIGTGVTIPPWNFPFAIMAGTTLAPVVAGNI

SEQ ID NO: 1695640 - protein, 18 aa, Staphylococcus aureus
FYKVKKIVRYAGKEDIAI

SEQ ID NO: 1695641 - protein, 19 aa, Staphylococcus aureus
FYKVKKIVRYAGKEDIAIL

SEQ ID NO: 1695642 - protein, 19 aa, Staphylococcus aureus
FYQQLFKLLEDMRVLNSIN

SEQ ID NO: 1695643 - protein, 19 aa, Staphylococcus aureus
FYTGILKDREVVITQSGIG

SEQ ID NO: 1695644 - protein, 24 aa, Staphylococcus aureus
GADAIMLITPYYNKTNQHGLVKHF

SEQ ID NO: 1695645 - protein, 19 aa, Staphylococcus aureus
GADRPLIKPAAFASEIHGE

SEQ ID NO: 1695646 - protein, 24 aa, Staphylococcus aureus
GAEEFGFATAPLVVLGCIMMRVCH

SEQ ID NO: 1695647 - protein, 31 aa, Staphylococcus aureus
GAELTWMRQPHYYMRLYSYTYSAGLTIGTVV

SEQ ID NO: 1695648 - protein, 28 aa, Staphylococcus aureus
GAHFTSRDIIYLMTDLLLIEDKDTLFKE

SEQ ID NO: 1695649 - protein, 17 aa, Staphylococcus aureus
GAMQRLESAIANKDQTK

SEQ ID NO: 1695650 - protein, 23 aa, Staphylococcus aureus
GANAVKFLLYYDVDDAEEINIQK

SEQ ID NO: 1695651 - protein, 27 aa, Staphylococcus aureus
GANLDPSHLWWQGIDPIAAIRILGQAN

SEQ ID NO: 1695652 - protein, 18 aa, Staphylococcus aureus
GANVKASILLLQKLDSKT

SEQ ID NO: 1695653 - protein, 28 aa, Staphylococcus aureus
GAQCWDLPNYLLDKYWGFRTWGNADAMA

SEQ ID NO: 1695654 - protein, 26 aa, Staphylococcus aureus
GAQLVTRLFFMFDKETMIASMGIGGG

SEQ ID NO: 1695655 - protein, 17 aa, Staphylococcus aureus
GARSSVFAPFKNLGLII

SEQ ID NO: 1695656 - protein, 24 aa, Staphylococcus aureus
GASGPLYGFSFVKMSAVAKDDMHN

SEQ ID NO: 1695657 - protein, 37 aa, Staphylococcus aureus
GATLELVRQLQFFINERIIPIIPQQGSLGASGDLAPL

SEQ ID NO: 1695658 - protein, 24 aa, Staphylococcus aureus
GAVALVLEAIPNDLAEEISKHLTI

SEQ ID NO: 1695659 - protein, 17 aa, Staphylococcus aureus
GAVRKLGEFKNYLGSIG

SEQ ID NO: 1695660 - protein, 26 aa, Staphylococcus aureus
GAWTVQMFMLFQFPHVAFENIPVADI

SEQ ID NO: 1695661 - protein, 22 aa, Staphylococcus aureus
GAYYFHGHIVPGWQGVKKTFDT

SEQ ID NO: 1695662 - protein, 23 aa, Staphylococcus aureus
GCGKSLILYDFYKECLKIDKKVA

SEQ ID NO: 1695663 - protein, 21 aa, Staphylococcus aureus
GCGNIYACEALFRAGVLPDKK

SEQ ID NO: 1695664 - protein, 17 aa, Staphylococcus aureus
GDAYLVMTYLEGGASGS

SEQ ID NO: 1695665 - protein, 23 aa, Staphylococcus aureus
GDDLQYTMTLTFEEAVFGTTKEI

SEQ ID NO: 1695666 - protein, 18 aa, Staphylococcus aureus
GDFFKKMDILISKQKIKI

SEQ ID NO: 1695667 - protein, 26 aa, Staphylococcus aureus
GDGSYLFEYPIWQRFGRYTGGLNFND

SEQ ID NO: 1695668 - protein, 25 aa, Staphylococcus aureus
GDIDQYFLMRYIKQGDILKLRLYRN

SEQ ID NO: 1695669 - protein, 22 aa, Staphylococcus aureus
GDIIGYVEAMKVLNEVTTDVAG

SEQ ID NO: 1695670 - protein, 34 aa, Staphylococcus aureus
GDIPNNLLFYIYGSLIEGFLYWIKDEKIDWPSEE

SEQ ID NO: 1695671 - protein, 21 aa, Staphylococcus aureus
GDIVPIYLKKNPNFKFPMKQD

SEQ ID NO: 1695672 - protein, 18 aa, Staphylococcus aureus
GDIYLGKYEGWYSVPDET

SEQ ID NO: 1695673 - protein, 25 aa, Staphylococcus aureus
GDKLAQLVIVPIWTPELKQVEEFEC

SEQ ID NO: 1695674 - protein, 25 aa, Staphylococcus aureus
GDKLAQLVIVPIWTPELKQVEEFES

SEQ ID NO: 1695675 - protein, 22 aa, Staphylococcus aureus
GDLAPLSHLALALIGEGKVFYK

SEQ ID NO: 1695676 - protein, 22 aa, Staphylococcus aureus
GDLAPLSHLALALIGEGKVLHR

SEQ ID NO: 1695677 - protein, 17 aa, Staphylococcus aureus
GDNLIIINKDRTPYDSD

SEQ ID NO: 1695678 - protein, 27 aa, Staphylococcus aureus
GDQSSEVYSPISPIKIATQDNSGNAVT

SEQ ID NO: 1695679 - protein, 17 aa, Staphylococcus aureus
GDRTIVESLKALGINHV

SEQ ID NO: 1695680 - protein, 24 aa, Staphylococcus aureus
GDRVSVAWMFESCGRCEYCTTGRE

SEQ ID NO: 1695681 - protein, 19 aa, Staphylococcus aureus
GDTLVITGSLYFISEVKSK

SEQ ID NO: 1695682 - protein, 27 aa, Staphylococcus aureus
GDVEPTSIISILVAAADALSAARPGAR

SEQ ID NO: 1695683 - protein, 25 aa, Staphylococcus aureus
GDVVVGMLPWRIINHVQADQITKVP

SEQ ID NO: 1695684 - protein, 19 aa, Staphylococcus aureus
GDYIKLVMKLGIEYFLPVK

SEQ ID NO: 1695685 - protein, 25 aa, Staphylococcus aureus
GDYIRASINLFPFNTNGNKGIAVGL

SEQ ID NO: 1695686 - protein, 35 aa, Staphylococcus aureus
GEEHLLNLDGIFVQIGLLPNTSWLKDAVELNERGE

SEQ ID NO: 1695687 - protein, 34 aa, Staphylococcus aureus
GEEHLLNLDGIFVQIGLLPNTSWVKYAVELNERG

SEQ ID NO: 1695688 - protein, 26 aa, Staphylococcus aureus
GEFHHPIFAVSPILKCLILKGLVKKE

SEQ ID NO: 1695689 - protein, 26 aa, Staphylococcus aureus
GEIDPVIRFYTWNPATLSIGYFQRLQ

SEQ ID NO: 1695690 - protein, 28 aa, Staphylococcus aureus
GEKNGITLMLLIGKFLQKFGSRRQIQTT

SEQ ID NO: 1695691 - protein, 24 aa, Staphylococcus aureus
GELGEDFTYYYAKSEQTPSSVGLG

SEQ ID NO: 1695692 - protein, 19 aa, Staphylococcus aureus
GELHLDILVDRMKKEFNVE

SEQ ID NO: 1695693 - protein, 25 aa, Staphylococcus aureus
GEMANAMLEKLRFSKMFFSSNAVNK

SEQ ID NO: 1695694 - protein, 24 aa, Staphylococcus aureus
GENIIELMIPVFYFYQQDDDFFNG

SEQ ID NO: 1695695 - protein, 26 aa, Staphylococcus aureus
GENIIELMIPVFYFYQQDDDFFNGYL

SEQ ID NO: 1695696 - protein, 23 aa, Staphylococcus aureus
GEPDEVWKERLELLKPYQVNKEM

SEQ ID NO: 1695697 - protein, 25 aa, Staphylococcus aureus
GEPVQYIVGFASFYGRTFEVNTNCL

SEQ ID NO: 1695698 - protein, 21 aa, Staphylococcus aureus
GEQFFKDNFGLKVKATNVVGK

SEQ ID NO: 1695699 - protein, 26 aa, Staphylococcus aureus
GEQKRFFEETYKLFSERYGKQNIAYA

SEQ ID NO: 1695700 - protein, 29 aa, Staphylococcus aureus
GERMYEFLDKLISVSLPRVRDFQGVSKKA

SEQ ID NO: 1695701 - protein, 17 aa, Staphylococcus aureus
GERRRLIDSPKVATYDL

SEQ ID NO: 1695702 - protein, 28 aa, Staphylococcus aureus
GESTTLRRLMNLYGFKEALQNSTLPMFG

SEQ ID NO: 1695703 - protein, 25 aa, Staphylococcus aureus
GETGRQIGWFISYDKDNPNMMMAIN

SEQ ID NO: 1695704 - protein, 21 aa, Staphylococcus aureus
GEVIFLDGKAYHANEHKGFVE

SEQ ID NO: 1695705 - protein, 24 aa, Staphylococcus aureus
GEVLVIRKQPLPYRQMYDCNVYRV

SEQ ID NO: 1695706 - protein, 19 aa, Staphylococcus aureus
GEVLYQAFGLKMQPEQQKL

SEQ ID NO: 1695707 - protein, 21 aa, Staphylococcus aureus
GEWTAILAGDALLTKAFELIS

SEQ ID NO: 1695708 - protein, 24 aa, Staphylococcus aureus
GEWTAILAGDALLTKAFELISSDD

SEQ ID NO: 1695709 - protein, 18 aa, Staphylococcus aureus
GFAVYFSPEIKKFIADNL

SEQ ID NO: 1695710 - protein, 25 aa, Staphylococcus aureus
GFDEPLLHTMFVDKRLRGVKAVQTL

SEQ ID NO: 1695711 - protein, 32 aa, Staphylococcus aureus
GFDHDTIWLSVLPIYHISGLSVLLRAVIEGFT

SEQ ID NO: 1695712 - protein, 28 aa, Staphylococcus aureus
GFDLGPSILTIPYIFEKLFEYSKKQMSD

SEQ ID NO: 1695713 - protein, 31 aa, Staphylococcus aureus
GFDYIVTGSGFLYNMVRVLVAFLIEVGKGRH

SEQ ID NO: 1695714 - protein, 32 aa, Staphylococcus aureus
GFDYIVTGSGFLYNMVRVLVAFLIEVGKGRYE

SEQ ID NO: 1695715 - protein, 27 aa, Staphylococcus aureus
GFEDQEVIWLYQYFSDISIAPTTYTLD

SEQ ID NO: 1695716 - protein, 18 aa, Staphylococcus aureus
GFEDYFLIVSDLIHYAKM

SEQ ID NO: 1695717 - protein, 24 aa, Staphylococcus aureus
GFENQLPWHLPNDLKYVKKLSTGH

SEQ ID NO: 1695718 - protein, 17 aa, Staphylococcus aureus
GFGFITPYNLDDLNYYL

SEQ ID NO: 1695719 - protein, 20 aa, Staphylococcus aureus
GFHHNALYSDYLIASDYSFV

SEQ ID NO: 1695720 - protein, 19 aa, Staphylococcus aureus
GFIDIPYLTGHEFGARLPN

SEQ ID NO: 1695721 - protein, 26 aa, Staphylococcus aureus
GFIVFHDEALQPLYKDRIPVVIKNTN

SEQ ID NO: 1695722 - protein, 22 aa, Staphylococcus aureus
GFNVRVDSLLYPGYQVSPYYDS

SEQ ID NO: 1695723 - protein, 17 aa, Staphylococcus aureus
GFNYQNCVISLVAIRNY

SEQ ID NO: 1695724 - protein, 24 aa, Staphylococcus aureus
GFPGKFIIDTLKNSAIQSNFIEVD

SEQ ID NO: 1695725 - protein, 17 aa, Staphylococcus aureus
GFTFDYCISNPPFGVDW

SEQ ID NO: 1695726 - protein, 19 aa, Staphylococcus aureus
GFYGAMFKDLDGHHFNFLV

SEQ ID NO: 1695727 - protein, 17 aa, Staphylococcus aureus
GGEKFAVKTGLQKTMQQ

SEQ ID NO: 1695728 - protein, 18 aa, Staphylococcus aureus
GGGERIGTLVLGRVHDDF

SEQ ID NO: 1695729 - protein, 26 aa, Staphylococcus aureus
GGGKTYFLFYVIRELFRRHSEVRLLD

SEQ ID NO: 1695730 - protein, 27 aa, Staphylococcus aureus
GGGYYDRFLANYLTKTISLLYDFQLTS

SEQ ID NO: 1695731 - protein, 29 aa, Staphylococcus aureus
GGHQWKDWKPLLSDILLYFFSNQSPDQLY

SEQ ID NO: 1695732 - protein, 29 aa, Staphylococcus aureus
GGHQWKDWKPLLSDILLYFLSKNTDDKLY

SEQ ID NO: 1695733 - protein, 21 aa, Staphylococcus aureus
GGIIETFGLTALPNAIQLSKA

SEQ ID NO: 1695734 - protein, 21 aa, Staphylococcus aureus
GGINLFPFEIYEPRFGTIFES

SEQ ID NO: 1695735 - protein, 22 aa, Staphylococcus aureus
GGITVIQILKLLEHIDLPSMGS

SEQ ID NO: 1695736 - protein, 21 aa, Staphylococcus aureus
GGPGVGSFGFTAESPSALPPP

SEQ ID NO: 1695737 - protein, 31 aa, Staphylococcus aureus
GGQQAGLFGGPLYIFHKIFSIITLSKELTDT

SEQ ID NO: 1695738 - protein, 20 aa, Staphylococcus aureus
GGQVIFYYTKPRNDELYYYS

SEQ ID NO: 1695739 - protein, 34 aa, Staphylococcus aureus
GGRDTMILGMSNDIKHIVVYNPAPLAIKDVSGLY

SEQ ID NO: 1695740 - protein, 31 aa, Staphylococcus aureus
GGRHTPFFSNYRPQFYFRTTDVTGVVHLPEG

SEQ ID NO: 1695741 - protein, 18 aa, Staphylococcus aureus
GGRVRDLPGVRYHIVRGA

SEQ ID NO: 1695742 - protein, 23 aa, Staphylococcus aureus
GGRWKIAIVYHLLHSNCLRLSEL

SEQ ID NO: 1695743 - protein, 22 aa, Staphylococcus aureus
GGVNLFPFEIYEPRFGTIFESK

SEQ ID NO: 1695744 - protein, 30 aa, Staphylococcus aureus
GHAPDLIKSAAFPNILPSSTNPTLPYTHNT

SEQ ID NO: 1695745 - protein, 30 aa, Staphylococcus aureus
GHFQGELHLRFQLAFYLFTNRGVICDPNQI

SEQ ID NO: 1695746 - protein, 18 aa, Staphylococcus aureus
GHHQVFIEPITEGSGIIK

SEQ ID NO: 1695747 - protein, 20 aa, Staphylococcus aureus
GHIAAAIFNLGYLPKGDKSI

SEQ ID NO: 1695748 - protein, 29 aa, Staphylococcus aureus
GHSQQEYPQFLYENVMSKISSRDGEDFKR

SEQ ID NO: 1695749 - protein, 24 aa, Staphylococcus aureus
GHSYSHYLLIEQAINTLKDAGYAF

SEQ ID NO: 1695750 - protein, 23 aa, Staphylococcus aureus
GHTVAFMHIPMLMDRIKATYNKN

SEQ ID NO: 1695751 - protein, 17 aa, Staphylococcus aureus
GHTYLPINVVIDLTVDV

SEQ ID NO: 1695752 - protein, 18 aa, Staphylococcus aureus
GHVIGMLEWALDYIAGNI

SEQ ID NO: 1695753 - protein, 22 aa, Staphylococcus aureus
GIALDYKIPYLDKSATELAKDG

SEQ ID NO: 1695754 - protein, 18 aa, Staphylococcus aureus
GIAQIQVMYDPGLILIGG

SEQ ID NO: 1695755 - protein, 23 aa, Staphylococcus aureus
GIATCWFNFRGFDHNPGIIPDYE

SEQ ID NO: 1695756 - protein, 19 aa, Staphylococcus aureus
GIATEPMPHLFIISDEFAE

SEQ ID NO: 1695757 - protein, 24 aa, Staphylococcus aureus
GIDVPNLDAVIFFAPKKSQVDIVQ

SEQ ID NO: 1695758 - protein, 20 aa, Staphylococcus aureus
GIECIYALYKKNRRSLQIYG

SEQ ID NO: 1695759 - protein, 23 aa, Staphylococcus aureus
GIEFDYLELLNYFSDLPIDEYAP

SEQ ID NO: 1695760 - protein, 26 aa, Staphylococcus aureus
GIEKRLSRYPQLYSRIGFSHQFDKLT

SEQ ID NO: 1695761 - protein, 18 aa, Staphylococcus aureus
GIELIINEALREVRKRQL

SEQ ID NO: 1695762 - protein, 35 aa, Staphylococcus aureus
GIEPQTLKLFKVCKMRGIPIFTFINKLDRVGKEPF

SEQ ID NO: 1695763 - protein, 29 aa, Staphylococcus aureus
GIEWIGYIPKYWTITKLKNIIDFISGYAF

SEQ ID NO: 1695764 - protein, 25 aa, Staphylococcus aureus
GIFKKPVITPIKPYKNFYPAEDYHQ

SEQ ID NO: 1695765 - protein, 25 aa, Staphylococcus aureus
GIGGLSNAFGFKLDTYHNTSKPNAA

SEQ ID NO: 1695766 - protein, 18 aa, Staphylococcus aureus
GIIIGFNVRPDSGAKRAT

SEQ ID NO: 1695767 - protein, 19 aa, Staphylococcus aureus
GIIYILQKYDLHNKDTIYV

SEQ ID NO: 1695768 - protein, 22 aa, Staphylococcus aureus
GIKATFKGLGTGPTIALRADFD

SEQ ID NO: 1695769 - protein, 25 aa, Staphylococcus aureus
GIKDKWRFVFYFEGSQFSKYKFTPS

SEQ ID NO: 1695770 - protein, 20 aa, Staphylococcus aureus
GIKSFYKTVFNNLTRYKAIV

SEQ ID NO: 1695771 - protein, 18 aa, Staphylococcus aureus
GILMSRTQAIILAELNKV

SEQ ID NO: 1695772 - protein, 23 aa, Staphylococcus aureus
GIMTEIPFAFFKQHVTDFDIPGE

SEQ ID NO: 1695773 - protein, 22 aa, Staphylococcus aureus
GIMTEIPFAFFKQHVTDFEIPG

SEQ ID NO: 1695774 - protein, 26 aa, Staphylococcus aureus
GINGLGETIKFFGGKIIGGAVRKLGE

SEQ ID NO: 1695775 - protein, 19 aa, Staphylococcus aureus
GINPNWLTKPVLGEIFKEI

SEQ ID NO: 1695776 - protein, 17 aa, Staphylococcus aureus
GIPEMYFYSYVSGATIS

SEQ ID NO: 1695777 - protein, 17 aa, Staphylococcus aureus
GIQFDTLEKITLALNVD

SEQ ID NO: 1695778 - protein, 18 aa, Staphylococcus aureus
GIRLQQTANTLGLTIDSR

SEQ ID NO: 1695779 - protein, 21 aa, Staphylococcus aureus
GISFLPIYITTNSDYNILVIN

SEQ ID NO: 1695780 - protein, 19 aa, Staphylococcus aureus
GISFLPIYITTNSNYNISV

SEQ ID NO: 1695781 - protein, 25 aa, Staphylococcus aureus
GISKQIFDLILKFADYGFPRAHAVS

SEQ ID NO: 1695782 - protein, 19 aa, Staphylococcus aureus
GISRFFDITTGTYIAYIRK

SEQ ID NO: 1695783 - protein, 18 aa, Staphylococcus aureus
GITKLVYIKSIQDTIEAV

SEQ ID NO: 1695784 - protein, 28 aa, Staphylococcus aureus
GIVESYEGYLSVFVKDDANKLFNFTPLN

SEQ ID NO: 1695785 - protein, 19 aa, Staphylococcus aureus
GIVISLLSLDHIEVSDDAI

SEQ ID NO: 1695786 - protein, 27 aa, Staphylococcus aureus
GIVLAIRNELHIPVKYVGLGEQLDDLQ

SEQ ID NO: 1695787 - protein, 25 aa, Staphylococcus aureus
GKARTGWLIVDYAGYPWPGYDDIVS

SEQ ID NO: 1695788 - protein, 24 aa, Staphylococcus aureus
GKARTGWLIVDYAGYTWPGYDDIV

SEQ ID NO: 1695789 - protein, 23 aa, Staphylococcus aureus
GKATNPEQLFAAGYASCFNGAFD

SEQ ID NO: 1695790 - protein, 20 aa, Staphylococcus aureus
GKDIIPPKTYSGNVDQVVTI

SEQ ID NO: 1695791 - protein, 20 aa, Staphylococcus aureus
GKEALLELYKNNYEAYELAG

SEQ ID NO: 1695792 - protein, 25 aa, Staphylococcus aureus
GKFRGDTFFPPYTFEDWEIASSVEG

SEQ ID NO: 1695793 - protein, 31 aa, Staphylococcus aureus
GKGKSFLAKLLWIYTSFFKGQMIYWDPKSEF

SEQ ID NO: 1695794 - protein, 26 aa, Staphylococcus aureus
GKGTNLLTGIIRCPQCGAPMAASNTT

SEQ ID NO: 1695795 - protein, 27 aa, Staphylococcus aureus
GKIMRSRGMYLFLNRNTRTAKGYFIVD

SEQ ID NO: 1695796 - protein, 25 aa, Staphylococcus aureus
GKKTAYFELAGLWIALNEEKDIPRN

SEQ ID NO: 1695797 - protein, 17 aa, Staphylococcus aureus
GKKYLLQNGKWGYFNRE

SEQ ID NO: 1695798 - protein, 17 aa, Staphylococcus aureus
GKMPWPMYHNERRYYRT

SEQ ID NO: 1695799 - protein, 23 aa, Staphylococcus aureus
GKNDLPIIIQDKTFVSKKLNYTK

SEQ ID NO: 1695800 - protein, 24 aa, Staphylococcus aureus
GKNDLPIIIQDKTFVSKKLNYTKT

SEQ ID NO: 1695801 - protein, 25 aa, Staphylococcus aureus
GKNDLYSLIISILIFIKPANIRKNL

SEQ ID NO: 1695802 - protein, 19 aa, Staphylococcus aureus
GKPEAWGWEQFTSQIALGR

SEQ ID NO: 1695803 - protein, 20 aa, Staphylococcus aureus
GKPEAWGWEQFTSQIALGRV

SEQ ID NO: 1695804 - protein, 27 aa, Staphylococcus aureus
GKPLATHLPLIFQKNGDDYYISGHIAK

SEQ ID NO: 1695805 - protein, 21 aa, Staphylococcus aureus
GKPMENIFKAIRRLIDEYTDL

SEQ ID NO: 1695806 - protein, 22 aa, Staphylococcus aureus
GKQLSIVKPLPNGSFQILTEIN

SEQ ID NO: 1695807 - protein, 18 aa, Staphylococcus aureus
GKSLAYLLAALMYNIETG

SEQ ID NO: 1695808 - protein, 17 aa, Staphylococcus aureus
GKSLLTRTILGMKPSQL

SEQ ID NO: 1695809 - protein, 29 aa, Staphylococcus aureus
GKSVCINSILMSLLYKNHPEELRLLLIDP

SEQ ID NO: 1695810 - protein, 23 aa, Staphylococcus aureus
GKTTLLRMINALEIPTEGTVYVN

SEQ ID NO: 1695811 - protein, 26 aa, Staphylococcus aureus
GKTTLTEKLLYFSGAIREAGTVKGKK

SEQ ID NO: 1695812 - protein, 17 aa, Staphylococcus aureus
GKWSYLYRAIDTEGHTL

SEQ ID NO: 1695813 - protein, 17 aa, Staphylococcus aureus
GKYFMRDVITYIGLDQS

SEQ ID NO: 1695814 - protein, 20 aa, Staphylococcus aureus
GLAALVDRGHRELPIRADFV

SEQ ID NO: 1695815 - protein, 17 aa, Staphylococcus aureus
GLAFVCAAKGYKAVFTM

SEQ ID NO: 1695816 - protein, 35 aa, Staphylococcus aureus
GLAPEAWLECYLDRTLLPILKLYSNTGISLEAHVQ

SEQ ID NO: 1695817 - protein, 20 aa, Staphylococcus aureus
GLAVLVDRGHRELPIRADFV

SEQ ID NO: 1695818 - protein, 20 aa, Staphylococcus aureus
GLDGPKLPSTPSRQAVAMPA

SEQ ID NO: 1695819 - protein, 17 aa, Staphylococcus aureus
GLDKAIETLKESKPYLF

SEQ ID NO: 1695820 - protein, 17 aa, Staphylococcus aureus
GLDLLHMHYAVPHAICG

SEQ ID NO: 1695821 - protein, 19 aa, Staphylococcus aureus
GLDLLHMHYAVPHAICGIL

SEQ ID NO: 1695822 - protein, 21 aa, Staphylococcus aureus
GLDLLHMHYAVPHAICGILAR

SEQ ID NO: 1695823 - protein, 17 aa, Staphylococcus aureus
GLDTRFQRFNKEKISWI

SEQ ID NO: 1695824 - protein, 18 aa, Staphylococcus aureus
GLEKGYFARPTIFINVNN

SEQ ID NO: 1695825 - protein, 17 aa, Staphylococcus aureus
GLEQLEFVVIPQTLDQV

SEQ ID NO: 1695826 - protein, 24 aa, Staphylococcus aureus
GLFKKMHIRMMPAQEPPYTRLIDS

SEQ ID NO: 1695827 - protein, 17 aa, Staphylococcus aureus
GLGLERTVAWISGVEHV

SEQ ID NO: 1695828 - protein, 23 aa, Staphylococcus aureus
GLHEPYDLQKILLGGAKLSATMI

SEQ ID NO: 1695829 - protein, 35 aa, Staphylococcus aureus
GLHPYGATFFVFSDNLKPALRLSSIMGLNARFIFT

SEQ ID NO: 1695830 - protein, 23 aa, Staphylococcus aureus
GLHRKRLISYGGLLKEIHKKLNL

SEQ ID NO: 1695831 - protein, 18 aa, Staphylococcus aureus
GLIIAQYISSPDALNNYL

SEQ ID NO: 1695832 - protein, 18 aa, Staphylococcus aureus
GLIIQRFGTTYVLTTKKE

SEQ ID NO: 1695833 - protein, 20 aa, Staphylococcus aureus
GLITAKILRAQEMNFPISIE

SEQ ID NO: 1695834 - protein, 21 aa, Staphylococcus aureus
GLLLKKHGQKLYDAGLRRINV

SEQ ID NO: 1695835 - protein, 20 aa, Staphylococcus aureus
GLLVPFVRDCDKKNFAEIEA

SEQ ID NO: 1695836 - protein, 24 aa, Staphylococcus aureus
GLNAKVIIIELNDDRIKYLEDMYA

SEQ ID NO: 1695837 - protein, 26 aa, Staphylococcus aureus
GLNITEFAVLELLYNKGPQPIQRIRN

SEQ ID NO: 1695838 - protein, 24 aa, Staphylococcus aureus
GLNKPNRLYLLKPNYDIEASHIKE

SEQ ID NO: 1695839 - protein, 29 aa, Staphylococcus aureus
GLNSNWDMLFIVFSIHLIDILKKLSHEEI

SEQ ID NO: 1695840 - protein, 19 aa, Staphylococcus aureus
GLPNALFTVTLYDKDRLIG

SEQ ID NO: 1695841 - protein, 26 aa, Staphylococcus aureus
GLPNALFTVTLYDKDWLIGMGRVIGD

SEQ ID NO: 1695842 - protein, 17 aa, Staphylococcus aureus
GLPVILSPVKEHIYLNE

SEQ ID NO: 1695843 - protein, 17 aa, Staphylococcus aureus
GLQKAITLKAAFELGER

SEQ ID NO: 1695844 - protein, 21 aa, Staphylococcus aureus
GLQKAITLKAAFELGERMGRR

SEQ ID NO: 1695845 - protein, 26 aa, Staphylococcus aureus
GLSEEALIKIIPSYHALIARSQTTVT

SEQ ID NO: 1695846 - protein, 21 aa, Staphylococcus aureus
GLSILGYRNVPVNKDAIAKHV

SEQ ID NO: 1695847 - protein, 28 aa, Staphylococcus aureus
GLSLHEAPAHVLNYFDPKDKSLLTEGMV

SEQ ID NO: 1695848 - protein, 19 aa, Staphylococcus aureus
GLSMIEAMISKRPVVAFDI

SEQ ID NO: 1695849 - protein, 18 aa, Staphylococcus aureus
GLTLDDYLVLIYLNEFKN

SEQ ID NO: 1695850 - protein, 24 aa, Staphylococcus aureus
GLTTQFIPHWEQPEYIQSLTFHSA

SEQ ID NO: 1695851 - protein, 20 aa, Staphylococcus aureus
GLYDNRLLVKATKSARHQFQ

SEQ ID NO: 1695852 - protein, 17 aa, Staphylococcus aureus
GLYLFIDRKNKVGEAIK

SEQ ID NO: 1695853 - protein, 29 aa, Staphylococcus aureus
GLYSFICDYYEIPFQRYNWSISFESVCKD

SEQ ID NO: 1695854 - protein, 18 aa, Staphylococcus aureus
GMFIELPNTIEGMVHIAN

SEQ ID NO: 1695855 - protein, 22 aa, Staphylococcus aureus
GMGRIGRMVLRIALQNKNLNVV

SEQ ID NO: 1695856 - protein, 21 aa, Staphylococcus aureus
GMKHHVLDMSLLSQLTPNALT

SEQ ID NO: 1695857 - protein, 26 aa, Staphylococcus aureus
GMKRRLSLAISFLQNPNILILDEPTV

SEQ ID NO: 1695858 - protein, 30 aa, Staphylococcus aureus
GMLFDAKNFYFNYPFLFGNDDYIFKKNGSE

SEQ ID NO: 1695859 - protein, 18 aa, Staphylococcus aureus
GMLYVTISDVYSGSPTLT

SEQ ID NO: 1695860 - protein, 17 aa, Staphylococcus aureus
GMNLYQPYTVYPATNTN

SEQ ID NO: 1695861 - protein, 17 aa, Staphylococcus aureus
GMRIGELFAIKRGNINY

SEQ ID NO: 1695862 - protein, 19 aa, Staphylococcus aureus
GMRIGELLAIKRENINYED

SEQ ID NO: 1695863 - protein, 25 aa, Staphylococcus aureus
GMSNGIPNIVVYNPAPISITSLNPN

SEQ ID NO: 1695864 - protein, 18 aa, Staphylococcus aureus
GMVCPFPLIEAQKKMATL

SEQ ID NO: 1695865 - protein, 19 aa, Staphylococcus aureus
GMVFQQPNPFPKSIYDNIT

SEQ ID NO: 1695866 - protein, 17 aa, Staphylococcus aureus
GMVLYLDRNTRTAKGHY

SEQ ID NO: 1695867 - protein, 18 aa, Staphylococcus aureus
GMVLYLDRNTRTAKGHYF

SEQ ID NO: 1695868 - protein, 23 aa, Staphylococcus aureus
GNDCTFIAVKLPYGVQKDADEVE

SEQ ID NO: 1695869 - protein, 27 aa, Staphylococcus aureus
GNDFAMPMLLAISHVHQLLIKADLRMS

SEQ ID NO: 1695870 - protein, 25 aa, Staphylococcus aureus
GNDNYILVNKFYLEFMRDLQGAVFL

SEQ ID NO: 1695871 - protein, 22 aa, Staphylococcus aureus
GNEEIFASRTLIDRLKERDFEI

SEQ ID NO: 1695872 - protein, 31 aa, Staphylococcus aureus
GNESTIQPILKEKFIALGLDVKEDQAAKHPK

SEQ ID NO: 1695873 - protein, 28 aa, Staphylococcus aureus
GNGGDGIGFAFSPGVLGETGLNGAAVGI

SEQ ID NO: 1695874 - protein, 21 aa, Staphylococcus aureus
GNGGGFYEFGLTKSSRTSLTI

SEQ ID NO: 1695875 - protein, 19 aa, Staphylococcus aureus
GNIDGLIIEIMIREYNLEI

SEQ ID NO: 1695876 - protein, 21 aa, Staphylococcus aureus
GNIHGMPLRILTGEGPKELLE

SEQ ID NO: 1695877 - protein, 24 aa, Staphylococcus aureus
GNKDYFLHAHLFQRYEWEDESVRY

SEQ ID NO: 1695878 - protein, 26 aa, Staphylococcus aureus
GNKKARRLLFWVVMNIIREKHHFDNH

SEQ ID NO: 1695879 - protein, 24 aa, Staphylococcus aureus
GNKLENIWFIDWSSTALNNSSNRG

SEQ ID NO: 1695880 - protein, 18 aa, Staphylococcus aureus
GNKTLLVPKLFTTYNQTS

SEQ ID NO: 1695881 - protein, 24 aa, Staphylococcus aureus
GNLKDAIVLFDRSQYQASWTDYMH

SEQ ID NO: 1695882 - protein, 18 aa, Staphylococcus aureus
GNLKQAIADKDATKALVN

SEQ ID NO: 1695883 - protein, 34 aa, Staphylococcus aureus
GNPFSINSITYILVNPFYIGKIQFAKYKDWNEKR

SEQ ID NO: 1695884 - protein, 22 aa, Staphylococcus aureus
GNPIKHYRLLYDNYLKEVEEVL

SEQ ID NO: 1695885 - protein, 23 aa, Staphylococcus aureus
GNQIKCHYVLMTYYNIICHYGEQ

SEQ ID NO: 1695886 - protein, 26 aa, Staphylococcus aureus
GNQPKVRIFEYLGNNEDIAKSVYANT

SEQ ID NO: 1695887 - protein, 17 aa, Staphylococcus aureus
GNRFLNILVVCSSGMGT

SEQ ID NO: 1695888 - protein, 23 aa, Staphylococcus aureus
GNSGVILSQLFRGFCKNIESESE

SEQ ID NO: 1695889 - protein, 26 aa, Staphylococcus aureus
GNSRNHWYQWLKHNLTLEGYHVTLFN

SEQ ID NO: 1695890 - protein, 26 aa, Staphylococcus aureus
GNTKLKLNGYFIASIISPLNLNKLNN

SEQ ID NO: 1695891 - protein, 27 aa, Staphylococcus aureus
GNTKLKLNGYFIASIISPLNLNKLNNL

SEQ ID NO: 1695892 - protein, 23 aa, Staphylococcus aureus
GNTVCYMWLRFNMDQQFEDTVIN

SEQ ID NO: 1695893 - protein, 22 aa, Staphylococcus aureus
GPDPFPTIVRDFQSVIGKEIKS

SEQ ID NO: 1695894 - protein, 25 aa, Staphylococcus aureus
GPEKVKMPNVIGLPKEEALQKLKSL

SEQ ID NO: 1695895 - protein, 19 aa, Staphylococcus aureus
GPEVNIINALMLLNQQQVT

SEQ ID NO: 1695896 - protein, 26 aa, Staphylococcus aureus
GPIDRQLFYQFIMKLPESVLRLKGYV

SEQ ID NO: 1695897 - protein, 20 aa, Staphylococcus aureus
GPKARLKLLVALSNNLDKTE

SEQ ID NO: 1695898 - protein, 18 aa, Staphylococcus aureus
GPKIFSFRKNETLYTIRL

SEQ ID NO: 1695899 - protein, 19 aa, Staphylococcus aureus
GPSWKYLKFIFNKDEEKNN

SEQ ID NO: 1695900 - protein, 24 aa, Staphylococcus aureus
GQEVIIIWNPWDNGFMTQDAKNNV

SEQ ID NO: 1695901 - protein, 21 aa, Staphylococcus aureus
GQEYFMKHLLGTKSGLLATPN

SEQ ID NO: 1695902 - protein, 21 aa, Staphylococcus aureus
GQFFVALVEYKMGNKSKFIQY

SEQ ID NO: 1695903 - protein, 19 aa, Staphylococcus aureus
GQFFVALVEYKMVNNSKFI

SEQ ID NO: 1695904 - protein, 24 aa, Staphylococcus aureus
GQGEILINPVQILSIYSALENNGN

SEQ ID NO: 1695905 - protein, 17 aa, Staphylococcus aureus
GQGFAMSVGLALAERHL

SEQ ID NO: 1695906 - protein, 25 aa, Staphylococcus aureus
GQHPNVVFWIGWNQEAFDVIAELKK

SEQ ID NO: 1695907 - protein, 24 aa, Staphylococcus aureus
GQKQKLKLLSFLLEDHDLIILDEI

SEQ ID NO: 1695908 - protein, 24 aa, Staphylococcus aureus
GQQQRIMIARALISEPAVLVLDEP

SEQ ID NO: 1695909 - protein, 24 aa, Staphylococcus aureus
GQQRLLDFVLSLIGQPQLILLDES

SEQ ID NO: 1695910 - protein, 22 aa, Staphylococcus aureus
GQRYYLPIRTWNGSSPPNQILG

SEQ ID NO: 1695911 - protein, 24 aa, Staphylococcus aureus
GQSGYAAFVVFNMMFGGDPSSVLF

SEQ ID NO: 1695912 - protein, 26 aa, Staphylococcus aureus
GQSLNNAMKGLRYSIANETTVKASQN

SEQ ID NO: 1695913 - protein, 19 aa, Staphylococcus aureus
GQTILPEVLSLYNAQFPNV

SEQ ID NO: 1695914 - protein, 19 aa, Staphylococcus aureus
GQVIYFLPQESSNIYFLIE

SEQ ID NO: 1695915 - protein, 20 aa, Staphylococcus aureus
GQWLILRDIAKHQPTTLIEI

SEQ ID NO: 1695916 - protein, 24 aa, Staphylococcus aureus
GRALELMCRLILNKFDKDIIKQTP

SEQ ID NO: 1695917 - protein, 19 aa, Staphylococcus aureus
GRATFLPLNVIQSRVVATE

SEQ ID NO: 1695918 - protein, 17 aa, Staphylococcus aureus
GRENYYMYKKFGVIPEM

SEQ ID NO: 1695919 - protein, 18 aa, Staphylococcus aureus
GRFKVNSSKLLLPKEDRT

SEQ ID NO: 1695920 - protein, 35 aa, Staphylococcus aureus
GRGEKIEFLNKPPSAWVILAKPNLGISSPDIFKLI

SEQ ID NO: 1695921 - protein, 23 aa, Staphylococcus aureus
GRGGEVLYQAFGLKMQPEQQKLT

SEQ ID NO: 1695922 - protein, 20 aa, Staphylococcus aureus
GRGIRIRFKYDGKTYESKMM

SEQ ID NO: 1695923 - protein, 32 aa, Staphylococcus aureus; identical to SEQ ID NO: 1595865

SEQ ID NO: 1695924 - protein, 26 aa, Staphylococcus aureus
GRKSYQYDWFYHSKAWKKLREIALDR

SEQ ID NO: 1695925 - protein, 26 aa, Staphylococcus aureus
GRKSYQYDWFYHSKAWKRLREIALDR

SEQ ID NO: 1695926 - protein, 27 aa, Staphylococcus aureus
GRKSYRYDWFYHSKAWKKLREIALDRD

SEQ ID NO: 1695927 - protein, 27 aa, Staphylococcus aureus
GRKTDERLWLLNRAGKIPFVVSGQGQE

SEQ ID NO: 1695928 - protein, 17 aa, Staphylococcus aureus
GRLIGVAPNNKFTMYRV

SEQ ID NO: 1695929 - protein, 19 aa, Staphylococcus aureus
GRLIGVAPNNKFTMYRVFG

SEQ ID NO: 1695930 - protein, 22 aa, Staphylococcus aureus
GRLMDSLINYLDVIEYTKLSET

SEQ ID NO: 1695931 - protein, 26 aa, Staphylococcus aureus
GRLNIKAFQFTLFDNTFLDEEYIESI

SEQ ID NO: 1695932 - protein, 27 aa, Staphylococcus aureus
GRLNIKAFQFTLFDNTFLDEGYIESII

SEQ ID NO: 1695933 - protein, 17 aa, Staphylococcus aureus
GRLPEEYLMLHKKFIKP

SEQ ID NO: 1695934 - protein, 28 aa, Staphylococcus aureus
GRLPGIQFLELFTDNLYFNISRHAIEMA

SEQ ID NO: 1695935 - protein, 27 aa, Staphylococcus aureus
GRLQKDLINWFIDGQYKLFYKKQDLSK

SEQ ID NO: 1695936 - protein, 28 aa, Staphylococcus aureus
GRLQKDLINWFIVDQYKLFYKKQDLSKS

SEQ ID NO: 1695937 - protein, 21 aa, Staphylococcus aureus
GRMFRYLYPLTKEAKKLLGHT

SEQ ID NO: 1695938 - protein, 18 aa, Staphylococcus aureus
GRMRKLNHPIPLKKYQHG

SEQ ID NO: 1695939 - protein, 22 aa, Staphylococcus aureus
GRNMTMYVTAPVVAGFAVAAKK

SEQ ID NO: 1695940 - protein, 21 aa, Staphylococcus aureus
GRQNYYMYKKFGVIPEMEYEM

SEQ ID NO: 1695941 - protein, 20 aa, Staphylococcus aureus
GRQYGFGINLISYYQGLKSK

SEQ ID NO: 1695942 - protein, 22 aa, Staphylococcus aureus
GRRFRFTALVVVGDKNGRVGFG

SEQ ID NO: 1695943 - protein, 17 aa, Staphylococcus aureus
GRRLNVFYATQVALEPP

SEQ ID NO: 1695944 - protein, 24 aa, Staphylococcus aureus
GRRNKFCENIISVPLPRHCSENKY

SEQ ID NO: 1695945 - protein, 18 aa, Staphylococcus aureus
GRRNKFFENIISVPLPLW

SEQ ID NO: 1695946 - protein, 26 aa, Staphylococcus aureus
GRRVICKHLIALLFTASPEAANKHIT

SEQ ID NO: 1695947 - protein, 18 aa, Staphylococcus aureus
GRTTFLHNIIFDVARHHR

SEQ ID NO: 1695948 - protein, 26 aa, Staphylococcus aureus
GRVDPDQLYYLMSRRISQREAERLVI

SEQ ID NO: 1695949 - protein, 19 aa, Staphylococcus aureus
GRWFAYFVKNAPSVPFIII

SEQ ID NO: 1695950 - protein, 19 aa, Staphylococcus aureus
GRWFAYFVKQAPRVPFIII

SEQ ID NO: 1695951 - protein, 20 aa, Staphylococcus aureus
GRWFAYFVKQAPRVPFIIIG

SEQ ID NO: 1695952 - protein, 18 aa, Staphylococcus aureus
GRYVVLKKKNSLFKGKEI

SEQ ID NO: 1695953 - protein, 17 aa, Staphylococcus aureus
GSDWEGQFANKVKDVLL

SEQ ID NO: 1695954 - protein, 18 aa, Staphylococcus aureus
GSDYPLSREKLSPVLALV

SEQ ID NO: 1695955 - protein, 17 aa, Staphylococcus aureus
GSFERLQALTTKTTLPV

SEQ ID NO: 1695956 - protein, 32 aa, Staphylococcus aureus
GSGQQWYSWIHINDLIQAILFLINKESASGPF

SEQ ID NO: 1695957 - protein, 29 aa, Staphylococcus aureus
GSHQWKDWKPLLSDILLYFLSKNTDDQLY

SEQ ID NO: 1695958 - protein, 23 aa, Staphylococcus aureus
GSKGILFTATYVDAFHKMDEYIK

SEQ ID NO: 1695959 - protein, 29 aa, Staphylococcus aureus
GSKIQTIGVILPSLTNPFFSALMQSIHDH

SEQ ID NO: 1695960 - protein, 30 aa, Staphylococcus aureus
GSLIDYGCHLLDLSLWLLGKNMVPHEVLGK

SEQ ID NO: 1695961 - protein, 19 aa, Staphylococcus aureus
GSPFCNYLIAHSGSSQPLV

SEQ ID NO: 1695962 - protein, 25 aa, Staphylococcus aureus
GSSGTIPGALFKLEKTHDLTEDQMI

SEQ ID NO: 1695963 - protein, 21 aa, Staphylococcus aureus
GSVYFIINFYNKNGTKLSTEI

SEQ ID NO: 1695964 - protein, 28 aa, Staphylococcus aureus
GSWQEYWAFESRFITLNYLDQPVGQSYL

SEQ ID NO: 1695965 - protein, 17 aa, Staphylococcus aureus
GTAHASLIRFPESTLRP

SEQ ID NO: 1695966 - protein, 39 aa, Staphylococcus aureus
GTANSPARLMPDKILDLRYKLRVNNVPTPRTVTFNETLT

SEQ ID NO: 1695967 - protein, 21 aa, Staphylococcus aureus
GTAQRILYSAFNLVEQRSGRD

SEQ ID NO: 1695968 - protein, 22 aa, Staphylococcus aureus
GTDAINYITFDPNTNTNGITAA

SEQ ID NO: 1695969 - protein, 20 aa, Staphylococcus aureus
GTDALVLRYLTPHGKWNIHS

SEQ ID NO: 1695970 - protein, 21 aa, Staphylococcus aureus
GTDALVLRYLTPHGKWNIHSM

SEQ ID NO: 1695971 - protein, 23 aa, Staphylococcus aureus
GTDYVYAEFYDDTYYYVFRGEGI

SEQ ID NO: 1695972 - protein, 29 aa, Staphylococcus aureus
GTEAFIETAKIVLRWLKEQGIQVELLNLG

SEQ ID NO: 1695973 - protein, 19 aa, Staphylococcus aureus
GTEHILLGLIRENEGVAAR

SEQ ID NO: 1695974 - protein, 19 aa, Staphylococcus aureus
GTIIKTLRKYMKLTQSKLS

SEQ ID NO: 1695975 - protein, 29 aa, Staphylococcus aureus
GTILDSARFRLLLSEAFDVAPRSVDALII

SEQ ID NO: 1695976 - protein, 24 aa, Staphylococcus aureus
GTKAKADRYVPYTIAVNGTSTPIL

SEQ ID NO: 1695977 - protein, 19 aa, Staphylococcus aureus
GTKKRIRYYSCSNFRNKGS

SEQ ID NO: 1695978 - protein, 19 aa, Staphylococcus aureus
GTLFRKNIYQMIPQEVTPM

SEQ ID NO: 1695979 - protein, 17 aa, Staphylococcus aureus
GTLLRYYTGLLERSKVQ

SEQ ID NO: 1695980 - protein, 24 aa, Staphylococcus aureus
GTLLTIIRAILNRKNCSGLSIGDM

SEQ ID NO: 1695981 - protein, 20 aa, Staphylococcus aureus
GTLNHITNAQRTALEGQINQ

SEQ ID NO: 1695982 - protein, 23 aa, Staphylococcus aureus
GTLNQAMNQLRQSIASKDATKSS

SEQ ID NO: 1695983 - protein, 23 aa, Staphylococcus aureus
GTLTGRRILILGDVLELGENSKE

SEQ ID NO: 1695984 - protein, 26 aa, Staphylococcus aureus
GTSARLHPWLLKIYEKEVMKYTANMK

SEQ ID NO: 1695985 - protein, 28 aa, Staphylococcus aureus
GTSVKSLPPFYYPLNELISIGQMIKNAG

SEQ ID NO: 1695986 - protein, 29 aa, Staphylococcus aureus
GTTLGNSLRRILLSSLPGAAVKYIEIEGV

SEQ ID NO: 1695987 - protein, 28 aa, Staphylococcus aureus
GTTLGNSLRRILLSSLSGAAVKYIEIEG

SEQ ID NO: 1695988 - protein, 22 aa, Staphylococcus aureus
GTTNFSLSMTASTGGATNLQQV

SEQ ID NO: 1695989 - protein, 27 aa, Staphylococcus aureus
GTVKNFRVTKIFGYFGLKRLEIEEAQA

SEQ ID NO: 1695990 - protein, 17 aa, Staphylococcus aureus
GTVLYNDTPLFDKQHRP

SEQ ID NO: 1695991 - protein, 20 aa, Staphylococcus aureus
GTYDFTRTHYPIFGKKVGEQ

SEQ ID NO: 1695992 - protein, 20 aa, Staphylococcus aureus
GTYQHLGLRALSEIAILPVP

SEQ ID NO: 1695993 - protein, 24 aa, Staphylococcus aureus
GTYQHLGLRALSKIASLPVPERTK

SEQ ID NO: 1695994 - protein, 21 aa, Staphylococcus aureus
GTYRALTKVFTRFGVEVDFVD

SEQ ID NO: 1695995 - protein, 22 aa, Staphylococcus aureus
GTYRALTKVFTRFGVEVDFVDT

SEQ ID NO: 1695996 - protein, 25 aa, Staphylococcus aureus
GTYYHKLEWLYRRCLEFLERYETQP

SEQ ID NO: 1695997 - protein, 19 aa, Staphylococcus aureus
GVAHLPGHLSPLLKNYYLN

SEQ ID NO: 1695998 - protein, 29 aa, Staphylococcus aureus
GVAKRAQSFGMKILAFDPYLTDEKVKSLS

SEQ ID NO: 1695999 - protein, 18 aa, Staphylococcus aureus
GVAYRKFDTAKEIITSVL

SEQ ID NO: 1696000 - protein, 24 aa, Staphylococcus aureus
GVFGIWNHPEAAQLIYMGLHSLQH

SEQ ID NO: 1696001 - protein, 19 aa, Staphylococcus aureus
GVGFRYFTQRIAMNYNIVG

SEQ ID NO: 1696002 - protein, 24 aa, Staphylococcus aureus
GVGPLTITMVLNNTLLAEKMRRGV

SEQ ID NO: 1696003 - protein, 23 aa, Staphylococcus aureus
GVGPVIEGGFYYDFDIDQNISSD

SEQ ID NO: 1696004 - protein, 18 aa, Staphylococcus aureus
GVIALNATDIRIAFSCVE

SEQ ID NO: 1696005 - protein, 25 aa, Staphylococcus aureus
GVKEMVLIPHFVKVTNLTDLFELIK

SEQ ID NO: 1696006 - protein, 19 aa, Staphylococcus aureus
GVKKFIAECIKFGTTSNIS

SEQ ID NO: 1696007 - protein, 17 aa, Staphylococcus aureus
GVKVSRITALQDDIKMA

SEQ ID NO: 1696008 - protein, 18 aa, Staphylococcus aureus
GVLMLNPELLMRGDDQKQ

SEQ ID NO: 1696009 - protein, 17 aa, Staphylococcus aureus
GVLVCTVIGFPLGASTT

SEQ ID NO: 1696010 - protein, 20 aa, Staphylococcus aureus
GVMTTLFLIGQAIQDDEIIQ

SEQ ID NO: 1696011 - protein, 35 aa, Staphylococcus aureus
GVPNEFNGAVFINENVRNFLKQNIEDIHFANDDQP

SEQ ID NO: 1696012 - protein, 17 aa, Staphylococcus aureus
GVPVWNGLTDDWHPTQM

SEQ ID NO: 1696013 - protein, 25 aa, Staphylococcus aureus
GVQLVDFWATWCGPCKMIAPVLEEL

SEQ ID NO: 1696014 - protein, 19 aa, Staphylococcus aureus
GVRRRNKFCENIISVPPHS

SEQ ID NO: 1696015 - protein, 18 aa, Staphylococcus aureus
GVRVIVPFGPRTIQGYVM

SEQ ID NO: 1696016 - protein, 24 aa, Staphylococcus aureus
GVSIDHLWLYETNKYYALAMELIH

SEQ ID NO: 1696017 - protein, 23 aa, Staphylococcus aureus
GVSVDKIWLDPGIGFAKTREEEA

SEQ ID NO: 1696018 - protein, 19 aa, Staphylococcus aureus
GVTTPYYAMIDSLAVVVKS

SEQ ID NO: 1696019 - protein, 19 aa, Staphylococcus aureus
GWFVGYVITNHDKYYFATH

SEQ ID NO: 1696020 - protein, 23 aa, Staphylococcus aureus
GWSRYEFLSFLNREINEEHVIIL

SEQ ID NO: 1696021 - protein, 28 aa, Staphylococcus aureus
GYDALSAVTPFYYPFTFEEIRDYYFDII

SEQ ID NO: 1696022 - protein, 24 aa, Staphylococcus aureus
GYDPEYGARPLIRAIQKTIEDNLS

SEQ ID NO: 1696023 - protein, 19 aa, Staphylococcus aureus
GYDVEILIELTIKNNRYKD

SEQ ID NO: 1696024 - protein, 17 aa, Staphylococcus aureus
GYEWQFKLNYRTTEIPY

SEQ ID NO: 1696025 - protein, 17 aa, Staphylococcus aureus
GYFYPEIAMYFKNPSRV

SEQ ID NO: 1696026 - protein, 24 aa, Staphylococcus aureus
GYGMKIMMSLPQYVQGVFPDFNHL

SEQ ID NO: 1696027 - protein, 24 aa, Staphylococcus aureus
GYGTKIMMSLPQYVQGVFPDFNHL

SEQ ID NO: 1696028 - protein, 17 aa, Staphylococcus aureus
GYIMFDSDENYKYGAGL

SEQ ID NO: 1696029 - protein, 18 aa, Staphylococcus aureus
GYKNIEFTFVEEKGKNIY

SEQ ID NO: 1696030 - protein, 22 aa, Staphylococcus aureus
GYKRKLHPRYNTYTDLAVYKIK

SEQ ID NO: 1696031 - protein, 29 aa, Staphylococcus aureus
GYLARIVGYKKAREIWYLCRQYNAQEALD

SEQ ID NO: 1696032 - protein, 18 aa, Staphylococcus aureus
GYNLQIATNSQFVLSYDL

SEQ ID NO: 1696033 - protein, 23 aa, Staphylococcus aureus
GYPIVLIHTVLDNYSVFNKFAAE

SEQ ID NO: 1696034 - protein, 22 aa, Staphylococcus aureus
GYQDIYFLNKNGEWYYFEVRSA

SEQ ID NO: 1696035 - protein, 24 aa, Staphylococcus aureus
GYQKFYSYHSKGDNIHFFNTILKY

SEQ ID NO: 1696036 - protein, 18 aa, Staphylococcus aureus
GYRSLHIVVSIPVFLAER

SEQ ID NO: 1696037 - protein, 18 aa, Staphylococcus aureus
GYSQHFPSVFALIGSHSE

SEQ ID NO: 1696038 - protein, 20 aa, Staphylococcus aureus
GYSYIMMKNVAYKTYFDVTM

SEQ ID NO: 1696039 - protein, 20 aa, Staphylococcus aureus
GYVDWIKLSLGPLARENYYM

SEQ ID NO: 1696040 - protein, 24 aa, Staphylococcus aureus
GYVKVLELVGVGYRAQMQGKDLIL

SEQ ID NO: 1696041 - protein, 17 aa, Staphylococcus aureus
HAFIHMVGFSRGGLQGL

SEQ ID NO: 1696042 - protein, 22 aa, Staphylococcus aureus
HAIQRFELKSIPLKNSFGIWGD

SEQ ID NO: 1696043 - protein, 27 aa, Staphylococcus aureus
HAKYFDISCVPILTRSQKSLQGILVVM

SEQ ID NO: 1696044 - protein, 19 aa, Staphylococcus aureus
HALDLLGLATLSLLDTFSC

SEQ ID NO: 1696045 - protein, 19 aa, Staphylococcus aureus
HAMSGILMSRTQAIILAEL

SEQ ID NO: 1696046 - protein, 24 aa, Staphylococcus aureus
HAPNIRTFLHRYDLYETKYWSVFD

SEQ ID NO: 1696047 - protein, 20 aa, Staphylococcus aureus
HAQAFFTQHGSNNVVVERQF

SEQ ID NO: 1696048 - protein, 27 aa, Staphylococcus aureus
HAVMVGIIYQFIVANALFDSKHEINHY

SEQ ID NO: 1696049 - protein, 26 aa, Staphylococcus aureus
HAVMVGIIYQFIVANSLFDSKHDINH

SEQ ID NO: 1696050 - protein, 17 aa, Staphylococcus aureus
HAVSRLVGAPLGYVGHD

SEQ ID NO: 1696051 - protein, 33 aa, Staphylococcus aureus
HCPGNFQRLMQLSKRLLIIPNINNQRSALYIKH

SEQ ID NO: 1696052 - protein, 33 aa, Staphylococcus aureus
HCPGNFQRLMQLSKRLPIIPNINNQRSALYITH

SEQ ID NO: 1696053 - protein, 34 aa, Staphylococcus aureus
HCPGNFQRLMQLSKRLPIIPVIKNQRSALYIKHL

SEQ ID NO: 1696054 - protein, 20 aa, Staphylococcus aureus
HDACTILYLLQPELFTMVPV

SEQ ID NO: 1696055 - protein, 22 aa, Staphylococcus aureus
HDDAIALILAGAIDSPLEILAV

SEQ ID NO: 1696056 - protein, 26 aa, Staphylococcus aureus
HDGTKLGFMSFFTKASVAALKKYPEV

SEQ ID NO: 1696057 - protein, 19 aa, Staphylococcus aureus
HDHVWGQPLYDSKTLFKLL

SEQ ID NO: 1696058 - protein, 24 aa, Staphylococcus aureus
HDIANVIEMYKLKKFLGIDDDKDD

SEQ ID NO: 1696059 - protein, 23 aa, Staphylococcus aureus
HDIANVIEMYKLKKILGIDDDKE

SEQ ID NO: 1696060 - protein, 23 aa, Staphylococcus aureus
HDINGNVPMFINIGEWDGDDEEL

SEQ ID NO: 1696061 - protein, 29 aa, Staphylococcus aureus
HDINHYIQYLIQLGYPLDTITDLDFETLY

SEQ ID NO: 1696062 - protein, 19 aa, Staphylococcus aureus
HDKKFILMTAHRRENIGKP

SEQ ID NO: 1696063 - protein, 19 aa, Staphylococcus aureus
HDKKFILMTAHRRENIGQP

SEQ ID NO: 1696064 - protein, 17 aa, Staphylococcus aureus
HDLKILINLNASGGFEL

SEQ ID NO: 1696065 - protein, 30 aa, Staphylococcus aureus
HDLTEDQMIDFLFTSALFGRVVANNASVAG

SEQ ID NO: 1696066 - protein, 22 aa, Staphylococcus aureus
HDSNIKLYESLGIKQVYVEDFE

SEQ ID NO: 1696067 - protein, 18 aa, Staphylococcus aureus
HDTIVASGNYTNASPDKQ

SEQ ID NO: 1696068 - protein, 20 aa, Staphylococcus aureus
HDVYLKHFYDSIAPSFYFDF

SEQ ID NO: 1696069 - protein, 21 aa, Staphylococcus aureus
HDYAFDIRGLYTKASLSVLTS

SEQ ID NO: 1696070 - protein, 24 aa, Staphylococcus aureus
HEGKYIAYFQAFTNTHAPVEVLKE

SEQ ID NO: 1696071 - protein, 18 aa, Staphylococcus aureus
HEHDVIMFTICIDVIDSA

SEQ ID NO: 1696072 - protein, 17 aa, Staphylococcus aureus
HEKILRKTISKNLKRLS

SEQ ID NO: 1696073 - protein, 17 aa, Staphylococcus aureus
HELDKVQGSAIAKAEAE

SEQ ID NO: 1696074 - protein, 27 aa, Staphylococcus aureus
HELQPDEFYFLPSFMSPLKKHHDFIDV

SEQ ID NO: 1696075 - protein, 19 aa, Staphylococcus aureus
HELVKDGNFFKLEFAPEIE

SEQ ID NO: 1696076 - protein, 21 aa, Staphylococcus aureus
HESIPYVIDPVMLAKSGDSLM

SEQ ID NO: 1696077 - protein, 23 aa, Staphylococcus aureus
HETGKEDFYFIKLNQFNDDTVTY

SEQ ID NO: 1696078 - protein, 26 aa, Staphylococcus aureus
HEVDGVFIYIGMKPLTAPFKDLGITN

SEQ ID NO: 1696079 - protein, 20 aa, Staphylococcus aureus
HEYQVGDIYPRDGLEVSEER

SEQ ID NO: 1696080 - protein, 21 aa, Staphylococcus aureus
HEYQVGDIYPRDGLEVSEERF

SEQ ID NO: 1696081 - protein, 30 aa, Staphylococcus aureus
HFEISVIDEFFKILKIIPKEYHNINVELSY

SEQ ID NO: 1696082 - protein, 17 aa, Staphylococcus aureus
HFIDVLKTYLPEGPKYY

SEQ ID NO: 1696083 - protein, 26 aa, Staphylococcus aureus
HFKETSLDFFVIEDFSYSPRLVNQAH

SEQ ID NO: 1696084 - protein, 18 aa, Staphylococcus aureus
HFMGYRQMKTFKTELIKM

SEQ ID NO: 1696085 - protein, 22 aa, Staphylococcus aureus
HFQAFYIMLNAIKYPYPDSNKK

SEQ ID NO: 1696086 - protein, 22 aa, Staphylococcus aureus
HFQHYMMFFYGNGTKMIFSQNL

SEQ ID NO: 1696087 - protein, 23 aa, Staphylococcus aureus
HFSKLDVPFIYRVHEQPKSERLR

SEQ ID NO: 1696088 - protein, 19 aa, Staphylococcus aureus
HFVKSWLLDARAPKVELPE

SEQ ID NO: 1696089 - protein, 19 aa, Staphylococcus aureus
HFVKSWLLDSRAPKVIPPE

SEQ ID NO: 1696090 - protein, 17 aa, Staphylococcus aureus
HFVLIFARKNVTSRSPY

SEQ ID NO: 1696091 - protein, 18 aa, Staphylococcus aureus
HFVLIFARKNVTSRSPYV

SEQ ID NO: 1696092 - protein, 24 aa, Staphylococcus aureus
HGFKNYVALLFHKGAILEDKYHTL

SEQ ID NO: 1696093 - protein, 29 aa, Staphylococcus aureus
HGGIPDTGFYHFWIQGIFARWTDNPNIED

SEQ ID NO: 1696094 - protein, 27 aa, Staphylococcus aureus
HGGIPDTGFYRFWAQGIFARWTDNPNI

SEQ ID NO: 1696095 - protein, 26 aa, Staphylococcus aureus
HGISSKCVYVKWNPYSYTYAKQHQIE

SEQ ID NO: 1696096 - protein, 25 aa, Staphylococcus aureus
HGIVFNASLSLYKDAIHQKGSMRSN

SEQ ID NO: 1696097 - protein, 22 aa, Staphylococcus aureus
HGLSSQILMLMTMNLHFESNEV

SEQ ID NO: 1696098 - protein, 33 aa, Staphylococcus aureus
HGNGGDGIGFAFSPGVLGETGLNGAAVGIGGLS

SEQ ID NO: 1696099 - protein, 17 aa, Staphylococcus aureus
HGQKLYDAGLRRINVSL

SEQ ID NO: 1696100 - protein, 27 aa, Staphylococcus aureus
HGTEFLMDHRHLWLRSKKQHAVMKIRN

SEQ ID NO: 1696101 - protein, 19 aa, Staphylococcus aureus
HHESHLFIRVIKDANNKRI

SEQ ID NO: 1696102 - protein, 23 aa, Staphylococcus aureus
HHLKKMIGDLPLREKRKARKAIE

SEQ ID NO: 1696103 - protein, 24 aa, Staphylococcus aureus
HHNKYLRYWRRLSQTVKINYVTCM

SEQ ID NO: 1696104 - protein, 27 aa, Staphylococcus aureus
HHRPDQAHMYLFDFGTNGLMPVTDIPH

SEQ ID NO: 1696105 - protein, 18 aa, Staphylococcus aureus
HIALNIAIILAGGDLPRN

SEQ ID NO: 1696106 - protein, 27 aa, Staphylococcus aureus
HIASYLPIKHPFDQALYQTYLIDDMTS

SEQ ID NO: 1696107 - protein, 20 aa, Staphylococcus aureus
HIDGLITSDNVFFNQLSEEE

SEQ ID NO: 1696108 - protein, 17 aa, Staphylococcus aureus
HIDHFPEMWLLSSSETL

SEQ ID NO: 1696109 - protein, 26 aa, Staphylococcus aureus
HIEDLLTFPLIALIVSGGHTELVYMK

SEQ ID NO: 1696110 - protein, 20 aa, Staphylococcus aureus
HIEIICLKSCDLTTILHNLY

SEQ ID NO: 1696111 - protein, 23 aa, Staphylococcus aureus
HIEKSRLKALYLSVIDRIDIKKD

SEQ ID NO: 1696112 - protein, 27 aa, Staphylococcus aureus
HIEKYGEIPFLNIPLKLKGYSDNIIRN

SEQ ID NO: 1696113 - protein, 18 aa, Staphylococcus aureus
HIFSDLSSKMFTWNNGEY

SEQ ID NO: 1696114 - protein, 25 aa, Staphylococcus aureus
HIGLLKIDFLGLRNLSIIHQILTQV

SEQ ID NO: 1696115 - protein, 20 aa, Staphylococcus aureus
HIKKSRLKALYLSVIDRIDI

SEQ ID NO: 1696116 - protein, 17 aa, Staphylococcus aureus
HILMLFDDYKRIDLTLI

SEQ ID NO: 1696117 - protein, 20 aa, Staphylococcus aureus
HIMPVWSIKNRALKVRDEDF

SEQ ID NO: 1696118 - protein, 24 aa, Staphylococcus aureus
HINWRKWCYDFTAINDFCYQTNSY

SEQ ID NO: 1696119 - protein, 24 aa, Staphylococcus aureus
HISGTYTMPCARTLVPVKVPLDVT

SEQ ID NO: 1696120 - protein, 21 aa, Staphylococcus aureus
HISPELLRYRYKHKMRGDELL

SEQ ID NO: 1696121 - protein, 18 aa, Staphylococcus aureus
HIVSLPDSGTRIEVKAPL

SEQ ID NO: 1696122 - protein, 17 aa, Staphylococcus aureus
HKFMNWDGPILTDSGGF

SEQ ID NO: 1696123 - protein, 20 aa, Staphylococcus aureus
HKGKMAFRVYPKWCNQLNKR

SEQ ID NO: 1696124 - protein, 17 aa, Staphylococcus aureus
HKIAESVKLLFNVDCEV

SEQ ID NO: 1696125 - protein, 19 aa, Staphylococcus aureus
HKIIWRYDMTNKSEGLFWV

SEQ ID NO: 1696126 - protein, 18 aa, Staphylococcus aureus
HKLFKEGIATEPMPHLFI

SEQ ID NO: 1696127 - protein, 17 aa, Staphylococcus aureus
HLAFKMADQIFLKKQRV

SEQ ID NO: 1696128 - protein, 32 aa, Staphylococcus aureus
HLDLETTKWLEDYLRYFKGAIVIISHDRYFLD

SEQ ID NO: 1696129 - protein, 17 aa, Staphylococcus aureus
HLEKKRIVIFAAGIGNP

SEQ ID NO: 1696130 - protein, 27 aa, Staphylococcus aureus
HLEPEQLLKPLFQHFKEKYLEVISKID

SEQ ID NO: 1696131 - protein, 34 aa, Staphylococcus aureus
HLGYLQDKHYPLLRFGFIHVPYIPEQIDGKSDTP

SEQ ID NO: 1696132 - protein, 18 aa, Staphylococcus aureus
HLHDSWLKVDGRLNKILK

SEQ ID NO: 1696133 - protein, 19 aa, Staphylococcus aureus
HLIEKYSIGVIALNATDIR

SEQ ID NO: 1696134 - protein, 20 aa, Staphylococcus aureus
HLINPTQAMDIAYTEKVGNG

SEQ ID NO: 1696135 - protein, 25 aa, Staphylococcus aureus
HLITKPIFEALFSKYSFVNNNPVSS

SEQ ID NO: 1696136 - protein, 22 aa, Staphylococcus aureus
HLKKMYHAMAHKFGDNWKKAQE

SEQ ID NO: 1696137 - protein, 23 aa, Staphylococcus aureus
HLKKMYHVMAHKFGDNWKKAQKV

SEQ ID NO: 1696138 - protein, 29 aa, Staphylococcus aureus
HLKSDIQTLFYGRFYLRELATPDNTIKFE

SEQ ID NO: 1696139 - protein, 20 aa, Staphylococcus aureus
HLLDVALTLDYYNVTTAENA

SEQ ID NO: 1696140 - protein, 17 aa, Staphylococcus aureus
HLLRWITKLYTKGVIEM

SEQ ID NO: 1696141 - protein, 20 aa, Staphylococcus aureus
HLLTCLDSKGFFKFIPVVAE

SEQ ID NO: 1696142 - protein, 25 aa, Staphylococcus aureus
HLPDMDVIISAPFYPAYMTRERIEK

SEQ ID NO: 1696143 - protein, 19 aa, Staphylococcus aureus
HLQAIIEWALQQIENNFNF

SEQ ID NO: 1696144 - protein, 20 aa, Staphylococcus aureus
HLTFALYFNTGGFLNILMKW

SEQ ID NO: 1696145 - protein, 35 aa, Staphylococcus aureus
HLTSKTLPMIDTIKSLMAFLKQRHIPMAIATSSVK

SEQ ID NO: 1696146 - protein, 33 aa, Staphylococcus aureus
HLTTLHTSLIEMIDYFKALFPNGGLYIHLDQAT

SEQ ID NO: 1696147 - protein, 17 aa, Staphylococcus aureus
HMDYQRPRLKVLSDYYE

SEQ ID NO: 1696148 - protein, 18 aa, Staphylococcus aureus
HMDYQRPRLKVLSDYYEG

SEQ ID NO: 1696149 - protein, 19 aa, Staphylococcus aureus
HMHRKTSLGYYLDKQFEGH

SEQ ID NO: 1696150 - protein, 20 aa, Staphylococcus aureus
HMHRKTSLGYYLDKQFEGRG

SEQ ID NO: 1696151 - protein, 19 aa, Staphylococcus aureus
HMHVLLCVENAYFRKKENY

SEQ ID NO: 1696152 - protein, 20 aa, Staphylococcus aureus
HMKEAIKYAVKFYNYPNEHI

SEQ ID NO: 1696153 - protein, 17 aa, Staphylococcus aureus
HMYHPEVWLIDGKSKKI

SEQ ID NO: 1696154 - protein, 33 aa, Staphylococcus aureus; identical to SEQ ID NO: 1592390

SEQ ID NO: 1696155 - protein, 22 aa, Staphylococcus aureus
HNAYRYIDGELWIYSAVLDGNK

SEQ ID NO: 1696156 - protein, 22 aa, Staphylococcus aureus
HNAYRYINGELWIYSAVLDSNK

SEQ ID NO: 1696157 - protein, 24 aa, Staphylococcus aureus
HNAYSEIPLAYQILGIGPVELRVR

SEQ ID NO: 1696158 - protein, 31 aa, Staphylococcus aureus
HNDDLPYAELALGAGMAFLIRRFTKKDQQTE

SEQ ID NO: 1696159 - protein, 18 aa, Staphylococcus aureus
HNERLYNFLLPKDKIVDN

SEQ ID NO: 1696160 - protein, 32 aa, Staphylococcus aureus
HNHLDIPIDLLPYLFFQFAKDGKRLYSDNGVD

SEQ ID NO: 1696161 - protein, 17 aa, Staphylococcus aureus
HNIYYGRDIPIIGSSGV

SEQ ID NO: 1696162 - protein, 17 aa, Staphylococcus aureus
HNIYYGRDLPIIGSSGV

SEQ ID NO: 1696163 - protein, 28 aa, Staphylococcus aureus
HNKEKSWQIFYFIKEFIQSLDLLEEFNF

SEQ ID NO: 1696164 - protein, 26 aa, Staphylococcus aureus
HNNPFHMSPYFGYAARLLATSGIDYT

SEQ ID NO: 1696165 - protein, 23 aa, Staphylococcus aureus
HNNTFYRVNIPTISVLNPVGSGD

SEQ ID NO: 1696166 - protein, 17 aa, Staphylococcus aureus
HNNYIKRLPVSTYRAQN

SEQ ID NO: 1696167 - protein, 30 aa, Staphylococcus aureus
HNVTIEPSPIWMQARLIKAGIRPINNVVDI

SEQ ID NO: 1696168 - protein, 17 aa, Staphylococcus aureus
HNYAKYVTRFIVGYLTR

SEQ ID NO: 1696169 - protein, 21 aa, Staphylococcus aureus
HNYLPLPIVISEAEGVWVKDP

SEQ ID NO: 1696170 - protein, 24 aa, Staphylococcus aureus
HPEEELFFVVSVDTPVITGKAVST

SEQ ID NO: 1696171 - protein, 28 aa, Staphylococcus aureus
HPEGIYLSGALLMFAGSKSYYLYGASSN

SEQ ID NO: 1696172 - protein, 17 aa, Staphylococcus aureus
HPEWLYCAKANLVLKPA

SEQ ID NO: 1696173 - protein, 20 aa, Staphylococcus aureus
HPFHIYSMRQAIEEGFILNV

SEQ ID NO: 1696174 - protein, 21 aa, Staphylococcus aureus
HPKMMLKITLYAYTQSVFSGR

SEQ ID NO: 1696175 - protein, 18 aa, Staphylococcus aureus
HPNVVRIVVLSGGYSREK

SEQ ID NO: 1696176 - protein, 28 aa, Staphylococcus aureus
HPTGSSLKPFLAYGPAIENMKWATNHAI

SEQ ID NO: 1696177 - protein, 20 aa, Staphylococcus aureus
HPTHFFSSSPIFYSNNNPFN

SEQ ID NO: 1696178 - protein, 21 aa, Staphylococcus aureus
HPVCHYIYDLDELKSHLQHIT

SEQ ID NO: 1696179 - protein, 17 aa, Staphylococcus aureus
HPVTYWVASMSEAQQTQ

SEQ ID NO: 1696180 - protein, 21 aa, Staphylococcus aureus
HQGRDYFVKFNCPEFTSLCPI

SEQ ID NO: 1696181 - protein, 17 aa, Staphylococcus aureus
HQILQHSFTIRQYEMQK

SEQ ID NO: 1696182 - protein, 20 aa, Staphylococcus aureus
HQNHFYLTNIIDSLIYLIMI

SEQ ID NO: 1696183 - protein, 22 aa, Staphylococcus aureus
HQPAKLFLLNPDVVEMLIENKS

SEQ ID NO: 1696184 - protein, 21 aa, Staphylococcus aureus
HQQIELIKRLVSYVPKIELHM

SEQ ID NO: 1696185 - protein, 20 aa, Staphylococcus aureus
HQQIELVKRLVPYVPKVELH

SEQ ID NO: 1696186 - protein, 17 aa, Staphylococcus aureus
HRDCLFIELIDDKGNRY

SEQ ID NO: 1696187 - protein, 20 aa, Staphylococcus aureus
HRFVRYADDFVIFVKTKRAG

SEQ ID NO: 1696188 - protein, 21 aa, Staphylococcus aureus
HRKRLISYGGLLKEIHKKLNL

SEQ ID NO: 1696189 - protein, 20 aa, Staphylococcus aureus
HRKRPATAKPVLLGITKASL

SEQ ID NO: 1696190 - protein, 20 aa, Staphylococcus aureus
HRLDLRADIVRKYPNVKLTI

SEQ ID NO: 1696191 - protein, 19 aa, Staphylococcus aureus
HRMDNMTYFFLNTSSKSHK

SEQ ID NO: 1696192 - protein, 19 aa, Staphylococcus aureus
HRNKIQSHIYDIFIIAVLF

SEQ ID NO: 1696193 - protein, 19 aa, Staphylococcus aureus
HRQYWLSKFKDEVPILSLP

SEQ ID NO: 1696194 - protein, 25 aa, Staphylococcus aureus
HRSNLVMMGVLPLEFTKGESADSLG

SEQ ID NO: 1696195 - protein, 17 aa, Staphylococcus aureus
HRTIIRLSPPLVIDKEE

SEQ ID NO: 1696196 - protein, 22 aa, Staphylococcus aureus
HSDRQQVIFIDYLQLMDTDAKV

SEQ ID NO: 1696197 - protein, 20 aa, Staphylococcus aureus
HSHLSILQNLATILGDNQTV

SEQ ID NO: 1696198 - protein, 21 aa, Staphylococcus aureus
HSIDQLYQHLGERYYSSNMAS

SEQ ID NO: 1696199 - protein, 20 aa, Staphylococcus aureus
HSLFFKLAILYFTESGENVR

SEQ ID NO: 1696200 - protein, 17 aa, Staphylococcus aureus
HSLLMKVIEEDFSSYIN

SEQ ID NO: 1696201 - protein, 18 aa, Staphylococcus aureus
HSMFSSLPSHIFKSITFD

SEQ ID NO: 1696202 - protein, 26 aa, Staphylococcus aureus
HSRQYAKRQMTWFKNKMSVHWLDKEN

SEQ ID NO: 1696203 - protein, 17 aa, Staphylococcus aureus
HSYWLDKNLTSNDVLIL

SEQ ID NO: 1696204 - protein, 25 aa, Staphylococcus aureus
HTCAALYAILYKLNKLKEKPSLSYG

SEQ ID NO: 1696205 - protein, 22 aa, Staphylococcus aureus
HTDVFNVLLQILDEGRLTDSKG

SEQ ID NO: 1696206 - protein, 41 aa, Staphylococcus aureus
HTEKLALVYARPLFYFGNIMKPLIWLMNGSARVIIRMFGVN

SEQ ID NO: 1696207 - protein, 21 aa, Staphylococcus aureus
HTERPVIFPLSNPTKLSEATA

SEQ ID NO: 1696208 - protein, 17 aa, Staphylococcus aureus
HTFFEMLGNFSIGDYFK

SEQ ID NO: 1696209 - protein, 25 aa, Staphylococcus aureus
HTIKPESMILTPQHAPEWTKDRQRL

SEQ ID NO: 1696210 - protein, 26 aa, Staphylococcus aureus
HTKRDKLLIMLMYEGGLRIGEALSLR

SEQ ID NO: 1696211 - protein, 25 aa, Staphylococcus aureus
HTQFIVDEILAIKLPAEATKVSPKV

SEQ ID NO: 1696212 - protein, 30 aa, Staphylococcus aureus
HTQKRLAMVLVQFPPWFDCNAQNIKYILYV

SEQ ID NO: 1696213 - protein, 20 aa, Staphylococcus aureus
HTSFQLHYLAVHQDVLLTRY

SEQ ID NO: 1696214 - protein, 24 aa, Staphylococcus aureus
HTTQKLIIPIYGKAESLNVAIAGS

SEQ ID NO: 1696215 - protein, 17 aa, Staphylococcus aureus
HTTTLMLFVQRCKDMQD

SEQ ID NO: 1696216 - protein, 19 aa, Staphylococcus aureus
HTYKLLQKNVIPHTKIGGK

SEQ ID NO: 1696217 - protein, 27 aa, Staphylococcus aureus
HVGIPDTGFYRFWTQGIFARWTDNPNI

SEQ ID NO: 1696218 - protein, 28 aa, Staphylococcus aureus
HVHYYDNPMYFIRLNFPNSLSVGDKAKG

SEQ ID NO: 1696219 - protein, 30 aa, Staphylococcus aureus
HVLYGKLGEPQLLYIDLHLIHEVTSPQAFE

SEQ ID NO: 1696220 - protein, 29 aa, Staphylococcus aureus
HVQTVGKGGLLITLAKLSAHYGLGLKSLI

SEQ ID NO: 1696221 - protein, 20 aa, Staphylococcus aureus
HVRNIIFNGPLRIMAENRLH

SEQ ID NO: 1696222 - protein, 19 aa, Staphylococcus aureus
HVVFDFKVPLATSASIWET

SEQ ID NO: 1696223 - protein, 20 aa, Staphylococcus aureus
HWDRYQEDMFPPMQLDETES

SEQ ID NO: 1696224 - protein, 17 aa, Staphylococcus aureus
HWYQLNHAILDDIIQNL

SEQ ID NO: 1696225 - protein, 17 aa, Staphylococcus aureus
HYARLRPKKLKANIEYT

SEQ ID NO: 1696226 - protein, 17 aa, Staphylococcus aureus
HYDLPVFITNYPTKIKP

SEQ ID NO: 1696227 - protein, 18 aa, Staphylococcus aureus
HYFIFTKNRRDDVTKLPF

SEQ ID NO: 1696228 - protein, 31 aa, Staphylococcus aureus
HYHTKIFRTFTPDIFVIDKLPTAYNPNAYDE

SEQ ID NO: 1696229 - protein, 17 aa, Staphylococcus aureus
HYLMNKYNYNYREAHGI

SEQ ID NO: 1696230 - protein, 21 aa, Staphylococcus aureus
HYNIHALRHSYASYLANNGVD

SEQ ID NO: 1696231 - protein, 22 aa, Staphylococcus aureus
HYNNLGIIWYDAHGDLNIPEES

SEQ ID NO: 1696232 - protein, 26 aa, Staphylococcus aureus
HYRHVDLPASVPLAWGAHSAASIVAE

SEQ ID NO: 1696233 - protein, 25 aa, Staphylococcus aureus
HYYDNPMYFIRLNFPNNLSVGNKAK

SEQ ID NO: 1696234 - protein, 19 aa, Staphylococcus aureus
HYYMYKKFGIWPEKEYAIN

SEQ ID NO: 1696235 - protein, 17 aa, Staphylococcus aureus
IAARYLNHNSRLFKLYK

SEQ ID NO: 1696236 - protein, 18 aa, Staphylococcus aureus
IADNFNVTLPEFGKSYLK

SEQ ID NO: 1696237 - protein, 26 aa, Staphylococcus aureus
IAFATARFYIRVLTRFFQNISKNKET

SEQ ID NO: 1696238 - protein, 22 aa, Staphylococcus aureus
IAFENLTNIKVNLKGSGFVSHQ

SEQ ID NO: 1696239 - protein, 18 aa, Staphylococcus aureus
IAGFDFTFGKFGKGNMTV

SEQ ID NO: 1696240 - protein, 17 aa, Staphylococcus aureus
IAGLVAAGLHPNPVEYA

SEQ ID NO: 1696241 - protein, 19 aa, Staphylococcus aureus
IAIDVAFTSLLTRALDTTH

SEQ ID NO: 1696242 - protein, 18 aa, Staphylococcus aureus
IAKKIGYPVIIKATAGGG

SEQ ID NO: 1696243 - protein, 17 aa, Staphylococcus aureus
IAKYCDVFYIGGTKIGA

SEQ ID NO: 1696244 - protein, 18 aa, Staphylococcus aureus
IAMESWGVWRVIESQLHL

SEQ ID NO: 1696245 - protein, 18 aa, Staphylococcus aureus
IAMIEAVRITLKNALAMV

SEQ ID NO: 1696246 - protein, 18 aa, Staphylococcus aureus
IANPIPYEHALSKAYIEA

SEQ ID NO: 1696247 - protein, 18 aa, Staphylococcus aureus
IANQHYLIHASNFDDACH

SEQ ID NO: 1696248 - protein, 25 aa, Staphylococcus aureus
IAQEDYYRLILLSRHQNDIPMWLRE

SEQ ID NO: 1696249 - protein, 27 aa, Staphylococcus aureus
IAQYHPTFIIMISTMYYSTLRASNFNP

SEQ ID NO: 1696250 - protein, 19 aa, Staphylococcus aureus
IARDLFLKFNVPSPKYKAI

SEQ ID NO: 1696251 - protein, 26 aa, Staphylococcus aureus
IARKHNLHATFMPKPLFGVNGSGMHF

SEQ ID NO: 1696252 - protein, 26 aa, Staphylococcus aureus
IATQILTVPRIQRVIQILIQRVTQDQ

SEQ ID NO: 1696253 - protein, 26 aa, Staphylococcus aureus
IAVVMGPGPIGLLVAQVLKSKGATVV

SEQ ID NO: 1696254 - protein, 27 aa, Staphylococcus aureus
IAYFKVHHPLYYYASYFTIRASDFDLI

SEQ ID NO: 1696255 - protein, 17 aa, Staphylococcus aureus
ICCDLKFIEGRVVSWII

SEQ ID NO: 1696256 - protein, 24 aa, Staphylococcus aureus
ICEDDVIQWIPLKSLYHPDRDVLI

SEQ ID NO: 1696257 - protein, 17 aa, Staphylococcus aureus
ICHVLSPNKMPVKSLLE

SEQ ID NO: 1696258 - protein, 36 aa, Staphylococcus aureus
IDACYQLNVLQLIRLCRYFVEVLRQSANGRIIVISS

SEQ ID NO: 1696259 - protein, 17 aa, Staphylococcus aureus
IDAEELFNLVYNANPKT

SEQ ID NO: 1696260 - protein, 17 aa, Staphylococcus aureus
IDALPHLNNAQKADVKS

SEQ ID NO: 1696261 - protein, 25 aa, Staphylococcus aureus
IDALYQFLFEFIFDIEERYIRMYVQ

SEQ ID NO: 1696262 - protein, 19 aa, Staphylococcus aureus
IDAQFEPLRKMEAPMFKKI

SEQ ID NO: 1696263 - protein, 30 aa, Staphylococcus aureus
IDAVQPFVKQKLIFLVGMAGERDLTKTPEM

SEQ ID NO: 1696264 - protein, 28 aa, Staphylococcus aureus
IDDELNGYFLFPRELLVEKGILASSKYQ

SEQ ID NO: 1696265 - protein, 26 aa, Staphylococcus aureus
IDDELNGYFLFPRELLVEKGILTTFE

SEQ ID NO: 1696266 - protein, 18 aa, Staphylococcus aureus
IDDNDYLKIVEKITKKER

SEQ ID NO: 1696267 - protein, 19 aa, Staphylococcus aureus
IDEIDRNPILTDKEKQALK

SEQ ID NO: 1696268 - protein, 22 aa, Staphylococcus aureus
IDEIIFLKDESYFKYVLVEEKQ

SEQ ID NO: 1696269 - protein, 22 aa, Staphylococcus aureus
IDEIIFLKDESYFKYVLVEGKQ

SEQ ID NO: 1696270 - protein, 27 aa, Staphylococcus aureus
IDFDAFSTPFILLSGNPMYHVDLDEIN

SEQ ID NO: 1696271 - protein, 28 aa, Staphylococcus aureus
IDFSNPNLLFPLLDEEFHLPLVVATTGE

SEQ ID NO: 1696272 - protein, 32 aa, Staphylococcus aureus
IDGFHNFSTIEYLIIKELIKYAKSVTIILTTD

SEQ ID NO: 1696273 - protein, 34 aa, Staphylococcus aureus
IDGFHNFSTIEYLIIKGLIKYAKSVTIILTTDGN

SEQ ID NO: 1696274 - protein, 26 aa, Staphylococcus aureus
IDGITSIFHVMNFLAVDKAPKADWED

SEQ ID NO: 1696275 - protein, 25 aa, Staphylococcus aureus
IDGITSIFHVMNFLAVDKSPKADWE

SEQ ID NO: 1696276 - protein, 26 aa, Staphylococcus aureus
IDGLIYHILIAIQRLNENFSFDIPIN

SEQ ID NO: 1696277 - protein, 18 aa, Staphylococcus aureus
IDGLTSLNGPQKAKLKEQ

SEQ ID NO: 1696278 - protein, 21 aa, Staphylococcus aureus
IDGYSDFLFLNRKDYPKTSDD

SEQ ID NO: 1696279 - protein, 28 aa, Staphylococcus aureus
IDKKDILPLRIILGSVNLYGILSTNHLL

SEQ ID NO: 1696280 - protein, 21 aa, Staphylococcus aureus
IDKLCSYLHISPSEFFEHNPI

SEQ ID NO: 1696281 - protein, 17 aa, Staphylococcus aureus
IDKLICSWLKQIDNVIP

SEQ ID NO: 1696282 - protein, 23 aa, Staphylococcus aureus
IDKLICSWLKQIDNVIPQLIMEM

SEQ ID NO: 1696283 - protein, 22 aa, Staphylococcus aureus
IDKLICSWLKQIDNVIPQLIMK

SEQ ID NO: 1696284 - protein, 22 aa, Staphylococcus aureus
IDKLICSWLKQIDNVIPQLITD

SEQ ID NO: 1696285 - protein, 22 aa, Staphylococcus aureus
IDKLICSWLKQIDNVIPQLITE

SEQ ID NO: 1696286 - protein, 22 aa, Staphylococcus aureus
IDKPDVILLDLGLPDKDGLCLI

SEQ ID NO: 1696287 - protein, 20 aa, Staphylococcus aureus
IDLINFNIKKLRLTNIKAFQ

SEQ ID NO: 1696288 - protein, 30 aa, Staphylococcus aureus
IDLKAYGLTPRLHLFMEDGSIFKNEPLIID

SEQ ID NO: 1696289 - protein, 18 aa, Staphylococcus aureus
IDLNDAMETLKHLVDNEI

SEQ ID NO: 1696290 - protein, 17 aa, Staphylococcus aureus
IDMTKYYLKVPISITNT

SEQ ID NO: 1696291 - protein, 23 aa, Staphylococcus aureus
IDNKVCYQVFYDEKGFPYISRNI

SEQ ID NO: 1696292 - protein, 21 aa, Staphylococcus aureus
IDNLLIEDIINMKLKAIVISP

SEQ ID NO: 1696293 - protein, 21 aa, Staphylococcus aureus
IDNTFLTPYLSTPLADGADIV

SEQ ID NO: 1696294 - protein, 36 aa, Staphylococcus aureus
IDNYDGHLLIQWYLKGIYKFKYAILEAVRKVFDYKS

SEQ ID NO: 1696295 - protein, 26 aa, Staphylococcus aureus
IDNYDGHLLIQWYSKGIYKFKYVILE

SEQ ID NO: 1696296 - protein, 19 aa, Staphylococcus aureus
IDQYLTNGKSRAIPIFVFL

SEQ ID NO: 1696297 - protein, 18 aa, Staphylococcus aureus
IDRILYAADYPYIEPEKL

SEQ ID NO: 1696298 - protein, 17 aa, Staphylococcus aureus
IDRSLFWVNPDCGLKTR

SEQ ID NO: 1696299 - protein, 32 aa, Staphylococcus aureus
IDSVFTAIKLRQRVWRRLAKDLKPENLHEIKQ

SEQ ID NO: 1696300 - protein, 25 aa, Staphylococcus aureus
IDTEGNIYFIYTVADLEVILNCGNK

SEQ ID NO: 1696301 - protein, 23 aa, Staphylococcus aureus
IDTKHFPIELFRKYSKNLYDTNH

SEQ ID NO: 1696302 - protein, 19 aa, Staphylococcus aureus
IDTLKYIDQYSSAGSFRRF

SEQ ID NO: 1696303 - protein, 39 aa, Staphylococcus aureus
IDYTYVRMAMYMDPLKPYLPELMKMHKLIYPAGDGRINY

SEQ ID NO: 1696304 - protein, 21 aa, Staphylococcus aureus
IEACTSLKIRFLNNLELIKGD

SEQ ID NO: 1696305 - protein, 17 aa, Staphylococcus aureus
IEAGKRVYRTFVQGKMI

SEQ ID NO: 1696306 - protein, 19 aa, Staphylococcus aureus
IEAKHTFDYYAGLSFRTLV

SEQ ID NO: 1696307 - protein, 17 aa, Staphylococcus aureus
IEAKSSALPLVILAAVA

SEQ ID NO: 1696308 - protein, 25 aa, Staphylococcus aureus
IEDARFRTIIKLYSYYTSLKEQSSL

SEQ ID NO: 1696309 - protein, 20 aa, Staphylococcus aureus
IEDKYLSERTKRLKLKQLLN

SEQ ID NO: 1696310 - protein, 25 aa, Staphylococcus aureus
IEDVYKKAQAFDRLLEDINNFTQSP

SEQ ID NO: 1696311 - protein, 23 aa, Staphylococcus aureus
IEENKYVFVLKHSETCPISANAY

SEQ ID NO: 1696312 - protein, 17 aa, Staphylococcus aureus
IEEPGLDRLIRATYELL

SEQ ID NO: 1696313 - protein, 23 aa, Staphylococcus aureus
IEERYLLFMLEQAGVDENITAHH

SEQ ID NO: 1696314 - protein, 26 aa, Staphylococcus aureus
IEEVKRPWLPPLPENVYQEDLVETDF

SEQ ID NO: 1696315 - protein, 18 aa, Staphylococcus aureus
IEFDNKYGKYQLQVFSAY

SEQ ID NO: 1696316 - protein, 25 aa, Staphylococcus aureus
IEHDLAILMIVGEGMNKVIGTANKI

SEQ ID NO: 1696317 - protein, 17 aa, Staphylococcus aureus
IEHLSSYYKFKQPTLLY

SEQ ID NO: 1696318 - protein, 17 aa, Staphylococcus aureus
IEIAVKKLIFEVKGKII

SEQ ID NO: 1696319 - protein, 26 aa, Staphylococcus aureus
IEIILRKNHFFTYYQVFESLPDKYNT

SEQ ID NO: 1696320 - protein, 21 aa, Staphylococcus aureus
IEIQPKFELLPKLDKQRKIEY

SEQ ID NO: 1696321 - protein, 24 aa, Staphylococcus aureus
IEIQPKFELLPKLDKQRKIEYIAD

SEQ ID NO: 1696322 - protein, 24 aa, Staphylococcus aureus
IEKDIVFYQLMFRMGKDSNIHEKL

SEQ ID NO: 1696323 - protein, 34 aa, Staphylococcus aureus
IEKHTNKPYLIYMLGFMPGFPYLGGLDEQLHTPR

SEQ ID NO: 1696324 - protein, 25 aa, Staphylococcus aureus
IEKKLSRYPQLYSRIGFAHEFDNLS

SEQ ID NO: 1696325 - protein, 17 aa, Staphylococcus aureus
IEKLVIKIIETKAGLQN

SEQ ID NO: 1696326 - protein, 17 aa, Staphylococcus aureus
IEKPDLLLLDEPTNHLD

SEQ ID NO: 1696327 - protein, 26 aa, Staphylococcus aureus
IEKYGAFVGLFPGKDALLHISQISKN

SEQ ID NO: 1696328 - protein, 23 aa, Staphylococcus aureus
IELHMYGFGFGSKKLNDMDTIIW

SEQ ID NO: 1696329 - protein, 17 aa, Staphylococcus aureus
IELIKSDITGYKIHKQT

SEQ ID NO: 1696330 - protein, 30 aa, Staphylococcus aureus
IENCNFLVFFGYNFNSSFLKYGELALLNSL

SEQ ID NO: 1696331 - protein, 25 aa, Staphylococcus aureus
IENDLLTMYDYFQKAINYKKTKQVN

SEQ ID NO: 1696332 - protein, 19 aa, Staphylococcus aureus
IENGIMGIPSFLVYKNGEL

SEQ ID NO: 1696333 - protein, 18 aa, Staphylococcus aureus
IENKIPVINIPVGYVANL

SEQ ID NO: 1696334 - protein, 18 aa, Staphylococcus aureus
IENLTKQLDQQNSNVNTL

SEQ ID NO: 1696335 - protein, 24 aa, Staphylococcus aureus
IENQKYIFDYSACKYPIGVVEDEI

SEQ ID NO: 1696336 - protein, 24 aa, Staphylococcus aureus
IENQKYMFDYSACKYPIGAVEDEI

SEQ ID NO: 1696337 - protein, 26 aa, Staphylococcus aureus
IEPEQLLKPLFQHFKEKYPEVISKID

SEQ ID NO: 1696338 - protein, 25 aa, Staphylococcus aureus
IEQEDKIYILFHKPTQVITSVSDDR

SEQ ID NO: 1696339 - protein, 19 aa, Staphylococcus aureus
IEQLNALNNAQQDGFKGRI

SEQ ID NO: 1696340 - protein, 21 aa, Staphylococcus aureus
IEQPIEFIRLMPTLQKHRDEV

SEQ ID NO: 1696341 - protein, 30 aa, Staphylococcus aureus
IEQPTLKFELFYFDIFTYGTSFVTLQVPRE

SEQ ID NO: 1696342 - protein, 26 aa, Staphylococcus aureus
IEQYKRTMFWLEFEIRQYTHSNITLD

SEQ ID NO: 1696343 - protein, 20 aa, Staphylococcus aureus
IERGISDLDLKFAKQAKYTV

SEQ ID NO: 1696344 - protein, 24 aa, Staphylococcus aureus
IESKDEDVPLLLAKKKNQKDNQSK

SEQ ID NO: 1696345 - protein, 21 aa, Staphylococcus aureus
IESQLFLISITTFFVNVDPIC

SEQ ID NO: 1696346 - protein, 28 aa, Staphylococcus aureus
IETLPVKKIPVVSKISAGLPIYCEENLV

SEQ ID NO: 1696347 - protein, 32 aa, Staphylococcus aureus
IETYQLNLISFNVLYPVLRPYLTSNAHIVGIS

SEQ ID NO: 1696348 - protein, 17 aa, Staphylococcus aureus
IEVGKTMNPIVLTTTDN

SEQ ID NO: 1696349 - protein, 18 aa, Staphylococcus aureus
IEVQALVTPTTFNNPRRM

SEQ ID NO: 1696350 - protein, 18 aa, Staphylococcus aureus
IEWLVVQRGFEIPSFNFV

SEQ ID NO: 1696351 - protein, 25 aa, Staphylococcus aureus
IEYVENVYIMLNKPKGYISGTEDHH

SEQ ID NO: 1696352 - protein, 21 aa, Staphylococcus aureus
IFDAHLLVLDDPELIQPIQDK

SEQ ID NO: 1696353 - protein, 27 aa, Staphylococcus aureus
IFDDLWMNLYYLFKNLRNLFKEEGLEP

SEQ ID NO: 1696354 - protein, 27 aa, Staphylococcus aureus
IFGGEQIYNLFFPYVEKMYITKIHHEF

SEQ ID NO: 1696355 - protein, 27 aa, Staphylococcus aureus
IFGNLKDAIVLFDRSQYQAGWTDYMHF

SEQ ID NO: 1696356 - protein, 17 aa, Staphylococcus aureus
IFGSGAYRISSREMWRD

SEQ ID NO: 1696357 - protein, 20 aa, Staphylococcus aureus
IFKNSWFKVYRMFDELRETF

SEQ ID NO: 1696358 - protein, 20 aa, Staphylococcus aureus
IFNVLRLARRYILTNKSGAN

SEQ ID NO: 1696359 - protein, 17 aa, Staphylococcus aureus
IFNYRCWTQGIFARWTD

SEQ ID NO: 1696360 - protein, 18 aa, Staphylococcus aureus
IFQEYNLLHTLTVKENIM

SEQ ID NO: 1696361 - protein, 19 aa, Staphylococcus aureus
IFQKDKILNKLKSLGLNSN

SEQ ID NO: 1696362 - protein, 18 aa, Staphylococcus aureus
IFRFHAHAFRHTVGTRMI

SEQ ID NO: 1696363 - protein, 27 aa, Staphylococcus aureus
IFRGTEIVYQFLKYLFTHTYEHKNEEK

SEQ ID NO: 1696364 - protein, 21 aa, Staphylococcus aureus
IFRHKYRTIKLNWICKAPKYT

SEQ ID NO: 1696365 - protein, 30 aa, Staphylococcus aureus
IFSFRKNETLYTIRLLPVGGYVRMAGDGLE

SEQ ID NO: 1696366 - protein, 29 aa, Staphylococcus aureus
IFSIETRRYYLMLMLFSKENAMSLNHFSI

SEQ ID NO: 1696367 - protein, 26 aa, Staphylococcus aureus
IFSQDKMHRYLLKKTWDIDKEVLTII

SEQ ID NO: 1696368 - protein, 17 aa, Staphylococcus aureus
IFTIMEDVLKLPRAVFK

SEQ ID NO: 1696369 - protein, 17 aa, Staphylococcus aureus
IFTVLHAGGKFGQSGYK

SEQ ID NO: 1696370 - protein, 18 aa, Staphylococcus aureus
IFVDVPGYGYAKVSKTQR

SEQ ID NO: 1696371 - protein, 25 aa, Staphylococcus aureus
IGACDDVILKFFNLTTKQYEEKHIT

SEQ ID NO: 1696372 - protein, 22 aa, Staphylococcus aureus
IGATHLADWAYQANILGLKDKT

SEQ ID NO: 1696373 - protein, 18 aa, Staphylococcus aureus
IGAVVPQVTHKKAARDAI

SEQ ID NO: 1696374 - protein, 20 aa, Staphylococcus aureus
IGCDLLVIRHPFNNYYEKLA

SEQ ID NO: 1696375 - protein, 21 aa, Staphylococcus aureus
IGCDLLVIRHPFNNYYEKLAN

SEQ ID NO: 1696376 - protein, 20 aa, Staphylococcus aureus
IGCDLLVIRHPYNNYYEKLA

SEQ ID NO: 1696377 - protein, 20 aa, Staphylococcus aureus
IGDLISAHFYTLLAEINDLS

SEQ ID NO: 1696378 - protein, 23 aa, Staphylococcus aureus
IGDMFVVLIIMMQQIKGNIKLAL

SEQ ID NO: 1696379 - protein, 17 aa, Staphylococcus aureus
IGELLMCDIIDAFINAE

SEQ ID NO: 1696380 - protein, 25 aa, Staphylococcus aureus
IGEVDGEIIFKHGLSLDQVKQIINL

SEQ ID NO: 1696381 - protein, 18 aa, Staphylococcus aureus
IGFDLRNFWTLKLNSETM

SEQ ID NO: 1696382 - protein, 25 aa, Staphylococcus aureus
IGFKRYAYLNDRYGFKRDFKLYECD

SEQ ID NO: 1696383 - protein, 17 aa, Staphylococcus aureus
IGGAKFIRNEYFENNQL

SEQ ID NO: 1696384 - protein, 24 aa, Staphylococcus aureus
IGIHAFKLGFIINAVNRELPYHLA

SEQ ID NO: 1696385 - protein, 38 aa, Staphylococcus aureus
IGIILKKWTTIRFMNVVPDYFIYKIALVGKDDKKYGEG

SEQ ID NO: 1696386 - protein, 24 aa, Staphylococcus aureus
IGKRPMDRVLRPLKLMDANIEGIE

SEQ ID NO: 1696387 - protein, 17 aa, Staphylococcus aureus
IGLAEAIRYLERIGFDA

SEQ ID NO: 1696388 - protein, 22 aa, Staphylococcus aureus
IGLAEAIRYLERIGFDAIHNYE

SEQ ID NO: 1696389 - protein, 20 aa, Staphylococcus aureus
IGLPKEEALQKLKSLGLKDV

SEQ ID NO: 1696390 - protein, 22 aa, Staphylococcus aureus
IGMLLYNYVPQLQWSEWLETYG

SEQ ID NO: 1696391 - protein, 17 aa, Staphylococcus aureus
IGMVCDGYLMRIENLTP

SEQ ID NO: 1696392 - protein, 19 aa, Staphylococcus aureus
IGQCLGPCVYDVDLSKYAQ

SEQ ID NO: 1696393 - protein, 20 aa, Staphylococcus aureus
IGQCLGPCVYDVDLSKYAQM

SEQ ID NO: 1696394 - protein, 27 aa, Staphylococcus aureus
IGRGMTINRMYWRARRRESIFMTYILK

SEQ ID NO: 1696395 - protein, 23 aa, Staphylococcus aureus
IGRYLRYEFMPLKYKKRIVMNGE

SEQ ID NO: 1696396 - protein, 20 aa, Staphylococcus aureus
IGTAISTGNASWRGPNTEAG

SEQ ID NO: 1696397 - protein, 20 aa, Staphylococcus aureus
IGTYFKRTCNLCGHSQKFNK

SEQ ID NO: 1696398 - protein, 31 aa, Staphylococcus aureus
IGVLLNRRVPDPLVYAYCFMWNENCNPPLNS

SEQ ID NO: 1696399 - protein, 37 aa, Staphylococcus aureus
IGVNFYPMHINCRSDCALLPKSMWPQKPSKKRKTKYF

SEQ ID NO: 1696400 - protein, 23 aa, Staphylococcus aureus
IGYNMYLLYNNTINTNISIIGHR

SEQ ID NO: 1696401 - protein, 25 aa, Staphylococcus aureus
IHGANHYLIHQFVSPYYNRRNDVWV

SEQ ID NO: 1696402 - protein, 25 aa, Staphylococcus aureus
IHHRYPDIPFYLQVGNPYLSDSVDN

SEQ ID NO: 1696403 - protein, 24 aa, Staphylococcus aureus
IHIQQYDYLLKRYLLNIERENDIS

SEQ ID NO: 1696404 - protein, 25 aa, Staphylococcus aureus
IHITGTYTMPCARTLVPVKVPLDVT

SEQ ID NO: 1696405 - protein, 26 aa, Staphylococcus aureus
IHLMNIKEQFLVKLQERAIPFELNGS

SEQ ID NO: 1696406 - protein, 24 aa, Staphylococcus aureus
IHLMSRARRYPLPLVLEISNIESV

SEQ ID NO: 1696407 - protein, 19 aa, Staphylococcus aureus
IHMTLPSLTYYYNHKNDLA

SEQ ID NO: 1696408 - protein, 27 aa, Staphylococcus aureus
IHNNQMFDLFHLYIEQFDNIIEKFHEL

SEQ ID NO: 1696409 - protein, 27 aa, Staphylococcus aureus
IHPESYKVTYKLLDKLGFGGNDLGSDA

SEQ ID NO: 1696410 - protein, 19 aa, Staphylococcus aureus
IHPEWLYCAKANLVLKPAY

SEQ ID NO: 1696411 - protein, 17 aa, Staphylococcus aureus
IHPLGHSLGAFLAQYNL

SEQ ID NO: 1696412 - protein, 27 aa, Staphylococcus aureus
IHQYKFLKDYYLCELLAHLIEIPQTTY

SEQ ID NO: 1696413 - protein, 18 aa, Staphylococcus aureus
IHYIDRLDRFSFPGDVIK

SEQ ID NO: 1696414 - protein, 24 aa, Staphylococcus aureus
IIAGDWFYGMKIPPQRQLAIQYNV

SEQ ID NO: 1696415 - protein, 18 aa, Staphylococcus aureus
IIAGLNNPTINKGNVTSA

SEQ ID NO: 1696416 - protein, 19 aa, Staphylococcus aureus
IIAIPDWFWSYQMAMTLNE

SEQ ID NO: 1696417 - protein, 17 aa, Staphylococcus aureus
IIALISIVDACTPTLSN

SEQ ID NO: 1696418 - protein, 20 aa, Staphylococcus aureus
IIDDLVIYKLADDNYLLVVN

SEQ ID NO: 1696419 - protein, 24 aa, Staphylococcus aureus
IIDKAKLIYLTYPNNPTGSTATKE

SEQ ID NO: 1696420 - protein, 24 aa, Staphylococcus aureus
IIDQFKLMFKDGEIIDFSSGKGEA

SEQ ID NO: 1696421 - protein, 17 aa, Staphylococcus aureus
IIDTLLKEAFIRIDHEY

SEQ ID NO: 1696422 - protein, 19 aa, Staphylococcus aureus
IIDYSLYIKKGLVEPFIVF

SEQ ID NO: 1696423 - protein, 21 aa, Staphylococcus aureus
IIEAKHTLDYYAGLSFRTLVP

SEQ ID NO: 1696424 - protein, 24 aa, Staphylococcus aureus
IIEATLDWTFYNDIPLSYKTSNLL

SEQ ID NO: 1696425 - protein, 21 aa, Staphylococcus aureus
IIEDKYLSERTKRLKLKQLLN

SEQ ID NO: 1696426 - protein, 22 aa, Staphylococcus aureus
IIEFITLNNYVLIKTSPGFAQS

SEQ ID NO: 1696427 - protein, 24 aa, Staphylococcus aureus
IIEINCHGGILTINRVLELTMTYG

SEQ ID NO: 1696428 - protein, 27 aa, Staphylococcus aureus
IIEINCHGGILTINRVLELTMTYGARL

SEQ ID NO: 1696429 - protein, 25 aa, Staphylococcus aureus
IIEKDIAFYQLMFRMGKDSNIHEKL

SEQ ID NO: 1696430 - protein, 18 aa, Staphylococcus aureus
IIEKYGMDITFVPANLKG

SEQ ID NO: 1696431 - protein, 20 aa, Staphylococcus aureus
IIELLKQLQLDFGITYLFIT

SEQ ID NO: 1696432 - protein, 17 aa, Staphylococcus aureus
IIELTNHYGAHNYLPLP

SEQ ID NO: 1696433 - protein, 19 aa, Staphylococcus aureus
IIEMLLDYIEQLKAFIMDL

SEQ ID NO: 1696434 - protein, 20 aa, Staphylococcus aureus
IIETVLLNHDEIVKASELTK

SEQ ID NO: 1696435 - protein, 23 aa, Staphylococcus aureus
IIFDLLVEYDGELPFWDKSSPEA

SEQ ID NO: 1696436 - protein, 25 aa, Staphylococcus aureus
IIFSTPLYWYSMSASLKLFIDRWTE

SEQ ID NO: 1696437 - protein, 23 aa, Staphylococcus aureus
IIHLKNIHFVGLAFNFMCFKSDA

SEQ ID NO: 1696438 - protein, 17 aa, Staphylococcus aureus
IIIGFANNYFPELQVLA

SEQ ID NO: 1696439 - protein, 18 aa, Staphylococcus aureus
IIINFYNEKTIKDVIEDI

SEQ ID NO: 1696440 - protein, 24 aa, Staphylococcus aureus
IIKDSIADIFLQQILTRPAEHDVV

SEQ ID NO: 1696441 - protein, 24 aa, Staphylococcus aureus
IIKGKKVILFAPTFRGSGHGTAHY

SEQ ID NO: 1696442 - protein, 25 aa, Staphylococcus aureus
IIKGKKVILFAPTFRGSGHGTAYYP

SEQ ID NO: 1696443 - protein, 19 aa, Staphylococcus aureus
IIKLVKENDVKKFKYKNFE

SEQ ID NO: 1696444 - protein, 18 aa, Staphylococcus aureus
IIKNYDSFLPQKLDIVVF

SEQ ID NO: 1696445 - protein, 21 aa, Staphylococcus aureus
IILIHACWLANIEIAMINTRL

SEQ ID NO: 1696446 - protein, 18 aa, Staphylococcus aureus
IILLEYDGVVHIGYDNNF

SEQ ID NO: 1696447 - protein, 25 aa, Staphylococcus aureus
IILQKYVHLLSEYGVWHPRAWEFAP

SEQ ID NO: 1696448 - protein, 18 aa, Staphylococcus aureus
IINGNAQHPVITPSDVNN

SEQ ID NO: 1696449 - protein, 27 aa, Staphylococcus aureus
IINLIELYNVKVAVLKPFRLGGIDKVQ

SEQ ID NO: 1696450 - protein, 28 aa, Staphylococcus aureus
IINLIELYNVKVVVLKPFRLGGIDKVQT

SEQ ID NO: 1696451 - protein, 27 aa, Staphylococcus aureus
IINLIELYNVKVVVLKPLRLGGMDKVQ

SEQ ID NO: 1696452 - protein, 18 aa, Staphylococcus aureus
IINNYLLPSYTTVSIQKL

SEQ ID NO: 1696453 - protein, 19 aa, Staphylococcus aureus
IINRFRKRFDTKMTELGFT

SEQ ID NO: 1696454 - protein, 18 aa, Staphylococcus aureus
IIPVPKLIREMLKNMYNE

SEQ ID NO: 1696455 - protein, 21 aa, Staphylococcus aureus
IIREGLKQIIPWGDYHFNTIY

SEQ ID NO: 1696456 - protein, 18 aa, Staphylococcus aureus
IIRIFPNQTSANRLIGAV

SEQ ID NO: 1696457 - protein, 21 aa, Staphylococcus aureus
IIRYAKYLNELSDETQFIVIT

SEQ ID NO: 1696458 - protein, 18 aa, Staphylococcus aureus
IISGLNNPTINKGNVTSA

SEQ ID NO: 1696459 - protein, 20 aa, Staphylococcus aureus
IISHFLPLEKGPETFDKLVN

SEQ ID NO: 1696460 - protein, 28 aa, Staphylococcus aureus
IIVFEIQAAFYQPVKFKGTAYIRVGSST

SEQ ID NO: 1696461 - protein, 17 aa, Staphylococcus aureus
IIVFHKLTKEELKEIVT

SEQ ID NO: 1696462 - protein, 34 aa, Staphylococcus aureus
IIWNIATFYYSRMMKIMNLAILKIKIGGVNMLNI

SEQ ID NO: 1696463 - protein, 35 aa, Staphylococcus aureus
IIWNIATFYYSRMMKIMNLAILKIKIGGVNMLNIQ

SEQ ID NO: 1696464 - protein, 20 aa, Staphylococcus aureus
IKAGAMSLVPLLKSNTPFAD

SEQ ID NO: 1696465 - protein, 26 aa, Staphylococcus aureus
IKAIYKRDYLCILGETVKEKLTHELQ

SEQ ID NO: 1696466 - protein, 27 aa, Staphylococcus aureus
IKAIYKRDYLCILGQTVHDKLGHEMQT

SEQ ID NO: 1696467 - protein, 27 aa, Staphylococcus aureus
IKAIYKRDYLCILGQTVHDKLGHEVQT

SEQ ID NO: 1696468 - protein, 26 aa, Staphylococcus aureus
IKAKASLSKIPLVKYSTMQYFHKELN

SEQ ID NO: 1696469 - protein, 25 aa, Staphylococcus aureus
IKAKIFRYQYRDANLTWICKAPKYT

SEQ ID NO: 1696470 - protein, 24 aa, Staphylococcus aureus
IKAKIFRYQYRDVNLTWICKAPKY

SEQ ID NO: 1696471 - protein, 31 aa, Staphylococcus aureus
IKDGTMILKPAFRDYLLKLVEAHDIEYQYYM

SEQ ID NO: 1696472 - protein, 24 aa, Staphylococcus aureus
IKDITPIMYQQFLNWMKSENYSRS

SEQ ID NO: 1696473 - protein, 24 aa, Staphylococcus aureus
IKDKTKLIYLTYPNNPTGSTATKE

SEQ ID NO: 1696474 - protein, 38 aa, Staphylococcus aureus
IKDLTPKKLKFKSQNWYWFAYFDGPLKLPKNPRGSVKF

SEQ ID NO: 1696475 - protein, 23 aa, Staphylococcus aureus
IKEAAMLAGYFSKAGNSGQIPVD

SEQ ID NO: 1696476 - protein, 27 aa, Staphylococcus aureus
IKEALTLNGYFIKWKVLNAKDYGDIPQ

SEQ ID NO: 1696477 - protein, 18 aa, Staphylococcus aureus
IKEFWNGDIPWIQSSDVK

SEQ ID NO: 1696478 - protein, 26 aa, Staphylococcus aureus
IKFERDYLFFKLAIHSGLKVSELLTI

SEQ ID NO: 1696479 - protein, 24 aa, Staphylococcus aureus
IKGKPMYKLYLYEYPDRLEHQKKI

SEQ ID NO: 1696480 - protein, 20 aa, Staphylococcus aureus
IKGKWSYLYRAIDAEGHTLD

SEQ ID NO: 1696481 - protein, 21 aa, Staphylococcus aureus
IKGYTRRDSAYWRDIAFGVSE

SEQ ID NO: 1696482 - protein, 19 aa, Staphylococcus aureus
IKHYLLMLDEKMKNLDDYM

SEQ ID NO: 1696483 - protein, 19 aa, Staphylococcus aureus
IKIIACYGGVSGGWFGTTH

SEQ ID NO: 1696484 - protein, 20 aa, Staphylococcus aureus
IKIQFDYSNLFNYLIKFLED

SEQ ID NO: 1696485 - protein, 32 aa, Staphylococcus aureus
IKIQFDYSNLFNYLIKFLEDCNNFKLLLVNYL

SEQ ID NO: 1696486 - protein, 24 aa, Staphylococcus aureus
IKKIHEPFVIYDGITNGALYHRLK

SEQ ID NO: 1696487 - protein, 18 aa, Staphylococcus aureus
IKKINLDPSFINWSDVLK

SEQ ID NO: 1696488 - protein, 21 aa, Staphylococcus aureus
IKKKAIVIGGGLLGLECARGL

SEQ ID NO: 1696489 - protein, 26 aa, Staphylococcus aureus
IKKNYNFDYIFIDVPPTINSDFTNNA

SEQ ID NO: 1696490 - protein, 20 aa, Staphylococcus aureus
IKLLNPLTLAYMGDAVLDQY

SEQ ID NO: 1696491 - protein, 28 aa, Staphylococcus aureus
IKLREDGKIYKFYLYINGILETSDNEIT

SEQ ID NO: 1696492 - protein, 17 aa, Staphylococcus aureus
IKNFRNKFGKFLSQSFL

SEQ ID NO: 1696493 - protein, 20 aa, Staphylococcus aureus
IKNMMFSIKITFIRRYFMIS

SEQ ID NO: 1696494 - protein, 27 aa, Staphylococcus aureus
IKQKPTVRWLFLTITVKNVYDGEELNK

SEQ ID NO: 1696495 - protein, 27 aa, Staphylococcus aureus
IKRETEFDILFFSAIGVSDGDFIKSSS

SEQ ID NO: 1696496 - protein, 18 aa, Staphylococcus aureus
IKRLACLPSHIYRLKGFM

SEQ ID NO: 1696497 - protein, 19 aa, Staphylococcus aureus
IKSFYKTVFNNLTRYKAIV

SEQ ID NO: 1696498 - protein, 18 aa, Staphylococcus aureus
IKSIKPIARLGYYDYTVV

SEQ ID NO: 1696499 - protein, 25 aa, Staphylococcus aureus
IKSNKNPKLLFKGAGNIKGSSVGYK

SEQ ID NO: 1696500 - protein, 27 aa, Staphylococcus aureus
IKSSYNLKCLLLKLTYRYLDNQPINDA

SEQ ID NO: 1696501 - protein, 27 aa, Staphylococcus aureus
IKSSYNLKCLLLKLTYRYLDNQPLNDA

SEQ ID NO: 1696502 - protein, 27 aa, Staphylococcus aureus
IKTKNYAKDVDILFILGGDGTVNELIN

SEQ ID NO: 1696503 - protein, 21 aa, Staphylococcus aureus
IKVQPFCYDLVDQKLKPNQYA

SEQ ID NO: 1696504 - protein, 22 aa, Staphylococcus aureus
IKVQPFCYDLVDQKLKPNQYAE

SEQ ID NO: 1696505 - protein, 18 aa, Staphylococcus aureus
ILAIPVGNAGNITAYWKG

SEQ ID NO: 1696506 - protein, 21 aa, Staphylococcus aureus
ILALFCRIFKYKFGMNNKVVI

SEQ ID NO: 1696507 - protein, 22 aa, Staphylococcus aureus
ILALFCRIFKYKFGMNNKVVIK

SEQ ID NO: 1696508 - protein, 20 aa, Staphylococcus aureus
ILALFCRIFKYKFGMVNKLI

SEQ ID NO: 1696509 - protein, 22 aa, Staphylococcus aureus
ILALFCRIFKYKFGMVNKVEIK

SEQ ID NO: 1696510 - protein, 24 aa, Staphylococcus aureus
ILALFCRIFKYKFGMVNKVVIKLS

SEQ ID NO: 1696511 - protein, 21 aa, Staphylococcus aureus
ILALFCRIFKYKFVMNNKMVF

SEQ ID NO: 1696512 - protein, 17 aa, Staphylococcus aureus
ILAYALDVKLYGVSSLK

SEQ ID NO: 1696513 - protein, 19 aa, Staphylococcus aureus
ILDPFTGTGTFIVRTLEYL

SEQ ID NO: 1696514 - protein, 34 aa, Staphylococcus aureus
ILDSGGAERLLGYGDMLYLGSGMNKPIRVQGTFV

SEQ ID NO: 1696515 - protein, 19 aa, Staphylococcus aureus
ILERTVYPVVPPKVDYRLT

SEQ ID NO: 1696516 - protein, 24 aa, Staphylococcus aureus
ILESKTVIIATGAGWRKLNIPGEE

SEQ ID NO: 1696517 - protein, 28 aa, Staphylococcus aureus
ILGMSNDIKHIVVYNPAPLAIKDVSGLY

SEQ ID NO: 1696518 - protein, 28 aa, Staphylococcus aureus
ILGQIRTKFFNYFYTINYAQDLSGEEQI

SEQ ID NO: 1696519 - protein, 20 aa, Staphylococcus aureus
ILHIIDQMNGIPFTERADRI

SEQ ID NO: 1696520 - protein, 19 aa, Staphylococcus aureus
ILIYLDNAATTKVFEEVLD

SEQ ID NO: 1696521 - protein, 17 aa, Staphylococcus aureus
ILKFQIPNDVIKRDGSY

SEQ ID NO: 1696522 - protein, 27 aa, Staphylococcus aureus
ILKGYDFISVLGWPTYYANLGYQRASM

SEQ ID NO: 1696523 - protein, 36 aa, Staphylococcus aureus
ILKSYPYMLSGGMLQRLMIALALALKPKLIIADEPT

SEQ ID NO: 1696524 - protein, 19 aa, Staphylococcus aureus
ILKYVFASGIAREIIYALL

SEQ ID NO: 1696525 - protein, 20 aa, Staphylococcus aureus
ILLDQMVSHFKKFEADFKNA

SEQ ID NO: 1696526 - protein, 18 aa, Staphylococcus aureus
ILLLLEDVPRDEWNRLVN

SEQ ID NO: 1696527 - protein, 18 aa, Staphylococcus aureus
ILLNVKGVIRILSPDNPP

SEQ ID NO: 1696528 - protein, 25 aa, Staphylococcus aureus
ILMAMRPYQVYAVEALIQQATETGN

SEQ ID NO: 1696529 - protein, 20 aa, Staphylococcus aureus
ILMAMRPYQVYAVESLIQQA

SEQ ID NO: 1696530 - protein, 20 aa, Staphylococcus aureus
ILNAILEDYVDFGQPVGSKT

SEQ ID NO: 1696531 - protein, 29 aa, Staphylococcus aureus
ILNEIKLHREFIIEVPYMNSRKFELLIAN

SEQ ID NO: 1696532 - protein, 17 aa, Staphylococcus aureus
ILNKEVKGYLYFFKFGT

SEQ ID NO: 1696533 - protein, 18 aa, Staphylococcus aureus
ILNKQHGPNTAQNDVEAA

SEQ ID NO: 1696534 - protein, 36 aa, Staphylococcus aureus
ILPKVQFNLLNSSAYYRYLSRRIGAIVETTLSALKY

SEQ ID NO: 1696535 - protein, 17 aa, Staphylococcus aureus
ILPNFQFIGNGKGLATY

SEQ ID NO: 1696536 - protein, 18 aa, Staphylococcus aureus
ILQVKLHSKIFDKDTKKR

SEQ ID NO: 1696537 - protein, 18 aa, Staphylococcus aureus
ILRDKLPLRRDDESEICR

SEQ ID NO: 1696538 - protein, 20 aa, Staphylococcus aureus
ILRDKLPLRRDDESEIYLSF

SEQ ID NO: 1696539 - protein, 18 aa, Staphylococcus aureus
ILRKTISKNLKRLSEGKT

SEQ ID NO: 1696540 - protein, 29 aa, Staphylococcus aureus
ILSGTGMYPLWKGLPTVKVLQLITKIYGS

SEQ ID NO: 1696541 - protein, 25 aa, Staphylococcus aureus
ILSTNHLLYLTQRFYDATFSKEELQ

SEQ ID NO: 1696542 - protein, 18 aa, Staphylococcus aureus
ILTVLHAGGKFGGGGYKV

SEQ ID NO: 1696543 - protein, 33 aa, Staphylococcus aureus
ILVYSNPPILPLIPDVLHRLLKKKYSFVVYDIA

SEQ ID NO: 1696544 - protein, 20 aa, Staphylococcus aureus
ILYLLIHEQTFIPINTIAKQ

SEQ ID NO: 1696545 - protein, 21 aa, Staphylococcus aureus
ILYLLIHEQTFIPINTIANQL

SEQ ID NO: 1696546 - protein, 18 aa, Staphylococcus aureus
ILYLLQPELFTMVPVNID

SEQ ID NO: 1696547 - protein, 17 aa, Staphylococcus aureus
IMAFEHITFPVFGVQYH

SEQ ID NO: 1696548 - protein, 24 aa, Staphylococcus aureus
IMDQIRVLRELDFHFQLVIDANES

SEQ ID NO: 1696549 - protein, 20 aa, Staphylococcus aureus
IMGLNARFIFTHDSIAVGED

SEQ ID NO: 1696550 - protein, 17 aa, Staphylococcus aureus
IMGYMIRSQEMPIFITY

SEQ ID NO: 1696551 - protein, 17 aa, Staphylococcus aureus
IMLALKSIFVKSRGQTA

SEQ ID NO: 1696552 - protein, 19 aa, Staphylococcus aureus
IMMPRSIATYELYIAALKL

SEQ ID NO: 1696553 - protein, 20 aa, Staphylococcus aureus
IMMPRSIATYELYIAALKLG

SEQ ID NO: 1696554 - protein, 34 aa, Staphylococcus aureus
IMNIYEMFAQVLYPKILIDKIIYLLGTVADNGKS

SEQ ID NO: 1696555 - protein, 24 aa, Staphylococcus aureus
IMNRKILPVKPISQLFPIPMVMGC

SEQ ID NO: 1696556 - protein, 28 aa, Staphylococcus aureus
IMSLNGLNNFFIYPGQKLKVTGNASTNS

SEQ ID NO: 1696557 - protein, 17 aa, Staphylococcus aureus
IMTMLDAKNIDDLTQKQ

SEQ ID NO: 1696558 - protein, 18 aa, Staphylococcus aureus
IMYNLDRIVVYMRLRRVG

SEQ ID NO: 1696559 - protein, 37 aa, Staphylococcus aureus
INASNLFIHKLFYMDQLPFMETLLSTLSGVYAHICEN

SEQ ID NO: 1696560 - protein, 18 aa, Staphylococcus aureus
INAVKTFSEYKKDALAKI

SEQ ID NO: 1696561 - protein, 17 aa, Staphylococcus aureus
INDDLARVTHLVQNYRK

SEQ ID NO: 1696562 - protein, 28 aa, Staphylococcus aureus
INDLKLDYINYWIGKYRSHPYNKKVKVI

SEQ ID NO: 1696563 - protein, 28 aa, Staphylococcus aureus
INDNEIYINKFLNLLNFVSNDKKEDFFN

SEQ ID NO: 1696564 - protein, 25 aa, Staphylococcus aureus
INDQKKIIITTLQKFPVIYDEIDNT

SEQ ID NO: 1696565 - protein, 24 aa, Staphylococcus aureus
INDQTKFYINPTGRFVIGGPQGDA

SEQ ID NO: 1696566 - protein, 22 aa, Staphylococcus aureus
INGIPFSYFMSYVSGAGLSLIR

SEQ ID NO: 1696567 - protein, 24 aa, Staphylococcus aureus
INGKHKVDVLLGGGAKYFGKSNGN

SEQ ID NO: 1696568 - protein, 18 aa, Staphylococcus aureus
INGMANQVNTTKAALNGA

SEQ ID NO: 1696569 - protein, 29 aa, Staphylococcus aureus
INGQTWYYGKLSNGKLAWIKSTDLAKELI

SEQ ID NO: 1696570 - protein, 18 aa, Staphylococcus aureus
INHNNDLFKHVKDILRKQ

SEQ ID NO: 1696571 - protein, 18 aa, Staphylococcus aureus
INHWFNSDTIYRSILNLV

SEQ ID NO: 1696572 - protein, 17 aa, Staphylococcus aureus
INHYLEALKQKKHLSKD

SEQ ID NO: 1696573 - protein, 29 aa, Staphylococcus aureus
INIGQRRLFEWLRQNGFLIKRKGVDYNMP

SEQ ID NO: 1696574 - protein, 30 aa, Staphylococcus aureus
INIPYNKNFINQIGWYLDFEKDIDVIGDKS

SEQ ID NO: 1696575 - protein, 23 aa, Staphylococcus aureus
INISKILDFQISENKPIIGENIF

SEQ ID NO: 1696576 - protein, 24 aa, Staphylococcus aureus
INKLDRLLFIKDEKHYLIENDFIQ

SEQ ID NO: 1696577 - protein, 27 aa, Staphylococcus aureus
INLIELYNVKVVVLKPFRLGGIDKVQT

SEQ ID NO: 1696578 - protein, 17 aa, Staphylococcus aureus
INLKLSTLAFVVGQMQN

SEQ ID NO: 1696579 - protein, 29 aa, Staphylococcus aureus
INLMLRSEALFKKALLYAPLYPVEVTSTK

SEQ ID NO: 1696580 - protein, 24 aa, Staphylococcus aureus
INLPTHPILIQTAQYNLIIDAGIG

SEQ ID NO: 1696581 - protein, 24 aa, Staphylococcus aureus
INMQANWMIIINGISLDCFKNSQV

SEQ ID NO: 1696582 - protein, 17 aa, Staphylococcus aureus
INNIKHLRLNNIYPIIV

SEQ ID NO: 1696583 - protein, 23 aa, Staphylococcus aureus
INNYPFPNTFKVLVVSGAELKNA

SEQ ID NO: 1696584 - protein, 17 aa, Staphylococcus aureus
INPYIKNMMYVLADNRH

SEQ ID NO: 1696585 - protein, 18 aa, Staphylococcus aureus
INRLIKIVNVLGYEYNKD

SEQ ID NO: 1696586 - protein, 22 aa, Staphylococcus aureus
INSLPEFSQYIDQKLESEMNKD

SEQ ID NO: 1696587 - protein, 24 aa, Staphylococcus aureus
INTAFFVKLFKTALAERDYYFNID

SEQ ID NO: 1696588 - protein, 22 aa, Staphylococcus aureus
INTAFFVKLFNTALAEREYYFN

SEQ ID NO: 1696589 - protein, 25 aa, Staphylococcus aureus
INTIPFDLYVYVNKYISNKIFNCDN

SEQ ID NO: 1696590 - protein, 17 aa, Staphylococcus aureus
INVELSNFYLDYGKDIL

SEQ ID NO: 1696591 - protein, 17 aa, Staphylococcus aureus
INVHPHLFRHTHATVFY

SEQ ID NO: 1696592 - protein, 23 aa, Staphylococcus aureus
INVTFNALYIIKIGKNNTLICIA

SEQ ID NO: 1696593 - protein, 21 aa, Staphylococcus aureus
INYEVLCNLSRRLPRIYHDGD

SEQ ID NO: 1696594 - protein, 40 aa, Staphylococcus aureus; identical to SEQ ID NO: 1593765

SEQ ID NO: 1696595 - protein, 23 aa, Staphylococcus aureus
IPATIAIIEGKIKIGLESEDLEI

SEQ ID NO: 1696596 - protein, 25 aa, Staphylococcus aureus
IPFDVSAYRTIYYSELYADVVNAKD

SEQ ID NO: 1696597 - protein, 20 aa, Staphylococcus aureus
IPFYESLNFKMRGNIFLEEG

SEQ ID NO: 1696598 - protein, 26 aa, Staphylococcus aureus
IPHGRANAILLPHIIRYNAKDPQKHA

SEQ ID NO: 1696599 - protein, 17 aa, Staphylococcus aureus
IPHWEQPEHIQSLTFHS

SEQ ID NO: 1696600 - protein, 26 aa, Staphylococcus aureus
IPIIEDDIFRDIFFSDPTPAIKTFDK

SEQ ID NO: 1696601 - protein, 26 aa, Staphylococcus aureus
IPIIEDDIFRDIFFSNPTPAIKTYDK

SEQ ID NO: 1696602 - protein, 20 aa, Staphylococcus aureus
IPIIEERLIFVTNKEMKDFK

SEQ ID NO: 1696603 - protein, 20 aa, Staphylococcus aureus
IPINLWVNGNHKTISTDKVS

SEQ ID NO: 1696604 - protein, 18 aa, Staphylococcus aureus
IPLFVDSSPPVSGSSDFL

SEQ ID NO: 1696605 - protein, 19 aa, Staphylococcus aureus
IPMIERLPRELKHISLIQL

SEQ ID NO: 1696606 - protein, 19 aa, Staphylococcus aureus
IPQMMDIGVDSLKLRTYEV

SEQ ID NO: 1696607 - protein, 18 aa, Staphylococcus aureus
IPRILKRTNLIGQSQTGT

SEQ ID NO: 1696608 - protein, 17 aa, Staphylococcus aureus
IPRILKRTNLIGQSQTS

SEQ ID NO: 1696609 - protein, 17 aa, Staphylococcus aureus
IPRKDRLLLGTLFLNHV

SEQ ID NO: 1696610 - protein, 19 aa, Staphylococcus aureus
IPSLTYIKDKLATNGIELS

SEQ ID NO: 1696611 - protein, 21 aa, Staphylococcus aureus
IPTLNYEVMLTIPAGTQTGKQ

SEQ ID NO: 1696612 - protein, 24 aa, Staphylococcus aureus
IPTSKAPKLLLKGSGNLKGSSVGY

SEQ ID NO: 1696613 - protein, 18 aa, Staphylococcus aureus
IPVAPNTLGKSGVLVVYV

SEQ ID NO: 1696614 - protein, 32 aa, Staphylococcus aureus
IPVATVMTDYRLHKNWITPYSTRYYVATKETK

SEQ ID NO: 1696615 - protein, 24 aa, Staphylococcus aureus
IPVCGFAWIHWSVANVGVSGNSIS

SEQ ID NO: 1696616 - protein, 18 aa, Staphylococcus aureus
IPYAMHVAPLCIKYRFFI

SEQ ID NO: 1696617 - protein, 18 aa, Staphylococcus aureus
IQALIRGVWLLSGTDKEL

SEQ ID NO: 1696618 - protein, 24 aa, Staphylococcus aureus
IQAYTYHHILRIIQKYELDYIIDD

SEQ ID NO: 1696619 - protein, 26 aa, Staphylococcus aureus
IQEAFKDRILIPKNNLDYVPKKNKVL

SEQ ID NO: 1696620 - protein, 21 aa, Staphylococcus aureus
IQEIKKKYPSIKIIKALAADE

SEQ ID NO: 1696621 - protein, 19 aa, Staphylococcus aureus
IQEKEHLLSPLFKDWHKYN

SEQ ID NO: 1696622 - protein, 25 aa, Staphylococcus aureus
IQEYDTLMIYYVKSLIGLGQYFEAV

SEQ ID NO: 1696623 - protein, 19 aa, Staphylococcus aureus
IQGYLFLQSLYENEKNYPD

SEQ ID NO: 1696624 - protein, 17 aa, Staphylococcus aureus
IQICGYNSLYKSHSTFW

SEQ ID NO: 1696625 - protein, 19 aa, Staphylococcus aureus
IQITKFIRPANIERMIDHL

SEQ ID NO: 1696626 - protein, 17 aa, Staphylococcus aureus
IQKAVAEMKLAVGLLVD

SEQ ID NO: 1696627 - protein, 17 aa, Staphylococcus aureus
IQKLILAYEKTEIGFGE

SEQ ID NO: 1696628 - protein, 24 aa, Staphylococcus aureus
IQKLPTTLIVAFKSTLEEAKGADL

SEQ ID NO: 1696629 - protein, 18 aa, Staphylococcus aureus
IQKLVNRKQLKDHDGFKL

SEQ ID NO: 1696630 - protein, 23 aa, Staphylococcus aureus
IQKSFTLNMLHPYIDEIRITKNK

SEQ ID NO: 1696631 - protein, 19 aa, Staphylococcus aureus
IQLLAPVISHRKGSHEKLI

SEQ ID NO: 1696632 - protein, 18 aa, Staphylococcus aureus
IQNQIVTPIQIAIRIQRV

SEQ ID NO: 1696633 - protein, 27 aa, Staphylococcus aureus
IQQRFTLNMLYPYIDQIHITKKKMLVG

SEQ ID NO: 1696634 - protein, 19 aa, Staphylococcus aureus
IQSDHLFYRHDIANKALQL

SEQ ID NO: 1696635 - protein, 17 aa, Staphylococcus aureus
IQSWIPCKIEDQFLNQE

SEQ ID NO: 1696636 - protein, 23 aa, Staphylococcus aureus
IQTAIRIQIAIQIQTAIQNQTAI

SEQ ID NO: 1696637 - protein, 23 aa, Staphylococcus aureus
IQTKKAPKLLLKGTGDLKGSSIG

SEQ ID NO: 1696638 - protein, 20 aa, Staphylococcus aureus
IQTTIFIDEGWAFSASRQGK

SEQ ID NO: 1696639 - protein, 21 aa, Staphylococcus aureus
IQTTLFIDEGWAFSASRQGKK

SEQ ID NO: 1696640 - protein, 27 aa, Staphylococcus aureus
IQYDVALFSYNKLLEIFFSVIDPLDTG

SEQ ID NO: 1696641 - protein, 26 aa, Staphylococcus aureus
IRDVATKAWFNTYLNIYAATTVNHLL

SEQ ID NO: 1696642 - protein, 17 aa, Staphylococcus aureus
IREIQKLILAYEKTEIG

SEQ ID NO: 1696643 - protein, 27 aa, Staphylococcus aureus
IRETTAIDIPFAARHFHYFASVIETEE

SEQ ID NO: 1696644 - protein, 19 aa, Staphylococcus aureus
IRFECKLSQIILLGDELDG

SEQ ID NO: 1696645 - protein, 19 aa, Staphylococcus aureus
IRFHNCSLFPVYHGSAKNN

SEQ ID NO: 1696646 - protein, 31 aa, Staphylococcus aureus
IRGKGVMVVAPLEILDPFKGALKFQLPNDVI

SEQ ID NO: 1696647 - protein, 17 aa, Staphylococcus aureus
IRGLYTKASLSVLTSDY

SEQ ID NO: 1696648 - protein, 29 aa, Staphylococcus aureus
IRKNGRKSVFLMLNIKKGIFKTHPNLRQA

SEQ ID NO: 1696649 - protein, 29 aa, Staphylococcus aureus
IRKNIHVNGFDFKLSILKGHMGISIQVKD

SEQ ID NO: 1696650 - protein, 26 aa, Staphylococcus aureus
IRLKSKKGTLLWLMDETKTPMGARRL

SEQ ID NO: 1696651 - protein, 20 aa, Staphylococcus aureus
IRLKYRYLDLRRHELAQTFK

SEQ ID NO: 1696652 - protein, 24 aa, Staphylococcus aureus
IRQFKSLRRFFKIYVRGIRGASEL

SEQ ID NO: 1696653 - protein, 18 aa, Staphylococcus aureus
IRQFKYLSAFEKDVMYLM

SEQ ID NO: 1696654 - protein, 19 aa, Staphylococcus aureus
IRQRNLLNLVHAWSTELQL

SEQ ID NO: 1696655 - protein, 23 aa, Staphylococcus aureus
IRSPIEAYAYLEKLRSIIQYTGV

SEQ ID NO: 1696656 - protein, 27 aa, Staphylococcus aureus
IRSSFSKFIYYYINTGLFSEYINLFSS

SEQ ID NO: 1696657 - protein, 17 aa, Staphylococcus aureus
IRTIIHFHLSISPSNYI

SEQ ID NO: 1696658 - protein, 24 aa, Staphylococcus aureus
IRTPLLSVEFFNLFFNTEQIKYSD

SEQ ID NO: 1696659 - protein, 21 aa, Staphylococcus aureus
IRTVKNLLIKGFKIATLEDKE

SEQ ID NO: 1696660 - protein, 17 aa, Staphylococcus aureus
IRVNCVAPGPFWSPLQI

SEQ ID NO: 1696661 - protein, 21 aa, Staphylococcus aureus
ISDLNVRPILFVGSGFSQRYI

SEQ ID NO: 1696662 - protein, 32 aa, Staphylococcus aureus
ISEEIFDDLWINLYYLFMNLRDLFKEEGLEPW

SEQ ID NO: 1696663 - protein, 19 aa, Staphylococcus aureus
ISEKMIYDEVALGLRARGM

SEQ ID NO: 1696664 - protein, 24 aa, Staphylococcus aureus
ISENKLINIILEKTLIHQRFDTKE

SEQ ID NO: 1696665 - protein, 20 aa, Staphylococcus aureus
ISFDIMLASYIIDPSRTISD

SEQ ID NO: 1696666 - protein, 19 aa, Staphylococcus aureus
ISFEAFLEKAAVSSSQTVE

SEQ ID NO: 1696667 - protein, 17 aa, Staphylococcus aureus
ISFIPMTDDVELSLAGF

SEQ ID NO: 1696668 - protein, 17 aa, Staphylococcus aureus
ISGDIYYSSIDGPIEDM

SEQ ID NO: 1696669 - protein, 22 aa, Staphylococcus aureus
ISGPAALRCSQFVYKEQKNQKT

SEQ ID NO: 1696670 - protein, 22 aa, Staphylococcus aureus
ISGPATLRCSQFVYKEQKNQKT

SEQ ID NO: 1696671 - protein, 24 aa, Staphylococcus aureus
ISIERQYFKHLYRFNNQDLKHLEQ

SEQ ID NO: 1696672 - protein, 25 aa, Staphylococcus aureus
ISIERQYFNQFYRFNNQDLKHLEQE

SEQ ID NO: 1696673 - protein, 18 aa, Staphylococcus aureus
ISIKPIPRVKPKPKFMMR

SEQ ID NO: 1696674 - protein, 24 aa, Staphylococcus aureus
ISKKYQWIAYYEILAKLVDKFPDV

SEQ ID NO: 1696675 - protein, 19 aa, Staphylococcus aureus
ISKLQEHYQFHLAISGHEG

SEQ ID NO: 1696676 - protein, 18 aa, Staphylococcus aureus
ISLQMHAFPKEIRKIVFN

SEQ ID NO: 1696677 - protein, 23 aa, Staphylococcus aureus
ISLSYLSLIVNKKAKPSPKMAKK

SEQ ID NO: 1696678 - protein, 17 aa, Staphylococcus aureus
ISLYNKYGSPLPLMHLY

SEQ ID NO: 1696679 - protein, 17 aa, Staphylococcus aureus
ISNLLKKRGIRHDVLNA

SEQ ID NO: 1696680 - protein, 18 aa, Staphylococcus aureus
ISNLLLVTGNYRRPSTGA

SEQ ID NO: 1696681 - protein, 20 aa, Staphylococcus aureus
ISPELLRYRYKHKMRGDELL

SEQ ID NO: 1696682 - protein, 25 aa, Staphylococcus aureus
ISRKHNLHATFMPKPLFGVNGSGMH

SEQ ID NO: 1696683 - protein, 23 aa, Staphylococcus aureus
ISRMMGFLNLKYPNITSITEVPI

SEQ ID NO: 1696684 - protein, 21 aa, Staphylococcus aureus
ISSARQFIGNEPFAVLLGDDI

SEQ ID NO: 1696685 - protein, 29 aa, Staphylococcus aureus
ISSFVYKRRLPFHAKRFNDWLESMASNIV

SEQ ID NO: 1696686 - protein, 25 aa, Staphylococcus aureus
ISSGAAIYAAIQKAKELGKGKTVIT

SEQ ID NO: 1696687 - protein, 24 aa, Staphylococcus aureus
ISSKCVYVKWNPYSYTYAKQHRIE

SEQ ID NO: 1696688 - protein, 17 aa, Staphylococcus aureus
ISSKNALDGVERLAQDK

SEQ ID NO: 1696689 - protein, 18 aa, Staphylococcus aureus
ISSKNALDGVERLAQDKQ

SEQ ID NO: 1696690 - protein, 26 aa, Staphylococcus aureus
ISSKPPILLTPLFPTYFFSTHSDRQN

SEQ ID NO: 1696691 - protein, 24 aa, Staphylococcus aureus
ISTGLIVPSKFFDLAKEGKDFYMF

SEQ ID NO: 1696692 - protein, 19 aa, Staphylococcus aureus
ISTLSFVLEKGKLGQIILC

SEQ ID NO: 1696693 - protein, 18 aa, Staphylococcus aureus
ISVPKNCKLLVIGATEEE

SEQ ID NO: 1696694 - protein, 22 aa, Staphylococcus aureus
ISVYGSVKFLKNTYVKTAYAGM

SEQ ID NO: 1696695 - protein, 23 aa, Staphylococcus aureus
ISYIPKVGYYDKITHAHAYGGPI

SEQ ID NO: 1696696 - protein, 24 aa, Staphylococcus aureus
ITAKSILGLLPDYPDHTLTGEIIF

SEQ ID NO: 1696697 - protein, 18 aa, Staphylococcus aureus
ITASFENGLLTITLPKIK

SEQ ID NO: 1696698 - protein, 24 aa, Staphylococcus aureus
ITDDYVLTRLKTMGKLAMLMLKDL

SEQ ID NO: 1696699 - protein, 23 aa, Staphylococcus aureus
ITDKEKILVLGSGPIRIGQGVEF

SEQ ID NO: 1696700 - protein, 23 aa, Staphylococcus aureus
ITDKNLIKPIPTLSTGTLSGKGV

SEQ ID NO: 1696701 - protein, 21 aa, Staphylococcus aureus
ITFDECDIFFIGGGSDREQAL

SEQ ID NO: 1696702 - protein, 21 aa, Staphylococcus aureus
ITGRIFISLAVKFSKARLIDN

SEQ ID NO: 1696703 - protein, 33 aa, Staphylococcus aureus
ITIAYKVFKTAYDHVEWFRKGINGLGETIKFFG

SEQ ID NO: 1696704 - protein, 18 aa, Staphylococcus aureus
ITIVGKDSFVGCNVNLVA

SEQ ID NO: 1696705 - protein, 26 aa, Staphylococcus aureus
ITKGNFRLIHRLFAQIDRIMDINGLD

SEQ ID NO: 1696706 - protein, 17 aa, Staphylococcus aureus
ITKPYIAEGRRYTGSFT

SEQ ID NO: 1696707 - protein, 17 aa, Staphylococcus aureus
ITLAEYFENWIKTYKQP

SEQ ID NO: 1696708 - protein, 17 aa, Staphylococcus aureus
ITMAVVTWKVWKIERNT

SEQ ID NO: 1696709 - protein, 18 aa, Staphylococcus aureus
ITNIPRYHEVAPLSLMQH

SEQ ID NO: 1696710 - protein, 27 aa, Staphylococcus aureus
ITNTNVAPYSGVTWMGAGTGFVVGNHT

SEQ ID NO: 1696711 - protein, 25 aa, Staphylococcus aureus
ITQEEWVNLWQKALQVDYRPVVNIK

SEQ ID NO: 1696712 - protein, 24 aa, Staphylococcus aureus
ITQNEIVTWILVYTTSIEDMKQQA

SEQ ID NO: 1696713 - protein, 19 aa, Staphylococcus aureus
ITQSFYEYFYLQCKNDSSS

SEQ ID NO: 1696714 - protein, 26 aa, Staphylococcus aureus
ITRIYKAHVKALLPLKPQTIDMPIGK

SEQ ID NO: 1696715 - protein, 20 aa, Staphylococcus aureus
ITSIIFKYLQENGIESHFIK

SEQ ID NO: 1696716 - protein, 23 aa, Staphylococcus aureus
ITSNIPFRIRKPLPNMIFHQVEV

SEQ ID NO: 1696717 - protein, 24 aa, Staphylococcus aureus
ITTNDILTMLKATTTVPGLRNNIT

SEQ ID NO: 1696718 - protein, 18 aa, Staphylococcus aureus
ITTSFENGLLTITLPKIK

SEQ ID NO: 1696719 - protein, 26 aa, Staphylococcus aureus
ITVDTGILCWAWFEEAYQIETFAKFS

SEQ ID NO: 1696720 - protein, 20 aa, Staphylococcus aureus
ITVIQILKLLEHVDLQSMGP

SEQ ID NO: 1696721 - protein, 17 aa, Staphylococcus aureus
ITWYSNRHLLEKDLLYL

SEQ ID NO: 1696722 - protein, 19 aa, Staphylococcus aureus
ITYKIPKKVIKHAGYVRCK

SEQ ID NO: 1696723 - protein, 27 aa, Staphylococcus aureus
IVAGSYFVTALQTVVSRRLNPFETGVV

SEQ ID NO: 1696724 - protein, 31 aa, Staphylococcus aureus
IVALASNPVGWAALGGLAVGIGATHLADWAY

SEQ ID NO: 1696725 - protein, 25 aa, Staphylococcus aureus
IVEETLTLPFFSDKKAILVKNAYIF

SEQ ID NO: 1696726 - protein, 27 aa, Staphylococcus aureus
IVEMHDFFKNALLSDSLLRDIKVLSSN

SEQ ID NO: 1696727 - protein, 17 aa, Staphylococcus aureus
IVESLKALGINHVAESR

SEQ ID NO: 1696728 - protein, 17 aa, Staphylococcus aureus
IVEYIGEMLTFLKYFDA

SEQ ID NO: 1696729 - protein, 29 aa, Staphylococcus aureus
IVEYIGEMLTFLKYFDAPQPFKIMASHYL

SEQ ID NO: 1696730 - protein, 26 aa, Staphylococcus aureus
IVFATARFYIRVLTRFFQNITKNEET

SEQ ID NO: 1696731 - protein, 17 aa, Staphylococcus aureus
IVGFANFIYGEELYLSA

SEQ ID NO: 1696732 - protein, 31 aa, Staphylococcus aureus
IVGSETAFPLLYTYFVKNGDWTLQQLVDYLT

SEQ ID NO: 1696733 - protein, 35 aa, Staphylococcus aureus
IVGVKYTAPNFFLLERIRKAFPDKLILSGFDEMLV

SEQ ID NO: 1696734 - protein, 24 aa, Staphylococcus aureus
IVGYINRTLMPFGQQHRSYKNENL

SEQ ID NO: 1696735 - protein, 34 aa, Staphylococcus aureus
IVHRDDIITEQDILAHINLIDQLSAEVIDTPSTA

SEQ ID NO: 1696736 - protein, 23 aa, Staphylococcus aureus
IVIDRFHIVQLLNRALNGIRVTV

SEQ ID NO: 1696737 - protein, 23 aa, Staphylococcus aureus
IVIQNYPYERFLFDDLGDVTNVI

SEQ ID NO: 1696738 - protein, 17 aa, Staphylococcus aureus
IVISLLSLDHIEVSDDA

SEQ ID NO: 1696739 - protein, 24 aa, Staphylococcus aureus
IVKKDFTGISFLNLVDFDALYGHR

SEQ ID NO: 1696740 - protein, 23 aa, Staphylococcus aureus
IVKNNVDILPYLDASFRTEPSLN

SEQ ID NO: 1696741 - protein, 18 aa, Staphylococcus aureus
IVLFNRMGGTYIKSGYGA

SEQ ID NO: 1696742 - protein, 25 aa, Staphylococcus aureus
IVNQYYVRFYNNVLFFRDDEGKFIN

SEQ ID NO: 1696743 - protein, 17 aa, Staphylococcus aureus
IVNVLKKYPIFIISDEI

SEQ ID NO: 1696744 - protein, 18 aa, Staphylococcus aureus
IVPDLIRLNKTFLIESRE

SEQ ID NO: 1696745 - protein, 23 aa, Staphylococcus aureus
IVQPHAMALNYVYYDIYTQMIEM

SEQ ID NO: 1696746 - protein, 20 aa, Staphylococcus aureus
IVSIYRYISKLQQHFQFHLA

SEQ ID NO: 1696747 - protein, 18 aa, Staphylococcus aureus
IVTLLDKPNRRKADIEAK

SEQ ID NO: 1696748 - protein, 35 aa, Staphylococcus aureus; identical to SEQ ID NO: 1591992

SEQ ID NO: 1696749 - protein, 32 aa, Staphylococcus aureus
IVTSTNMIFKYAYDMKLIRIMPSEGIKRPKKK

SEQ ID NO: 1696750 - protein, 22 aa, Staphylococcus aureus
IWNVADILRGLYKPHEYGKVIL

SEQ ID NO: 1696751 - protein, 20 aa, Staphylococcus aureus
IYAHVMHTHLLINFVTRSEG

SEQ ID NO: 1696752 - protein, 19 aa, Staphylococcus aureus
IYALCHYTLLLYNTKDNEQ

SEQ ID NO: 1696753 - protein, 25 aa, Staphylococcus aureus
IYDALRQSFNIPALKAWQSVKQNAG

SEQ ID NO: 1696754 - protein, 17 aa, Staphylococcus aureus
IYDKVISTAIQNINNGV

SEQ ID NO: 1696755 - protein, 19 aa, Staphylococcus aureus
IYHQAYKKGVPQFDLKEVD

SEQ ID NO: 1696756 - protein, 36 aa, Staphylococcus aureus
IYIDGFHNFSTIEYLIIKGLIKYAKSVTIILTTDGN

SEQ ID NO: 1696757 - protein, 18 aa, Staphylococcus aureus
IYKIALVGKDDKKYGEGV

SEQ ID NO: 1696758 - protein, 17 aa, Staphylococcus aureus
IYKIALVGKDEKKYKDG

SEQ ID NO: 1696759 - protein, 17 aa, Staphylococcus aureus
IYLNFKDVNYQLISEGN

SEQ ID NO: 1696760 - protein, 31 aa, Staphylococcus aureus
IYLNNPLVIEIKKLYPFVFNTLFEAIDKLAI

SEQ ID NO: 1696761 - protein, 32 aa, Staphylococcus aureus
IYLNNPLVIEIKKLYPFVFNTLFGAIDKLAID

SEQ ID NO: 1696762 - protein, 18 aa, Staphylococcus aureus
IYNYIKQVVQTKGYPPSV

SEQ ID NO: 1696763 - protein, 20 aa, Staphylococcus aureus
IYQLPGHVFIFGGQTLYEEM

SEQ ID NO: 1696764 - protein, 21 aa, Staphylococcus aureus
IYRFSLLVPNQAALHYFEKRL

SEQ ID NO: 1696765 - protein, 17 aa, Staphylococcus aureus
IYSFFDPFSSDCFKLSA

SEQ ID NO: 1696766 - protein, 18 aa, Staphylococcus aureus
IYSGTEMDILPDGSLDYD

SEQ ID NO: 1696767 - protein, 34 aa, Staphylococcus aureus
IYSGYDQLLAFFNNRYWRSQFNPRGGWSPSGPRR

SEQ ID NO: 1696768 - protein, 25 aa, Staphylococcus aureus
IYTGSLYLSLISLLENRDLQAGEII

SEQ ID NO: 1696769 - protein, 25 aa, Staphylococcus aureus
IYTHPINNYILNGITRIVIKKIVKD

SEQ ID NO: 1696770 - protein, 17 aa, Staphylococcus aureus
IYTIAAMAPCPYIYAEI

SEQ ID NO: 1696771 - protein, 18 aa, Staphylococcus aureus
IYTIAAMAPCPYIYAEIA

SEQ ID NO: 1696772 - protein, 25 aa, Staphylococcus aureus
IYTKRRIIKFFKNVYIKDITPIMYQ

SEQ ID NO: 1696773 - protein, 17 aa, Staphylococcus aureus
IYVHCQSGIRSSIAIGI

SEQ ID NO: 1696774 - protein, 21 aa, Staphylococcus aureus
IYVPKNIKLDTPLQAYFRINS

SEQ ID NO: 1696775 - protein, 17 aa, Staphylococcus aureus
KAALNGTQNLEKAKQHA

SEQ ID NO: 1696776 - protein, 18 aa, Staphylococcus aureus
KAARRWAYDVKGMEPNKA

SEQ ID NO: 1696777 - protein, 30 aa, Staphylococcus aureus
KACVDLSIQYIPQRLLPDKAIDVLDITASH

SEQ ID NO: 1696778 - protein, 17 aa, Staphylococcus aureus
KAEEMFLGDAPVAPIYQ

SEQ ID NO: 1696779 - protein, 25 aa, Staphylococcus aureus
KAEIKNFKFFVQYGNFKDLKNYKDG

SEQ ID NO: 1696780 - protein, 23 aa, Staphylococcus aureus
KAELLTFKGIPYQIKLTSADQEL

SEQ ID NO: 1696781 - protein, 20 aa, Staphylococcus aureus
KAEPELLDKINIANVEGLEN

SEQ ID NO: 1696782 - protein, 20 aa, Staphylococcus aureus
KAEWVLRKMTISRKHLAIVL

SEQ ID NO: 1696783 - protein, 19 aa, Staphylococcus aureus
KAFGIAGLRLGVLISTAET

SEQ ID NO: 1696784 - protein, 17 aa, Staphylococcus aureus
KAFLDSLNIKYDCPLET

SEQ ID NO: 1696785 - protein, 18 aa, Staphylococcus aureus
KAFLPYNYEIVSSIFDNF

SEQ ID NO: 1696786 - protein, 27 aa, Staphylococcus aureus
KAFYTHGHLYQVNRTRHLLAEQARELG

SEQ ID NO: 1696787 - protein, 22 aa, Staphylococcus aureus
KAGDFTEEKLELAKKVIISHRY

SEQ ID NO: 1696788 - protein, 26 aa, Staphylococcus aureus
KAHGLTPRLHLFMEDGSIFKNEPLII

SEQ ID NO: 1696789 - protein, 22 aa, Staphylococcus aureus
KAHPDVFNILLQVLDDGHLTDT

SEQ ID NO: 1696790 - protein, 20 aa, Staphylococcus aureus
KAIAYYRFRPYAMKILKENH

SEQ ID NO: 1696791 - protein, 21 aa, Staphylococcus aureus
KAIDYIILNQLFEIGDKAYIF

SEQ ID NO: 1696792 - protein, 24 aa, Staphylococcus aureus
KAIDYLREKGIAKAAKKADRFAAE

SEQ ID NO: 1696793 - protein, 28 aa, Staphylococcus aureus
KAIEQIKPKVRRKRAALDNIDESNNNQL

SEQ ID NO: 1696794 - protein, 27 aa, Staphylococcus aureus
KAIEQIKPKVRRKRAALDSIEENNKNQ

SEQ ID NO: 1696795 - protein, 23 aa, Staphylococcus aureus
KAIKSLITNIITKKLKKFEDIEI

SEQ ID NO: 1696796 - protein, 20 aa, Staphylococcus aureus
KAIRRFLNDIASQNYDIAPS

SEQ ID NO: 1696797 - protein, 20 aa, Staphylococcus aureus
KAISSPLLETSIVGAQGVLM

SEQ ID NO: 1696798 - protein, 27 aa, Staphylococcus aureus
KAIYKRDYLCILGQTVYDKLGHEMQTI

SEQ ID NO: 1696799 - protein, 17 aa, Staphylococcus aureus
KAIYYKEQQERITLYLK

SEQ ID NO: 1696800 - protein, 19 aa, Staphylococcus aureus
KAKASLLTVLPLDKERLAD

SEQ ID NO: 1696801 - protein, 24 aa, Staphylococcus aureus
KAKDRISVIGYPKGAQTKYKMFES

SEQ ID NO: 1696802 - protein, 25 aa, Staphylococcus aureus
KAKHTLQLIGFDKVAGYRLPKSDIS

SEQ ID NO: 1696803 - protein, 17 aa, Staphylococcus aureus
KAKIFRHKYRNIKLNWI

SEQ ID NO: 1696804 - protein, 28 aa, Staphylococcus aureus
KALKDWKYPRRILWLRKVQSTIKDSLFE

SEQ ID NO: 1696805 - protein, 20 aa, Staphylococcus aureus
KALMMTPLHEVKRIVVYLRG

SEQ ID NO: 1696806 - protein, 25 aa, Staphylococcus aureus
KALNQKFWQIFQKKSLSQTVFAIAY

SEQ ID NO: 1696807 - protein, 28 aa, Staphylococcus aureus
KALQDWKYPRRILWLRKVQSTIKDSLFE

SEQ ID NO: 1696808 - protein, 23 aa, Staphylococcus aureus
KALTYLLERGFTDALIKERGIGF

SEQ ID NO: 1696809 - protein, 20 aa, Staphylococcus aureus
KALVKVFFSGLRYFNCYLLK

SEQ ID NO: 1696810 - protein, 28 aa, Staphylococcus aureus
KAMLNEGYQFFGVLYIGAILTKDGPKVI

SEQ ID NO: 1696811 - protein, 17 aa, Staphylococcus aureus
KANDPVYLVITLATDHP

SEQ ID NO: 1696812 - protein, 18 aa, Staphylococcus aureus
KANEALVKALQAWDIDHL

SEQ ID NO: 1696813 - protein, 24 aa, Staphylococcus aureus
KANFLNNFLYFFSSSKEIKNYSVS

SEQ ID NO: 1696814 - protein, 26 aa, Staphylococcus aureus
KANQTEVTVFFLNGFQMKGVIEEFDK

SEQ ID NO: 1696815 - protein, 25 aa, Staphylococcus aureus
KANVSKSWLYKQKDIRTRVETLRGM

SEQ ID NO: 1696816 - protein, 26 aa, Staphylococcus aureus
KAPGFGDRRKAMLEDLAILSGAQVIT

SEQ ID NO: 1696817 - protein, 20 aa, Staphylococcus aureus
KAPILKLHIDGDIKGSSVGY

SEQ ID NO: 1696818 - protein, 17 aa, Staphylococcus aureus
KAQAFDEILEGLPNVCK

SEQ ID NO: 1696819 - protein, 23 aa, Staphylococcus aureus
KAQAFDEILKGLPNAMQDALKED

SEQ ID NO: 1696820 - protein, 19 aa, Staphylococcus aureus
KAQDKVLMIFGPEGGLSEN

SEQ ID NO: 1696821 - protein, 21 aa, Staphylococcus aureus
KARDMLGKYYKLFTDKHDING

SEQ ID NO: 1696822 - protein, 19 aa, Staphylococcus aureus
KARFLDKQKNKKTPVVSLE

SEQ ID NO: 1696823 - protein, 20 aa, Staphylococcus aureus
KARIMMIFSLYKGEKKKTTK

SEQ ID NO: 1696824 - protein, 25 aa, Staphylococcus aureus
KARLQLALLMLQRDNVLILDEPTNH

SEQ ID NO: 1696825 - protein, 19 aa, Staphylococcus aureus
KASNHQYLNSFWSHLKPVM

SEQ ID NO: 1696826 - protein, 20 aa, Staphylococcus aureus
KATFKGLGTGPTIALRADFD

SEQ ID NO: 1696827 - protein, 28 aa, Staphylococcus aureus
KATKNEVVLWQLVAHRLMTWKKEYANNA

SEQ ID NO: 1696828 - protein, 23 aa, Staphylococcus aureus
KATPYCNFIQYLNHIRLEHCLID

SEQ ID NO: 1696829 - protein, 17 aa, Staphylococcus aureus
KATVDSMLFRGVHYEIC

SEQ ID NO: 1696830 - protein, 18 aa, Staphylococcus aureus
KAVIADKERTKASGNYVN

SEQ ID NO: 1696831 - protein, 17 aa, Staphylococcus aureus
KAVITVPAYFNDAERQA

SEQ ID NO: 1696832 - protein, 17 aa, Staphylococcus aureus
KAVLIPGDIRDEQFNYD

SEQ ID NO: 1696833 - protein, 30 aa, Staphylococcus aureus
KAWAHSKWTSKWFSNAYKSAKGWLTDMANK

SEQ ID NO: 1696834 - protein, 30 aa, Staphylococcus aureus
KAYTSAKQFFSTVLIPLSTSMKTLSDLTKQ

SEQ ID NO: 1696835 - protein, 30 aa, Staphylococcus aureus
KAYTSAKQFFSTVLIPLSTSMKTLSDLTNQ

SEQ ID NO: 1696836 - protein, 19 aa, Staphylococcus aureus
KCRPAINYYLNMVYPNDHE

SEQ ID NO: 1696837 - protein, 18 aa, Staphylococcus aureus
KCTKAQFIKRLACLPSHI

SEQ ID NO: 1696838 - protein, 19 aa, Staphylococcus aureus
KCYTFIKGYGDFDGQQTFA

SEQ ID NO: 1696839 - protein, 20 aa, Staphylococcus aureus
KDADATLALVKKFDTPATVA

SEQ ID NO: 1696840 - protein, 37 aa, Staphylococcus aureus; identical to SEQ ID NO: 1583337

SEQ ID NO: 1696841 - protein, 17 aa, Staphylococcus aureus
KDADYVFLGTKPHDFDA

SEQ ID NO: 1696842 - protein, 18 aa, Staphylococcus aureus
KDALAKIEDAYNAKVNEA

SEQ ID NO: 1696843 - protein, 17 aa, Staphylococcus aureus
KDAMHLADFFDVPYEMF

SEQ ID NO: 1696844 - protein, 22 aa, Staphylococcus aureus
KDASLVLILSDHSEFKNLSDSH

SEQ ID NO: 1696845 - protein, 25 aa, Staphylococcus aureus
KDDANKLFNFTPLNSKKVYTRSITN

SEQ ID NO: 1696846 - protein, 22 aa, Staphylococcus aureus
KDEIILTVRAPVGKLAMAQINA

SEQ ID NO: 1696847 - protein, 21 aa, Staphylococcus aureus
KDEKVLVFDLGGGTFDVSILE

SEQ ID NO: 1696848 - protein, 20 aa, Staphylococcus aureus
KDETLFKLQRQFAYTKEEIH

SEQ ID NO: 1696849 - protein, 20 aa, Staphylococcus aureus
KDGLSPEYLLSRDYLEDDPE

SEQ ID NO: 1696850 - protein, 22 aa, Staphylococcus aureus
KDGLSPEYLLSRDYLEDDSEGF

SEQ ID NO: 1696851 - protein, 23 aa, Staphylococcus aureus
KDIAKILYSTRAGVAYMATGGMA

SEQ ID NO: 1696852 - protein, 26 aa, Staphylococcus aureus
KDIDARIYPVGRLDYDTSGLLLLTND

SEQ ID NO: 1696853 - protein, 26 aa, Staphylococcus aureus
KDKAIQSINQALANKLKEIEASNATD

SEQ ID NO: 1696854 - protein, 27 aa, Staphylococcus aureus
KDKDHFNFFSLFTFSEPIEQVVTHFLA

SEQ ID NO: 1696855 - protein, 23 aa, Staphylococcus aureus
KDKDKFIIFTSYPNLNEIKNKLN

SEQ ID NO: 1696856 - protein, 41 aa, Staphylococcus aureus
KDKENIHILTLEKHLTFILDEGLIYLLRILEHGSEIENIYN

SEQ ID NO: 1696857 - protein, 41 aa, Staphylococcus aureus
KDKENIHILTLEKHLTFILDEGLIYLLRILEHRSEIENIYN

SEQ ID NO: 1696858 - protein, 20 aa, Staphylococcus aureus
KDKGNTLNTAMGALRTSIQN

SEQ ID NO: 1696859 - protein, 20 aa, Staphylococcus aureus
KDKNIYLKYKVAKYLEELSY

SEQ ID NO: 1696860 - protein, 27 aa, Staphylococcus aureus
KDLTAELSLNLFIDPTTVTQKGNQNVE

SEQ ID NO: 1696861 - protein, 25 aa, Staphylococcus aureus
KDMETRGMVLYINRNTRTTKGYYFI

SEQ ID NO: 1696862 - protein, 25 aa, Staphylococcus aureus
KDMVGDHIIPWSKGGKTERGNLQML

SEQ ID NO: 1696863 - protein, 33 aa, Staphylococcus aureus
KDNKGLNFVLTTGTFFVKMNEKQYPDFKNKNLR

SEQ ID NO: 1696864 - protein, 18 aa, Staphylococcus aureus
KDNQNVLIIYQGAHSYVS

SEQ ID NO: 1696865 - protein, 19 aa, Staphylococcus aureus
KDNVDLAIFGPGNPLMAHQ

SEQ ID NO: 1696866 - protein, 20 aa, Staphylococcus aureus
KDPEKWLKSLKGSGVRSGSG

SEQ ID NO: 1696867 - protein, 25 aa, Staphylococcus aureus
KDPQKHALFPKYEFFRADTDYADIA

SEQ ID NO: 1696868 - protein, 25 aa, Staphylococcus aureus
KDQQSAFYEILNMPNLNEAQRNGFI

SEQ ID NO: 1696869 - protein, 17 aa, Staphylococcus aureus
KDRCEVIYLKRTEGIST

SEQ ID NO: 1696870 - protein, 25 aa, Staphylococcus aureus
KDRIIKPLTYLYNKDLERTGLLNTT

SEQ ID NO: 1696871 - protein, 31 aa, Staphylococcus aureus
KDSGKKIYNILYLVPSIQLLTQTLFSWNTDK

SEQ ID NO: 1696872 - protein, 22 aa, Staphylococcus aureus
KDSIYFLANYLCEIKSKATIII

SEQ ID NO: 1696873 - protein, 22 aa, Staphylococcus aureus
KDTKYLAWSLIDYDAIPVCGFA

SEQ ID NO: 1696874 - protein, 23 aa, Staphylococcus aureus
KDVGTYQHLGLRALSEIASLPVP

SEQ ID NO: 1696875 - protein, 25 aa, Staphylococcus aureus
KDVKTLVLTFPFSNAGFAVVLPAEN

SEQ ID NO: 1696876 - protein, 18 aa, Staphylococcus aureus
KDVWYKSSVGLLNSLLLY

SEQ ID NO: 1696877 - protein, 26 aa, Staphylococcus aureus
KDYEILKPKIVFNGSNPYLALNHIIV

SEQ ID NO: 1696878 - protein, 22 aa, Staphylococcus aureus
KDYFTSIKLVNAINLLLSTKHS

SEQ ID NO: 1696879 - protein, 18 aa, Staphylococcus aureus
KDYGPFYRYDPNQCILCG

SEQ ID NO: 1696880 - protein, 27 aa, Staphylococcus aureus
KDYVDIVEIGTPIIYNEGLPAVKHMAG

SEQ ID NO: 1696881 - protein, 18 aa, Staphylococcus aureus
KEAFADYLMIIVIDEELS

SEQ ID NO: 1696882 - protein, 24 aa, Staphylococcus aureus
KEALNFLCAYITKHQIKLVITTVS

SEQ ID NO: 1696883 - protein, 30 aa, Staphylococcus aureus
KEAREALNGYFRENIFTSYINGNDLPHEHN

SEQ ID NO: 1696884 - protein, 30 aa, Staphylococcus aureus
KEAREALNGYFRENIFTSYINGNDLPYEHN

SEQ ID NO: 1696885 - protein, 23 aa, Staphylococcus aureus
KECGLILGIDLLDHIIISDNRFT

SEQ ID NO: 1696886 - protein, 24 aa, Staphylococcus aureus
KEDMLNEYYYLPKTLYNTLASPDF

SEQ ID NO: 1696887 - protein, 25 aa, Staphylococcus aureus
KEDMLNEYYYLPKTLYNTLASPEFD

SEQ ID NO: 1696888 - protein, 19 aa, Staphylococcus aureus
KEEWLSMSLAERQKAEKAF

SEQ ID NO: 1696889 - protein, 32 aa, Staphylococcus aureus
KEFDTLYAYDLFLLTHIFIIFTDESLNHVISR

SEQ ID NO: 1696890 - protein, 19 aa, Staphylococcus aureus
KEFTNLYALLIPKMNNMDD

SEQ ID NO: 1696891 - protein, 18 aa, Staphylococcus aureus
KEFVDLFIIDTPSVSYGG

SEQ ID NO: 1696892 - protein, 18 aa, Staphylococcus aureus
KEGFSYHERRIHNDQMFD

SEQ ID NO: 1696893 - protein, 18 aa, Staphylococcus aureus
KEGRFVTLPEYPEFAWFE

SEQ ID NO: 1696894 - protein, 17 aa, Staphylococcus aureus
KEIEDFKFFVQYGDFKD

SEQ ID NO: 1696895 - protein, 17 aa, Staphylococcus aureus
KEIEEFNFFVQYGNFKE

SEQ ID NO: 1696896 - protein, 24 aa, Staphylococcus aureus
KEIEKFKFFVQYGNFKELKNYKDG

SEQ ID NO: 1696897 - protein, 24 aa, Staphylococcus aureus
KEIENFKFFAQYGSFKDLSKYKDG

SEQ ID NO: 1696898 - protein, 23 aa, Staphylococcus aureus
KEIENFKFFVQYGDFKNLKNYKD

SEQ ID NO: 1696899 - protein, 24 aa, Staphylococcus aureus
KEIENFKFFVQYGNFKDFKDYKDG

SEQ ID NO: 1696900 - protein, 23 aa, Staphylococcus aureus
KEIENFKFFVQYGNFKDFKDYKN

SEQ ID NO: 1696901 - protein, 23 aa, Staphylococcus aureus
KEIENFKFFVQYGNFTDINDYKD

SEQ ID NO: 1696902 - protein, 21 aa, Staphylococcus aureus
KEIFNNLLSKQVDGIIFLGGT

SEQ ID NO: 1696903 - protein, 19 aa, Staphylococcus aureus
KEIGKPVPLTWGNGGDWGD

SEQ ID NO: 1696904 - protein, 18 aa, Staphylococcus aureus
KEIIDTPFIEDIDKAYKG

SEQ ID NO: 1696905 - protein, 17 aa, Staphylococcus aureus
KEIKKDYDIDFITGHSL

SEQ ID NO: 1696906 - protein, 19 aa, Staphylococcus aureus
KEIWLLNQGIEAAQSYFNV

SEQ ID NO: 1696907 - protein, 24 aa, Staphylococcus aureus
KEIYQFPLFLFYKGNIKLIKIICI

SEQ ID NO: 1696908 - protein, 26 aa, Staphylococcus aureus
KEKEYGYIILPIVIPAGTNPENILDD

SEQ ID NO: 1696909 - protein, 24 aa, Staphylococcus aureus
KEKRTFSKFEAWIYLLMEANHSEA

SEQ ID NO: 1696910 - protein, 22 aa, Staphylococcus aureus
KELILKTVIDLVDKRVPIIAGT

SEQ ID NO: 1696911 - protein, 29 aa, Staphylococcus aureus
KELLEESIFTGFLLKFIPEKQRNYIDIED

SEQ ID NO: 1696912 - protein, 23 aa, Staphylococcus aureus
KELLLLLMRLMKVKVKGYGEIIF

SEQ ID NO: 1696913 - protein, 25 aa, Staphylococcus aureus
KELNIYRVPMDCETWIYKAINNQTE

SEQ ID NO: 1696914 - protein, 21 aa, Staphylococcus aureus
KELRAKLDLILGDTDNPHKIT

SEQ ID NO: 1696915 - protein, 24 aa, Staphylococcus aureus
KEMYDYYLYDFQIIKDYIKNKRNL

SEQ ID NO: 1696916 - protein, 20 aa, Staphylococcus aureus
KEMYDYYLYDFQVITDYIKD

SEQ ID NO: 1696917 - protein, 23 aa, Staphylococcus aureus
KENFNKILSLYPTKNLEDFYDKE

SEQ ID NO: 1696918 - protein, 24 aa, Staphylococcus aureus
KENFNKILSLYPTKNLEDFYDKEG

SEQ ID NO: 1696919 - protein, 24 aa, Staphylococcus aureus
KENIIEYLSYFQTSSPSYLIMASL

SEQ ID NO: 1696920 - protein, 24 aa, Staphylococcus aureus
KENKKFLLDLMLNNKSGDTLIKDG

SEQ ID NO: 1696921 - protein, 22 aa, Staphylococcus aureus
KEPFNQLGGYPYFDQIDPRTND

SEQ ID NO: 1696922 - protein, 20 aa, Staphylococcus aureus
KEQIYNYWKKKNPSLVTNSQ

SEQ ID NO: 1696923 - protein, 27 aa, Staphylococcus aureus
KEQTVLRKAYLESFRKGFKQQIENTKV

SEQ ID NO: 1696924 - protein, 25 aa, Staphylococcus aureus
KESATTDLYAYADQKKNNISADTNA

SEQ ID NO: 1696925 - protein, 32 aa, Staphylococcus aureus
KESFIEYLLFQYRFKSRIAVWVLNYIKVNEAK

SEQ ID NO: 1696926 - protein, 18 aa, Staphylococcus aureus
KESFYNVLNHRKSTRKFT

SEQ ID NO: 1696927 - protein, 25 aa, Staphylococcus aureus
KESLLKYLIRMSTRPTPFGLLSGIN

SEQ ID NO: 1696928 - protein, 25 aa, Staphylococcus aureus
KETFGDLYFMGVDEKFKYEDGEKTN

SEQ ID NO: 1696929 - protein, 17 aa, Staphylococcus aureus
KETYLESIKASLKRLED

SEQ ID NO: 1696930 - protein, 27 aa, Staphylococcus aureus
KETYNYPIILFYKRNINHLSYSHTLAV

SEQ ID NO: 1696931 - protein, 31 aa, Staphylococcus aureus
KEYAWAFLNELFYLIELYLKAFKGQKKTGHE

SEQ ID NO: 1696932 - protein, 20 aa, Staphylococcus aureus
KEYFDLNCYLTLLDVLDSHN

SEQ ID NO: 1696933 - protein, 22 aa, Staphylococcus aureus
KEYFNWLKQNYIFKELDSSTEI

SEQ ID NO: 1696934 - protein, 25 aa, Staphylococcus aureus
KEYKDEFLAAPAEIKFLLYFAKMTK

SEQ ID NO: 1696935 - protein, 19 aa, Staphylococcus aureus
KEYRKYYEPLIHKNDKEFK

SEQ ID NO: 1696936 - protein, 23 aa, Staphylococcus aureus
KEYRKYYEPLIHKNDKEFKEGME

SEQ ID NO: 1696937 - protein, 19 aa, Staphylococcus aureus
KEYRKYYEPLIRKNDKEFK

SEQ ID NO: 1696938 - protein, 19 aa, Staphylococcus aureus
KFDGIFLVATNPVDILVYA

SEQ ID NO: 1696939 - protein, 20 aa, Staphylococcus aureus
KFDHQLLNNLPAFKNKIPST

SEQ ID NO: 1696940 - protein, 29 aa, Staphylococcus aureus
KFEVKQEAATLWYHPHPSPNTAKQVYNGL

SEQ ID NO: 1696941 - protein, 17 aa, Staphylococcus aureus
KFEYLSRKSIRVIIYKG

SEQ ID NO: 1696942 - protein, 17 aa, Staphylococcus aureus
KFFVQYGNFKDINDYKN

SEQ ID NO: 1696943 - protein, 19 aa, Staphylococcus aureus
KFKAKYFQGFHNKFELKAE

SEQ ID NO: 1696944 - protein, 27 aa, Staphylococcus aureus
KFKEQVGYPLIVRPAFTMGGTGGGICH

SEQ ID NO: 1696945 - protein, 29 aa, Staphylococcus aureus
KFKSVDFVNLYFLHFLSTARTFYQYTENL

SEQ ID NO: 1696946 - protein, 45 aa, Staphylococcus aureus
KFKTTTIVFKFMAPLEYDTITARSLLSKLLVRATKKWPTDKLFNN

SEQ ID NO: 1696947 - protein, 17 aa, Staphylococcus aureus
KFLDLLSSRSSLREIQN

SEQ ID NO: 1696948 - protein, 18 aa, Staphylococcus aureus
KFLECVLVYKSDVEKELF

SEQ ID NO: 1696949 - protein, 18 aa, Staphylococcus aureus
KFLHLSVKETSGTKWEYI

SEQ ID NO: 1696950 - protein, 18 aa, Staphylococcus aureus
KFLKNTYVKTAYAGMVPY

SEQ ID NO: 1696951 - protein, 23 aa, Staphylococcus aureus
KFLSCKTIFYTAPPVRPSKIHKD

SEQ ID NO: 1696952 - protein, 25 aa, Staphylococcus aureus
KFRAKQIFEWLYQKRVDSIDEMTNL

SEQ ID NO: 1696953 - protein, 25 aa, Staphylococcus aureus
KFSKDYYLCELLAHLIEIPQTSYDY

SEQ ID NO: 1696954 - protein, 20 aa, Staphylococcus aureus
KFTIKVVLTDPYKYSVTGNK

SEQ ID NO: 1696955 - protein, 25 aa, Staphylococcus aureus
KFVAKQYLTIFKLSNAQNYKPILVQ

SEQ ID NO: 1696956 - protein, 18 aa, Staphylococcus aureus
KGAIAGELPYKAWIDNHK

SEQ ID NO: 1696957 - protein, 18 aa, Staphylococcus aureus
KGDIFLAWDAVQGDLPLS

SEQ ID NO: 1696958 - protein, 18 aa, Staphylococcus aureus
KGDNLIIINKDRTPYDSD

SEQ ID NO: 1696959 - protein, 37 aa, Staphylococcus aureus
KGDRVFIFMSRTPELYFALLGVLKIGAIVGPSFEAFM

SEQ ID NO: 1696960 - protein, 23 aa, Staphylococcus aureus
KGEDFGYLIYGIEDNTFNIVGTN

SEQ ID NO: 1696961 - protein, 25 aa, Staphylococcus aureus
KGEQQLPLFRYLTAAQHGFFNEKIK

SEQ ID NO: 1696962 - protein, 23 aa, Staphylococcus aureus
KGGLQFTYISLDDYRIIKSALYG

SEQ ID NO: 1696963 - protein, 24 aa, Staphylococcus aureus
KGGQLLESWLANHLVPRIDFKIHE

SEQ ID NO: 1696964 - protein, 24 aa, Staphylococcus aureus
KGHTVAFMHIPMLMDRIKATYNKN

SEQ ID NO: 1696965 - protein, 37 aa, Staphylococcus aureus
KGIEPQTLKLFKVCKLRGIPIFTFINKLDRVGKEPFE

SEQ ID NO: 1696966 - protein, 21 aa, Staphylococcus aureus
KGIFDYFLDTVGSNVTLYGLK

SEQ ID NO: 1696967 - protein, 21 aa, Staphylococcus aureus
KGIKYIPYFEQISVLEFIAKL

SEQ ID NO: 1696968 - protein, 24 aa, Staphylococcus aureus
KGKSIKFNGKLPHWSNDDPGKGNL

SEQ ID NO: 1696969 - protein, 20 aa, Staphylococcus aureus
KGKWNYLYRAIDAEGHTLHI

SEQ ID NO: 1696970 - protein, 21 aa, Staphylococcus aureus
KGLDGSRRFLDRVWRLIVNED

SEQ ID NO: 1696971 - protein, 18 aa, Staphylococcus aureus
KGLDKAIETLKESKPYLF

SEQ ID NO: 1696972 - protein, 23 aa, Staphylococcus aureus
KGLDSLLSIVQMPGGIPVATTAI

SEQ ID NO: 1696973 - protein, 20 aa, Staphylococcus aureus
KGLKVALPKEYLGEGVADDV

SEQ ID NO: 1696974 - protein, 22 aa, Staphylococcus aureus
KGNFRLIHRLFAQIDRIMDING

SEQ ID NO: 1696975 - protein, 17 aa, Staphylococcus aureus
KGNTLNTAMGALRTSIQ

SEQ ID NO: 1696976 - protein, 25 aa, Staphylococcus aureus
KGPIHFNLPFRDPLTPDLNAIELLT

SEQ ID NO: 1696977 - protein, 25 aa, Staphylococcus aureus
KGQSEPIVLVIFTNKDNKSDKPNDK

SEQ ID NO: 1696978 - protein, 17 aa, Staphylococcus aureus
KGRLLFHPRFEKELRAQ

SEQ ID NO: 1696979 - protein, 33 aa, Staphylococcus aureus
KGSKRQLVLQPWQHFIIGSLFGWVHKETKLRRY

SEQ ID NO: 1696980 - protein, 52 aa, Staphylococcus aureus
KGTINKPYLLEAPFWTVDTLFYCTPKKETDILFILSLFRKINWKVYDESTGV

SEQ ID NO: 1696981 - protein, 18 aa, Staphylococcus aureus
KGTSKWFSNSYKSLKDWT

SEQ ID NO: 1696982 - protein, 17 aa, Staphylococcus aureus
KGTWTILTGFSKSNKPG

SEQ ID NO: 1696983 - protein, 25 aa, Staphylococcus aureus
KGVYVVPAFVGLGTPYWDSEARGAI

SEQ ID NO: 1696984 - protein, 21 aa, Staphylococcus aureus
KGWMCIQVFFIRQGNMIKRDT

SEQ ID NO: 1696985 - protein, 23 aa, Staphylococcus aureus
KGWMCIQVFFIRQGNMIKRDTTM

SEQ ID NO: 1696986 - protein, 24 aa, Staphylococcus aureus
KGWMCIQVFFIRQGNMIKRDTTMI

SEQ ID NO: 1696987 - protein, 24 aa, Staphylococcus aureus
KGYFNFDFKTKRFDNLELKEGNDI

SEQ ID NO: 1696988 - protein, 17 aa, Staphylococcus aureus
KGYKFMVITDHSQSLRV

SEQ ID NO: 1696989 - protein, 17 aa, Staphylococcus aureus
KGYYFVKKFYEKDKLPD

SEQ ID NO: 1696990 - protein, 24 aa, Staphylococcus aureus
KHDALMLCEYLYDKGYGCLLNPND

SEQ ID NO: 1696991 - protein, 24 aa, Staphylococcus aureus
KHDINGNVPIFINIGEWDGDDDKL

SEQ ID NO: 1696992 - protein, 33 aa, Staphylococcus aureus
KHDINHYIQYLLQLGYPLDMITDLDFETLYQYM

SEQ ID NO: 1696993 - protein, 17 aa, Staphylococcus aureus
KHDKIIILPATSNTINK

SEQ ID NO: 1696994 - protein, 17 aa, Staphylococcus aureus
KHDNSFDIHLIPETRRS

SEQ ID NO: 1696995 - protein, 17 aa, Staphylococcus aureus
KHDVKIKMLTRLGLITN

SEQ ID NO: 1696996 - protein, 21 aa, Staphylococcus aureus
KHEALINGKRYPIRALMMSHM

SEQ ID NO: 1696997 - protein, 17 aa, Staphylococcus aureus
KHEIRYALENKIGYFVI

SEQ ID NO: 1696998 - protein, 27 aa, Staphylococcus aureus
KHESKQIFLMFNPVSKLNWVYKYFFAN

SEQ ID NO: 1696999 - protein, 18 aa, Staphylococcus aureus
KHFELMKDEALFINVGRG

SEQ ID NO: 1697000 - protein, 22 aa, Staphylococcus aureus
KHGIKMIYGMEGMLVDDGVPIA

SEQ ID NO: 1697001 - protein, 17 aa, Staphylococcus aureus
KHGTIRLLFKYRHKKKN

SEQ ID NO: 1697002 - protein, 24 aa, Staphylococcus aureus
KHIFKQHHPSRFFNFGIAEMASID

SEQ ID NO: 1697003 - protein, 18 aa, Staphylococcus aureus
KHIIAGFRKIFINDSQTN

SEQ ID NO: 1697004 - protein, 17 aa, Staphylococcus aureus
KHKSWRKVSFYEYNKKA

SEQ ID NO: 1697005 - protein, 17 aa, Staphylococcus aureus
KHLKNSGGIALLPEFIV

SEQ ID NO: 1697006 - protein, 31 aa, Staphylococcus aureus
KHLNEIVICISFLFLTIFIGGCGTGKEAEIK

SEQ ID NO: 1697007 - protein, 26 aa, Staphylococcus aureus
KHLPDMDVIISAPFYPAYMTRERIEK

SEQ ID NO: 1697008 - protein, 20 aa, Staphylococcus aureus
KHLPIGIIVLDENDHIEWVN

SEQ ID NO: 1697009 - protein, 21 aa, Staphylococcus aureus
KHLRLNNIYPIIVHGGGPFIN

SEQ ID NO: 1697010 - protein, 19 aa, Staphylococcus aureus
KHMLTLFRGGPTVWISNED

SEQ ID NO: 1697011 - protein, 29 aa, Staphylococcus aureus
KHNHVPPWILIIPLNFGETIKWLSILKPK

SEQ ID NO: 1697012 - protein, 26 aa, Staphylococcus aureus
KHNINEIYLIAHAFLESGYGTSNFAS

SEQ ID NO: 1697013 - protein, 19 aa, Staphylococcus aureus
KHPNHHMIAFDIAGGTADV

SEQ ID NO: 1697014 - protein, 18 aa, Staphylococcus aureus
KHQFPLKHINLGGGIGVN

SEQ ID NO: 1697015 - protein, 20 aa, Staphylococcus aureus
KHQILQHSLTIRQYEMQKQQ

SEQ ID NO: 1697016 - protein, 25 aa, Staphylococcus aureus
KHYRNVPSLSYFFLSLNKMIDYYTK

SEQ ID NO: 1697017 - protein, 22 aa, Staphylococcus aureus
KIAATKPEVIFISGRTANQKNL

SEQ ID NO: 1697018 - protein, 18 aa, Staphylococcus aureus
KIAEHFRMMAALYPNRID

SEQ ID NO: 1697019 - protein, 30 aa, Staphylococcus aureus
KIAKFYDFIEIQPPALYQDLIDRELIRDTE

SEQ ID NO: 1697020 - protein, 31 aa, Staphylococcus aureus
KIAKYYDFIEIQPPALYQDLIDRELIRDTET

SEQ ID NO: 1697021 - protein, 26 aa, Staphylococcus aureus
KIAMEKARLFALKHELKSEIQSMISD

SEQ ID NO: 1697022 - protein, 25 aa, Staphylococcus aureus
KIDEDKCLVVIPLNKAISESILNTI

SEQ ID NO: 1697023 - protein, 17 aa, Staphylococcus aureus
KIDFQIGTLSKAIGVVG

SEQ ID NO: 1697024 - protein, 19 aa, Staphylococcus aureus
KIDYVFADELLNHVSPPIK

SEQ ID NO: 1697025 - protein, 20 aa, Staphylococcus aureus
KIEFKIKKGIKWHDGNELKI

SEQ ID NO: 1697026 - protein, 22 aa, Staphylococcus aureus
KIENFKFFGQYANLKELRKYNN

SEQ ID NO: 1697027 - protein, 22 aa, Staphylococcus aureus
KIERGISDLDLKFAKQAKYTVY

SEQ ID NO: 1697028 - protein, 36 aa, Staphylococcus aureus
KIFQSIYMTWNSQKFFDLIKYFELPLQTKIKTFSRG

SEQ ID NO: 1697029 - protein, 17 aa, Staphylococcus aureus
KIFRKVKKLKRPDINLI

SEQ ID NO: 1697030 - protein, 19 aa, Staphylococcus aureus
KIGIVKIVSIIPENSMKDL

SEQ ID NO: 1697031 - protein, 20 aa, Staphylococcus aureus
KIIGIWNGMIKRQGTSGKVN

SEQ ID NO: 1697032 - protein, 25 aa, Staphylococcus aureus
KIIHLKNIHFVGLAFNFMCFKSDAP

SEQ ID NO: 1697033 - protein, 17 aa, Staphylococcus aureus
KIIVYYANKQYFFNNET

SEQ ID NO: 1697034 - protein, 30 aa, Staphylococcus aureus
KIKDILTEYNIRILDLPLTTGLVAEVGQGP

SEQ ID NO: 1697035 - protein, 20 aa, Staphylococcus aureus
KIKEMVPSFGYRLTDHEDLY

SEQ ID NO: 1697036 - protein, 34 aa, Staphylococcus aureus
KILFVAATAPFTPFYRALNWIVTDPLESIKEEIE

SEQ ID NO: 1697037 - protein, 17 aa, Staphylococcus aureus
KILKKHQLLDDAFRATQ

SEQ ID NO: 1697038 - protein, 17 aa, Staphylococcus aureus
KILLCDEATSALDPATT

SEQ ID NO: 1697039 - protein, 17 aa, Staphylococcus aureus
KILNFINEFIFADKLPS

SEQ ID NO: 1697040 - protein, 21 aa, Staphylococcus aureus
KILTQLNIRLLEQRISIEVSD

SEQ ID NO: 1697041 - protein, 22 aa, Staphylococcus aureus
KILTSNYLRFNSPKMYGELLKL

SEQ ID NO: 1697042 - protein, 18 aa, Staphylococcus aureus
KIPVLGFGVFQIPQEQTA

SEQ ID NO: 1697043 - protein, 25 aa, Staphylococcus aureus
KIQQGWFDFDVVVATPDMMGEVGKL

SEQ ID NO: 1697044 - protein, 33 aa, Staphylococcus aureus
KIQSSILTSIPLWKNQMAIALTLMRQRNAVAAQ

SEQ ID NO: 1697045 - protein, 22 aa, Staphylococcus aureus
KIQTIGVILPSLTNPFFSALMQ

SEQ ID NO: 1697046 - protein, 22 aa, Staphylococcus aureus
KIRDFIIIEAYMFRFKKKVKPE

SEQ ID NO: 1697047 - protein, 25 aa, Staphylococcus aureus
KIRQHLVKNYGLYKGTTKYGKITIN

SEQ ID NO: 1697048 - protein, 19 aa, Staphylococcus aureus
KISFIDKTRVLFNDINKFQ

SEQ ID NO: 1697049 - protein, 25 aa, Staphylococcus aureus
KISIILPNAILGVDLLFDVSRQKYI

SEQ ID NO: 1697050 - protein, 23 aa, Staphylococcus aureus
KIVDVIKYLINTIPKIRKNLRHA

SEQ ID NO: 1697051 - protein, 20 aa, Staphylococcus aureus
KIVIDLLLNLLDENKTMIVI

SEQ ID NO: 1697052 - protein, 20 aa, Staphylococcus aureus
KIVLHWLKEHNIQVDLLNLG

SEQ ID NO: 1697053 - protein, 24 aa, Staphylococcus aureus
KIVQPHAMAFNYVYYDIYTQMIEM

SEQ ID NO: 1697054 - protein, 18 aa, Staphylococcus aureus
KIYALRDVTGTVNSIPLI

SEQ ID NO: 1697055 - protein, 21 aa, Staphylococcus aureus
KIYIIAKVLNVSEAWLLGYDV

SEQ ID NO: 1697056 - protein, 24 aa, Staphylococcus aureus
KKAEHFHIFMGNDNDALLKEMDNW

SEQ ID NO: 1697057 - protein, 21 aa, Staphylococcus aureus
KKAIVYFYPRDNTPTCTTEAC

SEQ ID NO: 1697058 - protein, 17 aa, Staphylococcus aureus
KKAPYDERMPKIVIVID

SEQ ID NO: 1697059 - protein, 24 aa, Staphylococcus aureus
KKASKDIFFSERHLKRLEKDSFEY

SEQ ID NO: 1697060 - protein, 26 aa, Staphylococcus aureus
KKDDEGIYFYYLGTAGYIEGSEKQDK

SEQ ID NO: 1697061 - protein, 24 aa, Staphylococcus aureus
KKDIGMIFQHFNLLNSATVFKNVA

SEQ ID NO: 1697062 - protein, 32 aa, Staphylococcus aureus
KKDKIGYEIPFTRLFYKYTPPEPSEVISERIK

SEQ ID NO: 1697063 - protein, 25 aa, Staphylococcus aureus
KKDMDWIKKNYDLYSKLIAGAIHGK

SEQ ID NO: 1697064 - protein, 24 aa, Staphylococcus aureus
KKEALAKQLLLPDFATTKQDKIDS

SEQ ID NO: 1697065 - protein, 30 aa, Staphylococcus aureus
KKEAPYLKCGYIIPLQFGHFKETSLDFFVI

SEQ ID NO: 1697066 - protein, 22 aa, Staphylococcus aureus
KKEDFFNEFLGLYSIKEKDEFL

SEQ ID NO: 1697067 - protein, 18 aa, Staphylococcus aureus
KKEEKQKILIKQNKISKI

SEQ ID NO: 1697068 - protein, 25 aa, Staphylococcus aureus
KKEFIDFPVLFDDEGNFRKKQVIDY

SEQ ID NO: 1697069 - protein, 20 aa, Staphylococcus aureus
KKEILLRMFSNSKISMVYGA

SEQ ID NO: 1697070 - protein, 26 aa, Staphylococcus aureus
KKENPMIITSFRPFTKKWMYYDEAII

SEQ ID NO: 1697071 - protein, 24 aa, Staphylococcus aureus
KKENQWNAKFIDRGYIFTNTAGSP

SEQ ID NO: 1697072 - protein, 19 aa, Staphylococcus aureus
KKESPEILAFIRSFKKYIA

SEQ ID NO: 1697073 - protein, 22 aa, Staphylococcus aureus
KKFGAFVELPEGKSGLVHISEV

SEQ ID NO: 1697074 - protein, 20 aa, Staphylococcus aureus
KKFMHYLIKAQEHYQMTIVF

SEQ ID NO: 1697075 - protein, 36 aa, Staphylococcus aureus
KKGIAKLFDFMLPNSPINMPISKMNMFGLGNLMMRY

SEQ ID NO: 1697076 - protein, 35 aa, Staphylococcus aureus
KKGKPFSISSITYILANPFYIGKIQFAKYKDWSEK

SEQ ID NO: 1697077 - protein, 36 aa, Staphylococcus aureus
KKGKPFSISSITYILANPFYIGKIQFAKYKDWSEKR

SEQ ID NO: 1697078 - protein, 36 aa, Staphylococcus aureus
KKGTDILVESLFYNTPARLKYIKSLYTELGKITDIV

SEQ ID NO: 1697079 - protein, 24 aa, Staphylococcus aureus
KKGWPSMMYRIWKNPEKYKAYFIG

SEQ ID NO: 1697080 - protein, 21 aa, Staphylococcus aureus
KKIILEYMAVKKAVIRFLKSD

SEQ ID NO: 1697081 - protein, 26 aa, Staphylococcus aureus
KKKELNDALFYFNVPAEVQDVTEGPS

SEQ ID NO: 1697082 - protein, 27 aa, Staphylococcus aureus
KKKVDFYRYTLGYLFQNFALLDNQTIS

SEQ ID NO: 1697083 - protein, 17 aa, Staphylococcus aureus
KKLGLSLNIINKAKTMI

SEQ ID NO: 1697084 - protein, 25 aa, Staphylococcus aureus
KKLTDADVILYNGLNLETGNGWFEK

SEQ ID NO: 1697085 - protein, 27 aa, Staphylococcus aureus
KKMKTNDAFFFLYSDLKGNELKEELLY

SEQ ID NO: 1697086 - protein, 21 aa, Staphylococcus aureus
KKNKFLPNFDKQSIYSLRFDE

SEQ ID NO: 1697087 - protein, 18 aa, Staphylococcus aureus
KKNYKVFDFFQENGFGFI

SEQ ID NO: 1697088 - protein, 24 aa, Staphylococcus aureus
KKPSSFVIKPLPKNKYPDSIEEST

SEQ ID NO: 1697089 - protein, 20 aa, Staphylococcus aureus
KKQIHFLNYMKTKNLNHFIY

SEQ ID NO: 1697090 - protein, 27 aa, Staphylococcus aureus
KKRDEESYIFLYILGITGARYSDVINM

SEQ ID NO: 1697091 - protein, 23 aa, Staphylococcus aureus
KKRIENFKFFGQYANLKELKNYN

SEQ ID NO: 1697092 - protein, 19 aa, Staphylococcus aureus
KKRPHFQALTPLYPDERIK

SEQ ID NO: 1697093 - protein, 24 aa, Staphylococcus aureus
KKSTVPLFKTTRFNKPLIATKVKK

SEQ ID NO: 1697094 - protein, 23 aa, Staphylococcus aureus
KKSYFEVLGVPAGQVYPIAYEKD

SEQ ID NO: 1697095 - protein, 26 aa, Staphylococcus aureus
KKTDYPYFDLKWLLSQNNFEVFYGRD

SEQ ID NO: 1697096 - protein, 29 aa, Staphylococcus aureus
KKTKIIYDYFFVPMYIKDHNIYPMLGAVD

SEQ ID NO: 1697097 - protein, 20 aa, Staphylococcus aureus
KKVIRLKYWNKDKKLKIEQI

SEQ ID NO: 1697098 - protein, 26 aa, Staphylococcus aureus
KKVNDLEYPLFFMVTKNLSKKQELIS

SEQ ID NO: 1697099 - protein, 25 aa, Staphylococcus aureus
KKVQDYNEWLIKQPGYRTNFLNIDD

SEQ ID NO: 1697100 - protein, 26 aa, Staphylococcus aureus
KKYNLSKGLLNYRIAKGLTGDALIAP

SEQ ID NO: 1697101 - protein, 26 aa, Staphylococcus aureus
KKYNLSKGLLNYRISKGLTGDALIAP

SEQ ID NO: 1697102 - protein, 28 aa, Staphylococcus aureus
KKYPNCHQLIWQSALILDTHRLAKDILN

SEQ ID NO: 1697103 - protein, 33 aa, Staphylococcus aureus
KLAQAKQDALANLDTLRDLNQPQRDALRNQINQ

SEQ ID NO: 1697104 - protein, 33 aa, Staphylococcus aureus
KLAQAKQEALANLDTLRDLNQPQRDALRNQINQ

SEQ ID NO: 1697105 - protein, 18 aa, Staphylococcus aureus
KLATFFNVSLEKIDPRFS

SEQ ID NO: 1697106 - protein, 19 aa, Staphylococcus aureus
KLCGALLQYYRETGIYAER

SEQ ID NO: 1697107 - protein, 17 aa, Staphylococcus aureus
KLCHSLNGKIFIVKDMI

SEQ ID NO: 1697108 - protein, 17 aa, Staphylococcus aureus
KLDIEVSIMDFDRDEWA

SEQ ID NO: 1697109 - protein, 23 aa, Staphylococcus aureus
KLDLKKIKHPYLKKSFLEIVETL

SEQ ID NO: 1697110 - protein, 22 aa, Staphylococcus aureus
KLDLKKIKHPYLKKTFIEIVET

SEQ ID NO: 1697111 - protein, 31 aa, Staphylococcus aureus
KLDNAMGAVQQYIDEQHLGVISSTNYINADD

SEQ ID NO: 1697112 - protein, 20 aa, Staphylococcus aureus
KLEALYLQRHLLDELIRKNK

SEQ ID NO: 1697113 - protein, 21 aa, Staphylococcus aureus
KLERPWLTVVLDDFSRAIAGY

SEQ ID NO: 1697114 - protein, 20 aa, Staphylococcus aureus
KLETDLLQFIDAEELYKYPV

SEQ ID NO: 1697115 - protein, 17 aa, Staphylococcus aureus
KLFNFTPSNSKKVYTRS

SEQ ID NO: 1697116 - protein, 18 aa, Staphylococcus aureus
KLFSERYGKQNIAYATVH

SEQ ID NO: 1697117 - protein, 24 aa, Staphylococcus aureus
KLGLNITYLFEKPSVFKSLVSQIK

SEQ ID NO: 1697118 - protein, 31 aa, Staphylococcus aureus
KLHQQLTDMRLILGELIFTELIIVEMHDFFK

SEQ ID NO: 1697119 - protein, 20 aa, Staphylococcus aureus
KLICSWLKQIDNVIPQLITD

SEQ ID NO: 1697120 - protein, 19 aa, Staphylococcus aureus
KLIKIGVFGTFSAGKSSLI

SEQ ID NO: 1697121 - protein, 24 aa, Staphylococcus aureus
KLIKKGSWWFYPNDDTNRKPKFNH

SEQ ID NO: 1697122 - protein, 18 aa, Staphylococcus aureus
KLIKPTEYISDELTSKLK

SEQ ID NO: 1697123 - protein, 18 aa, Staphylococcus aureus
KLITTLYEKFFSTGFKTT

SEQ ID NO: 1697124 - protein, 23 aa, Staphylococcus aureus
KLKEPIIEHSTPIELEFKSEPPV

SEQ ID NO: 1697125 - protein, 28 aa, Staphylococcus aureus
KLKHFKPKRIVFWGIYEDYPKLVRLCST

SEQ ID NO: 1697126 - protein, 23 aa, Staphylococcus aureus
KLKNEIIRKYDLKPSIISNSIKQ

SEQ ID NO: 1697127 - protein, 22 aa, Staphylococcus aureus
KLKPYITIYAPKDGPKIFNNQL

SEQ ID NO: 1697128 - protein, 21 aa, Staphylococcus aureus
KLKQYHYVESGLFPDVYRHIG

SEQ ID NO: 1697129 - protein, 20 aa, Staphylococcus aureus
KLLFAEITSLSNKYGYCTAS

SEQ ID NO: 1697130 - protein, 24 aa, Staphylococcus aureus
KLLHDSIRLMWLAQNQTPSYKTIN

SEQ ID NO: 1697131 - protein, 18 aa, Staphylococcus aureus
KLLHDSIRMMWLAQNQTP

SEQ ID NO: 1697132 - protein, 19 aa, Staphylococcus aureus
KLLVKTLFIDEIKRQLTYY

SEQ ID NO: 1697133 - protein, 24 aa, Staphylococcus aureus
KLNHLYPEFNIWDAYSIYQLDEKQ

SEQ ID NO: 1697134 - protein, 23 aa, Staphylococcus aureus
KLNLELRIPIIIISGNHDGKERL

SEQ ID NO: 1697135 - protein, 34 aa, Staphylococcus aureus
KLNLENALKIELEFYFPLLKSWSKKKKSEMVGQY

SEQ ID NO: 1697136 - protein, 19 aa, Staphylococcus aureus
KLNMIIGHWGEFIPFFLER

SEQ ID NO: 1697137 - protein, 20 aa, Staphylococcus aureus
KLNPTPKWSIARYKGLGEMN

SEQ ID NO: 1697138 - protein, 19 aa, Staphylococcus aureus
KLNVSFPQAALGDEIKIPT

SEQ ID NO: 1697139 - protein, 27 aa, Staphylococcus aureus
KLRDENHIIYLFLGQFFTKNEDPWHQI

SEQ ID NO: 1697140 - protein, 25 aa, Staphylococcus aureus
KLRENNIKIIFRPLTPTIENAIKSE

SEQ ID NO: 1697141 - protein, 19 aa, Staphylococcus aureus
KLRQQIWQQFKQMTKDGKS

SEQ ID NO: 1697142 - protein, 21 aa, Staphylococcus aureus
KLRRPNLTFATLDHNVPTIDI

SEQ ID NO: 1697143 - protein, 21 aa, Staphylococcus aureus
KLSDKLTIAPISIFSDYTLEE

SEQ ID NO: 1697144 - protein, 21 aa, Staphylococcus aureus
KLSDYQLLTQFNPAFINKKIK

SEQ ID NO: 1697145 - protein, 20 aa, Staphylococcus aureus
KLSFTAGIRSVDDFQFDTDI

SEQ ID NO: 1697146 - protein, 20 aa, Staphylococcus aureus
KLSFVGHYNYLVLPRNLYEE

SEQ ID NO: 1697147 - protein, 28 aa, Staphylococcus aureus
KLSITDIMNYLFEIIDPYSVNQQGNDIG

SEQ ID NO: 1697148 - protein, 17 aa, Staphylococcus aureus
KLSRYYPQGLRSLNGGR

SEQ ID NO: 1697149 - protein, 17 aa, Staphylococcus aureus
KLTDLLDFMIPGYKKEG

SEQ ID NO: 1697150 - protein, 23 aa, Staphylococcus aureus
KLTQLNLIHKKIDTFNKICIITD

SEQ ID NO: 1697151 - protein, 25 aa, Staphylococcus aureus
KLVDGRFPDYRRVLPKNPDKHLEAG

SEQ ID NO: 1697152 - protein, 21 aa, Staphylococcus aureus
KLVEQGIYILKIFNPNLCKEV

SEQ ID NO: 1697153 - protein, 20 aa, Staphylococcus aureus
KLVHNGLFNILAELDFEDEA

SEQ ID NO: 1697154 - protein, 31 aa, Staphylococcus aureus
KLVIQTYFERVHLKFLSSLPVGGLGLDFVHD

SEQ ID NO: 1697155 - protein, 18 aa, Staphylococcus aureus
KLYDLFIQKLAERHTRPA

SEQ ID NO: 1697156 - protein, 25 aa, Staphylococcus aureus
KLYHHYVWEKYYGEIPPKHAVIFLN

SEQ ID NO: 1697157 - protein, 18 aa, Staphylococcus aureus
KLYIRDPQGDYLPSEEHY

SEQ ID NO: 1697158 - protein, 26 aa, Staphylococcus aureus
KLYKFLFEDPTFKTLPAKAKLLYALI

SEQ ID NO: 1697159 - protein, 25 aa, Staphylococcus aureus
KLYKGKHLLNDVPPHTINYGHIIDP

SEQ ID NO: 1697160 - protein, 25 aa, Staphylococcus aureus
KLYVSFDYIDWIKLGFGPSGKENYY

SEQ ID NO: 1697161 - protein, 18 aa, Staphylococcus aureus
KMAISDRFKLLQSQYTDE

SEQ ID NO: 1697162 - protein, 19 aa, Staphylococcus aureus
KMDEYLRPKTLFSGNFDNY

SEQ ID NO: 1697163 - protein, 18 aa, Staphylococcus aureus
KMFIENKYIRTLIIVTNY

SEQ ID NO: 1697164 - protein, 21 aa, Staphylococcus aureus
KMGLQIRHYTVQSLKLLKTHF

SEQ ID NO: 1697165 - protein, 29 aa, Staphylococcus aureus
KMKQDPLGDPIILIAPTQSTFQLEQAFVN

SEQ ID NO: 1697166 - protein, 23 aa, Staphylococcus aureus
KMMGEYIIYYDGVVIGGLYDNRL

SEQ ID NO: 1697167 - protein, 18 aa, Staphylococcus aureus
KMNKVIVIVLHDINFASC

SEQ ID NO: 1697168 - protein, 17 aa, Staphylococcus aureus
KMNQDLLVKCYLSCLKL

SEQ ID NO: 1697169 - protein, 19 aa, Staphylococcus aureus
KMRIYPEKLFGILAALRQN

SEQ ID NO: 1697170 - protein, 20 aa, Staphylococcus aureus
KMRRIYRRKLTYILNRLKPY

SEQ ID NO: 1697171 - protein, 28 aa, Staphylococcus aureus
KMSREEILILLTLWQKGFMTLKEMDRFV

SEQ ID NO: 1697172 - protein, 28 aa, Staphylococcus aureus
KMSREEILILLTLWQKGSMMLKEMDRFV

SEQ ID NO: 1697173 - protein, 29 aa, Staphylococcus aureus
KMTNAGQSVTYYFTDVKAPTVTVGNQTIE

SEQ ID NO: 1697174 - protein, 24 aa, Staphylococcus aureus
KMTNTLQVRLLSENARMPERNHKT

SEQ ID NO: 1697175 - protein, 22 aa, Staphylococcus aureus
KMVEIRRYLHQHPELSFHEDET

SEQ ID NO: 1697176 - protein, 23 aa, Staphylococcus aureus
KMVEIRRYLHQHPELSFHEDETA

SEQ ID NO: 1697177 - protein, 21 aa, Staphylococcus aureus
KMVEQIIRPTGLLDPKIEVRP

SEQ ID NO: 1697178 - protein, 17 aa, Staphylococcus aureus
KMYPLTQSSMPIDAKIN

SEQ ID NO: 1697179 - protein, 26 aa, Staphylococcus aureus
KNAIEMYYSLQNYYNTRIETIKVSEK

SEQ ID NO: 1697180 - protein, 20 aa, Staphylococcus aureus
KNAIKALANAKRDQINSNPD

SEQ ID NO: 1697181 - protein, 20 aa, Staphylococcus aureus
KNDEKYIENLTKQLDQQNSN

SEQ ID NO: 1697182 - protein, 28 aa, Staphylococcus aureus
KNEELNRFYLQHTLLPIVKQYEEEFNRK

SEQ ID NO: 1697183 - protein, 28 aa, Staphylococcus aureus
KNEELNRYYLQHTLLPIIKQYEEEFNRK

SEQ ID NO: 1697184 - protein, 20 aa, Staphylococcus aureus
KNELFKKLEFKQLLADIDQS

SEQ ID NO: 1697185 - protein, 17 aa, Staphylococcus aureus
KNEQSYSILFDRYQRDV

SEQ ID NO: 1697186 - protein, 17 aa, Staphylococcus aureus
KNEYEADPPLFFFSGPI

SEQ ID NO: 1697187 - protein, 19 aa, Staphylococcus aureus
KNEYFIKKWQRELEALYHI

SEQ ID NO: 1697188 - protein, 26 aa, Staphylococcus aureus
KNGSRPYYYSFKRNNNRVCIPFRTNA

SEQ ID NO: 1697189 - protein, 24 aa, Staphylococcus aureus
KNHWNDFIRIYADTLPNNEICLSD

SEQ ID NO: 1697190 - protein, 21 aa, Staphylococcus aureus
KNIALLFEKNSTRTRAAFTVA

SEQ ID NO: 1697191 - protein, 21 aa, Staphylococcus aureus
KNIEFYLIPTKGAAKVEKTLN

SEQ ID NO: 1697192 - protein, 19 aa, Staphylococcus aureus
KNIIDFISGYAFKSELFTI

SEQ ID NO: 1697193 - protein, 17 aa, Staphylococcus aureus
KNIKYRGFAINKEMLEE

SEQ ID NO: 1697194 - protein, 21 aa, Staphylococcus aureus
KNILTDLDYWQDGYIYSIQCY

SEQ ID NO: 1697195 - protein, 19 aa, Staphylococcus aureus
KNIRMPLSKMNMFGLRNMM

SEQ ID NO: 1697196 - protein, 25 aa, Staphylococcus aureus
KNKALRKYDYLINKIAFIDEYEEYI

SEQ ID NO: 1697197 - protein, 21 aa, Staphylococcus aureus
KNKLYWNGEINWFSPIEIGNK

SEQ ID NO: 1697198 - protein, 25 aa, Staphylococcus aureus
KNLDDYMHYLITKKEQLSKLIDSLM

SEQ ID NO: 1697199 - protein, 19 aa, Staphylococcus aureus
KNLGPLDDIMKMIPGMNKM

SEQ ID NO: 1697200 - protein, 27 aa, Staphylococcus aureus
KNLIGAFYRPTAVIYDLDFLKTLPFEQ

SEQ ID NO: 1697201 - protein, 25 aa, Staphylococcus aureus
KNMETRGMVLYINRNTRTTKGNFIV

SEQ ID NO: 1697202 - protein, 26 aa, Staphylococcus aureus
KNNESLLLKKYNLPEIDILKVGHHGS

SEQ ID NO: 1697203 - protein, 23 aa, Staphylococcus aureus
KNNGFIVFVRVKFYDGKDALKPN

SEQ ID NO: 1697204 - protein, 21 aa, Staphylococcus aureus
KNNHKLSYLQEFNLAIIRNLS

SEQ ID NO: 1697205 - protein, 22 aa, Staphylococcus aureus
KNNKFVRFKYRTGEITYGNEMQ

SEQ ID NO: 1697206 - protein, 18 aa, Staphylococcus aureus
KNNKFVRFQYRTGEITYG

SEQ ID NO: 1697207 - protein, 23 aa, Staphylococcus aureus
KNPFPSRWRYVVDILQQLLQTKK

SEQ ID NO: 1697208 - protein, 22 aa, Staphylococcus aureus
KNPGFLTVKKICDALQIDIANV

SEQ ID NO: 1697209 - protein, 20 aa, Staphylococcus aureus
KNQLAFIQAVEKHYKLYVNM

SEQ ID NO: 1697210 - protein, 25 aa, Staphylococcus aureus
KNQLFQNQLLQAIADKYNKSIAQVI

SEQ ID NO: 1697211 - protein, 31 aa, Staphylococcus aureus
KNRTWEFHITLPQFLAHEDYLLFINAIEQEF

SEQ ID NO: 1697212 - protein, 35 aa, Staphylococcus aureus
KNRTWEFHITLPQFLAHEDYLLFINAIEQEFKGIA

SEQ ID NO: 1697213 - protein, 31 aa, Staphylococcus aureus
KNRTWEFHITLPQFLAHEDYLLFLNAIEQEF

SEQ ID NO: 1697214 - protein, 20 aa, Staphylococcus aureus
KNTIYNHLYLKHIFESMPYL

SEQ ID NO: 1697215 - protein, 18 aa, Staphylococcus aureus
KNVDDIIISDFLTRYLIY

SEQ ID NO: 1697216 - protein, 19 aa, Staphylococcus aureus
KNVVNHFIAWMGYTKGTFV

SEQ ID NO: 1697217 - protein, 19 aa, Staphylococcus aureus
KNYDLIKDSPVYVDGVIKN

SEQ ID NO: 1697218 - protein, 26 aa, Staphylococcus aureus
KNYEHFRTVIQLLPKVIEQLRENGKQ

SEQ ID NO: 1697219 - protein, 24 aa, Staphylococcus aureus
KNYRDNSLWLFRGHSNLNWSLVPK

SEQ ID NO: 1697220 - protein, 20 aa, Staphylococcus aureus
KPDKILIFIDMRAKNEINKQ

SEQ ID NO: 1697221 - protein, 26 aa, Staphylococcus aureus
KPDWKIFQAIANKLGFDWNYKHPSEI

SEQ ID NO: 1697222 - protein, 20 aa, Staphylococcus aureus
KPEEYWIIEGEFRYKKSKFN

SEQ ID NO: 1697223 - protein, 20 aa, Staphylococcus aureus
KPHETWVPSLAMRLILGQMS

SEQ ID NO: 1697224 - protein, 23 aa, Staphylococcus aureus
KPHIVFMMTFPEDIKPIIKTLNN

SEQ ID NO: 1697225 - protein, 22 aa, Staphylococcus aureus
KPHIVFMMTFTEDIKPIIKALN

SEQ ID NO: 1697226 - protein, 20 aa, Staphylococcus aureus
KPIARLGYYDYTVVNEIFEM

SEQ ID NO: 1697227 - protein, 26 aa, Staphylococcus aureus
KPLNIKVIIVTTFKRPGYFEKAVAND

SEQ ID NO: 1697228 - protein, 27 aa, Staphylococcus aureus
KPLNIKVIIVTTFKRPGYFEKAVANDV

SEQ ID NO: 1697229 - protein, 19 aa, Staphylococcus aureus
KPMEWRGWVFLNEMLISEG

SEQ ID NO: 1697230 - protein, 21 aa, Staphylococcus aureus
KPMLFVSVVPTFSTSPNLTAP

SEQ ID NO: 1697231 - protein, 20 aa, Staphylococcus aureus
KPTFEDIPLLDLALSDEKVP

SEQ ID NO: 1697232 - protein, 17 aa, Staphylococcus aureus
KPVIREKMSRRKKTAAK

SEQ ID NO: 1697233 - protein, 22 aa, Staphylococcus aureus
KPYVDYQDVLNWIIKMNEHYVV

SEQ ID NO: 1697234 - protein, 25 aa, Staphylococcus aureus
KPYYKLNYLFECENKVFYDIKTSEL

SEQ ID NO: 1697235 - protein, 22 aa, Staphylococcus aureus
KQAEIFFDKNYPEQALNYSDDE

SEQ ID NO: 1697236 - protein, 18 aa, Staphylococcus aureus
KQAIGDHDTIVAGGNYTN

SEQ ID NO: 1697237 - protein, 18 aa, Staphylococcus aureus
KQALIDRVKKIKLGNGFD

SEQ ID NO: 1697238 - protein, 17 aa, Staphylococcus aureus
KQAVAKAEALISGTPDV

SEQ ID NO: 1697239 - protein, 24 aa, Staphylococcus aureus
KQCENELLRYPYIESFEDVDEVIQ

SEQ ID NO: 1697240 - protein, 27 aa, Staphylococcus aureus
KQDKLKIYKFFIIIAKYIKHNEQFFKD

SEQ ID NO: 1697241 - protein, 23 aa, Staphylococcus aureus
KQDPHAWLSLDNGIKYVKTIQQT

SEQ ID NO: 1697242 - protein, 18 aa, Staphylococcus aureus
KQEFLFVTELAPLTNAVM

SEQ ID NO: 1697243 - protein, 20 aa, Staphylococcus aureus
KQEGITIILVTHDIGVVADT

SEQ ID NO: 1697244 - protein, 20 aa, Staphylococcus aureus
KQEMVIPLTRRKRAIQLTEQ

SEQ ID NO: 1697245 - protein, 25 aa, Staphylococcus aureus
KQEQHALRQDYLSMIRGQVLTTFST

SEQ ID NO: 1697246 - protein, 19 aa, Staphylococcus aureus
KQFGKPISKYQLIQEKLAM

SEQ ID NO: 1697247 - protein, 29 aa, Staphylococcus aureus
KQGFDIEHLAKIKSLVNIPIIASGGGGNA

SEQ ID NO: 1697248 - protein, 17 aa, Staphylococcus aureus
KQGVNFTDADKAKRDAY

SEQ ID NO: 1697249 - protein, 29 aa, Staphylococcus aureus
KQHTQFIVDEILAIKLPAEATKVSPKEIQ

SEQ ID NO: 1697250 - protein, 19 aa, Staphylococcus aureus
KQILVGYFTISNKPLVFTK

SEQ ID NO: 1697251 - protein, 20 aa, Staphylococcus aureus
KQIVFSPEILSWIEQRNLNI

SEQ ID NO: 1697252 - protein, 28 aa, Staphylococcus aureus
KQKHLDAIIILSDYNRRYLSGFTGTSGA

SEQ ID NO: 1697253 - protein, 19 aa, Staphylococcus aureus
KQKLGIAIAFLNDPQFIIL

SEQ ID NO: 1697254 - protein, 18 aa, Staphylococcus aureus
KQLDTASHFVLIFARKNV

SEQ ID NO: 1697255 - protein, 20 aa, Staphylococcus aureus
KQLEDWLDYEITTLPYDMTL

SEQ ID NO: 1697256 - protein, 27 aa, Staphylococcus aureus
KQLHQQIELIKRLIPYVPKVELHMYGF

SEQ ID NO: 1697257 - protein, 23 aa, Staphylococcus aureus
KQLNAFIHHSNFKPGDKLPSVTQ

SEQ ID NO: 1697258 - protein, 25 aa, Staphylococcus aureus
KQLQLDFDITYLFITHDMGVINEIC

SEQ ID NO: 1697259 - protein, 24 aa, Staphylococcus aureus
KQLQLDFGITYLFITHDMGVINEI

SEQ ID NO: 1697260 - protein, 25 aa, Staphylococcus aureus
KQLRKRYDIPTKKAPKLLIKGDGDL

SEQ ID NO: 1697261 - protein, 18 aa, Staphylococcus aureus
KQLSLDLQILLWNMVKDR

SEQ ID NO: 1697262 - protein, 19 aa, Staphylococcus aureus
KQNANKFYKFAIYGKFGTG

SEQ ID NO: 1697263 - protein, 24 aa, Staphylococcus aureus
KQNANKFYKFAIYGRFGTGKTTFL

SEQ ID NO: 1697264 - protein, 24 aa, Staphylococcus aureus
KQNCLYVLIDPYLIENLRNAEGEI

SEQ ID NO: 1697265 - protein, 26 aa, Staphylococcus aureus
KQNIDQATKLQPIAELVDQATQLNQS

SEQ ID NO: 1697266 - protein, 25 aa, Staphylococcus aureus
KQPELPYIVVIVDELADLMMVAGKE

SEQ ID NO: 1697267 - protein, 22 aa, Staphylococcus aureus
KQPRVIFEKVFAEHFLNLYEKT

SEQ ID NO: 1697268 - protein, 25 aa, Staphylococcus aureus
KQQEDYCIILAYFYEGKPMLSYVYD

SEQ ID NO: 1697269 - protein, 24 aa, Staphylococcus aureus
KQQLNNMTHLTPAQKTNLTNQINS

SEQ ID NO: 1697270 - protein, 25 aa, Staphylococcus aureus
KQQVLEPYSIRRALPNYSFSHVRVG

SEQ ID NO: 1697271 - protein, 18 aa, Staphylococcus aureus
KQRDELIGDIAKLRERNK

SEQ ID NO: 1697272 - protein, 29 aa, Staphylococcus aureus
KQRVAIARALVTNPKILLCDEATSALDPA

SEQ ID NO: 1697273 - protein, 19 aa, Staphylococcus aureus
KQRVMIARALMGQPQVLIL

SEQ ID NO: 1697274 - protein, 30 aa, Staphylococcus aureus
KQSDKQFKVLYLVPSIQLLTQTLRGWNNDT

SEQ ID NO: 1697275 - protein, 20 aa, Staphylococcus aureus
KQSEYWFDEASKFLKQRDEL

SEQ ID NO: 1697276 - protein, 20 aa, Staphylococcus aureus
KQSIYSLRFDEMQNWLVEQG

SEQ ID NO: 1697277 - protein, 24 aa, Staphylococcus aureus
KQSKPILDFYDQKGVLKNIDGSKD

SEQ ID NO: 1697278 - protein, 30 aa, Staphylococcus aureus
KQSNRQFKVLYLVPSIQLLTQTLRGWNNDT

SEQ ID NO: 1697279 - protein, 23 aa, Staphylococcus aureus
KQTAFIIEQLVLGLDVALVSDAG

SEQ ID NO: 1697280 - protein, 25 aa, Staphylococcus aureus
KQTKITLFEALRAWLDDEIVADSWL

SEQ ID NO: 1697281 - protein, 22 aa, Staphylococcus aureus
KQTKWFPVVGQAVSASISYYFM

SEQ ID NO: 1697282 - protein, 20 aa, Staphylococcus aureus
KQTRQLAAIYLASGIDPDKA

SEQ ID NO: 1697283 - protein, 22 aa, Staphylococcus aureus
KQTRQLAAIYLASGIDPDKATL

SEQ ID NO: 1697284 - protein, 19 aa, Staphylococcus aureus
KQVQALIDEIDRNPNLTDK

SEQ ID NO: 1697285 - protein, 20 aa, Staphylococcus aureus
KQVYNGLSGLLYIEDDKKNN

SEQ ID NO: 1697286 - protein, 25 aa, Staphylococcus aureus
KQYGFKFLGPVTVFSFLAAAGLYDA

SEQ ID NO: 1697287 - protein, 19 aa, Staphylococcus aureus
KQYHLIQPVIGISSAGVVD

SEQ ID NO: 1697288 - protein, 30 aa, Staphylococcus aureus
KQYNKNEILSFYLNNIYFGDNQYTLEGAAN

SEQ ID NO: 1697289 - protein, 20 aa, Staphylococcus aureus
KQYTDMPFIIMLDEDENGYK

SEQ ID NO: 1697290 - protein, 33 aa, Staphylococcus aureus
KRARRDIEMLLGSKIYLELWVKVQRDWRNKVNF

SEQ ID NO: 1697291 - protein, 19 aa, Staphylococcus aureus
KRCLKLPEIFFSPKNDVYN

SEQ ID NO: 1697292 - protein, 18 aa, Staphylococcus aureus
KRDAVIKLGQLFENIREC

SEQ ID NO: 1697293 - protein, 18 aa, Staphylococcus aureus
KRDAVIKVGQLFENIREC

SEQ ID NO: 1697294 - protein, 23 aa, Staphylococcus aureus
KRELGFVLMALNIRKIVARRAVY

SEQ ID NO: 1697295 - protein, 17 aa, Staphylococcus aureus
KRHHRFVRYADDFVIFV

SEQ ID NO: 1697296 - protein, 23 aa, Staphylococcus aureus
KRHHRFVRYVDDFVIFVKTKRAG

SEQ ID NO: 1697297 - protein, 18 aa, Staphylococcus aureus
KRHPVDVCFVPIGDNFTM

SEQ ID NO: 1697298 - protein, 18 aa, Staphylococcus aureus
KRKDIYVKWQKYMNDELP

SEQ ID NO: 1697299 - protein, 18 aa, Staphylococcus aureus
KRKTVLSTLLEPLKNYKF

SEQ ID NO: 1697300 - protein, 18 aa, Staphylococcus aureus
KRKVYIKDIGRISELDFK

SEQ ID NO: 1697301 - protein, 20 aa, Staphylococcus aureus
KRLACLPSHIYRLKGFMRFE

SEQ ID NO: 1697302 - protein, 20 aa, Staphylococcus aureus
KRLFFVIENKIFSFNFPFSV

SEQ ID NO: 1697303 - protein, 17 aa, Staphylococcus aureus
KRLGIIFTPVEVVDFII

SEQ ID NO: 1697304 - protein, 21 aa, Staphylococcus aureus
KRLLELYKNYKGNITRFVAEN

SEQ ID NO: 1697305 - protein, 25 aa, Staphylococcus aureus
KRMKNYLYDIKYLLITHIHSDHVKP

SEQ ID NO: 1697306 - protein, 25 aa, Staphylococcus aureus
KRNEILQLMMLEPKIAILDEIDSGL

SEQ ID NO: 1697307 - protein, 19 aa, Staphylococcus aureus
KRNEQMIYIVNEKLTKKEL

SEQ ID NO: 1697308 - protein, 21 aa, Staphylococcus aureus
KRNIILLHYFMDMSDVEIAEL

SEQ ID NO: 1697309 - protein, 17 aa, Staphylococcus aureus
KRNLKWLTRRSRPGSFQ

SEQ ID NO: 1697310 - protein, 19 aa, Staphylococcus aureus
KRPDINLIDTKEISYLGWN

SEQ ID NO: 1697311 - protein, 28 aa, Staphylococcus aureus
KRQGLNKPNLLYLLKPAITKNDIYEIDK

SEQ ID NO: 1697312 - protein, 26 aa, Staphylococcus aureus
KRQGRQLLAYLGAPKQLYEKTPTADL

SEQ ID NO: 1697313 - protein, 18 aa, Staphylococcus aureus
KRRKLFNGYIECTYYQYW

SEQ ID NO: 1697314 - protein, 25 aa, Staphylococcus aureus
KRRKNSYFMPKWSLVNRLGNPNADK

SEQ ID NO: 1697315 - protein, 23 aa, Staphylococcus aureus
KRSEKLLHGMWQFPMFESEHAKR

SEQ ID NO: 1697316 - protein, 27 aa, Staphylococcus aureus
KRTALNYFLDLINKYTKFFIKDILSIQ

SEQ ID NO: 1697317 - protein, 19 aa, Staphylococcus aureus
KRTRSSLALFIMICTGCHV

SEQ ID NO: 1697318 - protein, 35 aa, Staphylococcus aureus
KRVETNGIATLKGVQPHIVIKPEVQQAIKASAENQ

SEQ ID NO: 1697319 - protein, 19 aa, Staphylococcus aureus
KRVINRAVPDALHEALLCL

SEQ ID NO: 1697320 - protein, 21 aa, Staphylococcus aureus
KRVLSHILGIELPNPSMIDES

SEQ ID NO: 1697321 - protein, 26 aa, Staphylococcus aureus
KRVPVTVNVYQFEFPQTSYTTTVGGT

SEQ ID NO: 1697322 - protein, 20 aa, Staphylococcus aureus
KSAILFASLFSKEPTIIKEL

SEQ ID NO: 1697323 - protein, 25 aa, Staphylococcus aureus
KSAPSLPILRGGQHYKLHFDFDATP

SEQ ID NO: 1697324 - protein, 29 aa, Staphylococcus aureus
KSARIFGAYRKGYFKRRLSMFGTVVFSVE

SEQ ID NO: 1697325 - protein, 18 aa, Staphylococcus aureus
KSDEKILLDQMVSHFKNF

SEQ ID NO: 1697326 - protein, 24 aa, Staphylococcus aureus
KSDLEIMGYFCLKIVNIKLEKDVS

SEQ ID NO: 1697327 - protein, 26 aa, Staphylococcus aureus
KSDLEIMGYFFLKIVNIKLEKDVSGK

SEQ ID NO: 1697328 - protein, 21 aa, Staphylococcus aureus
KSEDALYDEAYLFVVEQQKAS

SEQ ID NO: 1697329 - protein, 18 aa, Staphylococcus aureus
KSEIVVPIFKDDKIIGVL

SEQ ID NO: 1697330 - protein, 25 aa, Staphylococcus aureus
KSFAKTLDIYPIKNLEDLYDKEGYR

SEQ ID NO: 1697331 - protein, 22 aa, Staphylococcus aureus
KSFAKTLDMYPIKNLEGLYDKE

SEQ ID NO: 1697332 - protein, 17 aa, Staphylococcus aureus
KSFKDLVECSIGLLARE

SEQ ID NO: 1697333 - protein, 24 aa, Staphylococcus aureus
KSIFPSCRVAYMVLPYSIMKKYHS

SEQ ID NO: 1697334 - protein, 32 aa, Staphylococcus aureus
KSIGTGVTISPWNFPFAIMAGTTLAPVVAGNT

SEQ ID NO: 1697335 - protein, 26 aa, Staphylococcus aureus
KSIIGNGFAVIYLISQRLVKKSLDDG

SEQ ID NO: 1697336 - protein, 22 aa, Staphylococcus aureus
KSINPNLKGQLFKLLEFSNMEE

SEQ ID NO: 1697337 - protein, 20 aa, Staphylococcus aureus
KSIPLYEESYILLAPKETFK

SEQ ID NO: 1697338 - protein, 22 aa, Staphylococcus aureus
KSKDNGKIIKNHKWMTGNELKA

SEQ ID NO: 1697339 - protein, 25 aa, Staphylococcus aureus
KSKEYIILDFQFVLYILQKAYKENE

SEQ ID NO: 1697340 - protein, 24 aa, Staphylococcus aureus
KSKFNQIFIFTHSWNDFCDITYRL

SEQ ID NO: 1697341 - protein, 23 aa, Staphylococcus aureus
KSKHFTISFYLTTHSIPETYGVI

SEQ ID NO: 1697342 - protein, 19 aa, Staphylococcus aureus
KSKLSVTTTLFSKKKNYTK

SEQ ID NO: 1697343 - protein, 32 aa, Staphylococcus aureus
KSKQAPVYLYPNTDKVPGLNRFAFTLSNADNA

SEQ ID NO: 1697344 - protein, 26 aa, Staphylococcus aureus
KSLVKLFKTFPTKIIGLLKLFENNND

SEQ ID NO: 1697345 - protein, 24 aa, Staphylococcus aureus
KSMYYNNINGIYKGSILKPSEAKK

SEQ ID NO: 1697346 - protein, 34 aa, Staphylococcus aureus
KSNDLLGLTHERYSYIFDTLKKNKQEFLKDIEEI

SEQ ID NO: 1697347 - protein, 24 aa, Staphylococcus aureus
KSNDSIYIFKYNDAPILSVETLEE

SEQ ID NO: 1697348 - protein, 20 aa, Staphylococcus aureus
KSNKLLYKHISERLKNTIEI

SEQ ID NO: 1697349 - protein, 27 aa, Staphylococcus aureus
KSNMYSYNLISLMIEYLRFANCTQELI

SEQ ID NO: 1697350 - protein, 17 aa, Staphylococcus aureus
KSNSIAWLAYHLASLHS

SEQ ID NO: 1697351 - protein, 29 aa, Staphylococcus aureus
KSNVIRVLFDEGFIALRPSGTEPKIKLYV

SEQ ID NO: 1697352 - protein, 21 aa, Staphylococcus aureus
KSNVRFVIHYNMPGDLESYYQ

SEQ ID NO: 1697353 - protein, 31 aa, Staphylococcus aureus
KSNYSIDALYQFLFEFIFDIEERYIRMYVQL

SEQ ID NO: 1697354 - protein, 22 aa, Staphylococcus aureus
KSPVLKLHIDGDIKGSSIGYKN

SEQ ID NO: 1697355 - protein, 30 aa, Staphylococcus aureus
KSQEDAYIEKFLMSLYLYEMASQTSMQFDV

SEQ ID NO: 1697356 - protein, 30 aa, Staphylococcus aureus
KSQEDAYIEKFLMSLYLYETASQTSMQFDV

SEQ ID NO: 1697357 - protein, 29 aa, Staphylococcus aureus
KSQEDTYIEKFLMSLYLYEMASQTSMQFD

SEQ ID NO: 1697358 - protein, 28 aa, Staphylococcus aureus
KSQRFKSIKKKLPLINRFIGLTGTSSPN

SEQ ID NO: 1697359 - protein, 20 aa, Staphylococcus aureus
KSQYFKKLVIEGLIRERKSN

SEQ ID NO: 1697360 - protein, 17 aa, Staphylococcus aureus
KSRPYVVTTLFSTKDNF

SEQ ID NO: 1697361 - protein, 26 aa, Staphylococcus aureus
KSSTMRVDTLIKRRLSQMALDKDTSI

SEQ ID NO: 1697362 - protein, 26 aa, Staphylococcus aureus
KSSVGLLNSLLLYAKYEFEPEKRTIG

SEQ ID NO: 1697363 - protein, 22 aa, Staphylococcus aureus
KSTLLKALSRLLAVKEGEVFLD

SEQ ID NO: 1697364 - protein, 19 aa, Staphylococcus aureus
KSVKKLYFLEGIDAIEKIE

SEQ ID NO: 1697365 - protein, 17 aa, Staphylococcus aureus
KSYSRGTVVYVKLGSNI

SEQ ID NO: 1697366 - protein, 19 aa, Staphylococcus aureus
KTAYAGMVPYFTKNVNKIK

SEQ ID NO: 1697367 - protein, 27 aa, Staphylococcus aureus
KTEIQQQIWYWLERFDITENRKKRIDS

SEQ ID NO: 1697368 - protein, 22 aa, Staphylococcus aureus
KTERFYQLPKYLFEDAYFKKMS

SEQ ID NO: 1697369 - protein, 20 aa, Staphylococcus aureus
KTETLNSINFTDADQAKKDD

SEQ ID NO: 1697370 - protein, 24 aa, Staphylococcus aureus
KTFDYIFHHYLENSDLRPKTKRRK

SEQ ID NO: 1697371 - protein, 21 aa, Staphylococcus aureus
KTFLKFMNANYMMRGRILTNE

SEQ ID NO: 1697372 - protein, 33 aa, Staphylococcus aureus
KTHHTHGLRFYIKKGFLMIELPSGRALAYPKAS

SEQ ID NO: 1697373 - protein, 21 aa, Staphylococcus aureus
KTIFSKYRWNKSFKAYKRSSD

SEQ ID NO: 1697374 - protein, 25 aa, Staphylococcus aureus
KTINAPMVGTFYKSPSPDEEAYVVV

SEQ ID NO: 1697375 - protein, 17 aa, Staphylococcus aureus
KTKDKYIRPVRKRIGMV

SEQ ID NO: 1697376 - protein, 21 aa, Staphylococcus aureus
KTKIFITLFAYYDENSRKDYF

SEQ ID NO: 1697377 - protein, 30 aa, Staphylococcus aureus
KTKQLEINLPKWMHYALKMYQIAPRFFERC

SEQ ID NO: 1697378 - protein, 18 aa, Staphylococcus aureus
KTMARGYRREEVDAFLDD

SEQ ID NO: 1697379 - protein, 22 aa, Staphylococcus aureus
KTNIDFMSDYYFYLIETGQKEQ

SEQ ID NO: 1697380 - protein, 25 aa, Staphylococcus aureus
KTNKPIVRIYPLPFNPDEYADDSEF

SEQ ID NO: 1697381 - protein, 21 aa, Staphylococcus aureus
KTPNRYFIDPTTLGEGGLKEY

SEQ ID NO: 1697382 - protein, 17 aa, Staphylococcus aureus
KTRLRMLNHFPKPTFED

SEQ ID NO: 1697383 - protein, 23 aa, Staphylococcus aureus
KTRYNDWFERMINYGFEENIDYT

SEQ ID NO: 1697384 - protein, 26 aa, Staphylococcus aureus
KTSIATMIHLIQRKLQKNSAYLGTNG

SEQ ID NO: 1697385 - protein, 30 aa, Staphylococcus aureus
KTTAINFIYRIMKYDWANILVVRRFSNTNK

SEQ ID NO: 1697386 - protein, 24 aa, Staphylococcus aureus
KTTLTEKLLYFSGAIREAGTVKGK

SEQ ID NO: 1697387 - protein, 24 aa, Staphylococcus aureus
KTTTIRMLLGLIKPTKGNIKIFEK

SEQ ID NO: 1697388 - protein, 25 aa, Staphylococcus aureus
KTTTIVFKFMAPLEYDTITARSLLS

SEQ ID NO: 1697389 - protein, 27 aa, Staphylococcus aureus
KTVHIALMHDWLKGKIIVDSLGLHSNN

SEQ ID NO: 1697390 - protein, 23 aa, Staphylococcus aureus
KTVIDYYHRFVERFPTVEILSQA

SEQ ID NO: 1697391 - protein, 32 aa, Staphylococcus aureus
KTYKDFLDTTAKFHNYSINNIMLIAGQNPEAT

SEQ ID NO: 1697392 - protein, 29 aa, Staphylococcus aureus
KVARELIELIIAFMFHHQIPMSIETSKLL

SEQ ID NO: 1697393 - protein, 31 aa, Staphylococcus aureus
KVARELIELIIAFMFHHQIPMSLETSKLLSE

SEQ ID NO: 1697394 - protein, 29 aa, Staphylococcus aureus
KVARELIELIIAFMFHHQIPMSVETSKLL

SEQ ID NO: 1697395 - protein, 27 aa, Staphylococcus aureus
KVDAGTYWYNDPYTLDFMRKDLKEKLI

SEQ ID NO: 1697396 - protein, 23 aa, Staphylococcus aureus
KVDDSIWRSMLEHVNWNMIDNGV

SEQ ID NO: 1697397 - protein, 24 aa, Staphylococcus aureus
KVDDSIWRSMLEHVNWNMIDNGVA

SEQ ID NO: 1697398 - protein, 20 aa, Staphylococcus aureus
KVDGEWLYKLISYIESIDEY

SEQ ID NO: 1697399 - protein, 17 aa, Staphylococcus aureus
KVDVDKLPKKGIDITHG

SEQ ID NO: 1697400 - protein, 28 aa, Staphylococcus aureus
KVDVTAELEINLFIDPKTVQTNGNQTIT

SEQ ID NO: 1697401 - protein, 21 aa, Staphylococcus aureus
KVEFGKHYARLRPKKLKANIE

SEQ ID NO: 1697402 - protein, 19 aa, Staphylococcus aureus
KVFIEVTAYQIMYEFQNHS

SEQ ID NO: 1697403 - protein, 17 aa, Staphylococcus aureus
KVFLKDGNVVGAVLYGD

SEQ ID NO: 1697404 - protein, 27 aa, Staphylococcus aureus
KVFNEMLKILFIKLMDERNHTSRIADF

SEQ ID NO: 1697405 - protein, 26 aa, Staphylococcus aureus
KVFVKRKEMGSWSDWSELALNDYNTP

SEQ ID NO: 1697406 - protein, 17 aa, Staphylococcus aureus
KVFYSALGFDILGFEKN

SEQ ID NO: 1697407 - protein, 35 aa, Staphylococcus aureus
KVGSKRYLFIEYIPDNVLNCKPDFWKTLKYKKDKV

SEQ ID NO: 1697408 - protein, 26 aa, Staphylococcus aureus
KVGSKRYLFIEYIPDNVLNCKSDFWK

SEQ ID NO: 1697409 - protein, 17 aa, Staphylococcus aureus
KVHAQAFFTQHGSNNVV

SEQ ID NO: 1697410 - protein, 21 aa, Staphylococcus aureus
KVIENIPLLQVRSKEILAFVN

SEQ ID NO: 1697411 - protein, 22 aa, Staphylococcus aureus
KVIHDFQMFNLSDLASIYNDDA

SEQ ID NO: 1697412 - protein, 26 aa, Staphylococcus aureus
KVISGTQFIIELLGVNADQFRQLFIL

SEQ ID NO: 1697413 - protein, 25 aa, Staphylococcus aureus
KVITEWEIMGLRKVKIGKTIRYDRQ

SEQ ID NO: 1697414 - protein, 24 aa, Staphylococcus aureus
KVKDVLLIMAKFQEELVQPIADHQ

SEQ ID NO: 1697415 - protein, 17 aa, Staphylococcus aureus
KVKKYGFLDITIDDIFF

SEQ ID NO: 1697416 - protein, 20 aa, Staphylococcus aureus
KVLAPLFDNHDVAPNQVAIV

SEQ ID NO: 1697417 - protein, 22 aa, Staphylococcus aureus
KVLEGLEFMGVYWDPKKNENLL

SEQ ID NO: 1697418 - protein, 28 aa, Staphylococcus aureus
KVLEKDFNYIYVINLKGSLSGLSSEAIK

SEQ ID NO: 1697419 - protein, 18 aa, Staphylococcus aureus
KVLGFYPTNANTNAFRPG

SEQ ID NO: 1697420 - protein, 17 aa, Staphylococcus aureus
KVLMIFGPEGGLSENEI

SEQ ID NO: 1697421 - protein, 26 aa, Staphylococcus aureus
KVMQDSFKLLVTYRTKLQGGYGQFIN

SEQ ID NO: 1697422 - protein, 26 aa, Staphylococcus aureus
KVNQTEVTVFFLNGFQMKGVIEEYDK

SEQ ID NO: 1697423 - protein, 17 aa, Staphylococcus aureus
KVNRFLDLFDESLFVKV

SEQ ID NO: 1697424 - protein, 23 aa, Staphylococcus aureus
KVNYLTETLGFDAGIDYKKADFA

SEQ ID NO: 1697425 - protein, 22 aa, Staphylococcus aureus
KVNYLTETLGFDAGIDYKKEDF

SEQ ID NO: 1697426 - protein, 17 aa, Staphylococcus aureus
KVPKYIVYAFYKEYCDE

SEQ ID NO: 1697427 - protein, 21 aa, Staphylococcus aureus
KVPVNIFMAIIASESQWGKGE

SEQ ID NO: 1697428 - protein, 25 aa, Staphylococcus aureus
KVQPYCFKLYNDPFDMCYVVMNSKL

SEQ ID NO: 1697429 - protein, 25 aa, Staphylococcus aureus
KVRLQLALLMLQRDNVLILDEPTNH

SEQ ID NO: 1697430 - protein, 23 aa, Staphylococcus aureus
KVSFDYIDWIKLGFGPSGKENYY

SEQ ID NO: 1697431 - protein, 18 aa, Staphylococcus aureus
KVSYALMKLTPKELECFI

SEQ ID NO: 1697432 - protein, 24 aa, Staphylococcus aureus
KVTAWMPLMRNRGLLDDPVIVKIA

SEQ ID NO: 1697433 - protein, 17 aa, Staphylococcus aureus
KVTPEYLLLKNRQPENE

SEQ ID NO: 1697434 - protein, 18 aa, Staphylococcus aureus
KVVKLDRSHPFVNALDEV

SEQ ID NO: 1697435 - protein, 34 aa, Staphylococcus aureus
KVYAGNIQIWKKPSSFVIKPLPKNKYPDSIEDST

SEQ ID NO: 1697436 - protein, 19 aa, Staphylococcus aureus
KVYAGNLQVWKKPSSFVIK

SEQ ID NO: 1697437 - protein, 22 aa, Staphylococcus aureus
KVYGLTVLDTWWMTETGGHMIV

SEQ ID NO: 1697438 - protein, 17 aa, Staphylococcus aureus
KVYVGNYDFWYQSSQLA

SEQ ID NO: 1697439 - protein, 18 aa, Staphylococcus aureus
KVYVGNYDFWYQSSQLAQ

SEQ ID NO: 1697440 - protein, 26 aa, Staphylococcus aureus
KYAKKAYYTVYFKNGGKRILQLNSKK

SEQ ID NO: 1697441 - protein, 25 aa, Staphylococcus aureus
KYAQFAITILRTYYNFCRPFKSADK

SEQ ID NO: 1697442 - protein, 17 aa, Staphylococcus aureus
KYDHYRIGLNKAIQYLS

SEQ ID NO: 1697443 - protein, 18 aa, Staphylococcus aureus
KYDIDFITGHSLGGREAV

SEQ ID NO: 1697444 - protein, 31 aa, Staphylococcus aureus
KYDINHYIQYLIQLGYPLDMITDLDFETLYE

SEQ ID NO: 1697445 - protein, 18 aa, Staphylococcus aureus
KYDNLYKFFKDNEKKYQY

SEQ ID NO: 1697446 - protein, 18 aa, Staphylococcus aureus
KYDSMIILYGGQGVGKST

SEQ ID NO: 1697447 - protein, 22 aa, Staphylococcus aureus
KYGKYQLQVFSAYKTTTKDNYI

SEQ ID NO: 1697448 - protein, 21 aa, Staphylococcus aureus
KYGSPLPLMHLYKMFRPFVNE

SEQ ID NO: 1697449 - protein, 23 aa, Staphylococcus aureus
KYHISPELLRYRYKHKMRGDELL

SEQ ID NO: 1697450 - protein, 21 aa, Staphylococcus aureus
KYHLHDSWLKVDGRLNKILKG

SEQ ID NO: 1697451 - protein, 21 aa, Staphylococcus aureus
KYHLHDSWLKVDGRLNKMLKG

SEQ ID NO: 1697452 - protein, 22 aa, Staphylococcus aureus
KYHYFTKLLNLLKHEQVTYLID

SEQ ID NO: 1697453 - protein, 25 aa, Staphylococcus aureus
KYIEPKVAHYLPKDYVYAPIQTTKS

SEQ ID NO: 1697454 - protein, 23 aa, Staphylococcus aureus
KYIGQFKTGYFSPLANLARLTEE

SEQ ID NO: 1697455 - protein, 19 aa, Staphylococcus aureus
KYIKRILNEEVRADNYFVY

SEQ ID NO: 1697456 - protein, 20 aa, Staphylococcus aureus
KYKLVISRYSRVLYAIYMCV

SEQ ID NO: 1697457 - protein, 21 aa, Staphylococcus aureus
KYKMPVIYSTHPRSWKKIEES

SEQ ID NO: 1697458 - protein, 17 aa, Staphylococcus aureus
KYKNLIKEISPVDLTDL

SEQ ID NO: 1697459 - protein, 22 aa, Staphylococcus aureus
KYLARISELCNVQISIFSVGPD

SEQ ID NO: 1697460 - protein, 25 aa, Staphylococcus aureus
KYLDEYFRNVLGEKSYLILIDDFSG

SEQ ID NO: 1697461 - protein, 20 aa, Staphylococcus aureus
KYLKFIFNKDEEKNNIMFIL

SEQ ID NO: 1697462 - protein, 33 aa, Staphylococcus aureus
KYLKMNFDLKWEYYLRLFLNLISAQNNSAILKE

SEQ ID NO: 1697463 - protein, 25 aa, Staphylococcus aureus
KYLNDDWWHELDYWLNKRKSENEQI

SEQ ID NO: 1697464 - protein, 27 aa, Staphylococcus aureus
KYNGLKQAIAGLTPDLAPLQAAKTQLQ

SEQ ID NO: 1697465 - protein, 24 aa, Staphylococcus aureus
KYQSVLDLIRRLGKRTGITFTAHI

SEQ ID NO: 1697466 - protein, 21 aa, Staphylococcus aureus
KYRTWAWNYGRNPKYNFEREE

SEQ ID NO: 1697467 - protein, 20 aa, Staphylococcus aureus
KYTLITIVNYDFYQSEQGRN

SEQ ID NO: 1697468 - protein, 23 aa, Staphylococcus aureus
KYVTRFIVGYLTRNPITITHKDE

SEQ ID NO: 1697469 - protein, 20 aa, Staphylococcus aureus
KYYEPLIRKNDKEFKEGMER

SEQ ID NO: 1697470 - protein, 17 aa, Staphylococcus aureus
KYYMITESGLKELKVFK

SEQ ID NO: 1697471 - protein, 21 aa, Staphylococcus aureus
KYYNPTELSVYAIGKLEGKEF

SEQ ID NO: 1697472 - protein, 19 aa, Staphylococcus aureus
LAALKILNPDFTMGHSLGE

SEQ ID NO: 1697473 - protein, 18 aa, Staphylococcus aureus
LAAMIEGCYVLRAIEMVG

SEQ ID NO: 1697474 - protein, 23 aa, Staphylococcus aureus
LACLVTIIERKTRYLYACRLDSR

SEQ ID NO: 1697475 - protein, 18 aa, Staphylococcus aureus
LADFALTPDVAIIDSQFV

SEQ ID NO: 1697476 - protein, 17 aa, Staphylococcus aureus
LADGNYLNADPDKQNAY

SEQ ID NO: 1697477 - protein, 18 aa, Staphylococcus aureus
LADLGIKNAGLRLKFLKS

SEQ ID NO: 1697478 - protein, 24 aa, Staphylococcus aureus
LADLLPEHRIIINKQPLSIEPAIT

SEQ ID NO: 1697479 - protein, 21 aa, Staphylococcus aureus
LADMEVWMAFRNDIHEYGQST

SEQ ID NO: 1697480 - protein, 35 aa, Staphylococcus aureus
LADQLQLYYQILHGNPLFINKYWVQRTTATGIAEN

SEQ ID NO: 1697481 - protein, 24 aa, Staphylococcus aureus
LADRPLDEVALAKLIDTFRHTYQS

SEQ ID NO: 1697482 - protein, 25 aa, Staphylococcus aureus
LADVLIAFDVLSDVELLVLVESLSD

SEQ ID NO: 1697483 - protein, 25 aa, Staphylococcus aureus
LAELENILIALDRFSNYAELRLSVD

SEQ ID NO: 1697484 - protein, 31 aa, Staphylococcus aureus
LAENPELAVKPFYQLVYDIKTHRGYFRISRE

SEQ ID NO: 1697485 - protein, 24 aa, Staphylococcus aureus
LAEQLVTFIPHSLLTLHNEKYNIQ

SEQ ID NO: 1697486 - protein, 32 aa, Staphylococcus aureus
LAFKVMTDPYVGKLTFFRVYSGTMTSGSYVKN

SEQ ID NO: 1697487 - protein, 18 aa, Staphylococcus aureus
LAGDALLTKAFELISSDD

SEQ ID NO: 1697488 - protein, 17 aa, Staphylococcus aureus
LAGIKHAFYNIKGETRN

SEQ ID NO: 1697489 - protein, 18 aa, Staphylococcus aureus
LAHREFGNWLKNINLDRT

SEQ ID NO: 1697490 - protein, 19 aa, Staphylococcus aureus
LAIIFGRTKRRVDELTSAL

SEQ ID NO: 1697491 - protein, 26 aa, Staphylococcus aureus
LAKGLNIIGLINIQFVIAHDGVYVLE

SEQ ID NO: 1697492 - protein, 22 aa, Staphylococcus aureus
LAKIIERYERFLGKQAYAIPSQ

SEQ ID NO: 1697493 - protein, 25 aa, Staphylococcus aureus
LAKNYNIPLYLGKTLSNMKGTWIMA

SEQ ID NO: 1697494 - protein, 23 aa, Staphylococcus aureus
LALKGIAYRKFDTAKEIITSVLE

SEQ ID NO: 1697495 - protein, 19 aa, Staphylococcus aureus
LALRAQYLFESNIDYFVYN

SEQ ID NO: 1697496 - protein, 19 aa, Staphylococcus aureus
LALRAQYLFESNVDYFVYN

SEQ ID NO: 1697497 - protein, 20 aa, Staphylococcus aureus
LAMEWEQVVPDIYILGKALG

SEQ ID NO: 1697498 - protein, 17 aa, Staphylococcus aureus
LANKVFDLTIDSGKMYL

SEQ ID NO: 1697499 - protein, 17 aa, Staphylococcus aureus
LANVYLALDNELELLPV

SEQ ID NO: 1697500 - protein, 27 aa, Staphylococcus aureus
LANYIAQYPNCFVGFATLPINEPEAAA

SEQ ID NO: 1697501 - protein, 21 aa, Staphylococcus aureus
LAPPNFYRQCKLGWGPNIEKL

SEQ ID NO: 1697502 - protein, 19 aa, Staphylococcus aureus
LAQAKQDALANLDTLRDLN

SEQ ID NO: 1697503 - protein, 20 aa, Staphylococcus aureus
LAQAKQDALANLDTLRDLNQ

SEQ ID NO: 1697504 - protein, 23 aa, Staphylococcus aureus
LAQEEIFGPVLTVIKVKDDQEAI

SEQ ID NO: 1697505 - protein, 28 aa, Staphylococcus aureus
LAQGKKGLFIVPLNGLKKWLTSVEMWQN

SEQ ID NO: 1697506 - protein, 25 aa, Staphylococcus aureus
LAQYQRILKQKNNYLKQLQLGQKKD

SEQ ID NO: 1697507 - protein, 19 aa, Staphylococcus aureus
LARTNIGHIILIDKDDVDI

SEQ ID NO: 1697508 - protein, 17 aa, Staphylococcus aureus
LASLDLYAPVRNITSSR

SEQ ID NO: 1697509 - protein, 23 aa, Staphylococcus aureus
LATDKEFYIFHSLIQGRSYKDIS

SEQ ID NO: 1697510 - protein, 25 aa, Staphylococcus aureus
LAVGLLVDKKLSYMRIHSINIKEFE

SEQ ID NO: 1697511 - protein, 17 aa, Staphylococcus aureus
LAVKVLAQLFSKIKPDV

SEQ ID NO: 1697512 - protein, 17 aa, Staphylococcus aureus
LAYLLAALMYNIETGKH

SEQ ID NO: 1697513 - protein, 25 aa, Staphylococcus aureus
LCKIEADVPIYYYGFKDSDDIYAQN

SEQ ID NO: 1697514 - protein, 19 aa, Staphylococcus aureus
LCKVCKQYQLPLFMDGARL

SEQ ID NO: 1697515 - protein, 25 aa, Staphylococcus aureus
LCSGNGVIPLLLFAKHRRHIEGVEI

SEQ ID NO: 1697516 - protein, 22 aa, Staphylococcus aureus
LCTTYKMVLDFYIELSSNTVKG

SEQ ID NO: 1697517 - protein, 21 aa, Staphylococcus aureus
LDACLTPMLAPFTTITHMIGV

SEQ ID NO: 1697518 - protein, 22 aa, Staphylococcus aureus
LDDALNYYLFYLKIGIMRTPIL

SEQ ID NO: 1697519 - protein, 28 aa, Staphylococcus aureus
LDDALYDGLIFKNPAYKVNYKAGKPTKS

SEQ ID NO: 1697520 - protein, 23 aa, Staphylococcus aureus
LDDHQNMIFAFEESYGFLSEPFV

SEQ ID NO: 1697521 - protein, 19 aa, Staphylococcus aureus
LDDIHVATMLKQAIHHANH

SEQ ID NO: 1697522 - protein, 22 aa, Staphylococcus aureus
LDDIHVATMLKQAIHHTNHPKE

SEQ ID NO: 1697523 - protein, 18 aa, Staphylococcus aureus
LDDLTSVGFIFPNDNKKV

SEQ ID NO: 1697524 - protein, 23 aa, Staphylococcus aureus
LDDYQNMIFAFEESYGFLSDPFV

SEQ ID NO: 1697525 - protein, 22 aa, Staphylococcus aureus
LDELMTFYNYKEIKTPIFESTD

SEQ ID NO: 1697526 - protein, 20 aa, Staphylococcus aureus
LDEVLLSTSSLFLPQTLYFQ

SEQ ID NO: 1697527 - protein, 17 aa, Staphylococcus aureus
LDFKLRKQLIEKHNLYG

SEQ ID NO: 1697528 - protein, 19 aa, Staphylococcus aureus
LDFKLRKQLIEKHNLYGNM

SEQ ID NO: 1697529 - protein, 17 aa, Staphylococcus aureus
LDGQQNLQRAKTEATNA

SEQ ID NO: 1697530 - protein, 21 aa, Staphylococcus aureus
LDGWYGFQCYDYANMFFMLAT

SEQ ID NO: 1697531 - protein, 23 aa, Staphylococcus aureus
LDHDYIFINLKDSYFGHPLKYQS

SEQ ID NO: 1697532 - protein, 18 aa, Staphylococcus aureus
LDHRNVLGVLPTGGGKSI

SEQ ID NO: 1697533 - protein, 19 aa, Staphylococcus aureus
LDIDTLLPAIGQGALGIEC

SEQ ID NO: 1697534 - protein, 24 aa, Staphylococcus aureus
LDIDYGTYPFVTSSNPIAGNVTVG

SEQ ID NO: 1697535 - protein, 17 aa, Staphylococcus aureus
LDILVDRMKKEFNVECN

SEQ ID NO: 1697536 - protein, 17 aa, Staphylococcus aureus
LDKAQVEQLTHAFKQAK

SEQ ID NO: 1697537 - protein, 26 aa, Staphylococcus aureus
LDKCFYKYYGLNKLINLLIKEKPDLI

SEQ ID NO: 1697538 - protein, 18 aa, Staphylococcus aureus
LDMKGGLTDTFTNAFSSG

SEQ ID NO: 1697539 - protein, 23 aa, Staphylococcus aureus
LDMRLRYMLLPMCLDIEHSLKTD

SEQ ID NO: 1697540 - protein, 27 aa, Staphylococcus aureus
LDNAMGAVQQYIDEQHLGVISSTNYIN

SEQ ID NO: 1697541 - protein, 24 aa, Staphylococcus aureus
LDNIAFLSMLLTKKHLLILEACML

SEQ ID NO: 1697542 - protein, 22 aa, Staphylococcus aureus
LDNINDYTIPTGKKESATTDLY

SEQ ID NO: 1697543 - protein, 28 aa, Staphylococcus aureus
LDNTLGKWEPFLNDLKAVSPILDNHLDD

SEQ ID NO: 1697544 - protein, 17 aa, Staphylococcus aureus
LDPWTSCEFDFTREGKL

SEQ ID NO: 1697545 - protein, 18 aa, Staphylococcus aureus
LDQAMNTLRQSIANKDAT

SEQ ID NO: 1697546 - protein, 18 aa, Staphylococcus aureus
LDQETVGLLIVAKNPLMK

SEQ ID NO: 1697547 - protein, 25 aa, Staphylococcus aureus
LDQVNWVGFYLLEQNELILGPFQGH

SEQ ID NO: 1697548 - protein, 20 aa, Staphylococcus aureus
LDSYLNIDRIISAAQITGAN

SEQ ID NO: 1697549 - protein, 28 aa, Staphylococcus aureus
LDTALSIRMYYALFLNKPIITTDDTFTA

SEQ ID NO: 1697550 - protein, 25 aa, Staphylococcus aureus
LDTLKQLYYLSKQLKYDLYDIFFEM

SEQ ID NO: 1697551 - protein, 24 aa, Staphylococcus aureus
LDTNDFVYQVQLPEGVEYVNNSLT

SEQ ID NO: 1697552 - protein, 21 aa, Staphylococcus aureus
LDVKYKDGIGNYYANLNGSIE

SEQ ID NO: 1697553 - protein, 30 aa, Staphylococcus aureus
LDVQEGLRVYWYYDLIDNEIKIVCIDPQHL

SEQ ID NO: 1697554 - protein, 24 aa, Staphylococcus aureus
LDVRDVDAPPYWYKNINYQHDLDT

SEQ ID NO: 1697555 - protein, 19 aa, Staphylococcus aureus
LDYVWDQYPLMNEKDIRAV

SEQ ID NO: 1697556 - protein, 27 aa, Staphylococcus aureus
LEAQLFVVQILFQYLFSQGRLKDAKNY

SEQ ID NO: 1697557 - protein, 27 aa, Staphylococcus aureus
LEAQLFVVQILFQYLFSQGRLKDTKNY

SEQ ID NO: 1697558 - protein, 23 aa, Staphylococcus aureus
LEAYKYVINGKSAIEWIMDQYQV

SEQ ID NO: 1697559 - protein, 25 aa, Staphylococcus aureus
LEDIDLKELVLPLIVLDFSTEVASN

SEQ ID NO: 1697560 - protein, 17 aa, Staphylococcus aureus
LEELGVKFADRGLLEVD

SEQ ID NO: 1697561 - protein, 21 aa, Staphylococcus aureus
LEELLVLNAIHIPLHAGKIEE

SEQ ID NO: 1697562 - protein, 18 aa, Staphylococcus aureus
LEEYVNVRGVPLRLVDTA

SEQ ID NO: 1697563 - protein, 17 aa, Staphylococcus aureus
LEFGLYSLGDHLLNPFK

SEQ ID NO: 1697564 - protein, 22 aa, Staphylococcus aureus
LEFIIYPFKMNLSRVSKGFTII

SEQ ID NO: 1697565 - protein, 17 aa, Staphylococcus aureus
LEGLFKTLLNKNSQVVF

SEQ ID NO: 1697566 - protein, 30 aa, Staphylococcus aureus
LEHALKIELDFYFPLLKSWSKKKKNEMVGQ

SEQ ID NO: 1697567 - protein, 28 aa, Staphylococcus aureus
LEIPHEMKLVPNWVLWRAEWNEKQQNFG

SEQ ID NO: 1697568 - protein, 20 aa, Staphylococcus aureus
LEKDAYIVRLVFAGSTTTEP

SEQ ID NO: 1697569 - protein, 37 aa, Staphylococcus aureus
LEKEDYILPGYRDVPQIIWHGLPLTEAFLFSRGHFKG

SEQ ID NO: 1697570 - protein, 28 aa, Staphylococcus aureus
LEKGTSYHKILIKNFNLWQAQREDSLLD

SEQ ID NO: 1697571 - protein, 28 aa, Staphylococcus aureus
LEKLSDKLFIPIFLYDTNLKDELYYQDL

SEQ ID NO: 1697572 - protein, 22 aa, Staphylococcus aureus
LEKWYQIEYLKEMVTLVVVNRD

SEQ ID NO: 1697573 - protein, 22 aa, Staphylococcus aureus
LEKYKQLILDDKMLVVAVRDKS

SEQ ID NO: 1697574 - protein, 25 aa, Staphylococcus aureus
LEKYTLLTMHGLFNQLKLGIISIDN

SEQ ID NO: 1697575 - protein, 22 aa, Staphylococcus aureus
LELLIAIVSVKFDINYSLKPLK

SEQ ID NO: 1697576 - protein, 18 aa, Staphylococcus aureus
LELLLQHLSNFDLDSQLL

SEQ ID NO: 1697577 - protein, 19 aa, Staphylococcus aureus
LENFVKYIKENAGPSWKYL

SEQ ID NO: 1697578 - protein, 18 aa, Staphylococcus aureus
LENMWRTLKNELLGRYEH

SEQ ID NO: 1697579 - protein, 18 aa, Staphylococcus aureus
LENRNIDFFLNNPGAETY

SEQ ID NO: 1697580 - protein, 17 aa, Staphylococcus aureus
LENTFFPTKAFYILNDG

SEQ ID NO: 1697581 - protein, 21 aa, Staphylococcus aureus
LEPWTSCEFDFTKKSKLKVSF

SEQ ID NO: 1697582 - protein, 21 aa, Staphylococcus aureus
LEPWTSCEFDFTRDGKLNVSF

SEQ ID NO: 1697583 - protein, 17 aa, Staphylococcus aureus
LEQNWLGGAYWNPPEVT

SEQ ID NO: 1697584 - protein, 22 aa, Staphylococcus aureus
LETAAGFLMDKEIKFIGGVVND

SEQ ID NO: 1697585 - protein, 17 aa, Staphylococcus aureus
LETIIDEFFGEIGQQRP

SEQ ID NO: 1697586 - protein, 18 aa, Staphylococcus aureus
LETIQFPYFDSDGDGIFN

SEQ ID NO: 1697587 - protein, 18 aa, Staphylococcus aureus
LETKVLTMGFIDDLLYPD

SEQ ID NO: 1697588 - protein, 17 aa, Staphylococcus aureus
LETYYSWAFYEIVSAVT

SEQ ID NO: 1697589 - protein, 17 aa, Staphylococcus aureus
LEVFPQIIKATLMEDFT

SEQ ID NO: 1697590 - protein, 20 aa, Staphylococcus aureus
LEVPVKVYPVANAKAPSRDV

SEQ ID NO: 1697591 - protein, 25 aa, Staphylococcus aureus
LEVRKISNVFLYNKSKDKAKVFKSK

SEQ ID NO: 1697592 - protein, 17 aa, Staphylococcus aureus
LEYPWCNELDDLSNGLA

SEQ ID NO: 1697593 - protein, 32 aa, Staphylococcus aureus
LFAQLFTVDILYYRFVALNYHAILDCITQSKM

SEQ ID NO: 1697594 - protein, 28 aa, Staphylococcus aureus
LFAQMFTIDILYYRYVSLNYHASLDFIT

SEQ ID NO: 1697595 - protein, 17 aa, Staphylococcus aureus
LFDAVLMTIKYIMRESK

SEQ ID NO: 1697596 - protein, 19 aa, Staphylococcus aureus
LFDAVLMTIKYVMRESKVN

SEQ ID NO: 1697597 - protein, 20 aa, Staphylococcus aureus
LFESLSESESLDESESLPES

SEQ ID NO: 1697598 - protein, 32 aa, Staphylococcus aureus
LFESLSESESLSDPVSLVESESESLAESESLS

SEQ ID NO: 1697599 - protein, 33 aa, Staphylococcus aureus
LFESLSESESLSDPVSLVESESESLAESESLSE

SEQ ID NO: 1697600 - protein, 35 aa, Staphylococcus aureus
LFESLSESESLSDPVSLVESESESLAESESLSESE

SEQ ID NO: 1697601 - protein, 17 aa, Staphylococcus aureus
LFHPRFEKELRAQGIVH

SEQ ID NO: 1697602 - protein, 17 aa, Staphylococcus aureus
LFIALGIRDAIQHSSQD

SEQ ID NO: 1697603 - protein, 18 aa, Staphylococcus aureus
LFNDDHYFIFPKNRRDDV

SEQ ID NO: 1697604 - protein, 26 aa, Staphylococcus aureus
LFNDTPLNEVLLSTSSLFLPQTLYFQ

SEQ ID NO: 1697605 - protein, 26 aa, Staphylococcus aureus
LFNEGQKVNIIIIASGLYSDTIGAFD

SEQ ID NO: 1697606 - protein, 21 aa, Staphylococcus aureus
LFNEIAFVLDDFRNDDDYLTI

SEQ ID NO: 1697607 - protein, 26 aa, Staphylococcus aureus
LFNNTPLDEVLLSTSSLFLPQTLFLQ

SEQ ID NO: 1697608 - protein, 28 aa, Staphylococcus aureus
LFNTSDNPRFKRWVIGSILSRTYYHNMV

SEQ ID NO: 1697609 - protein, 18 aa, Staphylococcus aureus
LFNYIIDVVKARGAEVIL

SEQ ID NO: 1697610 - protein, 31 aa, Staphylococcus aureus
LFSFSSNLNNKALFGDLWAAKFAPTQMDESD

SEQ ID NO: 1697611 - protein, 24 aa, Staphylococcus aureus
LGAKRVMPLTVSGPFHSSLMKVIE

SEQ ID NO: 1697612 - protein, 19 aa, Staphylococcus aureus
LGDQTYEFFCQAGKDVDAL

SEQ ID NO: 1697613 - protein, 30 aa, Staphylococcus aureus; identical to SEQ ID NO: 1592789

SEQ ID NO: 1697614 - protein, 17 aa, Staphylococcus aureus
LGFQFKYSNLKIALEDL

SEQ ID NO: 1697615 - protein, 20 aa, Staphylococcus aureus
LGFVLMALNIRKIVARRAVY

SEQ ID NO: 1697616 - protein, 17 aa, Staphylococcus aureus
LGGAKFIRNEYFENNQL

SEQ ID NO: 1697617 - protein, 28 aa, Staphylococcus aureus
LGGEMLSFYDWYADLPLASPQIWGEQTD

SEQ ID NO: 1697618 - protein, 18 aa, Staphylococcus aureus
LGGIIYTHIAKDGKMSGP

SEQ ID NO: 1697619 - protein, 20 aa, Staphylococcus aureus
LGIEILGGRMNTLIERNTTI

SEQ ID NO: 1697620 - protein, 17 aa, Staphylococcus aureus
LGIIFTPVEVVDFIIKS

SEQ ID NO: 1697621 - protein, 25 aa, Staphylococcus aureus
LGKGKTVITVLPSNGERYLSTPLYS

SEQ ID NO: 1697622 - protein, 22 aa, Staphylococcus aureus
LGKSGLLVVYVVDDSTARATWY

SEQ ID NO: 1697623 - protein, 27 aa, Staphylococcus aureus
LGMAKEDIIGYYMLSVLSLEDEFKLEE

SEQ ID NO: 1697624 - protein, 28 aa, Staphylococcus aureus
LGPQDSYLLVRGIKTLGLRMKQINRSVI

SEQ ID NO: 1697625 - protein, 23 aa, Staphylococcus aureus
LGQENYYNYRKFGIIPEMEYEME

SEQ ID NO: 1697626 - protein, 21 aa, Staphylococcus aureus
LGQPSYFPIPEVIGVRLVNSL

SEQ ID NO: 1697627 - protein, 23 aa, Staphylococcus aureus
LGQYNEPILFDAPLMEQYDFVED

SEQ ID NO: 1697628 - protein, 18 aa, Staphylococcus aureus
LGRENYYMYKKFGVIPEM

SEQ ID NO: 1697629 - protein, 19 aa, Staphylococcus aureus
LGRYENYCFKIRELHPESK

SEQ ID NO: 1697630 - protein, 30 aa, Staphylococcus aureus
LGTALTYSERYFLMKFFGLPTDEDDADAKQ

SEQ ID NO: 1697631 - protein, 18 aa, Staphylococcus aureus
LGVNVRICTPKSLNPKDA

SEQ ID NO: 1697632 - protein, 27 aa, Staphylococcus aureus
LGVSKHTLIKWKKNIPDFLDAIKKGKE

SEQ ID NO: 1697633 - protein, 17 aa, Staphylococcus aureus
LHAGADIRHGLFCAGIE

SEQ ID NO: 1697634 - protein, 19 aa, Staphylococcus aureus
LHAPYGMRLAEYKEIVLSK

SEQ ID NO: 1697635 - protein, 24 aa, Staphylococcus aureus
LHDKLWNNAQYLKNGLSKLGYDTG

SEQ ID NO: 1697636 - protein, 26 aa, Staphylococcus aureus
LHDKYPQAFIHMIGFSRGGLQGLLTF

SEQ ID NO: 1697637 - protein, 21 aa, Staphylococcus aureus
LHEPYDLQKILLGGAKLSASM

SEQ ID NO: 1697638 - protein, 25 aa, Staphylococcus aureus
LHERHIYPFILYYQKQLIAIGYIDE

SEQ ID NO: 1697639 - protein, 24 aa, Staphylococcus aureus
LHFKDIIEYFRPGDTLVLNDTRVM

SEQ ID NO: 1697640 - protein, 19 aa, Staphylococcus aureus
LHKANEVGYLLYRPTENTT

SEQ ID NO: 1697641 - protein, 18 aa, Staphylococcus aureus
LHLPGLSIMKRMTRIAQT

SEQ ID NO: 1697642 - protein, 18 aa, Staphylococcus aureus
LHMGGRIGVLTVVEGSTD

SEQ ID NO: 1697643 - protein, 24 aa, Staphylococcus aureus
LHNLFKAITLKGPCYLHYYLQGYD

SEQ ID NO: 1697644 - protein, 17 aa, Staphylococcus aureus
LHSGIDGLLIGEALMRC

SEQ ID NO: 1697645 - protein, 22 aa, Staphylococcus aureus
LIAHTFYATEFDFPKALRKEEI

SEQ ID NO: 1697646 - protein, 22 aa, Staphylococcus aureus
LIAHTFYATEFDFPKVLRKEEI

SEQ ID NO: 1697647 - protein, 25 aa, Staphylococcus aureus
LIAKALLEYLPFDLTCTYYSYQFDG

SEQ ID NO: 1697648 - protein, 19 aa, Staphylococcus aureus
LIDAEELFNLVYNANPKTT

SEQ ID NO: 1697649 - protein, 20 aa, Staphylococcus aureus
LIDAVQPFVKQKLIFLVGMA

SEQ ID NO: 1697650 - protein, 19 aa, Staphylococcus aureus
LIDYSLYIKKGLVEPFIVF

SEQ ID NO: 1697651 - protein, 17 aa, Staphylococcus aureus
LIEILDKSTLTEINIED

SEQ ID NO: 1697652 - protein, 18 aa, Staphylococcus aureus
LIELSQWLDENSIDLHII

SEQ ID NO: 1697653 - protein, 18 aa, Staphylococcus aureus
LIESLFIQFHSQCLKQNL

SEQ ID NO: 1697654 - protein, 18 aa, Staphylococcus aureus
LIGILDKSTLTEINIEDT

SEQ ID NO: 1697655 - protein, 23 aa, Staphylococcus aureus
LIGNVLHFYLPTYEYNFNFNKRQ

SEQ ID NO: 1697656 - protein, 21 aa, Staphylococcus aureus
LIGYDDYYYIDPLWSHIRRGL

SEQ ID NO: 1697657 - protein, 17 aa, Staphylococcus aureus
LIGYPLVLKPTNTASSQ

SEQ ID NO: 1697658 - protein, 20 aa, Staphylococcus aureus
LIGYTPWGIIDIVSFTTGEM

SEQ ID NO: 1697659 - protein, 17 aa, Staphylococcus aureus
LIHFQEGIQLEVDEPFS

SEQ ID NO: 1697660 - protein, 18 aa, Staphylococcus aureus
LIHSWMNSDIHRSRLLNS

SEQ ID NO: 1697661 - protein, 19 aa, Staphylococcus aureus
LIIINKDRTPYDSDATLVI

SEQ ID NO: 1697662 - protein, 21 aa, Staphylococcus aureus
LIKDVADIFYLTEEDLLPLDR

SEQ ID NO: 1697663 - protein, 18 aa, Staphylococcus aureus
LIKEFPNIQLHLYGFGKE

SEQ ID NO: 1697664 - protein, 18 aa, Staphylococcus aureus
LIKQHMFCNVPIDKGIMI

SEQ ID NO: 1697665 - protein, 25 aa, Staphylococcus aureus
LIKSIQYCLGSNLKAFPKGWDYKNY

SEQ ID NO: 1697666 - protein, 26 aa, Staphylococcus aureus
LIMMPRSIATYELYIADLKLGVAIIP

SEQ ID NO: 1697667 - protein, 20 aa, Staphylococcus aureus
LINDVVIPQLPLVDIHQYIE

SEQ ID NO: 1697668 - protein, 19 aa, Staphylococcus aureus
LINKYPEIKKSMKSDFIAY

SEQ ID NO: 1697669 - protein, 28 aa, Staphylococcus aureus
LINNNFKRYVFFTNSFRKEMITKSSMTT

SEQ ID NO: 1697670 - protein, 22 aa, Staphylococcus aureus
LIPELQGRFPLRVELDSLSVED

SEQ ID NO: 1697671 - protein, 18 aa, Staphylococcus aureus
LIPHRGIVRLVHQNHYLP

SEQ ID NO: 1697672 - protein, 17 aa, Staphylococcus aureus
LIQKFEIDIYDIPMQAL

SEQ ID NO: 1697673 - protein, 18 aa, Staphylococcus aureus
LIQLKRGLSFERKKQILI

SEQ ID NO: 1697674 - protein, 18 aa, Staphylococcus aureus
LIQNILNQFNLKLVDKEI

SEQ ID NO: 1697675 - protein, 17 aa, Staphylococcus aureus
LIQWAWDNRKLSGNKRF

SEQ ID NO: 1697676 - protein, 25 aa, Staphylococcus aureus
LIRLIAADLVGFDWLDGFDIECRNE

SEQ ID NO: 1697677 - protein, 20 aa, Staphylococcus aureus
LIRMMLKDPIVMLADEPTGA

SEQ ID NO: 1697678 - protein, 19 aa, Staphylococcus aureus
LISYKYLNDKVKSVLKIER

SEQ ID NO: 1697679 - protein, 17 aa, Staphylococcus aureus
LIVLNHAPNLRTFLHRY

SEQ ID NO: 1697680 - protein, 20 aa, Staphylococcus aureus
LIWSRFTTAQIHLLLKTFPS

SEQ ID NO: 1697681 - protein, 21 aa, Staphylococcus aureus
LKAARRWAYDVKGIEPNKAEI

SEQ ID NO: 1697682 - protein, 17 aa, Staphylococcus aureus
LKAKLKLYEQMISNACT

SEQ ID NO: 1697683 - protein, 28 aa, Staphylococcus aureus
LKALKKWKYPRKVLWLRKVQATITDSLF

SEQ ID NO: 1697684 - protein, 21 aa, Staphylococcus aureus
LKALPPVFIAHCNGDYDVPVE

SEQ ID NO: 1697685 - protein, 17 aa, Staphylococcus aureus
LKAYGAELVLTPGLEAM

SEQ ID NO: 1697686 - protein, 19 aa, Staphylococcus aureus
LKDGFPFGSILLYEYENDN

SEQ ID NO: 1697687 - protein, 17 aa, Staphylococcus aureus
LKDLELRIAKALPNVDR

SEQ ID NO: 1697688 - protein, 24 aa, Staphylococcus aureus
LKECGLILGIDLLDHIIIGDNRFT

SEQ ID NO: 1697689 - protein, 25 aa, Staphylococcus aureus
LKECGLILGIDLLDHIIIGDNRFTS

SEQ ID NO: 1697690 - protein, 26 aa, Staphylococcus aureus
LKEELYKIFMYVKTFYFQHTPFDDSY

SEQ ID NO: 1697691 - protein, 18 aa, Staphylococcus aureus
LKEIRYTRDLFNKHLSMN

SEQ ID NO: 1697692 - protein, 25 aa, Staphylococcus aureus
LKEMDNWPTYYPSKLNKDQIKEEML

SEQ ID NO: 1697693 - protein, 36 aa, Staphylococcus aureus
LKEQYKGIGILYKNQQWYFVVVNIASKLVKLLNISK

SEQ ID NO: 1697694 - protein, 21 aa, Staphylococcus aureus
LKESGLILGIDLLDHIIIGDN

SEQ ID NO: 1697695 - protein, 17 aa, Staphylococcus aureus
LKGIECIYALYKKNRRS

SEQ ID NO: 1697696 - protein, 25 aa, Staphylococcus aureus
LKGKKAIIYFYPRDNTPTCTIEACD

SEQ ID NO: 1697697 - protein, 24 aa, Staphylococcus aureus
LKGKKTIIYFYPRDNTPTCTTEAC

SEQ ID NO: 1697698 - protein, 26 aa, Staphylococcus aureus
LKIAVSVLIRAIFLKINAITIAINNI

SEQ ID NO: 1697699 - protein, 18 aa, Staphylococcus aureus
LKIKGMVLYMNRNTKTTK

SEQ ID NO: 1697700 - protein, 28 aa, Staphylococcus aureus
LKILLTQNAIAILYPYIRSLVSDLTSKA

SEQ ID NO: 1697701 - protein, 20 aa, Staphylococcus aureus
LKKKGKIAMESWGVWRVIES

SEQ ID NO: 1697702 - protein, 22 aa, Staphylococcus aureus
LKKKYLDLLSQRFDTPEKLATE

SEQ ID NO: 1697703 - protein, 18 aa, Staphylococcus aureus
LKKLIGQWEREAIRPKIL

SEQ ID NO: 1697704 - protein, 20 aa, Staphylococcus aureus
LKLKTKLYPTQYIRFEEATI

SEQ ID NO: 1697705 - protein, 25 aa, Staphylococcus aureus
LKNAGTIFLFGFGASSLTIGDLFQK

SEQ ID NO: 1697706 - protein, 19 aa, Staphylococcus aureus
LKNEIIREYDLKPSIFSNS

SEQ ID NO: 1697707 - protein, 24 aa, Staphylococcus aureus
LKNKNVALLFEKDSTRTRCAFEVA

SEQ ID NO: 1697708 - protein, 29 aa, Staphylococcus aureus
LKNKYMYGGVTLAGDYLEKSRCIPINLWV

SEQ ID NO: 1697709 - protein, 18 aa, Staphylococcus aureus
LKNMFENYGLIALKDNHI

SEQ ID NO: 1697710 - protein, 24 aa, Staphylococcus aureus
LKNSFRPEFLNRVDDIIVFHKLTK

SEQ ID NO: 1697711 - protein, 18 aa, Staphylococcus aureus
LKPLPFISGYVGTCSFDL

SEQ ID NO: 1697712 - protein, 21 aa, Staphylococcus aureus
LKQKGYFCRVGEKWDNSNLSH

SEQ ID NO: 1697713 - protein, 19 aa, Staphylococcus aureus
LKQPVILNQQFGLGMDYFD

SEQ ID NO: 1697714 - protein, 17 aa, Staphylococcus aureus
LKQSFYEKHKIIEFDNK

SEQ ID NO: 1697715 - protein, 27 aa, Staphylococcus aureus
LKREFSYWQFRKLFKSYTWQSDVRELK

SEQ ID NO: 1697716 - protein, 18 aa, Staphylococcus aureus
LKRISFKILQVAKRAQRG

SEQ ID NO: 1697717 - protein, 18 aa, Staphylococcus aureus
LKRNLKWLTRRSRPGSFQ

SEQ ID NO: 1697718 - protein, 18 aa, Staphylococcus aureus
LKSIDRNGALKGIGKPEK

SEQ ID NO: 1697719 - protein, 18 aa, Staphylococcus aureus
LKSNEYVLFDLGVIYEHY

SEQ ID NO: 1697720 - protein, 21 aa, Staphylococcus aureus
LKSNEYVLFDLGVIYEYYCSD

SEQ ID NO: 1697721 - protein, 18 aa, Staphylococcus aureus
LKSRGMILKLDRNKRTAK

SEQ ID NO: 1697722 - protein, 21 aa, Staphylococcus aureus
LKTLFPEDVLSIAKGLTDGEV

SEQ ID NO: 1697723 - protein, 22 aa, Staphylococcus aureus
LKTLPPVFIAHCNSDYDVPVEE

SEQ ID NO: 1697724 - protein, 21 aa, Staphylococcus aureus
LKTLTFHTLLDEWLEYHIKTS

SEQ ID NO: 1697725 - protein, 19 aa, Staphylococcus aureus
LKVGMFDDSKIKYIEALPE

SEQ ID NO: 1697726 - protein, 18 aa, Staphylococcus aureus
LKVPEYVKASLAPGSKVV

SEQ ID NO: 1697727 - protein, 27 aa, Staphylococcus aureus
LKYAKKAYYTVYFKNGGKRILQLNSKN

SEQ ID NO: 1697728 - protein, 23 aa, Staphylococcus aureus
LKYYDIIVTSNLATKHPFFEYAR

SEQ ID NO: 1697729 - protein, 20 aa, Staphylococcus aureus
LLALHPLISERIVDLSSIII

SEQ ID NO: 1697730 - protein, 29 aa, Staphylococcus aureus
LLASMLNTFALFNINLSWIESRPLKTQLG

SEQ ID NO: 1697731 - protein, 20 aa, Staphylococcus aureus
LLCKHGHWHAVIYDIAQGKT

SEQ ID NO: 1697732 - protein, 17 aa, Staphylococcus aureus
LLCLDATTGQNALSQAR

SEQ ID NO: 1697733 - protein, 31 aa, Staphylococcus aureus
LLDCDINMLEKYWFSWLTKNNIPIKRKSSTI

SEQ ID NO: 1697734 - protein, 18 aa, Staphylococcus aureus
LLDKFMKDLIIQILAMIS

SEQ ID NO: 1697735 - protein, 21 aa, Staphylococcus aureus
LLDKFMKDLIIQILAMISEQE

SEQ ID NO: 1697736 - protein, 21 aa, Staphylococcus aureus
LLEKVGLGQSFLYRYPHELSG

SEQ ID NO: 1697737 - protein, 18 aa, Staphylococcus aureus
LLEPYNSFESQVKTIKSV

SEQ ID NO: 1697738 - protein, 17 aa, Staphylococcus aureus
LLFEKDSTRTRCAFEVA

SEQ ID NO: 1697739 - protein, 17 aa, Staphylococcus aureus
LLHDSIRMMWLAQNQTP

SEQ ID NO: 1697740 - protein, 18 aa, Staphylococcus aureus
LLHLSDILHKRVVGQDKA

SEQ ID NO: 1697741 - protein, 18 aa, Staphylococcus aureus
LLHVYLKEFSELIQKFHE

SEQ ID NO: 1697742 - protein, 17 aa, Staphylococcus aureus
LLIKLEKYNNIDQEKVI

SEQ ID NO: 1697743 - protein, 19 aa, Staphylococcus aureus
LLIKMWQLSQIYKPSSKQS

SEQ ID NO: 1697744 - protein, 17 aa, Staphylococcus aureus
LLITMAVVTWKVWKIER

SEQ ID NO: 1697745 - protein, 17 aa, Staphylococcus aureus
LLIVFDNLKKVKDREYK

SEQ ID NO: 1697746 - protein, 28 aa, Staphylococcus aureus
LLKKLKEEQIILPYTTQFYISNNEEIGY

SEQ ID NO: 1697747 - protein, 17 aa, Staphylococcus aureus
LLKKQFIGEFISSLNSP

SEQ ID NO: 1697748 - protein, 17 aa, Staphylococcus aureus
LLLEIPKSRKIHSDGIH

SEQ ID NO: 1697749 - protein, 24 aa, Staphylococcus aureus
LLLGHIDTVPYYWTPKNTENNIFA

SEQ ID NO: 1697750 - protein, 17 aa, Staphylococcus aureus
LLLKKAYYKYDVHIEVI

SEQ ID NO: 1697751 - protein, 18 aa, Staphylococcus aureus
LLNELLREKMSTGNLILS

SEQ ID NO: 1697752 - protein, 19 aa, Staphylococcus aureus
LLNIYEWPEKLLNKELKKL

SEQ ID NO: 1697753 - protein, 25 aa, Staphylococcus aureus
LLNQHYDWLIFSSKNAVKFFYKYLK

SEQ ID NO: 1697754 - protein, 23 aa, Staphylococcus aureus
LLNRNYVVVWRELKRYTFNDIYD

SEQ ID NO: 1697755 - protein, 18 aa, Staphylococcus aureus
LLNVLSGIVPKLIELPMK

SEQ ID NO: 1697756 - protein, 18 aa, Staphylococcus aureus
LLNVLSLIDQISSGSVIA

SEQ ID NO: 1697757 - protein, 22 aa, Staphylococcus aureus
LLPDHNWGNYKLVFNTRNGANL

SEQ ID NO: 1697758 - protein, 18 aa, Staphylococcus aureus
LLPNIPHVAIFDTAFHQT

SEQ ID NO: 1697759 - protein, 17 aa, Staphylococcus aureus
LLPVTDKILCMNGSYVI

SEQ ID NO: 1697760 - protein, 28 aa, Staphylococcus aureus
LLQEFPEQLTNYLLKYDYRDLEIIKAVI

SEQ ID NO: 1697761 - protein, 20 aa, Staphylococcus aureus
LLQQGITLGIITRGDGLSDY

SEQ ID NO: 1697762 - protein, 19 aa, Staphylococcus aureus
LLQYTFILSSFLKSINTIE

SEQ ID NO: 1697763 - protein, 17 aa, Staphylococcus aureus
LLRQYFPKGTDFKNISD

SEQ ID NO: 1697764 - protein, 19 aa, Staphylococcus aureus
LLSDNLNYFKLKKFIVALE

SEQ ID NO: 1697765 - protein, 22 aa, Staphylococcus aureus
LLSTFIFHIQPLSYLRFIHYKE

SEQ ID NO: 1697766 - protein, 19 aa, Staphylococcus aureus
LLTYPDGFNILKKLNKVLK

SEQ ID NO: 1697767 - protein, 17 aa, Staphylococcus aureus
LLYEFLEILGEPDFNMI

SEQ ID NO: 1697768 - protein, 18 aa, Staphylococcus aureus
LMEPWDGPTMISFCNGDK

SEQ ID NO: 1697769 - protein, 35 aa, Staphylococcus aureus; identical to SEQ ID NO: 1590446

SEQ ID NO: 1697770 - protein, 25 aa, Staphylococcus aureus
LMLDAVIDYLPSPLDVKPIIGHRAS

SEQ ID NO: 1697771 - protein, 17 aa, Staphylococcus aureus
LMLFVQRCKDMQDSGQL

SEQ ID NO: 1697772 - protein, 18 aa, Staphylococcus aureus
LMLIMPEGPALTLNPDFL

SEQ ID NO: 1697773 - protein, 17 aa, Staphylococcus aureus
LMLMTMNLHFESNEVSD

SEQ ID NO: 1697774 - protein, 27 aa, Staphylococcus aureus
LMTHPRYQIKKKYVAKLKGYLIERRSE

SEQ ID NO: 1697775 - protein, 24 aa, Staphylococcus aureus
LMTHPRYQIKKKYVAKLKGYLMRE

SEQ ID NO: 1697776 - protein, 28 aa, Staphylococcus aureus
LNAKVIIIELNDDRIKYLEGMYAEKDVT

SEQ ID NO: 1697777 - protein, 17 aa, Staphylococcus aureus
LNALAVIAISYLEKLDV

SEQ ID NO: 1697778 - protein, 19 aa, Staphylococcus aureus
LNCKSDFWKTLKYKKDKIT

SEQ ID NO: 1697779 - protein, 19 aa, Staphylococcus aureus
LNDAMLLIKGNLSLDPDEV

SEQ ID NO: 1697780 - protein, 26 aa, Staphylococcus aureus
LNDEFNYLYIFNLRGDQRTQGEISRK

SEQ ID NO: 1697781 - protein, 22 aa, Staphylococcus aureus
LNDIEFELPLIIRNEVLAPGGQ

SEQ ID NO: 1697782 - protein, 33 aa, Staphylococcus aureus
LNDIKKHTQFIIDEILAIKLPAEVIKASPKVGQ

SEQ ID NO: 1697783 - protein, 26 aa, Staphylococcus aureus
LNDMDTIIWIAKSCFLTGVFLSNLDQ

SEQ ID NO: 1697784 - protein, 23 aa, Staphylococcus aureus
LNEAMLTMLPITIKEKALREYYR

SEQ ID NO: 1697785 - protein, 18 aa, Staphylococcus aureus
LNEKYKFGIVLKEVTPLE

SEQ ID NO: 1697786 - protein, 21 aa, Staphylococcus aureus
LNFECGRFIVAHIGYYVTEVL

SEQ ID NO: 1697787 - protein, 24 aa, Staphylococcus aureus
LNFLNTKKLSIGWKIYLEKISLRD

SEQ ID NO: 1697788 - protein, 25 aa, Staphylococcus aureus
LNFNDDLLLWIVYKIYKEISDFIIT

SEQ ID NO: 1697789 - protein, 23 aa, Staphylococcus aureus
LNGDLPAFLSPEPGLQSGAMIMQ

SEQ ID NO: 1697790 - protein, 18 aa, Staphylococcus aureus
LNGKIFIVKDMIPGVNAP

SEQ ID NO: 1697791 - protein, 24 aa, Staphylococcus aureus
LNGQVIQILDIINPSNGYGGQPVT

SEQ ID NO: 1697792 - protein, 17 aa, Staphylococcus aureus
LNGTQNLEKAKQHANTA

SEQ ID NO: 1697793 - protein, 21 aa, Staphylococcus aureus
LNGVDLFELGILHTSLIKGYE

SEQ ID NO: 1697794 - protein, 20 aa, Staphylococcus aureus
LNIHTVEDLVLYLPTRYEDN

SEQ ID NO: 1697795 - protein, 17 aa, Staphylococcus aureus
LNIMQPFKVYPNGFPEV

SEQ ID NO: 1697796 - protein, 25 aa, Staphylococcus aureus
LNKDALLYICTKFVPIINSIGFNTH

SEQ ID NO: 1697797 - protein, 18 aa, Staphylococcus aureus
LNKLLENQQILALESNKK

SEQ ID NO: 1697798 - protein, 23 aa, Staphylococcus aureus
LNKPNRLYLLKPNYDIEASLTKE

SEQ ID NO: 1697799 - protein, 17 aa, Staphylococcus aureus
LNLIHKKIDTFNKICII

SEQ ID NO: 1697800 - protein, 19 aa, Staphylococcus aureus
LNLLGFELQPTNDGLIIYP

SEQ ID NO: 1697801 - protein, 19 aa, Staphylococcus aureus
LNLSFLPNYYSIIKDELNI

SEQ ID NO: 1697802 - protein, 21 aa, Staphylococcus aureus
LNLSHYLILNRYPSRNRYLSL

SEQ ID NO: 1697803 - protein, 18 aa, Staphylococcus aureus
LNQFFGSKSYLYQDNERV

SEQ ID NO: 1697804 - protein, 23 aa, Staphylococcus aureus
LNQHYDWLIFSSKNAVKFFYKYL

SEQ ID NO: 1697805 - protein, 17 aa, Staphylococcus aureus
LNQPFIYIGKDSVKLQY

SEQ ID NO: 1697806 - protein, 17 aa, Staphylococcus aureus
LNQQLQSLINKYPQIQK

SEQ ID NO: 1697807 - protein, 27 aa, Staphylococcus aureus
LNQSKIGGMPFLKSFKDIPLDENNVPM

SEQ ID NO: 1697808 - protein, 24 aa, Staphylococcus aureus
LNRAPTLHRLGIQAFEPTLVEGRA

SEQ ID NO: 1697809 - protein, 31 aa, Staphylococcus aureus
LNRKKEDLEFIIDKFFKKIQQERPESIPALT

SEQ ID NO: 1697810 - protein, 28 aa, Staphylococcus aureus
LNSNCDMLFIVFSIHLIDILKKLSHDEI

SEQ ID NO: 1697811 - protein, 25 aa, Staphylococcus aureus
LNTKRSLALFLMAEVDISILSMVPR

SEQ ID NO: 1697812 - protein, 24 aa, Staphylococcus aureus
LNTLTGRRILILGDVLELGENSKE

SEQ ID NO: 1697813 - protein, 34 aa, Staphylococcus aureus; identical to SEQ ID NO: 1591667

SEQ ID NO: 1697814 - protein, 18 aa, Staphylococcus aureus
LNVDHFIDVLKTYLPEGP

SEQ ID NO: 1697815 - protein, 23 aa, Staphylococcus aureus
LNVDHFIDVLKTYLPEGPKYYPD

SEQ ID NO: 1697816 - protein, 17 aa, Staphylococcus aureus
LNVFGISSIDDLPTTEE

SEQ ID NO: 1697817 - protein, 20 aa, Staphylococcus aureus
LNVGYLDSLLIHRPSPLMDP

SEQ ID NO: 1697818 - protein, 23 aa, Staphylococcus aureus
LNVKAVCYDPWNAQSFITTIESM

SEQ ID NO: 1697819 - protein, 20 aa, Staphylococcus aureus
LNVKAVCYDPWNAQSFVTTI

SEQ ID NO: 1697820 - protein, 19 aa, Staphylococcus aureus
LNVLDKLADALGVNVSELF

SEQ ID NO: 1697821 - protein, 19 aa, Staphylococcus aureus
LNVNEAWLMGFDISKNRKV

SEQ ID NO: 1697822 - protein, 20 aa, Staphylococcus aureus
LNVNPAYLMGWVEENDDEVQ

SEQ ID NO: 1697823 - protein, 25 aa, Staphylococcus aureus
LNVPNEPIIPFIIGDGIGPDIWKAA

SEQ ID NO: 1697824 - protein, 25 aa, Staphylococcus aureus
LNVSFDYIDWIKLGFGPSGKENYYM

SEQ ID NO: 1697825 - protein, 27 aa, Staphylococcus aureus
LNVSFDYIDWIKLGLGPLARENYYKYK

SEQ ID NO: 1697826 - protein, 19 aa, Staphylococcus aureus
LNVYDKPTPFLFGEDLVFM

SEQ ID NO: 1697827 - protein, 20 aa, Staphylococcus aureus
LNYFKLKKFIVALESKTAII

SEQ ID NO: 1697828 - protein, 20 aa, Staphylococcus aureus
LNYFKLKKFIVGLESKTAII

SEQ ID NO: 1697829 - protein, 20 aa, Staphylococcus aureus
LNYPITYIEIDDHLTYHHDG

SEQ ID NO: 1697830 - protein, 21 aa, Staphylococcus aureus
LPAHPILIQTAQYNLIIDGGI

SEQ ID NO: 1697831 - protein, 18 aa, Staphylococcus aureus
LPANIFYGTSIPTCILVF

SEQ ID NO: 1697832 - protein, 18 aa, Staphylococcus aureus
LPEVLGPYSHATVVNGMV

SEQ ID NO: 1697833 - protein, 23 aa, Staphylococcus aureus
LPGDYFGTIRFGRKEQLFEIRVK

SEQ ID NO: 1697834 - protein, 18 aa, Staphylococcus aureus
LPIIAKSFAPFLKEKTNH

SEQ ID NO: 1697835 - protein, 19 aa, Staphylococcus aureus
LPIKNIQKIFPIAGGYVNL

SEQ ID NO: 1697836 - protein, 18 aa, Staphylococcus aureus
LPISIIEAMAIGLPVIAS

SEQ ID NO: 1697837 - protein, 26 aa, Staphylococcus aureus
LPISRLLQWVTDFVKPLARLAYNGEG

SEQ ID NO: 1697838 - protein, 27 aa, Staphylococcus aureus
LPKQQLPYFISFLSFHQYSIFQVLSPK

SEQ ID NO: 1697839 - protein, 19 aa, Staphylococcus aureus
LPLTILELDNDTEISILEM

SEQ ID NO: 1697840 - protein, 23 aa, Staphylococcus aureus
LPMVGTISLVPQIVDVVSIPVIA

SEQ ID NO: 1697841 - protein, 28 aa, Staphylococcus aureus
LPNIEEELKILLIPKDPNDDKDVIVEIR

SEQ ID NO: 1697842 - protein, 33 aa, Staphylococcus aureus
LPNLYVKTPRGWHLYFVLDTPFYAKGIEKKAIK

SEQ ID NO: 1697843 - protein, 27 aa, Staphylococcus aureus
LPSYVYTFLGFLPRKEKEKSDVLEQRM

SEQ ID NO: 1697844 - protein, 25 aa, Staphylococcus aureus
LPVPKYRYFKLNNNKIQKMLYRILQ

SEQ ID NO: 1697845 - protein, 18 aa, Staphylococcus aureus
LQATNLVPFLTVKQQFTL

SEQ ID NO: 1697846 - protein, 21 aa, Staphylococcus aureus
LQDLWAQVYLIDRGERLESSF

SEQ ID NO: 1697847 - protein, 29 aa, Staphylococcus aureus
LQEEVPDGLIPLLKIQGLGSKKIAKLYKE

SEQ ID NO: 1697848 - protein, 26 aa, Staphylococcus aureus
LQFKSKDWYWNAYFEGPIKLHKEFTI

SEQ ID NO: 1697849 - protein, 18 aa, Staphylococcus aureus
LQGLLTFQDLPVTSYTIW

SEQ ID NO: 1697850 - protein, 20 aa, Staphylococcus aureus
LQGLYAYNIPFDNKARIEKY

SEQ ID NO: 1697851 - protein, 33 aa, Staphylococcus aureus
LQHFEGTILFVSHDRYFINQLANKVFDLTIDGG

SEQ ID NO: 1697852 - protein, 35 aa, Staphylococcus aureus
LQHFEGTILFVSHDRYFINQLANKVFDLTIDSGKM

SEQ ID NO: 1697853 - protein, 26 aa, Staphylococcus aureus
LQIDSYNLWWYGGIEGKAISVNIAEK

SEQ ID NO: 1697854 - protein, 17 aa, Staphylococcus aureus
LQILLWNMVKERDNQPD

SEQ ID NO: 1697855 - protein, 17 aa, Staphylococcus aureus
LQLAEKLIQLSLSAPEF

SEQ ID NO: 1697856 - protein, 19 aa, Staphylococcus aureus
LQMMVQTLPGFQGTKLRQY

SEQ ID NO: 1697857 - protein, 18 aa, Staphylococcus aureus
LQPENMYQILRKLPPREY

SEQ ID NO: 1697858 - protein, 21 aa, Staphylococcus aureus
LQQIALFPHMTIKENIAQVPQ

SEQ ID NO: 1697859 - protein, 18 aa, Staphylococcus aureus
LQQQLWKLVAQRENEQFK

SEQ ID NO: 1697860 - protein, 26 aa, Staphylococcus aureus
LQREKGITFLFIAHDLSMVKYISDRI

SEQ ID NO: 1697861 - protein, 21 aa, Staphylococcus aureus
LQRFNVMRSLLAQPRVLICDE

SEQ ID NO: 1697862 - protein, 29 aa, Staphylococcus aureus
LQSGKEYLQSLVIEYFRIQKEQDSKFKLN

SEQ ID NO: 1697863 - protein, 18 aa, Staphylococcus aureus
LQSLINKYPQIQKNNEVR

SEQ ID NO: 1697864 - protein, 30 aa, Staphylococcus aureus
LRARRTYAFTELFLFELRMQWLNRLEKSSD

SEQ ID NO: 1697865 - protein, 25 aa, Staphylococcus aureus
LRDENHIIYLFLGQFFTKNEDPWHQ

SEQ ID NO: 1697866 - protein, 26 aa, Staphylococcus aureus
LRDENHIIYLFLGQFFTKNEDPWHQI

SEQ ID NO: 1697867 - protein, 18 aa, Staphylococcus aureus
LRDKLPLRRDDESEIYLS

SEQ ID NO: 1697868 - protein, 18 aa, Staphylococcus aureus
LREGDILVVYKLDRLGRT

SEQ ID NO: 1697869 - protein, 31 aa, Staphylococcus aureus
LREKGAMTNVLFMTATPIPRTLAISVFGEMD

SEQ ID NO: 1697870 - protein, 21 aa, Staphylococcus aureus
LRENLFMNNRYKNVLDYILGL

SEQ ID NO: 1697871 - protein, 18 aa, Staphylococcus aureus
LREQGFNAFYKGDIAKQL

SEQ ID NO: 1697872 - protein, 21 aa, Staphylococcus aureus
LRFEANFIELRNRDITFIAAS

SEQ ID NO: 1697873 - protein, 18 aa, Staphylococcus aureus
LRGLYKPHEYGKVILPMT

SEQ ID NO: 1697874 - protein, 20 aa, Staphylococcus aureus
LRKEVISFTKLIKGTDKEAP

SEQ ID NO: 1697875 - protein, 18 aa, Staphylococcus aureus
LRKIKYFCPVCGKQVILK

SEQ ID NO: 1697876 - protein, 17 aa, Staphylococcus aureus
LRKPDWLRIKLNTNENY

SEQ ID NO: 1697877 - protein, 20 aa, Staphylococcus aureus
LRPETLFGNKFEGYLNQKIQ

SEQ ID NO: 1697878 - protein, 19 aa, Staphylococcus aureus
LRPETLFGSKFEGYLNTKN

SEQ ID NO: 1697879 - protein, 19 aa, Staphylococcus aureus
LRQSIIGINPNWLTKPVLG

SEQ ID NO: 1697880 - protein, 21 aa, Staphylococcus aureus
LRTDLPSFRPGDTLRIHVRII

SEQ ID NO: 1697881 - protein, 29 aa, Staphylococcus aureus
LRVASILAHTLFDYPSHQLVTFGVTGTNG

SEQ ID NO: 1697882 - protein, 22 aa, Staphylococcus aureus
LRVSAIIRRRKAEIAAIMVYEA

SEQ ID NO: 1697883 - protein, 18 aa, Staphylococcus aureus
LRYSVERFYRPVRKRTNV

SEQ ID NO: 1697884 - protein, 18 aa, Staphylococcus aureus
LSAQDSWTLAKHLKTFPI

SEQ ID NO: 1697885 - protein, 24 aa, Staphylococcus aureus
LSDARFRTIIKLYEYQRLLENKED

SEQ ID NO: 1697886 - protein, 24 aa, Staphylococcus aureus
LSDARFRTIIKLYEYQRSLENKED

SEQ ID NO: 1697887 - protein, 28 aa, Staphylococcus aureus
LSDIVYHLIALLRYGGGISYQLLDDHSN

SEQ ID NO: 1697888 - protein, 19 aa, Staphylococcus aureus
LSDSLLRDIKVLSSNAKGD

SEQ ID NO: 1697889 - protein, 24 aa, Staphylococcus aureus
LSEDKALLYWATINRNCVICGKPH

SEQ ID NO: 1697890 - protein, 26 aa, Staphylococcus aureus
LSEEDLKVIYKWMDLGRKTDERLWLL

SEQ ID NO: 1697891 - protein, 24 aa, Staphylococcus aureus
LSEEVLIKIIPSYHALIVRSQTTV

SEQ ID NO: 1697892 - protein, 17 aa, Staphylococcus aureus
LSEGTIVVVFPDGSDRY

SEQ ID NO: 1697893 - protein, 20 aa, Staphylococcus aureus
LSENLFSAVKIYGIFKHMHV

SEQ ID NO: 1697894 - protein, 18 aa, Staphylococcus aureus
LSENLFSAVKIYGTFKHM

SEQ ID NO: 1697895 - protein, 18 aa, Staphylococcus aureus
LSERTKRLKLKQLLNSQN

SEQ ID NO: 1697896 - protein, 25 aa, Staphylococcus aureus
LSESESLSESLSESESLSDSESLSD

SEQ ID NO: 1697897 - protein, 26 aa, Staphylococcus aureus
LSESKFTIMMLLSYEKDMILSPSDLS

SEQ ID NO: 1697898 - protein, 17 aa, Staphylococcus aureus
LSFILLNQFNDILSQLH

SEQ ID NO: 1697899 - protein, 18 aa, Staphylococcus aureus
LSFIVHRDFAYERGKALV

SEQ ID NO: 1697900 - protein, 17 aa, Staphylococcus aureus
LSGALLMFAGSKSYYLY

SEQ ID NO: 1697901 - protein, 17 aa, Staphylococcus aureus
LSHDQQFLYVSNRGHDS

SEQ ID NO: 1697902 - protein, 20 aa, Staphylococcus aureus
LSHNNYIKRLPVSTYRAQNR

SEQ ID NO: 1697903 - protein, 17 aa, Staphylococcus aureus
LSIGGPGLIHLLNGMYD

SEQ ID NO: 1697904 - protein, 18 aa, Staphylococcus aureus
LSINQLERLLKAIRDTFT

SEQ ID NO: 1697905 - protein, 29 aa, Staphylococcus aureus
LSIPRDTISYIPKVGYYDKITHAHAYGGP

SEQ ID NO: 1697906 - protein, 25 aa, Staphylococcus aureus
LSIVKPLPNGRFQILTEINLENGNI

SEQ ID NO: 1697907 - protein, 17 aa, Staphylococcus aureus
LSIYQSFELPEDDSRIK

SEQ ID NO: 1697908 - protein, 24 aa, Staphylococcus aureus
LSKEKIYVVYDWTGGTTLGKEALL

SEQ ID NO: 1697909 - protein, 24 aa, Staphylococcus aureus
LSKFEIREIRIIKSVLLKGKKSFN

SEQ ID NO: 1697910 - protein, 28 aa, Staphylococcus aureus
LSKNQAYNFLITSSQRWGLNQGINANGW

SEQ ID NO: 1697911 - protein, 21 aa, Staphylococcus aureus
LSKVDVDKLPKKGIDITHGDK

SEQ ID NO: 1697912 - protein, 23 aa, Staphylococcus aureus
LSLPEARIPLSQAVIELCLSPKS

SEQ ID NO: 1697913 - protein, 28 aa, Staphylococcus aureus
LSMIESSISNYILRVRFSINEIVDKDQV

SEQ ID NO: 1697914 - protein, 25 aa, Staphylococcus aureus
LSNDGFCYLSYWYGDNENIVNIFYF

SEQ ID NO: 1697915 - protein, 25 aa, Staphylococcus aureus
LSNNYTNPPLTNPILEGLEGSSSKL

SEQ ID NO: 1697916 - protein, 19 aa, Staphylococcus aureus
LSNVAWFWHTSYSHRTEQA

SEQ ID NO: 1697917 - protein, 19 aa, Staphylococcus aureus
LSNVTVYALAKLYDIEVDQ

SEQ ID NO: 1697918 - protein, 25 aa, Staphylococcus aureus
LSPTKIYRTALLKYNDIYFPEELKS

SEQ ID NO: 1697919 - protein, 24 aa, Staphylococcus aureus
LSQIAQQFYFFGAGKIEKIERKNN

SEQ ID NO: 1697920 - protein, 17 aa, Staphylococcus aureus
LSREKLSPVLALVKAQS

SEQ ID NO: 1697921 - protein, 27 aa, Staphylococcus aureus
LSRLVAPFVPFISEKIHYNLTGKSVHL

SEQ ID NO: 1697922 - protein, 25 aa, Staphylococcus aureus
LSSAQKRMYLLWKSNHKDTVYNVLF

SEQ ID NO: 1697923 - protein, 41 aa, Staphylococcus aureus
LSSAQKRMYLLWKSNLKDTVYNIPFLWRLSSELNVAQLRQA

SEQ ID NO: 1697924 - protein, 25 aa, Staphylococcus aureus
LSSKQFYWYERSIKLFSEFFGLNML

SEQ ID NO: 1697925 - protein, 22 aa, Staphylococcus aureus
LSSQILMLTTMNLHFESNVVSD

SEQ ID NO: 1697926 - protein, 17 aa, Staphylococcus aureus
LSSVLMLEHLGWQEVAD

SEQ ID NO: 1697927 - protein, 19 aa, Staphylococcus aureus
LSTLYRWNKLYKEEGLTGL

SEQ ID NO: 1697928 - protein, 27 aa, Staphylococcus aureus
LSTTNNRRNLIAIKFFEDKQVEQSEAS

SEQ ID NO: 1697929 - protein, 19 aa, Staphylococcus aureus
LSVMDARLKKMRKQRDEYK

SEQ ID NO: 1697930 - protein, 29 aa, Staphylococcus aureus
LTAVLAVPLWYKNKVYGVLLFGQRDGRPL

SEQ ID NO: 1697931 - protein, 19 aa, Staphylococcus aureus
LTDMLDGLLIAHPELDLIA

SEQ ID NO: 1697932 - protein, 19 aa, Staphylococcus aureus
LTDMLEGLLIVHPELDLIA

SEQ ID NO: 1697933 - protein, 26 aa, Staphylococcus aureus
LTEAVRRNLYSVILLDEVEKAHTDVF

SEQ ID NO: 1697934 - protein, 19 aa, Staphylococcus aureus
LTEFEVAYAPPYSHPKDLI

SEQ ID NO: 1697935 - protein, 25 aa, Staphylococcus aureus
LTEHHIRILDLPLATGLVAELGQGL

SEQ ID NO: 1697936 - protein, 25 aa, Staphylococcus aureus
LTEKKVSYGLIYTVLEGVKGLVENA

SEQ ID NO: 1697937 - protein, 24 aa, Staphylococcus aureus
LTEPYTNYSILLVSGTYPGGVIEG

SEQ ID NO: 1697938 - protein, 25 aa, Staphylococcus aureus
LTEPYTNYSILLVSGTYPGGVIEGF

SEQ ID NO: 1697939 - protein, 27 aa, Staphylococcus aureus
LTFCQLTIMCKLGWAPTKRISKGNSTD

SEQ ID NO: 1697940 - protein, 29 aa, Staphylococcus aureus
LTGFLSFQRIPIYIIWINPKSHKTPRYYF

SEQ ID NO: 1697941 - protein, 25 aa, Staphylococcus aureus
LTGIQFLELFTDNLYFNISRHAIEM

SEQ ID NO: 1697942 - protein, 24 aa, Staphylococcus aureus
LTGQPVYVALLKGTFSLDSIEFKT

SEQ ID NO: 1697943 - protein, 17 aa, Staphylococcus aureus
LTHLIVEEAYHCGASDV

SEQ ID NO: 1697944 - protein, 18 aa, Staphylococcus aureus
LTIALPSYPPYLHPRYKE

SEQ ID NO: 1697945 - protein, 24 aa, Staphylococcus aureus
LTIVTNYTVVKYISKTPLYNQSQV

SEQ ID NO: 1697946 - protein, 29 aa, Staphylococcus aureus
LTKADLPFFHAKGGIYVWLETPPGYDSEQ

SEQ ID NO: 1697947 - protein, 20 aa, Staphylococcus aureus
LTKFFIAGQKDGWISLEAEK

SEQ ID NO: 1697948 - protein, 19 aa, Staphylococcus aureus
LTKWINQKIIHKKQKLLKH

SEQ ID NO: 1697949 - protein, 19 aa, Staphylococcus aureus
LTLYLTSHYKKIDYEFLYL

SEQ ID NO: 1697950 - protein, 24 aa, Staphylococcus aureus
LTMKISREKLLKQQLDLIVKDTSL

SEQ ID NO: 1697951 - protein, 30 aa, Staphylococcus aureus
LTNSKDTYFLSWTTTPWTLPANVALAINKD

SEQ ID NO: 1697952 - protein, 34 aa, Staphylococcus aureus
LTPKKLKFKSQNWYWFAYFDGPLKLPKNPRGSVK

SEQ ID NO: 1697953 - protein, 26 aa, Staphylococcus aureus
LTQAINQLVPLADNSALRTAKTKLDE

SEQ ID NO: 1697954 - protein, 18 aa, Staphylococcus aureus
LTRLLFYSGLRIGEALAL

SEQ ID NO: 1697955 - protein, 23 aa, Staphylococcus aureus
LTSRGMILYMNRNTRTTTGYFSI

SEQ ID NO: 1697956 - protein, 17 aa, Staphylococcus aureus
LTTQFIPHWEQPEHIQS

SEQ ID NO: 1697957 - protein, 18 aa, Staphylococcus aureus
LTTQSINLLKKLMLENKK

SEQ ID NO: 1697958 - protein, 19 aa, Staphylococcus aureus
LTTQSINLLKKLMLENKKE

SEQ ID NO: 1697959 - protein, 18 aa, Staphylococcus aureus
LTVKENIMLPLSVQKMSK

SEQ ID NO: 1697960 - protein, 22 aa, Staphylococcus aureus
LTVYELLMDKYYLGLHSHIDWE

SEQ ID NO: 1697961 - protein, 18 aa, Staphylococcus aureus
LTYILNRLKPYKEQLDIQ

SEQ ID NO: 1697962 - protein, 22 aa, Staphylococcus aureus
LVAIERLYPFPEEEIETLLAQL

SEQ ID NO: 1697963 - protein, 25 aa, Staphylococcus aureus
LVATGYPVLLATSRKRFTKEMMDYD

SEQ ID NO: 1697964 - protein, 33 aa, Staphylococcus aureus
LVATNPVDILVYATWKFSGLPKERVIGSGTILD

SEQ ID NO: 1697965 - protein, 18 aa, Staphylococcus aureus
LVHEKIYDQLLPRLQEAF

SEQ ID NO: 1697966 - protein, 34 aa, Staphylococcus aureus
LVIEKLKVLGFTPKKLMEFFESRILPYDIHLEVL

SEQ ID NO: 1697967 - protein, 20 aa, Staphylococcus aureus
LVKDLFKGYVWNRIPRKDRL

SEQ ID NO: 1697968 - protein, 17 aa, Staphylococcus aureus
LVKFIKLKESIGNYIFV

SEQ ID NO: 1697969 - protein, 23 aa, Staphylococcus aureus
LVMDSFVFIQIQISVRRQVLFQL

SEQ ID NO: 1697970 - protein, 17 aa, Staphylococcus aureus
LVNILDLEDKFIDGINI

SEQ ID NO: 1697971 - protein, 18 aa, Staphylococcus aureus
LVNMFKGFEFKVNGTLPI

SEQ ID NO: 1697972 - protein, 18 aa, Staphylococcus aureus
LVNNSRFGFKMGHQSIVD

SEQ ID NO: 1697973 - protein, 23 aa, Staphylococcus aureus
LVNQLVDLLYTSTFIIEKPSYPP

SEQ ID NO: 1697974 - protein, 20 aa, Staphylococcus aureus
LVPEWANWDHFNELDKKGLI

SEQ ID NO: 1697975 - protein, 19 aa, Staphylococcus aureus
LVPVLALDLALDPALAPVL

SEQ ID NO: 1697976 - protein, 18 aa, Staphylococcus aureus
LVQQLAKENVAFTAGVRQ

SEQ ID NO: 1697977 - protein, 19 aa, Staphylococcus aureus
LVREHQIHMTLPSLTYYYN

SEQ ID NO: 1697978 - protein, 20 aa, Staphylococcus aureus
LVREHQIHMTLPSLTYYYNH

SEQ ID NO: 1697979 - protein, 19 aa, Staphylococcus aureus
LVRNINLALRAQYLFESNV

SEQ ID NO: 1697980 - protein, 18 aa, Staphylococcus aureus
LVSDGVSLIAVLFENQQD

SEQ ID NO: 1697981 - protein, 25 aa, Staphylococcus aureus
LVSDNLNYFKLKKFIVALESKTAII

SEQ ID NO: 1697982 - protein, 26 aa, Staphylococcus aureus
LVSVVTLQLISYYAALHRDLDVDKPR

SEQ ID NO: 1697983 - protein, 25 aa, Staphylococcus aureus
LVVVRTFIPELLTIALPSYPPYLHP

SEQ ID NO: 1697984 - protein, 26 aa, Staphylococcus aureus
LVVVRTFIPELLTIALPSYPPYLHPR

SEQ ID NO: 1697985 - protein, 20 aa, Staphylococcus aureus
LWMDLYDLFEELRNLFKEEG

SEQ ID NO: 1697986 - protein, 19 aa, Staphylococcus aureus
LWYLTFQEPKLTVKRAAAI

SEQ ID NO: 1697987 - protein, 17 aa, Staphylococcus aureus
LYDLFIQKLAERHTRPA

SEQ ID NO: 1697988 - protein, 19 aa, Staphylococcus aureus
LYDLFIQKLTERHTRPAIV

SEQ ID NO: 1697989 - protein, 19 aa, Staphylococcus aureus
LYEKCEILEVLAKMKELGY

SEQ ID NO: 1697990 - protein, 18 aa, Staphylococcus aureus
LYEKFFSTGFKTTSKRLG

SEQ ID NO: 1697991 - protein, 22 aa, Staphylococcus aureus
LYEKKLITYPRTDSRYITEDEK

SEQ ID NO: 1697992 - protein, 20 aa, Staphylococcus aureus
LYFYNRGYTFGNIQIFYSDK

SEQ ID NO: 1697993 - protein, 17 aa, Staphylococcus aureus
LYINFISNGIIGLLDIY

SEQ ID NO: 1697994 - protein, 17 aa, Staphylococcus aureus
LYLAADTVWFDGVEKTL

SEQ ID NO: 1697995 - protein, 17 aa, Staphylococcus aureus
LYLTSHYKQIDYEFLYL

SEQ ID NO: 1697996 - protein, 22 aa, Staphylococcus aureus
LYNELSLTTEYYYPLQNAIIEF

SEQ ID NO: 1697997 - protein, 21 aa, Staphylococcus aureus
LYNYHYLYPHQRYVIDLVIKE

SEQ ID NO: 1697998 - protein, 23 aa, Staphylococcus aureus
LYPAMEDFFLDIIIGKGDEARSI

SEQ ID NO: 1697999 - protein, 19 aa, Staphylococcus aureus
LYQLIVSKIQEAFKDRILI

SEQ ID NO: 1698000 - protein, 18 aa, Staphylococcus aureus
LYQVYRYNEKMKTRIDSL

SEQ ID NO: 1698001 - protein, 23 aa, Staphylococcus aureus
LYTAGQCTWYAYGMRQKMGKPVS

SEQ ID NO: 1698002 - protein, 19 aa, Staphylococcus aureus
MAKFICQEYHIVRYPDADS

SEQ ID NO: 1698003 - protein, 20 aa, Staphylococcus aureus
MALFADSMNVALLTGSVKGK

SEQ ID NO: 1698004 - protein, 17 aa, Staphylococcus aureus
MANQVNTTKAALNGAQN

SEQ ID NO: 1698005 - protein, 27 aa, Staphylococcus aureus
MAQRIAFIMSLIRRPDYLFLDEPTSAL

SEQ ID NO: 1698006 - protein, 19 aa, Staphylococcus aureus
MARHFGVYYSLTTISRDLQ

SEQ ID NO: 1698007 - protein, 29 aa, Staphylococcus aureus
MATGEIIGERKVRYTFKEYVQEKKDLTAE

SEQ ID NO: 1698008 - protein, 17 aa, Staphylococcus aureus
MAVSVGYINYQPIPIFP

SEQ ID NO: 1698009 - protein, 22 aa, Staphylococcus aureus
MAVVLPHGVLFRGAAEGVIRRY

SEQ ID NO: 1698010 - protein, 18 aa, Staphylococcus aureus
MCASLWSKFDLFKKYANS

SEQ ID NO: 1698011 - protein, 19 aa, Staphylococcus aureus
MDAGNMLKPMLARGELHCI

SEQ ID NO: 1698012 - protein, 30 aa, Staphylococcus aureus; identical to SEQ ID NO: 1645599

SEQ ID NO: 1698013 - protein, 31 aa, Staphylococcus aureus
MDASEFRNYILGLIFYRFLSEKAEQEYSDAL

SEQ ID NO: 1698014 - protein, 26 aa, Staphylococcus aureus
MDDDSYLNLIFKFTRNIPVNKLEESQ

SEQ ID NO: 1698015 - protein, 26 aa, Staphylococcus aureus
MDETWNFDYITTLLDRILDKYKDQSI

SEQ ID NO: 1698016 - protein, 23 aa, Staphylococcus aureus
MDKAQLKALYLTVIDRIDIRKDG

SEQ ID NO: 1698017 - protein, 17 aa, Staphylococcus aureus
MDKSQLKALYLTVIDRI

SEQ ID NO: 1698018 - protein, 23 aa, Staphylococcus aureus
MDKSQLKALYLTVIERIDIRKDE

SEQ ID NO: 1698019 - protein, 17 aa, Staphylococcus aureus
MDLHDEWIYSSRKYINF

SEQ ID NO: 1698020 - protein, 18 aa, Staphylococcus aureus
MDLYDLFEELRDLFKEED

SEQ ID NO: 1698021 - protein, 25 aa, Staphylococcus aureus
MDMVQIDLTRIWEILGEIIGETASD

SEQ ID NO: 1698022 - protein, 17 aa, Staphylococcus aureus
MDQIAPLGNIYQAGTLS

SEQ ID NO: 1698023 - protein, 23 aa, Staphylococcus aureus
MDTVVFIPSIIHPSFKRIPEVEN

SEQ ID NO: 1698024 - protein, 17 aa, Staphylococcus aureus
MEELRLLARAVFVLDAD

SEQ ID NO: 1698025 - protein, 19 aa, Staphylococcus aureus
MEHGYTDIKLLKDSFENFQ

SEQ ID NO: 1698026 - protein, 24 aa, Staphylococcus aureus
MEIDYPEKFVTLKHQHILGTLMSL

SEQ ID NO: 1698027 - protein, 25 aa, Staphylococcus aureus
MEIEYPEKFVTLKHQHILGTLMSLG

SEQ ID NO: 1698028 - protein, 17 aa, Staphylococcus aureus
MELAQQNAMLTQQLTEL

SEQ ID NO: 1698029 - protein, 33 aa, Staphylococcus aureus
MESRAHQLIIKFSSAWSFLVPAILQIDEDKIQS

SEQ ID NO: 1698030 - protein, 33 aa, Staphylococcus aureus
MESRAHQLIIKFSSAWSFLVPEILQIDEDKNQS

SEQ ID NO: 1698031 - protein, 28 aa, Staphylococcus aureus
MEVFDYITPEFLIKRSHLLKKAKCIIVD

SEQ ID NO: 1698032 - protein, 33 aa, Staphylococcus aureus
MEVLTTDITYLPFGHSMLYLSSIMDIYNGEIVA

SEQ ID NO: 1698033 - protein, 17 aa, Staphylococcus aureus
MEVTVLHLAEWLMEMQL

SEQ ID NO: 1698034 - protein, 20 aa, Staphylococcus aureus
MFDFGVLKRQQIFYAYDLDK

SEQ ID NO: 1698035 - protein, 19 aa, Staphylococcus aureus
MFEKFDRIEDSLRTQEKIY

SEQ ID NO: 1698036 - protein, 17 aa, Staphylococcus aureus
MFFMLATGERLQGLYAY

SEQ ID NO: 1698037 - protein, 26 aa, Staphylococcus aureus
MFGAIDKYFLTLNNQTFFSIIKENLK

SEQ ID NO: 1698038 - protein, 17 aa, Staphylococcus aureus
MFLGDAPVAPIYQKGVA

SEQ ID NO: 1698039 - protein, 21 aa, Staphylococcus aureus
MFMSDLIKRIDTHLSIDFMDV

SEQ ID NO: 1698040 - protein, 17 aa, Staphylococcus aureus
MFTICIDVIDSAFAPGV

SEQ ID NO: 1698041 - protein, 32 aa, Staphylococcus aureus
MGAQCWDLANYLLDKYWGFRTWGNADAMAQKS

SEQ ID NO: 1698042 - protein, 19 aa, Staphylococcus aureus
MGAVQQYIDEHHLDVISST

SEQ ID NO: 1698043 - protein, 18 aa, Staphylococcus aureus
MGDRLIVESIDRLGRNYE

SEQ ID NO: 1698044 - protein, 25 aa, Staphylococcus aureus
MGEPDEVWKERLELLKPYQVNKEMM

SEQ ID NO: 1698045 - protein, 21 aa, Staphylococcus aureus
MGGRLTRMPFMSGGYGNYVKI

SEQ ID NO: 1698046 - protein, 21 aa, Staphylococcus aureus
MGIPTDIKPFVTTKLISPLGK

SEQ ID NO: 1698047 - protein, 18 aa, Staphylococcus aureus
MGLPGGCPLGPRPIDQHI

SEQ ID NO: 1698048 - protein, 26 aa, Staphylococcus aureus
MGMSAVMNMNILINILGAFHQQYPNV

SEQ ID NO: 1698049 - protein, 19 aa, Staphylococcus aureus
MGRLFVTLVGAMAEWERTT

SEQ ID NO: 1698050 - protein, 17 aa, Staphylococcus aureus
MGTALLAFCETTLTKGI

SEQ ID NO: 1698051 - protein, 17 aa, Staphylococcus aureus
MGVFLRYCLKLDEALKH

SEQ ID NO: 1698052 - protein, 17 aa, Staphylococcus aureus
MHGLFNQLKLGIISIDN

SEQ ID NO: 1698053 - protein, 17 aa, Staphylococcus aureus
MHIPMLMDRIKATYNKN

SEQ ID NO: 1698054 - protein, 19 aa, Staphylococcus aureus
MHNQDFITLIQAFAEAVES

SEQ ID NO: 1698055 - protein, 19 aa, Staphylococcus aureus
MHPLNPYARKAWTIKPLKE

SEQ ID NO: 1698056 - protein, 25 aa, Staphylococcus aureus
MIAIDVKPYYQLCKAKSLLSIIDNT

SEQ ID NO: 1698057 - protein, 17 aa, Staphylococcus aureus
MIATFKEMNPQLPIVAI

SEQ ID NO: 1698058 - protein, 17 aa, Staphylococcus aureus
MIDNFKQVLKLIKEKRT

SEQ ID NO: 1698059 - protein, 20 aa, Staphylococcus aureus
MIEKVYLKYSKYDKQTFACY

SEQ ID NO: 1698060 - protein, 27 aa, Staphylococcus aureus
MIEMHELIQEFYYYALTKTVEGEKALT

SEQ ID NO: 1698061 - protein, 19 aa, Staphylococcus aureus
MIEPISLGFYEQNWYLIGF

SEQ ID NO: 1698062 - protein, 17 aa, Staphylococcus aureus
MIFNFNEIFRERMPKYI

SEQ ID NO: 1698063 - protein, 19 aa, Staphylococcus aureus
MIGDVQLLRAFDAEEVREM

SEQ ID NO: 1698064 - protein, 26 aa, Staphylococcus aureus
MIGEDFSHYLKVRPGAFFLTGCGNKS

SEQ ID NO: 1698065 - protein, 17 aa, Staphylococcus aureus
MIGYIPKSDLQVVFTSL

SEQ ID NO: 1698066 - protein, 23 aa, Staphylococcus aureus
MIIINESGLYSLIFDASKQSKNE

SEQ ID NO: 1698067 - protein, 17 aa, Staphylococcus aureus
MIIQSLFDLIDENKVLI

SEQ ID NO: 1698068 - protein, 18 aa, Staphylococcus aureus
MIKKLLIEFIIDNKDSKI

SEQ ID NO: 1698069 - protein, 20 aa, Staphylococcus aureus
MIKSDFFVINKTDLAPYVGA

SEQ ID NO: 1698070 - protein, 18 aa, Staphylococcus aureus
MILSANGPFIGGSRIPLT

SEQ ID NO: 1698071 - protein, 24 aa, Staphylococcus aureus
MINLENLAFFLDITTNYYSIEEFR

SEQ ID NO: 1698072 - protein, 26 aa, Staphylococcus aureus
MIQIDTTNILFILGGAFDGIEDVIKR

SEQ ID NO: 1698073 - protein, 25 aa, Staphylococcus aureus
MIRTPLLSVEFFNLFLNTEQIKYSD

SEQ ID NO: 1698074 - protein, 18 aa, Staphylococcus aureus
MITDILPNFQFIGNGKGF

SEQ ID NO: 1698075 - protein, 21 aa, Staphylococcus aureus
MKEDEELLLNDVPLAPIYQKG

SEQ ID NO: 1698076 - protein, 35 aa, Staphylococcus aureus
MKEYKDEFLAAPTEIKFLLYFAKMTKKDKNKLYHF

SEQ ID NO: 1698077 - protein, 21 aa, Staphylococcus aureus
MKHIQNMIGYIPKSDLQVVFT

SEQ ID NO: 1698078 - protein, 25 aa, Staphylococcus aureus
MKIRQRVMEMLLLPEQRLLYSDMAD

SEQ ID NO: 1698079 - protein, 19 aa, Staphylococcus aureus
MKKEQVINLFQRKAQFDNS

SEQ ID NO: 1698080 - protein, 21 aa, Staphylococcus aureus
MKLFLYIIVMFSTSFKKNKMT

SEQ ID NO: 1698081 - protein, 36 aa, Staphylococcus aureus
MKNEPEWMLDFRLKSLKLFYKMPMPQWGGDLSELNF

SEQ ID NO: 1698082 - protein, 37 aa, Staphylococcus aureus
MKNEPEWMLDFRLKSLKLFYKMPMPQWGGNLSELNFD

SEQ ID NO: 1698083 - protein, 37 aa, Staphylococcus aureus
MKNEPEWMLGFRLKSLKLFYKMPMPQWGGDLSELNFD

SEQ ID NO: 1698084 - protein, 20 aa, Staphylococcus aureus
MKQKLGIAIAFLNDPQFIIL

SEQ ID NO: 1698085 - protein, 22 aa, Staphylococcus aureus
MKQKLGIAIAFLNDPQFIILDE

SEQ ID NO: 1698086 - protein, 25 aa, Staphylococcus aureus
MKTGNMYYRPGYVQTGRAFFKLKVQ

SEQ ID NO: 1698087 - protein, 17 aa, Staphylococcus aureus
MLDSYLFQLATNKEQIT

SEQ ID NO: 1698088 - protein, 17 aa, Staphylococcus aureus
MLDYSWIDDVKNYKFFN

SEQ ID NO: 1698089 - protein, 28 aa, Staphylococcus aureus
MLGMAKEDIIGYYMLSVLSLEDEFKLEE

SEQ ID NO: 1698090 - protein, 20 aa, Staphylococcus aureus
MLIHENGWPTRIALKDFHDG

SEQ ID NO: 1698091 - protein, 23 aa, Staphylococcus aureus
MLKLAYIDLNEYLKTLQLKQQQL

SEQ ID NO: 1698092 - protein, 19 aa, Staphylococcus aureus
MLKPMLARGELHCIGATTL

SEQ ID NO: 1698093 - protein, 18 aa, Staphylococcus aureus
MLPKSIWENFKSQNFENM

SEQ ID NO: 1698094 - protein, 18 aa, Staphylococcus aureus
MLRMMMMQMGQKPSQKKI

SEQ ID NO: 1698095 - protein, 24 aa, Staphylococcus aureus
MLSENLFSAVKIYGTFKYMHVRMM

SEQ ID NO: 1698096 - protein, 30 aa, Staphylococcus aureus
MLTKVDLPFFHAKGGIYVWLETPPGYDSEQ

SEQ ID NO: 1698097 - protein, 34 aa, Staphylococcus aureus
MLTSIPINIWVSTPSFMEMCLLLPTLNEEQYGSL

SEQ ID NO: 1698098 - protein, 18 aa, Staphylococcus aureus
MLTSLIGVLLNRRVPDPL

SEQ ID NO: 1698099 - protein, 17 aa, Staphylococcus aureus
MMNEAIGNPLLDKFMKD

SEQ ID NO: 1698100 - protein, 17 aa, Staphylococcus aureus
MMRILRKIATGETISGR

SEQ ID NO: 1698101 - protein, 17 aa, Staphylococcus aureus
MNALINFTKHEGIIPAI

SEQ ID NO: 1698102 - protein, 24 aa, Staphylococcus aureus
MNDILSMFYDFAYCLYSTHKHREI

SEQ ID NO: 1698103 - protein, 33 aa, Staphylococcus aureus
MNIYEMFAQVLYPKILIDKIIYLLGTVADNGKS

SEQ ID NO: 1698104 - protein, 18 aa, Staphylococcus aureus
MNLPELIQWAWDNRKLSG

SEQ ID NO: 1698105 - protein, 20 aa, Staphylococcus aureus
MNMFGLGNLMMRYVMKKKNV

SEQ ID NO: 1698106 - protein, 42 aa, Staphylococcus aureus
MNMGFIDDMRFIMDKIPAAQRQTMLFSATMPKAIQALVQQFM

SEQ ID NO: 1698107 - protein, 43 aa, Staphylococcus aureus
MNMGFIDDMRFIMDKIPAVQRQTILFSATMPKAIQALVQQFMK

SEQ ID NO: 1698108 - protein, 27 aa, Staphylococcus aureus
MNMGFIDDMRFIMDKIPAVQRQTMLFS

SEQ ID NO: 1698109 - protein, 19 aa, Staphylococcus aureus
MNMTYIVMDNQIYGLTKGQ

SEQ ID NO: 1698110 - protein, 20 aa, Staphylococcus aureus
MNPDDEMPWIQSERELILVL

SEQ ID NO: 1698111 - protein, 18 aa, Staphylococcus aureus
MNPYEWYEKHDIKLITND

SEQ ID NO: 1698112 - protein, 22 aa, Staphylococcus aureus
MPDKLCLYYHIGQCLGPCVYDV

SEQ ID NO: 1698113 - protein, 18 aa, Staphylococcus aureus
MPDSLHAIDWIITNKDET

SEQ ID NO: 1698114 - protein, 18 aa, Staphylococcus aureus
MPFIIMLDEDENGYKAGR

SEQ ID NO: 1698115 - protein, 17 aa, Staphylococcus aureus
MPGYIHKKGHVGVVSRS

SEQ ID NO: 1698116 - protein, 28 aa, Staphylococcus aureus
MPKAMIMKFDLALQRMLLGEPVQYIVGF

SEQ ID NO: 1698117 - protein, 32 aa, Staphylococcus aureus
MPKLNLENALKIELEFYFTPPKSWSKKKKTQA

SEQ ID NO: 1698118 - protein, 17 aa, Staphylococcus aureus
MPRIFERGFTSTANRNE

SEQ ID NO: 1698119 - protein, 34 aa, Staphylococcus aureus
MPSVLNKYFNKLSVFRKLFGNLIYSNTLYDNNNA

SEQ ID NO: 1698120 - protein, 18 aa, Staphylococcus aureus
MQEEIFGPVVGFVKVNDF

SEQ ID NO: 1698121 - protein, 20 aa, Staphylococcus aureus
MQIDYPEKFVTLKHQHILGT

SEQ ID NO: 1698122 - protein, 18 aa, Staphylococcus aureus
MQKPFYTNVLIAKLQAIY

SEQ ID NO: 1698123 - protein, 19 aa, Staphylococcus aureus
MQMTQLNMLTMQLTQQNAK

SEQ ID NO: 1698124 - protein, 22 aa, Staphylococcus aureus
MQNSVNWYFERISDQIPKNYTA

SEQ ID NO: 1698125 - protein, 23 aa, Staphylococcus aureus
MQQLFQNIYRYLRNDLKLGLELT

SEQ ID NO: 1698126 - protein, 22 aa, Staphylococcus aureus
MQRLKFHYYFIDIENSKTATHL

SEQ ID NO: 1698127 - protein, 17 aa, Staphylococcus aureus
MQTPFIIASNHYPKFKE

SEQ ID NO: 1698128 - protein, 19 aa, Staphylococcus aureus
MRELSYAGFIVFHDEALQP

SEQ ID NO: 1698129 - protein, 23 aa, Staphylococcus aureus
MRLDELIKWAWDNPGLATGRNFY

SEQ ID NO: 1698130 - protein, 28 aa, Staphylococcus aureus
MRLMWKEMMAILQAFRVPSVNLLQFMVK

SEQ ID NO: 1698131 - protein, 30 aa, Staphylococcus aureus
MRLMWKEMMVILQAFRLPSVNLLQFMVKEN

SEQ ID NO: 1698132 - protein, 24 aa, Staphylococcus aureus
MRQMFQDYVKFLYGYEERISLSNC

SEQ ID NO: 1698133 - protein, 19 aa, Staphylococcus aureus
MRSVIYQFKEDELALIRIL

SEQ ID NO: 1698134 - protein, 24 aa, Staphylococcus aureus
MSDRTFYRRFEKYLGKEWNTDAKC

SEQ ID NO: 1698135 - protein, 19 aa, Staphylococcus aureus
MSHITVLQSAILASKVNAP

SEQ ID NO: 1698136 - protein, 19 aa, Staphylococcus aureus
MSHPDIRIALISDGKTILS

SEQ ID NO: 1698137 - protein, 18 aa, Staphylococcus aureus
MSIEGIIVLVIYHGHNEG

SEQ ID NO: 1698138 - protein, 17 aa, Staphylococcus aureus
MSLKNAELLYKFANGIF

SEQ ID NO: 1698139 - protein, 26 aa, Staphylococcus aureus
MSNGIPNIVVYNPAPIAARYLNHNSR

SEQ ID NO: 1698140 - protein, 32 aa, Staphylococcus aureus
MSNGIPNIVVYNPAPISIFNLNPNSPEGKRLL

SEQ ID NO: 1698141 - protein, 32 aa, Staphylococcus aureus
MTFERKMTAMLRYQFKVILSALKRKGYNMDDD

SEQ ID NO: 1698142 - protein, 26 aa, Staphylococcus aureus
MTIKENIVLVPKLLKWTEEEKDKRAK

SEQ ID NO: 1698143 - protein, 25 aa, Staphylococcus aureus
MTIKENIVLVPKLLKWTKEEKDKRA

SEQ ID NO: 1698144 - protein, 32 aa, Staphylococcus aureus
MTKEDFQNLILLFLESWYLKASFSQKFGAMEE

SEQ ID NO: 1698145 - protein, 29 aa, Staphylococcus aureus
MTLPNKEFQLLFMLATRPKQIFTREQIIE

SEQ ID NO: 1698146 - protein, 18 aa, Staphylococcus aureus
MTLQKNPLTLLVSTAGEN

SEQ ID NO: 1698147 - protein, 20 aa, Staphylococcus aureus
MTMGVSAPITLGLGAALKTS

SEQ ID NO: 1698148 - protein, 22 aa, Staphylococcus aureus
MTNDLQLPIGILPGGTFNDFTK

SEQ ID NO: 1698149 - protein, 19 aa, Staphylococcus aureus
MTPGQIRYYFPNHSELLNA

SEQ ID NO: 1698150 - protein, 17 aa, Staphylococcus aureus
MTTLFLIGQAIQDDEII

SEQ ID NO: 1698151 - protein, 18 aa, Staphylococcus aureus
MTVYVNQPKKTYTKETFV

SEQ ID NO: 1698152 - protein, 17 aa, Staphylococcus aureus
MVAKGMVLYMNRNTKTT

SEQ ID NO: 1698153 - protein, 19 aa, Staphylococcus aureus
MVATKIKGMIAAELSDERS

SEQ ID NO: 1698154 - protein, 17 aa, Staphylococcus aureus
MVDDELFIYNSKNQALT

SEQ ID NO: 1698155 - protein, 19 aa, Staphylococcus aureus
MVEIPFYTEEELTYRLNNN

SEQ ID NO: 1698156 - protein, 25 aa, Staphylococcus aureus
MVEKVDQLLINTQKLQQFSINSIEY

SEQ ID NO: 1698157 - protein, 25 aa, Staphylococcus aureus
MVEMDIKMLKKVPPLYFHPKPSVDS

SEQ ID NO: 1698158 - protein, 23 aa, Staphylococcus aureus
MVFQSYNLFPHKTALENVMEGLI

SEQ ID NO: 1698159 - protein, 25 aa, Staphylococcus aureus
MVGEKKLHLMPLDNLKNVTGYIRGG

SEQ ID NO: 1698160 - protein, 18 aa, Staphylococcus aureus
MVLYMNRNTKTTNGYYYV

SEQ ID NO: 1698161 - protein, 30 aa, Staphylococcus aureus
MVMKEEPERFWPADLVLLSIGFEGTEPTVP

SEQ ID NO: 1698162 - protein, 18 aa, Staphylococcus aureus
MVMMTVAELLPFGFSGKD

SEQ ID NO: 1698163 - protein, 20 aa, Staphylococcus aureus
MVMVMLYASLGSVLLREFGL

SEQ ID NO: 1698164 - protein, 27 aa, Staphylococcus aureus
MVNIELLYVEPQFRKLGIATQLKIALE

SEQ ID NO: 1698165 - protein, 21 aa, Staphylococcus aureus
MVQGLALPSNYLGRKMKILKD

SEQ ID NO: 1698166 - protein, 32 aa, Staphylococcus aureus
MVVSQFLTKNLFINWTWGEDFFRKYLIDYDSA

SEQ ID NO: 1698167 - protein, 17 aa, Staphylococcus aureus
MYAHFQDPKYRILDYVN

SEQ ID NO: 1698168 - protein, 21 aa, Staphylococcus aureus
MYHSPIRLLVVVQAPDYVVAR

SEQ ID NO: 1698169 - protein, 19 aa, Staphylococcus aureus
MYKVHLMKECLDREIKVIS

SEQ ID NO: 1698170 - protein, 18 aa, Staphylococcus aureus
MYKVHLMKECLDRGIKVI

SEQ ID NO: 1698171 - protein, 27 aa, Staphylococcus aureus
NAADAVYKAQLYLSSYGPKQYVEHLNQ

SEQ ID NO: 1698172 - protein, 26 aa, Staphylococcus aureus
NAAKALAFAYDKPLIPVHHIAGHIYA

SEQ ID NO: 1698173 - protein, 17 aa, Staphylococcus aureus
NAALHYLARLIEAGDLP

SEQ ID NO: 1698174 - protein, 39 aa, Staphylococcus aureus
NADLWYGFQCFDYANAGWKVLFGLLLKGLGAKDIPFANN

SEQ ID NO: 1698175 - protein, 17 aa, Staphylococcus aureus
NAESIIAGLNNPTINKG

SEQ ID NO: 1698176 - protein, 28 aa, Staphylococcus aureus
NAEVAELQNVTIPAIEAIVPQNDPDAND

SEQ ID NO: 1698177 - protein, 22 aa, Staphylococcus aureus
NAFFLDFNFEDYIDAVLELKHR

SEQ ID NO: 1698178 - protein, 25 aa, Staphylococcus aureus
NAFIQSYVIILLIDIRLPTVRLYII

SEQ ID NO: 1698179 - protein, 27 aa, Staphylococcus aureus
NAIDQDQFIKFYRGDKFKIASPITPLV

SEQ ID NO: 1698180 - protein, 23 aa, Staphylococcus aureus
NAIGTFYPFIKDDVALYGVEDAG

SEQ ID NO: 1698181 - protein, 25 aa, Staphylococcus aureus
NAINPIAPVTVVKQAARDAVSHDAQ

SEQ ID NO: 1698182 - protein, 17 aa, Staphylococcus aureus
NAIQKRKLQKFLAIDNN

SEQ ID NO: 1698183 - protein, 22 aa, Staphylococcus aureus
NAKDLINQTGNPTLDKAQVEQL

SEQ ID NO: 1698184 - protein, 26 aa, Staphylococcus aureus
NAKKIAETLNLLYQLTGNQNSVKVVK

SEQ ID NO: 1698185 - protein, 23 aa, Staphylococcus aureus
NAKKIVETLNLLYQLTGNQNGVK

SEQ ID NO: 1698186 - protein, 25 aa, Staphylococcus aureus
NAKNYLDRWKPKYEKKIIAQIDIKV

SEQ ID NO: 1698187 - protein, 22 aa, Staphylococcus aureus
NAKPPVARIMDYGKFKFEQQEK

SEQ ID NO: 1698188 - protein, 22 aa, Staphylococcus aureus
NAKTYLNTLTSITDAQKNNLIS

SEQ ID NO: 1698189 - protein, 23 aa, Staphylococcus aureus
NAKTYLNTLTSITDAQKNNLISQ

SEQ ID NO: 1698190 - protein, 18 aa, Staphylococcus aureus
NALGQALLAKRMGKKKLV

SEQ ID NO: 1698191 - protein, 23 aa, Staphylococcus aureus
NALNLTVLKLAFKETFFGKEIQG

SEQ ID NO: 1698192 - protein, 29 aa, Staphylococcus aureus
NALQKSLVNFFMFEAGFSLMFVKANSGTD

SEQ ID NO: 1698193 - protein, 21 aa, Staphylococcus aureus
NAMDQLKQAIGDHDTIVAGGN

SEQ ID NO: 1698194 - protein, 24 aa, Staphylococcus aureus
NAMDQLKQAIGDHDTIVAGGNYTN

SEQ ID NO: 1698195 - protein, 20 aa, Staphylococcus aureus
NAMKQAWLQISQDNKLMSCN

SEQ ID NO: 1698196 - protein, 22 aa, Staphylococcus aureus
NANRYTFVWKKSIPNHESKLNE

SEQ ID NO: 1698197 - protein, 19 aa, Staphylococcus aureus
NANTFLYFLTPIINCPDNL

SEQ ID NO: 1698198 - protein, 18 aa, Staphylococcus aureus
NAQHLDQAMASLQSGINN

SEQ ID NO: 1698199 - protein, 25 aa, Staphylococcus aureus
NAQNIKYILYVRQQLQAFPICVEFR

SEQ ID NO: 1698200 - protein, 25 aa, Staphylococcus aureus
NAQTLNTAMKGLRDSIANEATIKAG

SEQ ID NO: 1698201 - protein, 18 aa, Staphylococcus aureus
NARKYLARISELCNVQIS

SEQ ID NO: 1698202 - protein, 24 aa, Staphylococcus aureus
NARLITNKAAYFKKSQLIEQFIRS

SEQ ID NO: 1698203 - protein, 30 aa, Staphylococcus aureus
NASDAVYKAQLYLTPYGPKQYVEHLNQNTG

SEQ ID NO: 1698204 - protein, 23 aa, Staphylococcus aureus
NASPDKQGAYTDAYNAAKNIVNG

SEQ ID NO: 1698205 - protein, 31 aa, Staphylococcus aureus
NATELNTAMGTLKHAIADKTNTLASSKYVNA

SEQ ID NO: 1698206 - protein, 17 aa, Staphylococcus aureus
NATPSARRYARENGVNL

SEQ ID NO: 1698207 - protein, 23 aa, Staphylococcus aureus
NAVKFFYKYLKGINVDNIAVIGS

SEQ ID NO: 1698208 - protein, 17 aa, Staphylococcus aureus
NAVKTFSEYKKDALAKI

SEQ ID NO: 1698209 - protein, 20 aa, Staphylococcus aureus
NAYGVYFTPEIKKFIAENID

SEQ ID NO: 1698210 - protein, 23 aa, Staphylococcus aureus
NCKKKLTLFGKGKEAVYRCVCGH

SEQ ID NO: 1698211 - protein, 25 aa, Staphylococcus aureus
NCLMEVLGLALPYNGTALAVSDQRC

SEQ ID NO: 1698212 - protein, 19 aa, Staphylococcus aureus
NCLYVLVDPYLIENLRNAD

SEQ ID NO: 1698213 - protein, 25 aa, Staphylococcus aureus
NDCRLDNETFIYLITGPNMSGKSTY

SEQ ID NO: 1698214 - protein, 24 aa, Staphylococcus aureus
NDDLARVTALVQNYRKVSNRNKAD

SEQ ID NO: 1698215 - protein, 17 aa, Staphylococcus aureus
NDEDYVLYVNPKDYNKL

SEQ ID NO: 1698216 - protein, 26 aa, Staphylococcus aureus
NDFAKNWLYTFLKAIGIDDNNGQFNF

SEQ ID NO: 1698217 - protein, 28 aa, Staphylococcus aureus
NDFKFERPFIVAISIMYLFEMLSISNEE

SEQ ID NO: 1698218 - protein, 24 aa, Staphylococcus aureus
NDGDAVFFYNFRPDRAAQLSEIFA

SEQ ID NO: 1698219 - protein, 18 aa, Staphylococcus aureus
NDGELELIDVEHAFGISI

SEQ ID NO: 1698220 - protein, 23 aa, Staphylococcus aureus
NDGIINDVFIPLKSLRQLEIISG

SEQ ID NO: 1698221 - protein, 22 aa, Staphylococcus aureus
NDIDYDYVLKLYKQILSTDTEK

SEQ ID NO: 1698222 - protein, 23 aa, Staphylococcus aureus
NDIEFDLPLIIRNEKLSPGGEKT

SEQ ID NO: 1698223 - protein, 20 aa, Staphylococcus aureus
NDILAFINKDELELADDGTV

SEQ ID NO: 1698224 - protein, 18 aa, Staphylococcus aureus
NDIWKHFKAVKNNHVYDL

SEQ ID NO: 1698225 - protein, 24 aa, Staphylococcus aureus
NDKEALSLNYLPSLKFDYAQNEAT

SEQ ID NO: 1698226 - protein, 18 aa, Staphylococcus aureus
NDKQLVVSAPTKKPTTPT

SEQ ID NO: 1698227 - protein, 22 aa, Staphylococcus aureus
NDKSDLIYISQKGKFDAVVEDV

SEQ ID NO: 1698228 - protein, 20 aa, Staphylococcus aureus
NDLEMFIENKSIRTLTIVTN

SEQ ID NO: 1698229 - protein, 21 aa, Staphylococcus aureus
NDLFINKYWVQRTTATGIAEN

SEQ ID NO: 1698230 - protein, 22 aa, Staphylococcus aureus
NDLYSLIISILIFTKPANIRKN

SEQ ID NO: 1698231 - protein, 19 aa, Staphylococcus aureus
NDLYTALDILKQSVYEWIE

SEQ ID NO: 1698232 - protein, 19 aa, Staphylococcus aureus
NDNNQLYGFVYPIVDKKEL

SEQ ID NO: 1698233 - protein, 21 aa, Staphylococcus aureus
NDPVYLVITLATDHPNAHLKA

SEQ ID NO: 1698234 - protein, 20 aa, Staphylococcus aureus
NDRDLTELSSYRVYQDINKD

SEQ ID NO: 1698235 - protein, 19 aa, Staphylococcus aureus
NDRQLVVSAPSKKPTTPTT

SEQ ID NO: 1698236 - protein, 17 aa, Staphylococcus aureus
NDSLLEKNSYKLLIDDK

SEQ ID NO: 1698237 - protein, 25 aa, Staphylococcus aureus
NDSSVLLFNITKNNQPLFLSEENIK

SEQ ID NO: 1698238 - protein, 26 aa, Staphylococcus aureus
NDSVEDYLTYLNGRFSNMILGHNGDG

SEQ ID NO: 1698239 - protein, 23 aa, Staphylococcus aureus
NDSWPDLIFPESEIAFIVLHFGG

SEQ ID NO: 1698240 - protein, 24 aa, Staphylococcus aureus
NDTKKNIGYHFLDKPKITVKKESH

SEQ ID NO: 1698241 - protein, 17 aa, Staphylococcus aureus
NDTLWYDTSNPDVAVLR

SEQ ID NO: 1698242 - protein, 23 aa, Staphylococcus aureus
NDTPLLAIPGSPPDLLHPPQGDA

SEQ ID NO: 1698243 - protein, 22 aa, Staphylococcus aureus
NDTVLPVLMSGGTLILQCYFNG

SEQ ID NO: 1698244 - protein, 21 aa, Staphylococcus aureus
NDVKKFKYKNFEDEIEIDFTD

SEQ ID NO: 1698245 - protein, 19 aa, Staphylococcus aureus
NDVVLVYKKVKDGFDVQVI

SEQ ID NO: 1698246 - protein, 20 aa, Staphylococcus aureus
NDVWVIKESKEYLIPYIADV

SEQ ID NO: 1698247 - protein, 21 aa, Staphylococcus aureus
NDYFVRIQQWCQKFNIALKIK

SEQ ID NO: 1698248 - protein, 17 aa, Staphylococcus aureus
NDYIVYSFALLWGQFAC

SEQ ID NO: 1698249 - protein, 31 aa, Staphylococcus aureus
NDYKDKWNTVLKRFWKFEGTAVYEKVGIKEN

SEQ ID NO: 1698250 - protein, 18 aa, Staphylococcus aureus
NDYLKIIEKITKKEKTTH

SEQ ID NO: 1698251 - protein, 20 aa, Staphylococcus aureus
NEAFLEEMIALLPEVKHYAD

SEQ ID NO: 1698252 - protein, 30 aa, Staphylococcus aureus
NEAIGNPLLDKFMKDLIIQILAMISEQERN

SEQ ID NO: 1698253 - protein, 23 aa, Staphylococcus aureus
NEAYLWTQSVLNKGNYKHVYGAG

SEQ ID NO: 1698254 - protein, 26 aa, Staphylococcus aureus
NEDIPFSGAFSIKFRLSKQTITCTDY

SEQ ID NO: 1698255 - protein, 17 aa, Staphylococcus aureus
NEFIFNEIYAMGVAVDM

SEQ ID NO: 1698256 - protein, 32 aa, Staphylococcus aureus
NEFYWVSTYVMKGLWRNQLLYAFDHLNICREM

SEQ ID NO: 1698257 - protein, 18 aa, Staphylococcus aureus
NEHFGQIGVLLYSGDVTL

SEQ ID NO: 1698258 - protein, 27 aa, Staphylococcus aureus
NEITYRLSKIFGIKSISPLLKVEKTIE

SEQ ID NO: 1698259 - protein, 26 aa, Staphylococcus aureus
NEITYRLSKIFGIKSISPVLKVEKTI

SEQ ID NO: 1698260 - protein, 26 aa, Staphylococcus aureus
NEITYRLSKIFGIKSISPVLKVEKTL

SEQ ID NO: 1698261 - protein, 23 aa, Staphylococcus aureus
NEKDIRAVLGRFLFVQDDVKKII

SEQ ID NO: 1698262 - protein, 27 aa, Staphylococcus aureus
NEKDIRSVLGRFLFVQDDVKKIINDLS

SEQ ID NO: 1698263 - protein, 24 aa, Staphylococcus aureus
NEKFGLFLDMGLGKTVSTLTAFSQ

SEQ ID NO: 1698264 - protein, 26 aa, Staphylococcus aureus
NEKIQKLLAFQTLYIGIDPKRGPSLY

SEQ ID NO: 1698265 - protein, 25 aa, Staphylococcus aureus
NEKKYPVKLVNNRIVLIKDVKDKKL

SEQ ID NO: 1698266 - protein, 22 aa, Staphylococcus aureus
NEKVLRNIFISIASYIKDAAKS

SEQ ID NO: 1698267 - protein, 19 aa, Staphylococcus aureus
NELDYIIDDDWNYAAQLDA

SEQ ID NO: 1698268 - protein, 26 aa, Staphylococcus aureus
NELNTLLNSKLVFGDTLYITDLCIIA

SEQ ID NO: 1698269 - protein, 24 aa, Staphylococcus aureus
NELSDYLPLMLQFLQVAEWRNDPI

SEQ ID NO: 1698270 - protein, 22 aa, Staphylococcus aureus
NELYNYHYLYPHQRYAIDLVIK

SEQ ID NO: 1698271 - protein, 36 aa, Staphylococcus aureus
NEMLMANYLFNTSDNPRFKRWIIGSILSRTYYHNMV

SEQ ID NO: 1698272 - protein, 23 aa, Staphylococcus aureus
NEMLMANYLFNTSDNPRFKRWVI

SEQ ID NO: 1698273 - protein, 17 aa, Staphylococcus aureus
NENAVNTMWLTSSLFNQ

SEQ ID NO: 1698274 - protein, 21 aa, Staphylococcus aureus
NENVYIDFKIKNSAGIKNISY

SEQ ID NO: 1698275 - protein, 21 aa, Staphylococcus aureus
NEPFFQGHFPEYAVMPGVLIT

SEQ ID NO: 1698276 - protein, 32 aa, Staphylococcus aureus
NEPLIIDDVVKGFLTYNIPKKVIKHAGYVRCK

SEQ ID NO: 1698277 - protein, 26 aa, Staphylococcus aureus
NEPTYKNLYKNVWLLKDVPSEFNISK

SEQ ID NO: 1698278 - protein, 26 aa, Staphylococcus aureus
NEPTYKNLYKNVWLLKDVPSEFSISK

SEQ ID NO: 1698279 - protein, 28 aa, Staphylococcus aureus
NEPVYKNLYSDVWLLKEIPEKYGIPKQD

SEQ ID NO: 1698280 - protein, 28 aa, Staphylococcus aureus
NEQNSPLFIYQFTLTSKFNKWVKVMSVR

SEQ ID NO: 1698281 - protein, 23 aa, Staphylococcus aureus
NERWLRRVINSLVYDYGYPIGCS

SEQ ID NO: 1698282 - protein, 24 aa, Staphylococcus aureus
NESEIKLWYLTFQEPKLTVKRAAA

SEQ ID NO: 1698283 - protein, 22 aa, Staphylococcus aureus
NESKLGGFDWFKRKTNKKDTHE

SEQ ID NO: 1698284 - protein, 18 aa, Staphylococcus aureus
NESRFKGVKGDKGEPGQP

SEQ ID NO: 1698285 - protein, 17 aa, Staphylococcus aureus
NETFIIDANLDSVRSTV

SEQ ID NO: 1698286 - protein, 18 aa, Staphylococcus aureus
NETFLEEMIALLPEVKQY

SEQ ID NO: 1698287 - protein, 20 aa, Staphylococcus aureus
NEVIPFMTYREWEKYKRKGG

SEQ ID NO: 1698288 - protein, 33 aa, Staphylococcus aureus
NEVPDWYLDSCLKIKYMFPKAHAAAYVLMAVRI

SEQ ID NO: 1698289 - protein, 26 aa, Staphylococcus aureus
NEVQDLLIPLTFHFSKDEQLVIDQYK

SEQ ID NO: 1698290 - protein, 17 aa, Staphylococcus aureus
NEWVNMLEAGIVDPTKV

SEQ ID NO: 1698291 - protein, 22 aa, Staphylococcus aureus
NEYELRAMLRMMPSLIDTGDDN

SEQ ID NO: 1698292 - protein, 21 aa, Staphylococcus aureus
NEYFNWLKQNYIFKELDSSTE

SEQ ID NO: 1698293 - protein, 18 aa, Staphylococcus aureus
NEYFYVVANIPTLQEYRK

SEQ ID NO: 1698294 - protein, 26 aa, Staphylococcus aureus
NEYIEQLIQFVILSKFGYMNVENHFD

SEQ ID NO: 1698295 - protein, 26 aa, Staphylococcus aureus
NEYIEQLIQFVILSKFGYMNVENHFN

SEQ ID NO: 1698296 - protein, 22 aa, Staphylococcus aureus
NEYLYKELAIKIARLRNARIES

SEQ ID NO: 1698297 - protein, 24 aa, Staphylococcus aureus
NEYNFKLISDMLTDFNFSLEYHRN

SEQ ID NO: 1698298 - protein, 25 aa, Staphylococcus aureus
NEYSLDFYYQAYKRIRKYGGGAIAS

SEQ ID NO: 1698299 - protein, 19 aa, Staphylococcus aureus
NFAKISFLSHSLEPTILIY

SEQ ID NO: 1698300 - protein, 17 aa, Staphylococcus aureus
NFDKVENVWLKTELKYF

SEQ ID NO: 1698301 - protein, 24 aa, Staphylococcus aureus
NFDMRPYFIIFDEVTAFTSTLDKK

SEQ ID NO: 1698302 - protein, 18 aa, Staphylococcus aureus
NFEDEIEIDFTDSNHLAA

SEQ ID NO: 1698303 - protein, 22 aa, Staphylococcus aureus
NFEEAFVVKQILQHLATKHGIN

SEQ ID NO: 1698304 - protein, 25 aa, Staphylococcus aureus
NFEEKLRYFLIEDYNQKEHSVIQST

SEQ ID NO: 1698305 - protein, 37 aa, Staphylococcus aureus
NFENMINYHSKFDILSWLQDPFATPTLGKRVNLETGV

SEQ ID NO: 1698306 - protein, 31 aa, Staphylococcus aureus
NFGASLKADQFKYEVTLPQGVTYVNDSLTTT

SEQ ID NO: 1698307 - protein, 17 aa, Staphylococcus aureus
NFGRFPYSKGRLTKEDH

SEQ ID NO: 1698308 - protein, 17 aa, Staphylococcus aureus
NFINADTDKQTAYTTAV

SEQ ID NO: 1698309 - protein, 18 aa, Staphylococcus aureus
NFINADTDKQTAYTTAVN

SEQ ID NO: 1698310 - protein, 43 aa, Staphylococcus aureus
NFKNKEGYNLTFFAFFVKAVADALKAYPLLNSSWQGNEILLHK

SEQ ID NO: 1698311 - protein, 25 aa, Staphylococcus aureus
NFKPASWIFLYLKTSIQMIAAINGA

SEQ ID NO: 1698312 - protein, 17 aa, Staphylococcus aureus
NFLIQNDLARLKAHYKI

SEQ ID NO: 1698313 - protein, 17 aa, Staphylococcus aureus
NFMLNKAILEGYHTLLT

SEQ ID NO: 1698314 - protein, 21 aa, Staphylococcus aureus
NFNELFQFIFNEYYDINFEHL

SEQ ID NO: 1698315 - protein, 28 aa, Staphylococcus aureus
NFNGKKEWELFYLYKELIQTFEILYDDT

SEQ ID NO: 1698316 - protein, 20 aa, Staphylococcus aureus
NFSNILLQYTFILSSFLKSI

SEQ ID NO: 1698317 - protein, 18 aa, Staphylococcus aureus
NFTKILLLKDGKSVQQGL

SEQ ID NO: 1698318 - protein, 25 aa, Staphylococcus aureus
NFTTGWIFFINSVGELELVSHVALP

SEQ ID NO: 1698319 - protein, 25 aa, Staphylococcus aureus
NFTVDDLFKILKAYKNTLFKFTNEI

SEQ ID NO: 1698320 - protein, 20 aa, Staphylococcus aureus
NFVDFIRWMKTPFEYENVLS

SEQ ID NO: 1698321 - protein, 18 aa, Staphylococcus aureus
NFVEHRTLIYVPAWYFYG

SEQ ID NO: 1698322 - protein, 18 aa, Staphylococcus aureus
NFVGKIEWIASKVPFAKT

SEQ ID NO: 1698323 - protein, 24 aa, Staphylococcus aureus
NFYRDKLGYLFQNYGLIDNLTVNE

SEQ ID NO: 1698324 - protein, 20 aa, Staphylococcus aureus
NGFIAFVRVNFYDGKDALQP

SEQ ID NO: 1698325 - protein, 20 aa, Staphylococcus aureus
NGFIQSLKDDPSQSANLLSE

SEQ ID NO: 1698326 - protein, 18 aa, Staphylococcus aureus
NGFRAYVFAPVIKGKVDK

SEQ ID NO: 1698327 - protein, 24 aa, Staphylococcus aureus
NGGDKWILYGLNGAGKTTLLNILN

SEQ ID NO: 1698328 - protein, 22 aa, Staphylococcus aureus
NGGKFNGIIPISQLSTHHIDSP

SEQ ID NO: 1698329 - protein, 25 aa, Staphylococcus aureus
NGGKFNGIIPISQLSTRHIDSPSEV

SEQ ID NO: 1698330 - protein, 29 aa, Staphylococcus aureus
NGGLLFGTIDTWLVWKLSGKAAHITDYSN

SEQ ID NO: 1698331 - protein, 25 aa, Staphylococcus aureus
NGHGTAHYPFFKIDFERLARYCDKH

SEQ ID NO: 1698332 - protein, 24 aa, Staphylococcus aureus
NGHGTAHYPFFKIDFERLARYCEK

SEQ ID NO: 1698333 - protein, 25 aa, Staphylococcus aureus
NGHGTAHYPFFKIDFERLARYCEKY

SEQ ID NO: 1698334 - protein, 24 aa, Staphylococcus aureus
NGIKSFYKTVFNNLTRYKAIVVST

SEQ ID NO: 1698335 - protein, 23 aa, Staphylococcus aureus
NGIPNIVVYNPAPIAARYLNHNS

SEQ ID NO: 1698336 - protein, 23 aa, Staphylococcus aureus
NGKHKVDVLLGGGAKYFGKSNGN

SEQ ID NO: 1698337 - protein, 24 aa, Staphylococcus aureus
NGKKQSLVFYHLKLDSEYASIFGL

SEQ ID NO: 1698338 - protein, 20 aa, Staphylococcus aureus
NGKVNYLLAYDAKVFRKGGV

SEQ ID NO: 1698339 - protein, 26 aa, Staphylococcus aureus
NGLLLKKHGQKLYDAGLRRINVSLDA

SEQ ID NO: 1698340 - protein, 24 aa, Staphylococcus aureus
NGLPTDGFTYKWNNAATGTNDANW

SEQ ID NO: 1698341 - protein, 25 aa, Staphylococcus aureus
NGMQTLGVALPWAISAALVRPNTQV

SEQ ID NO: 1698342 - protein, 32 aa, Staphylococcus aureus
NGMVMKERPERFWPADLVLLSIGFEGTEPTVP

SEQ ID NO: 1698343 - protein, 25 aa, Staphylococcus aureus
NGNSLPDITLLAPIARLLDISLDTL

SEQ ID NO: 1698344 - protein, 31 aa, Staphylococcus aureus
NGNVVTTFTRRNNTSPWVKEASAATVAGIAG

SEQ ID NO: 1698345 - protein, 22 aa, Staphylococcus aureus
NGQSYPWGQCTWYVHQRRKEIG

SEQ ID NO: 1698346 - protein, 17 aa, Staphylococcus aureus
NGTSWFYFATDQWKYEE

SEQ ID NO: 1698347 - protein, 26 aa, Staphylococcus aureus
NGTVGFLVLHIPYISSVDFGKFEKDL

SEQ ID NO: 1698348 - protein, 20 aa, Staphylococcus aureus
NGVTTPYYAMIDSLAVVVKS

SEQ ID NO: 1698349 - protein, 24 aa, Staphylococcus aureus
NGYRSLHIVVSIPVFLAERVEVLP

SEQ ID NO: 1698350 - protein, 22 aa, Staphylococcus aureus
NHANDIINGNAQHPVITASDVN

SEQ ID NO: 1698351 - protein, 24 aa, Staphylococcus aureus
NHAPNLRTFLHRYDLYETKYSSVF

SEQ ID NO: 1698352 - protein, 28 aa, Staphylococcus aureus
NHDNIIFQFPLYWYSSPSLLKKWIDEVI

SEQ ID NO: 1698353 - protein, 19 aa, Staphylococcus aureus
NHERWLQRYDLISERNHFN

SEQ ID NO: 1698354 - protein, 19 aa, Staphylococcus aureus
NHFPKPTFEDIPLLDLALS

SEQ ID NO: 1698355 - protein, 24 aa, Staphylococcus aureus
NHFQSLFINPFTRKLHTFNLEKKQ

SEQ ID NO: 1698356 - protein, 20 aa, Staphylococcus aureus
NHIHLPKINASDFLMYYANE

SEQ ID NO: 1698357 - protein, 23 aa, Staphylococcus aureus
NHKMNYLMMFVHLWLMKDIFQHH

SEQ ID NO: 1698358 - protein, 24 aa, Staphylococcus aureus
NHKNIIFWVGWNEEAFNIVADLKR

SEQ ID NO: 1698359 - protein, 24 aa, Staphylococcus aureus
NHLLDKFMKDLIIQILAMVSEQER

SEQ ID NO: 1698360 - protein, 22 aa, Staphylococcus aureus
NHNRIIHSELLRFAGIGESKVE

SEQ ID NO: 1698361 - protein, 22 aa, Staphylococcus aureus
NHPKSLFIWRSNLISSSAKGQE

SEQ ID NO: 1698362 - protein, 17 aa, Staphylococcus aureus
NHPLNIWALHKLLKQCN

SEQ ID NO: 1698363 - protein, 32 aa, Staphylococcus aureus
NHPQWETFVDAFNFVCTFLAKAIARDGEGATK

SEQ ID NO: 1698364 - protein, 20 aa, Staphylococcus aureus
NHPVSYYFKNNFYITPSGML

SEQ ID NO: 1698365 - protein, 32 aa, Staphylococcus aureus
NHSITSKLIFASWSPRLHFNASLFQIEDDDIL

SEQ ID NO: 1698366 - protein, 31 aa, Staphylococcus aureus
NHVIARHYAIRNALRRALKALDLTLLVNDKD

SEQ ID NO: 1698367 - protein, 22 aa, Staphylococcus aureus
NHYDLPVFITNYPTKIKPFYMQ

SEQ ID NO: 1698368 - protein, 19 aa, Staphylococcus aureus
NIALLFEKNSTRTRTAFTV

SEQ ID NO: 1698369 - protein, 19 aa, Staphylococcus aureus
NIASLDLYAPVRNITSSRD

SEQ ID NO: 1698370 - protein, 29 aa, Staphylococcus aureus
NIDEKNYPSIFKHYLFFINEVEDRIKNNS

SEQ ID NO: 1698371 - protein, 18 aa, Staphylococcus aureus
NIDQLLYTIADKLEEYKD

SEQ ID NO: 1698372 - protein, 22 aa, Staphylococcus aureus
NIDTPIKVILLNIDPAQITTIL

SEQ ID NO: 1698373 - protein, 29 aa, Staphylococcus aureus
NIDTPKNIDFNEKLTYRTASDVVINNAQP

SEQ ID NO: 1698374 - protein, 17 aa, Staphylococcus aureus
NIDVVLRKDPKTGKPLL

SEQ ID NO: 1698375 - protein, 20 aa, Staphylococcus aureus
NIERLVPFRTLTGRQSYYVD

SEQ ID NO: 1698376 - protein, 20 aa, Staphylococcus aureus
NIESKIFIKGYTITNKSVIN

SEQ ID NO: 1698377 - protein, 19 aa, Staphylococcus aureus
NIESKIFIKGYTITNKSVT

SEQ ID NO: 1698378 - protein, 25 aa, Staphylococcus aureus
NIETYPMNWPIGMGQSFFGIIDRKS

SEQ ID NO: 1698379 - protein, 22 aa, Staphylococcus aureus
NIFCENIISVPLPMQLSTSYVW

SEQ ID NO: 1698380 - protein, 24 aa, Staphylococcus aureus
NIGDKELTHMWSGQSPRLATTHPA

SEQ ID NO: 1698381 - protein, 18 aa, Staphylococcus aureus
NIGILSQQPYIFSASIKE

SEQ ID NO: 1698382 - protein, 27 aa, Staphylococcus aureus
NIHFFNTILKYVKEGCLYPLSYYDGDW

SEQ ID NO: 1698383 - protein, 27 aa, Staphylococcus aureus
NIHLMNLKEKFLVKLQERAIPFELNGS

SEQ ID NO: 1698384 - protein, 26 aa, Staphylococcus aureus
NIHVNGFDFKLLILKGHMGISIQVKD

SEQ ID NO: 1698385 - protein, 21 aa, Staphylococcus aureus
NIIGVFHSKYLLAWSNKKEDQ

SEQ ID NO: 1698386 - protein, 19 aa, Staphylococcus aureus
NIISKIKPATTVKATALQQ

SEQ ID NO: 1698387 - protein, 28 aa, Staphylococcus aureus
NIKAQEKFLQHDLLFKINGSKIDGSKIL

SEQ ID NO: 1698388 - protein, 19 aa, Staphylococcus aureus
NIKNAYLNGVLKILKTEFS

SEQ ID NO: 1698389 - protein, 17 aa, Staphylococcus aureus
NIKNFKSVEFTSIESDP

SEQ ID NO: 1698390 - protein, 17 aa, Staphylococcus aureus
NILKLVFGNGENPALNI

SEQ ID NO: 1698391 - protein, 24 aa, Staphylococcus aureus
NILQAKRIILLAFGEKKRATITHL

SEQ ID NO: 1698392 - protein, 18 aa, Staphylococcus aureus
NINIIPMENGKKLKMWNI

SEQ ID NO: 1698393 - protein, 27 aa, Staphylococcus aureus
NIPIIEDDIFRDIFFSDPTPAIKTYDK

SEQ ID NO: 1698394 - protein, 19 aa, Staphylococcus aureus
NIPLDKKVIMYAPTWRDDE

SEQ ID NO: 1698395 - protein, 23 aa, Staphylococcus aureus
NIPLTVFSIMEEGNIKRAVMGKK

SEQ ID NO: 1698396 - protein, 21 aa, Staphylococcus aureus
NIPLVDYMFCTYNTDLYYNTM

SEQ ID NO: 1698397 - protein, 27 aa, Staphylococcus aureus
NIPREYLNPRIPKGRGIVKWNAFKTIP

SEQ ID NO: 1698398 - protein, 18 aa, Staphylococcus aureus
NIPSRLKALHWHEDMFQI

SEQ ID NO: 1698399 - protein, 18 aa, Staphylococcus aureus
NIRLYEKCKLLSHIETTS

SEQ ID NO: 1698400 - protein, 23 aa, Staphylococcus aureus
NIRNSLYMMLTRSFITSYLILSE

SEQ ID NO: 1698401 - protein, 19 aa, Staphylococcus aureus
NIRTFLHRYDLYETKYWSV

SEQ ID NO: 1698402 - protein, 26 aa, Staphylococcus aureus
NISANLIIIRLKNPSYAPYVAMSLIS

SEQ ID NO: 1698403 - protein, 22 aa, Staphylococcus aureus
NISIERQYFKQSYRFNNQDLKH

SEQ ID NO: 1698404 - protein, 22 aa, Staphylococcus aureus
NISKYAGDYIFLSKPSYGKFDF

SEQ ID NO: 1698405 - protein, 17 aa, Staphylococcus aureus
NIVVIQPATQVKTDTRN

SEQ ID NO: 1698406 - protein, 19 aa, Staphylococcus aureus
NIYNRYTLHRFNEEYALEP

SEQ ID NO: 1698407 - protein, 26 aa, Staphylococcus aureus
NIYTGSLYLSLISLLENRDLQAGETI

SEQ ID NO: 1698408 - protein, 22 aa, Staphylococcus aureus
NKAAVIRRIKKLIDAKLVKLDK

SEQ ID NO: 1698409 - protein, 21 aa, Staphylococcus aureus
NKETEFAVLLFSTVGVSNGDT

SEQ ID NO: 1698410 - protein, 20 aa, Staphylococcus aureus
NKFYKFAIYGKFGTGKTTFL

SEQ ID NO: 1698411 - protein, 21 aa, Staphylococcus aureus
NKFYKFAIYGKFGTGKTTFLT

SEQ ID NO: 1698412 - protein, 27 aa, Staphylococcus aureus
NKGDKLAQLVIVPIWTPELKQVEEFES

SEQ ID NO: 1698413 - protein, 23 aa, Staphylococcus aureus
NKGYRLYFDSPTNQQFFILSNEK

SEQ ID NO: 1698414 - protein, 27 aa, Staphylococcus aureus
NKKDMDWIKKNYDLYSKLIAGAIHGKP

SEQ ID NO: 1698415 - protein, 28 aa, Staphylococcus aureus
NKKDMDWIKKNYDLYSKLIAGAIHGKPI

SEQ ID NO: 1698416 - protein, 21 aa, Staphylococcus aureus
NKKDYGLYWVKSQGYDIVLEI

SEQ ID NO: 1698417 - protein, 22 aa, Staphylococcus aureus
NKKGFAFLRPEDKDMEDIFIPP

SEQ ID NO: 1698418 - protein, 17 aa, Staphylococcus aureus
NKKIIMNPSLAKQLNKA

SEQ ID NO: 1698419 - protein, 17 aa, Staphylococcus aureus
NKKIITHTFNLKSNAFS

SEQ ID NO: 1698420 - protein, 26 aa, Staphylococcus aureus
NKKPMLVAADIYRPAAINQLQTVGKQ

SEQ ID NO: 1698421 - protein, 28 aa, Staphylococcus aureus
NKKRNILDVLLNEKLVPGDMLYVTDLCI

SEQ ID NO: 1698422 - protein, 23 aa, Staphylococcus aureus
NKKSGLRIYKQPAIKVDSLPSTD

SEQ ID NO: 1698423 - protein, 22 aa, Staphylococcus aureus
NKKVGLWSFDFNIDWHAGGDKR

SEQ ID NO: 1698424 - protein, 21 aa, Staphylococcus aureus
NKLDVLLNKKLVPGDMLYITD

SEQ ID NO: 1698425 - protein, 22 aa, Staphylococcus aureus
NKLEQDLIKKFKLSGLVNADQT

SEQ ID NO: 1698426 - protein, 20 aa, Staphylococcus aureus
NKLFSILVRGPNIEAGGKSA

SEQ ID NO: 1698427 - protein, 20 aa, Staphylococcus aureus
NKLFSILVRGPNTEADEKSA

SEQ ID NO: 1698428 - protein, 19 aa, Staphylococcus aureus
NKLGYDQVLWLDGVEQKYI

SEQ ID NO: 1698429 - protein, 23 aa, Staphylococcus aureus
NKLIRPETLFKYEYFKKYVVEDI

SEQ ID NO: 1698430 - protein, 18 aa, Staphylococcus aureus
NKLLLSFQQSEKLRRHMS

SEQ ID NO: 1698431 - protein, 17 aa, Staphylococcus aureus
NKLVLYVPTYREDKADN

SEQ ID NO: 1698432 - protein, 28 aa, Staphylococcus aureus
NKNDMDWIKKNYDLYSKLIAGAIHGKPI

SEQ ID NO: 1698433 - protein, 29 aa, Staphylococcus aureus
NKNDMDWIKKNYDLYSKLIAGAIHGKPIG

SEQ ID NO: 1698434 - protein, 18 aa, Staphylococcus aureus
NKNDVIYVHCQSGIRSSI

SEQ ID NO: 1698435 - protein, 31 aa, Staphylococcus aureus
NKNLNLEFKYLFLKLIVKEDWSLSNLFNTGA

SEQ ID NO: 1698436 - protein, 33 aa, Staphylococcus aureus
NKNLTLENFVLIYYLDQIIAQANLRLATMSDNR

SEQ ID NO: 1698437 - protein, 26 aa, Staphylococcus aureus
NKNQHDKFVFGAIQKKLLNEYDFDYS

SEQ ID NO: 1698438 - protein, 25 aa, Staphylococcus aureus
NKQCDYSEILLPKNAGEEYKDREFL

SEQ ID NO: 1698439 - protein, 25 aa, Staphylococcus aureus
NKQYFDDLSLYIIAAQQKKLQLENE

SEQ ID NO: 1698440 - protein, 18 aa, Staphylococcus aureus
NKRYDIIIVDTPPVNTVT

SEQ ID NO: 1698441 - protein, 17 aa, Staphylococcus aureus
NKSFHFSGKVNLGNKYE

SEQ ID NO: 1698442 - protein, 23 aa, Staphylococcus aureus
NKSIAQVILRCLVERDIVVLAKS

SEQ ID NO: 1698443 - protein, 28 aa, Staphylococcus aureus
NKSKHNLLQCLIFVNDMYLLSNPKSQNI

SEQ ID NO: 1698444 - protein, 24 aa, Staphylococcus aureus
NKSVMYLLVNEGELSTYGPKGRFG

SEQ ID NO: 1698445 - protein, 19 aa, Staphylococcus aureus
NKTPLITYGMFIKDKTRKF

SEQ ID NO: 1698446 - protein, 21 aa, Staphylococcus aureus
NKTTTTFKYEVTRNSMSDSVS

SEQ ID NO: 1698447 - protein, 22 aa, Staphylococcus aureus
NKVKVIAWYDNEWGYSNRVVDV

SEQ ID NO: 1698448 - protein, 21 aa, Staphylococcus aureus
NKVSFLIDKKSGYFYIVNDEL

SEQ ID NO: 1698449 - protein, 30 aa, Staphylococcus aureus
NKVTWGYAKSILNTWLNANLKSIEQVRAFE

SEQ ID NO: 1698450 - protein, 20 aa, Staphylococcus aureus
NKYDIDFITGHSLGGREAVI

SEQ ID NO: 1698451 - protein, 22 aa, Staphylococcus aureus
NKYDPTLTLAFKLARLFDTTVD

SEQ ID NO: 1698452 - protein, 26 aa, Staphylococcus aureus
NKYGADSLRWALISDSAPWNNKRFSE

SEQ ID NO: 1698453 - protein, 20 aa, Staphylococcus aureus
NKYHITNMGAILFAKDLTKF

SEQ ID NO: 1698454 - protein, 21 aa, Staphylococcus aureus
NKYIRTLIIVTNYSVVKYISK

SEQ ID NO: 1698455 - protein, 21 aa, Staphylococcus aureus
NKYKGFVDLFIIDTPSVSYGG

SEQ ID NO: 1698456 - protein, 25 aa, Staphylococcus aureus
NLAIMGRYVLTPEIFDYLKTQKEGA

SEQ ID NO: 1698457 - protein, 18 aa, Staphylococcus aureus
NLASLDLYAPVRNITSSR

SEQ ID NO: 1698458 - protein, 30 aa, Staphylococcus aureus
NLATKHPFFEYARSFDFIIVSDIGLINVDV

SEQ ID NO: 1698459 - protein, 20 aa, Staphylococcus aureus
NLDGTRLLDQAKQTAKQQLN

SEQ ID NO: 1698460 - protein, 26 aa, Staphylococcus aureus
NLDGVWLGDLILIKRGLSDAEKAGIL

SEQ ID NO: 1698461 - protein, 26 aa, Staphylococcus aureus
NLDGVWLGDLILIKRGLSDREKAGIL

SEQ ID NO: 1698462 - protein, 25 aa, Staphylococcus aureus
NLDNPILYQYILQASRKFAGTFDQH

SEQ ID NO: 1698463 - protein, 24 aa, Staphylococcus aureus
NLENKVLMVGYTFYNTNKDEVEEL

SEQ ID NO: 1698464 - protein, 26 aa, Staphylococcus aureus
NLGKMETLLLCTRQFLWSTAKGYQQY

SEQ ID NO: 1698465 - protein, 27 aa, Staphylococcus aureus
NLGYQRASMYDIYPPYDGIPNEAFLIK

SEQ ID NO: 1698466 - protein, 17 aa, Staphylococcus aureus
NLHVDVVKLYFKKQRHG

SEQ ID NO: 1698467 - protein, 20 aa, Staphylococcus aureus
NLIIINKDRTPYDSDATLVI

SEQ ID NO: 1698468 - protein, 26 aa, Staphylococcus aureus
NLIPYARKLEVLYEDAFIIIVTKLNN

SEQ ID NO: 1698469 - protein, 20 aa, Staphylococcus aureus
NLKIIASCSFAKNMLEKEDS

SEQ ID NO: 1698470 - protein, 18 aa, Staphylococcus aureus
NLKPLFDSPARIVISHGN

SEQ ID NO: 1698471 - protein, 25 aa, Staphylococcus aureus
NLKTSKTPKLLFKGSGDIKGSSVGY

SEQ ID NO: 1698472 - protein, 22 aa, Staphylococcus aureus
NLLEAGMVITIEPGIYVPSVAG

SEQ ID NO: 1698473 - protein, 25 aa, Staphylococcus aureus
NLLQQGLNVFIIQLPSGMDPDEYIG

SEQ ID NO: 1698474 - protein, 18 aa, Staphylococcus aureus
NLLYEFLEILGEPDFDMI

SEQ ID NO: 1698475 - protein, 31 aa, Staphylococcus aureus
NLMLRSEAPFKKALLYAPLYPIEVRSTKNLS

SEQ ID NO: 1698476 - protein, 41 aa, Staphylococcus aureus
NLMLTHAYTMYRKMKLIQAEKWFLLKDFGRSGKGLFMATFE

SEQ ID NO: 1698477 - protein, 19 aa, Staphylococcus aureus
NLMMRYVMKKKNVDTLPSL

SEQ ID NO: 1698478 - protein, 26 aa, Staphylococcus aureus
NLNGWDFDHWLYEIACADKEIVTLLW

SEQ ID NO: 1698479 - protein, 24 aa, Staphylococcus aureus
NLNHFIYSISDFRNLIKDHALFHN

SEQ ID NO: 1698480 - protein, 18 aa, Staphylococcus aureus
NLPINQRIDIYIGVTGEL

SEQ ID NO: 1698481 - protein, 25 aa, Staphylococcus aureus
NLPKNFSQVFRPKAFKYSNGEIVFN

SEQ ID NO: 1698482 - protein, 29 aa, Staphylococcus aureus
NLQQGGHIIVWFGLTWSLELYQQANARLY

SEQ ID NO: 1698483 - protein, 29 aa, Staphylococcus aureus
NLQVWKKPSSFVIKPLPKNKYPDSIEDST

SEQ ID NO: 1698484 - protein, 30 aa, Staphylococcus aureus
NLTEAYTNYAILFISGTYPGGVIEAFSLTS

SEQ ID NO: 1698485 - protein, 28 aa, Staphylococcus aureus
NLTEAYTNYAILFISGTYPGGVIEVFSL

SEQ ID NO: 1698486 - protein, 28 aa, Staphylococcus aureus
NLTEPYTNYSVLLISGTYPGGIIETFGL

SEQ ID NO: 1698487 - protein, 17 aa, Staphylococcus aureus
NLTHLNDAQKQSFESQI

SEQ ID NO: 1698488 - protein, 26 aa, Staphylococcus aureus
NLTMKISREQLLKQQLELIVRDAGLN

SEQ ID NO: 1698489 - protein, 17 aa, Staphylococcus aureus
NLTPRYKLKTESELKRL

SEQ ID NO: 1698490 - protein, 23 aa, Staphylococcus aureus
NLTYLELSILYTISTRPSEILNL

SEQ ID NO: 1698491 - protein, 22 aa, Staphylococcus aureus
NMAEKYYHCLILLIYLNVSLLN

SEQ ID NO: 1698492 - protein, 17 aa, Staphylococcus aureus
NMDDRIPINVWTGDSIA

SEQ ID NO: 1698493 - protein, 17 aa, Staphylococcus aureus
NMFWRQNISQMWVETEF

SEQ ID NO: 1698494 - protein, 28 aa, Staphylococcus aureus
NMGMSAVMNMKILINILGAFHQQYPNVT

SEQ ID NO: 1698495 - protein, 21 aa, Staphylococcus aureus
NMGYRFPTQYGQSGYAAFVVF

SEQ ID NO: 1698496 - protein, 26 aa, Staphylococcus aureus
NMIIINESGLYSLIFDASKQSKNENI

SEQ ID NO: 1698497 - protein, 31 aa, Staphylococcus aureus
NMISFHSTNDLLSWLQDPFAKEMPGKRINIR

SEQ ID NO: 1698498 - protein, 25 aa, Staphylococcus aureus
NMLPDGHLLNILNKFADILIRQKIE

SEQ ID NO: 1698499 - protein, 23 aa, Staphylococcus aureus
NMNAWLKPYRRALHLEEPVVKIT

SEQ ID NO: 1698500 - protein, 18 aa, Staphylococcus aureus
NMNPWFEKIEEILLNVKG

SEQ ID NO: 1698501 - protein, 31 aa, Staphylococcus aureus
NMQSAYYYNIFVQKVFLKAIDSCWLEQVDYL

SEQ ID NO: 1698502 - protein, 26 aa, Staphylococcus aureus
NNAMDQLKQAIADHDTIVAGGNYTNA

SEQ ID NO: 1698503 - protein, 32 aa, Staphylococcus aureus
NNAPYQFVDIKTLVYPGFATDLQQPITPLLFM

SEQ ID NO: 1698504 - protein, 24 aa, Staphylococcus aureus
NNEIFHRYFTKEQLISSIIQTLLN

SEQ ID NO: 1698505 - protein, 23 aa, Staphylococcus aureus
NNEKVFKIINWLFSNYKRLDEET

SEQ ID NO: 1698506 - protein, 24 aa, Staphylococcus aureus
NNEKWLNIVRKLVDQFIFKEYFKY

SEQ ID NO: 1698507 - protein, 33 aa, Staphylococcus aureus
NNENFNYKVKAYLSLLNLKGKNLYLIDGIKISE

SEQ ID NO: 1698508 - protein, 24 aa, Staphylococcus aureus
NNEVRIQWRVADIKIPTSEIKNIT

SEQ ID NO: 1698509 - protein, 25 aa, Staphylococcus aureus
NNFENWFPFIHNKSTAYISPNKHTW

SEQ ID NO: 1698510 - protein, 17 aa, Staphylococcus aureus
NNFGPFLKEEIDFSKID

SEQ ID NO: 1698511 - protein, 22 aa, Staphylococcus aureus
NNFLLYLQDFERKDFINMKPKQ

SEQ ID NO: 1698512 - protein, 22 aa, Staphylococcus aureus
NNGFIVFVRVKFYDGKDALQPN

SEQ ID NO: 1698513 - protein, 24 aa, Staphylococcus aureus
NNGFLGRTVRCYRAFFGGNNAGHT

SEQ ID NO: 1698514 - protein, 17 aa, Staphylococcus aureus
NNHLRQLHEIRPQHFVF

SEQ ID NO: 1698515 - protein, 29 aa, Staphylococcus aureus
NNHQDQKLYFYFSSPGKDQIIYKESLTYN

SEQ ID NO: 1698516 - protein, 29 aa, Staphylococcus aureus
NNHQDQKLYFYFSSPGKNQIIYKESLTYN

SEQ ID NO: 1698517 - protein, 24 aa, Staphylococcus aureus
NNHSLFFKLAILYFTESGEKVRRR

SEQ ID NO: 1698518 - protein, 26 aa, Staphylococcus aureus
NNIRSAVYLLLCKMIRQPNFAVLEVS

SEQ ID NO: 1698519 - protein, 20 aa, Staphylococcus aureus
NNKEISSFIRLLLNKNQSNY

SEQ ID NO: 1698520 - protein, 23 aa, Staphylococcus aureus
NNKHDLAALSYLTFVALDDEGKP

SEQ ID NO: 1698521 - protein, 23 aa, Staphylococcus aureus
NNLEELLILNAIHIPLHAGKIEE

SEQ ID NO: 1698522 - protein, 20 aa, Staphylococcus aureus
NNLFLFSEVGYFTSKGDLLY

SEQ ID NO: 1698523 - protein, 24 aa, Staphylococcus aureus
NNMNPWFEKIEEILLNVKGVIRIL

SEQ ID NO: 1698524 - protein, 19 aa, Staphylococcus aureus
NNNRFPENLSYVRSYTDPK

SEQ ID NO: 1698525 - protein, 32 aa, Staphylococcus aureus
NNPDSLRYFYTDYIHELLLLEDSNKFKGVKAT

SEQ ID NO: 1698526 - protein, 24 aa, Staphylococcus aureus
NNRHISLIADVFKAFQSLYNGHYN

SEQ ID NO: 1698527 - protein, 23 aa, Staphylococcus aureus
NNTGFVLVYFMNSSVKYIINKNT

SEQ ID NO: 1698528 - protein, 24 aa, Staphylococcus aureus
NNTKNLIYHLYDDRGLWVDFNNNE

SEQ ID NO: 1698529 - protein, 24 aa, Staphylococcus aureus
NNTPKVGAIMQTTQGYYGHVAYVE

SEQ ID NO: 1698530 - protein, 27 aa, Staphylococcus aureus
NNTSDLPIGVIPVDSLYSPVERVNYTV

SEQ ID NO: 1698531 - protein, 18 aa, Staphylococcus aureus
NNTYFFKLSSFRKNIRKD

SEQ ID NO: 1698532 - protein, 19 aa, Staphylococcus aureus
NNTYFFKLSSFRKNIRKDN

SEQ ID NO: 1698533 - protein, 18 aa, Staphylococcus aureus
NNTYFLAVYDNAINIFED

SEQ ID NO: 1698534 - protein, 26 aa, Staphylococcus aureus
NNVPLKSFHVIDLNELYIATDAMRDV

SEQ ID NO: 1698535 - protein, 25 aa, Staphylococcus aureus
NNVPLKSFHVVDLSELYIAMDAMHD

SEQ ID NO: 1698536 - protein, 27 aa, Staphylococcus aureus
NPAKGLLQYIPQTFRHYAVRGHNNIYS

SEQ ID NO: 1698537 - protein, 19 aa, Staphylococcus aureus
NPDFFMYQAYAAQVNREIA

SEQ ID NO: 1698538 - protein, 27 aa, Staphylococcus aureus
NPDLSYAANFLYMLRGELPTDIKVEAF

SEQ ID NO: 1698539 - protein, 20 aa, Staphylococcus aureus
NPEATAVAGYKAWKNKFDRQ

SEQ ID NO: 1698540 - protein, 24 aa, Staphylococcus aureus
NPEIHTLCRQLLLDGCRVAQAEGL

SEQ ID NO: 1698541 - protein, 23 aa, Staphylococcus aureus
NPEIRILCRQLLLDGCRVAQAEG

SEQ ID NO: 1698542 - protein, 26 aa, Staphylococcus aureus
NPEKHHLYINDFPAIPIEENDNIRLL

SEQ ID NO: 1698543 - protein, 26 aa, Staphylococcus aureus
NPELSYAANFLYMLRGELPTDIEVEA

SEQ ID NO: 1698544 - protein, 21 aa, Staphylococcus aureus
NPELYIIDEPFLGLDPLGIQS

SEQ ID NO: 1698545 - protein, 18 aa, Staphylococcus aureus
NPEQFAQDHLAFCKAHNL

SEQ ID NO: 1698546 - protein, 28 aa, Staphylococcus aureus
NPGNTEAMIKYLLPKATVVAPNLFEAGQ

SEQ ID NO: 1698547 - protein, 25 aa, Staphylococcus aureus
NPKTERKPVITGYRAHNVFDVADTK

SEQ ID NO: 1698548 - protein, 20 aa, Staphylococcus aureus
NPLKSSGFGDDWLQNAKLMN

SEQ ID NO: 1698549 - protein, 22 aa, Staphylococcus aureus
NPLWHVYRLVKFSKVFKNVIII

SEQ ID NO: 1698550 - protein, 31 aa, Staphylococcus aureus
NPQLRLYGLGAYELFSLMYDIHTVRMTIIQP

SEQ ID NO: 1698551 - protein, 18 aa, Staphylococcus aureus
NPQNFIQLKDKKYAQTLK

SEQ ID NO: 1698552 - protein, 23 aa, Staphylococcus aureus
NPTIVIHYDIRHLSAEFAQIIAN

SEQ ID NO: 1698553 - protein, 22 aa, Staphylococcus aureus
NPTIVIHYDIRHLSTEFAQIIA

SEQ ID NO: 1698554 - protein, 28 aa, Staphylococcus aureus
NQALDDIALVTPDHIVRAAARDAVKQQY

SEQ ID NO: 1698555 - protein, 26 aa, Staphylococcus aureus
NQAQQIANGIPTPVLTPDTVTQAVTT

SEQ ID NO: 1698556 - protein, 25 aa, Staphylococcus aureus
NQASDFLKFRGLVDQYKEIELNKKI

SEQ ID NO: 1698557 - protein, 26 aa, Staphylococcus aureus
NQCVSTGYFRLPTKDNVQLFTNQYCS

SEQ ID NO: 1698558 - protein, 21 aa, Staphylococcus aureus
NQEIIDYIDTLKYIDQYSSAG

SEQ ID NO: 1698559 - protein, 24 aa, Staphylococcus aureus
NQEIIDYIDTLNYIDQYSSAGSFR

SEQ ID NO: 1698560 - protein, 25 aa, Staphylococcus aureus
NQEIIDYIDTLNYIDQYSSAGSFRR

SEQ ID NO: 1698561 - protein, 24 aa, Staphylococcus aureus
NQERKFLGLTLTPNKHRLQEYIKS

SEQ ID NO: 1698562 - protein, 24 aa, Staphylococcus aureus
NQGIYDFDILVVALGFVSETFRIE

SEQ ID NO: 1698563 - protein, 25 aa, Staphylococcus aureus
NQGLDLLQEIIWNPLIENKAFNDNF

SEQ ID NO: 1698564 - protein, 25 aa, Staphylococcus aureus
NQHAKYIRFMVDKLMIGKSASEVVR

SEQ ID NO: 1698565 - protein, 27 aa, Staphylococcus aureus
NQIIQVCARLIYLLSLQKGVKCINLKT

SEQ ID NO: 1698566 - protein, 19 aa, Staphylococcus aureus
NQINWVGFYLLEQNELILG

SEQ ID NO: 1698567 - protein, 28 aa, Staphylococcus aureus
NQKAQALDHAMELLRNSIADNQATLASE

SEQ ID NO: 1698568 - protein, 19 aa, Staphylococcus aureus
NQKEIIDFEFVIAKSFVEG

SEQ ID NO: 1698569 - protein, 26 aa, Staphylococcus aureus
NQKFKLKLRLYELEKQLPQHFIRISK

SEQ ID NO: 1698570 - protein, 17 aa, Staphylococcus aureus
NQKLVEQGIYILKIFNP

SEQ ID NO: 1698571 - protein, 18 aa, Staphylococcus aureus
NQLLFTKHNLRGIEFPGG

SEQ ID NO: 1698572 - protein, 20 aa, Staphylococcus aureus
NQLVDLLYTSTFIIEKPSYP

SEQ ID NO: 1698573 - protein, 21 aa, Staphylococcus aureus
NQMAFKPIIADHLKLVDTSIY

SEQ ID NO: 1698574 - protein, 23 aa, Staphylococcus aureus
NQMFDLFHLYIEQFDNIIEKFYE

SEQ ID NO: 1698575 - protein, 26 aa, Staphylococcus aureus
NQMQKPYVFFLKDGKAREVIKRQSLR

SEQ ID NO: 1698576 - protein, 26 aa, Staphylococcus aureus
NQNHQLFLLGKDKEKYKEGIEGKDVF

SEQ ID NO: 1698577 - protein, 23 aa, Staphylococcus aureus
NQNVHFEVLLVKLAEQIKGQPQV

SEQ ID NO: 1698578 - protein, 20 aa, Staphylococcus aureus
NQRDLNIGILSQQPYIFSAS

SEQ ID NO: 1698579 - protein, 25 aa, Staphylococcus aureus
NQRKIRRDLYDSRGFLSCSRTLTTN

SEQ ID NO: 1698580 - protein, 22 aa, Staphylococcus aureus
NQTIEVGKTMNPVVLTTTDNGT

SEQ ID NO: 1698581 - protein, 25 aa, Staphylococcus aureus
NQVLKQLMHAMSLKLVDFKIEFGKT

SEQ ID NO: 1698582 - protein, 18 aa, Staphylococcus aureus
NQVNTTKAALNGAQNLAQ

SEQ ID NO: 1698583 - protein, 21 aa, Staphylococcus aureus
NQYIQIMNALPIIITKEQLKM

SEQ ID NO: 1698584 - protein, 22 aa, Staphylococcus aureus
NRENIKKWFGKAWQSVKSTTGS

SEQ ID NO: 1698585 - protein, 24 aa, Staphylococcus aureus
NREQHLQAIIEWTLQQIENNFEFE

SEQ ID NO: 1698586 - protein, 20 aa, Staphylococcus aureus
NRFLDLFDESLFVKVGMELF

SEQ ID NO: 1698587 - protein, 19 aa, Staphylococcus aureus
NRFRADSQFLYKSAQRGDL

SEQ ID NO: 1698588 - protein, 20 aa, Staphylococcus aureus
NRFRADSQFLYKSAQRGDLG

SEQ ID NO: 1698589 - protein, 18 aa, Staphylococcus aureus
NRGLINELFIKLANEFNI

SEQ ID NO: 1698590 - protein, 23 aa, Staphylococcus aureus
NRHISLIADVFKAFQTLYNGHYN

SEQ ID NO: 1698591 - protein, 25 aa, Staphylococcus aureus
NRHLLEKDLLYLNKPDSLTLLKSSA

SEQ ID NO: 1698592 - protein, 24 aa, Staphylococcus aureus
NRKDIPFDELVLFSSARSAGKEVE

SEQ ID NO: 1698593 - protein, 26 aa, Staphylococcus aureus
NRKEQVVLFLNRRGYASFMLCRDCGY

SEQ ID NO: 1698594 - protein, 17 aa, Staphylococcus aureus
NRKFFTLFHFIIKRTLS

SEQ ID NO: 1698595 - protein, 18 aa, Staphylococcus aureus
NRKMILNKSPNPVMRGHT

SEQ ID NO: 1698596 - protein, 20 aa, Staphylococcus aureus
NRLFIDCKVPQWVRDQMPIV

SEQ ID NO: 1698597 - protein, 23 aa, Staphylococcus aureus
NRLINDMIYFVRDTIMNKTSEKD

SEQ ID NO: 1698598 - protein, 20 aa, Staphylococcus aureus
NRLTLVSLNKKYRDLHFYRN

SEQ ID NO: 1698599 - protein, 27 aa, Staphylococcus aureus
NRNKELYIDLLTILKPRIQKSIKLKEI

SEQ ID NO: 1698600 - protein, 28 aa, Staphylococcus aureus
NRNMIIINESGLYSLIFDASKQSKNENI

SEQ ID NO: 1698601 - protein, 28 aa, Staphylococcus aureus
NRPEQGLLKLRKSLNLFANIRPTTVVKG

SEQ ID NO: 1698602 - protein, 25 aa, Staphylococcus aureus
NRPEQGLLKLRKSLNLFANIRSTTV

SEQ ID NO: 1698603 - protein, 27 aa, Staphylococcus aureus
NRPEQGLLKLRKSLNLFVNIRPTTVVK

SEQ ID NO: 1698604 - protein, 23 aa, Staphylococcus aureus
NRQMIKWTKLYIDQFLSSWTMPK

SEQ ID NO: 1698605 - protein, 20 aa, Staphylococcus aureus
NRRLLIVPFNADFNDSNENV

SEQ ID NO: 1698606 - protein, 22 aa, Staphylococcus aureus
NRRLNINPTWEYIKIKANEKIE

SEQ ID NO: 1698607 - protein, 30 aa, Staphylococcus aureus
NRSFKENGQWYKLEKLWEKAIKSGKSIENV

SEQ ID NO: 1698608 - protein, 19 aa, Staphylococcus aureus
NRVMPLLKTFRLENELKVF

SEQ ID NO: 1698609 - protein, 20 aa, Staphylococcus aureus
NRVSWLEKWQCIEKKGRKEI

SEQ ID NO: 1698610 - protein, 24 aa, Staphylococcus aureus
NSAPLIYKTLSALYHNFAGFGLNI

SEQ ID NO: 1698611 - protein, 18 aa, Staphylococcus aureus
NSFAMRLNQLGKKAHVVG

SEQ ID NO: 1698612 - protein, 28 aa, Staphylococcus aureus
NSGFRNEYYYLTAIPYTLDEYKRYFQPL

SEQ ID NO: 1698613 - protein, 23 aa, Staphylococcus aureus
NSGKFKFKYLDDWLYTKSIIFKN

SEQ ID NO: 1698614 - protein, 17 aa, Staphylococcus aureus
NSHTKFFFGMDNVGVDD

SEQ ID NO: 1698615 - protein, 17 aa, Staphylococcus aureus
NSIAWLAYHLASLHSNE

SEQ ID NO: 1698616 - protein, 20 aa, Staphylococcus aureus
NSINFISSGNIRKAIKKNNY

SEQ ID NO: 1698617 - protein, 17 aa, Staphylococcus aureus
NSKFKNMISFHSTNDLL

SEQ ID NO: 1698618 - protein, 24 aa, Staphylococcus aureus
NSKNELIGILYAGSGKDESEKNFG

SEQ ID NO: 1698619 - protein, 26 aa, Staphylococcus aureus
NSLDNLIIYALYDQFRDMITLTDDGY

SEQ ID NO: 1698620 - protein, 19 aa, Staphylococcus aureus
NSLLRIDNIAQQTYAKFKA

SEQ ID NO: 1698621 - protein, 17 aa, Staphylococcus aureus
NSLLTGHPNHLIPNITF

SEQ ID NO: 1698622 - protein, 26 aa, Staphylococcus aureus
NSMKLHALIDGLALHKLLNPNGVSND

SEQ ID NO: 1698623 - protein, 20 aa, Staphylococcus aureus
NSMRILLIKVYKMLLKNNLG

SEQ ID NO: 1698624 - protein, 19 aa, Staphylococcus aureus
NSMVTDFEDLKDLGKEMEQ

SEQ ID NO: 1698625 - protein, 25 aa, Staphylococcus aureus
NSNGLMIRALAEKLGLEVGIYKTQK

SEQ ID NO: 1698626 - protein, 45 aa, Staphylococcus aureus
NSPIYKLAIEYKLAFPLHPEFRTMPVVWYCPPLSPIMSYFEGKNT

SEQ ID NO: 1698627 - protein, 21 aa, Staphylococcus aureus
NSPTQLLAWLKAEQGLDIPNL

SEQ ID NO: 1698628 - protein, 26 aa, Staphylococcus aureus
NSSFRGLYQFIRFIDELIERGKDFGE

SEQ ID NO: 1698629 - protein, 22 aa, Staphylococcus aureus
NSSSILTSLFLTANNIPNNLSS

SEQ ID NO: 1698630 - protein, 23 aa, Staphylococcus aureus
NSTGKWFGKAWQSVKSTTGSIYN

SEQ ID NO: 1698631 - protein, 24 aa, Staphylococcus aureus
NSVFPHILRGVNILGIDSVFTAIK

SEQ ID NO: 1698632 - protein, 20 aa, Staphylococcus aureus
NTAMSNLQRGINDEAATKAA

SEQ ID NO: 1698633 - protein, 28 aa, Staphylococcus aureus
NTARIIDIAITDYLLFKKDPKQTLIENL

SEQ ID NO: 1698634 - protein, 26 aa, Staphylococcus aureus
NTARQGLTLDRQPALTTLHGASNLNQ

SEQ ID NO: 1698635 - protein, 27 aa, Staphylococcus aureus
NTDSKYAYVLYPGLSKDVFKSKASKVT

SEQ ID NO: 1698636 - protein, 25 aa, Staphylococcus aureus
NTEDVAMAFGFFDGMHKGHDKVFDI

SEQ ID NO: 1698637 - protein, 23 aa, Staphylococcus aureus
NTEIAFSGLKKAISNWGKAGKDP

SEQ ID NO: 1698638 - protein, 20 aa, Staphylococcus aureus
NTELIARMKHHVKFGNSNVT

SEQ ID NO: 1698639 - protein, 24 aa, Staphylococcus aureus
NTERRIQRLYQALKPLGESKPDWK

SEQ ID NO: 1698640 - protein, 17 aa, Staphylococcus aureus
NTEYTPLYLNAENHTLN

SEQ ID NO: 1698641 - protein, 22 aa, Staphylococcus aureus
NTFFKTYLQQKGFNPELMSATI

SEQ ID NO: 1698642 - protein, 30 aa, Staphylococcus aureus
NTFFNKYRFVIYEYIKKWNQINKKSGLRIY

SEQ ID NO: 1698643 - protein, 18 aa, Staphylococcus aureus
NTFLTPYLSTPLAEGADI

SEQ ID NO: 1698644 - protein, 33 aa, Staphylococcus aureus
NTGSEEMDLPLKELALITGAALLARRRSKKEKE

SEQ ID NO: 1698645 - protein, 22 aa, Staphylococcus aureus
NTIHWQFGHVLTIFESALAVAG

SEQ ID NO: 1698646 - protein, 19 aa, Staphylococcus aureus
NTIISGPALVAQWINLQYY

SEQ ID NO: 1698647 - protein, 18 aa, Staphylococcus aureus
NTIKSVHFTNLETSPMGS

SEQ ID NO: 1698648 - protein, 30 aa, Staphylococcus aureus
NTIKTYCYHLKLFYEFMSQSRIELGDLQFE

SEQ ID NO: 1698649 - protein, 24 aa, Staphylococcus aureus
NTINGLQHLTQLQKDNLKHQIEQA

SEQ ID NO: 1698650 - protein, 30 aa, Staphylococcus aureus
NTKKTYAYALKKFFVYLESKKICYKEVSFD

SEQ ID NO: 1698651 - protein, 17 aa, Staphylococcus aureus
NTLAEMPISLTTQLFNT

SEQ ID NO: 1698652 - protein, 23 aa, Staphylococcus aureus
NTLDQAMNTLRQSIANKDATKAS

SEQ ID NO: 1698653 - protein, 17 aa, Staphylococcus aureus
NTLNKLLENQQILALES

SEQ ID NO: 1698654 - protein, 17 aa, Staphylococcus aureus
NTRYCGTTKRRFRFGKS

SEQ ID NO: 1698655 - protein, 25 aa, Staphylococcus aureus
NTSDLPIGVIPVDSLYSPVERVNYT

SEQ ID NO: 1698656 - protein, 34 aa, Staphylococcus aureus
NTSDNPRFKRWVIGSILFRTYYHNMVTHLLEAAY

SEQ ID NO: 1698657 - protein, 26 aa, Staphylococcus aureus
NTTDAINIYFVPSDLVNPTISVGNYT

SEQ ID NO: 1698658 - protein, 22 aa, Staphylococcus aureus
NTTLLSTFIYKIANERLFSREE

SEQ ID NO: 1698659 - protein, 21 aa, Staphylococcus aureus
NTWFGGHVVVLPGVTIGEGSV

SEQ ID NO: 1698660 - protein, 17 aa, Staphylococcus aureus
NTYFLAVYDNAINIFED

SEQ ID NO: 1698661 - protein, 26 aa, Staphylococcus aureus
NVAILDDGYYLPMDKYLFVYHDQLEY

SEQ ID NO: 1698662 - protein, 27 aa, Staphylococcus aureus
NVAILDDGYYLPMDKYLFVYHDQLEYI

SEQ ID NO: 1698663 - protein, 18 aa, Staphylococcus aureus
NVAWFWHTSFSHTTEQAR

SEQ ID NO: 1698664 - protein, 17 aa, Staphylococcus aureus
NVDAAMDKLRQSIADNA

SEQ ID NO: 1698665 - protein, 28 aa, Staphylococcus aureus
NVDFKYEAPWFQLSPTHFVKSWLLDSRA

SEQ ID NO: 1698666 - protein, 17 aa, Staphylococcus aureus
NVDHFIDVLKTYLPEGP

SEQ ID NO: 1698667 - protein, 39 aa, Staphylococcus aureus
NVDLWYGFQCFDYANAGWKVLFGLLLKGVGAKDIPFANN

SEQ ID NO: 1698668 - protein, 26 aa, Staphylococcus aureus
NVEEVYKQLLLMSPIITLGEDESFEI

SEQ ID NO: 1698669 - protein, 21 aa, Staphylococcus aureus
NVEVPVKVYPVANAKAPSRDV

SEQ ID NO: 1698670 - protein, 28 aa, Staphylococcus aureus
NVFIAFQAFIIKFLNPSFLFHNKTNIAI

SEQ ID NO: 1698671 - protein, 17 aa, Staphylococcus aureus
NVFYATQVAIEPPTFVV

SEQ ID NO: 1698672 - protein, 19 aa, Staphylococcus aureus
NVFYWAGANYKNFKTRTFK

SEQ ID NO: 1698673 - protein, 18 aa, Staphylococcus aureus
NVGDAIVVGNAYGRIRAM

SEQ ID NO: 1698674 - protein, 19 aa, Staphylococcus aureus
NVGKSTIFNRIVGERVSIV

SEQ ID NO: 1698675 - protein, 25 aa, Staphylococcus aureus
NVGRWFAYFVKHAPRVPFVIIGKNT

SEQ ID NO: 1698676 - protein, 26 aa, Staphylococcus aureus
NVGYKNEYFYITYSSISLKEYRKYYE

SEQ ID NO: 1698677 - protein, 18 aa, Staphylococcus aureus
NVGYLDSLLIHRPSPLMD

SEQ ID NO: 1698678 - protein, 20 aa, Staphylococcus aureus
NVHASLLPKYRGGAPIHQAI

SEQ ID NO: 1698679 - protein, 21 aa, Staphylococcus aureus
NVIFEHCLPSFHNADTKIGQQ

SEQ ID NO: 1698680 - protein, 18 aa, Staphylococcus aureus
NVILFIDELHTLVGAGGA

SEQ ID NO: 1698681 - protein, 20 aa, Staphylococcus aureus
NVIYTFLKNNKNFEFEPFQH

SEQ ID NO: 1698682 - protein, 22 aa, Staphylococcus aureus
NVKFEDMLDIKFYSLDGINGLS

SEQ ID NO: 1698683 - protein, 26 aa, Staphylococcus aureus
NVKKAWWQKFITQSPFNIGIDAAILM

SEQ ID NO: 1698684 - protein, 17 aa, Staphylococcus aureus
NVKKFMHYLIKAQEHYQ

SEQ ID NO: 1698685 - protein, 17 aa, Staphylococcus aureus
NVKKFVNIGKKLLDLHL

SEQ ID NO: 1698686 - protein, 27 aa, Staphylococcus aureus
NVKKKEFLSLIPNVTWNYIKTKLEELD

SEQ ID NO: 1698687 - protein, 22 aa, Staphylococcus aureus
NVKYIEAPYEPHKFMKMVKDKE

SEQ ID NO: 1698688 - protein, 17 aa, Staphylococcus aureus
NVLNCKSDFWKTLKYKK

SEQ ID NO: 1698689 - protein, 25 aa, Staphylococcus aureus
NVLNGDLFRFYKNPDFKKVNPSKYK

SEQ ID NO: 1698690 - protein, 19 aa, Staphylococcus aureus
NVLYDRYQLPLFIVENGFG

SEQ ID NO: 1698691 - protein, 19 aa, Staphylococcus aureus
NVNFDYLFAAIGGGGLISG

SEQ ID NO: 1698692 - protein, 24 aa, Staphylococcus aureus
NVNGLLRQYFPKGTDFKMITDEAL

SEQ ID NO: 1698693 - protein, 17 aa, Staphylococcus aureus
NVNKVLADKLKEIEASN

SEQ ID NO: 1698694 - protein, 24 aa, Staphylococcus aureus
NVPNATFMMIYDADRFGLSTLHQL

SEQ ID NO: 1698695 - protein, 17 aa, Staphylococcus aureus
NVPVDYYVRVNMKAFVE

SEQ ID NO: 1698696 - protein, 17 aa, Staphylococcus aureus
NVRILLKDVIVSGVSID

SEQ ID NO: 1698697 - protein, 20 aa, Staphylococcus aureus
NVRMTYYHNVSHKQQEVILK

SEQ ID NO: 1698698 - protein, 26 aa, Staphylococcus aureus
NVSFDYVDWIKLSLGPLARENYYMYK

SEQ ID NO: 1698699 - protein, 25 aa, Staphylococcus aureus
NWENKFIKDIFIFENNRRKPITSSL

SEQ ID NO: 1698700 - protein, 22 aa, Staphylococcus aureus
NWFSETSLYEKCEILEVLAKMK

SEQ ID NO: 1698701 - protein, 17 aa, Staphylococcus aureus
NWIPNFYRQCKLGVGRR

SEQ ID NO: 1698702 - protein, 28 aa, Staphylococcus aureus
NWLHSTKFMLPKWLYKIAKQRADNKQLQ

SEQ ID NO: 1698703 - protein, 39 aa, Staphylococcus aureus
NWVKSGIKEIEMFKIMGLPFISHSLVSQDNQSISKKMTG

SEQ ID NO: 1698704 - protein, 22 aa, Staphylococcus aureus
NYDEVRKFALEHKPKLIVAGAS

SEQ ID NO: 1698705 - protein, 18 aa, Staphylococcus aureus
NYDKVISFIKINDSNYRL

SEQ ID NO: 1698706 - protein, 18 aa, Staphylococcus aureus
NYDLNYIKGYLPVHNNEK

SEQ ID NO: 1698707 - protein, 25 aa, Staphylococcus aureus
NYEDYIELRQLRYIYDVYFDRDDCI

SEQ ID NO: 1698708 - protein, 17 aa, Staphylococcus aureus
NYFYPDNPKAYQISQFD

SEQ ID NO: 1698709 - protein, 17 aa, Staphylococcus aureus
NYGLFINGEFVKGSSDE

SEQ ID NO: 1698710 - protein, 19 aa, Staphylococcus aureus
NYIKNLLVVDYPQSVKGAY

SEQ ID NO: 1698711 - protein, 22 aa, Staphylococcus aureus
NYLMFGTDLFSKGHNQVVPFRN

SEQ ID NO: 1698712 - protein, 21 aa, Staphylococcus aureus
NYLRAYLIIDLSISSDLAITI

SEQ ID NO: 1698713 - protein, 18 aa, Staphylococcus aureus
NYLSILQHYGMQTSLLDI

SEQ ID NO: 1698714 - protein, 27 aa, Staphylococcus aureus
NYMSRLMNPVRFLDYLDVSKLNGGEVN

SEQ ID NO: 1698715 - protein, 28 aa, Staphylococcus aureus
NYMSRLMNPVRFLDYLDVSKLNGGEVNE

SEQ ID NO: 1698716 - protein, 17 aa, Staphylococcus aureus
NYPEYIYHFIVEGNRRL

SEQ ID NO: 1698717 - protein, 21 aa, Staphylococcus aureus
NYQVLRQTKVPAVLLELGYIS

SEQ ID NO: 1698718 - protein, 19 aa, Staphylococcus aureus
NYSSIKLISIQLPLLEEQQ

SEQ ID NO: 1698719 - protein, 21 aa, Staphylococcus aureus
NYTLLQYGFLSSENKLYKLNE

SEQ ID NO: 1698720 - protein, 21 aa, Staphylococcus aureus
NYYFHGHIVPGWQGVKKTFDT

SEQ ID NO: 1698721 - protein, 27 aa, Staphylococcus aureus
PAADPEYIFYAYKRFNFELKDPNFTSE

SEQ ID NO: 1698722 - protein, 25 aa, Staphylococcus aureus
PAEESYFLFYINRPSIIVGKNQNTI

SEQ ID NO: 1698723 - protein, 24 aa, Staphylococcus aureus
PAEIKFLLYFAKMTKKDKNKLYHF

SEQ ID NO: 1698724 - protein, 24 aa, Staphylococcus aureus
PAFINDILKVEGVKSIFHVMDFIS

SEQ ID NO: 1698725 - protein, 24 aa, Staphylococcus aureus
PANLMGIRAFRKLLPNIPHVAIFD

SEQ ID NO: 1698726 - protein, 26 aa, Staphylococcus aureus
PANVKKEHWGFDNPAGKPWSEFQRVR

SEQ ID NO: 1698727 - protein, 17 aa, Staphylococcus aureus
PATNPLFQSFFDASVEA

SEQ ID NO: 1698728 - protein, 18 aa, Staphylococcus aureus
PCCFKLYNDPFDMVYVMM

SEQ ID NO: 1698729 - protein, 27 aa, Staphylococcus aureus
PDAYGSQLGLKYYIQQKFPQKQVFAVG

SEQ ID NO: 1698730 - protein, 24 aa, Staphylococcus aureus
PDDIEMLQDLVLAATNEAMNKADE

SEQ ID NO: 1698731 - protein, 25 aa, Staphylococcus aureus
PDIEPYFHKVILLSGALRLDTLESA

SEQ ID NO: 1698732 - protein, 20 aa, Staphylococcus aureus
PDIVLLDLVMPGMNGIEITV

SEQ ID NO: 1698733 - protein, 19 aa, Staphylococcus aureus
PDKQGAYTDAYNAAKNIVN

SEQ ID NO: 1698734 - protein, 20 aa, Staphylococcus aureus
PDKQGAYTDAYNAAKNIVNG

SEQ ID NO: 1698735 - protein, 17 aa, Staphylococcus aureus
PDLIIADVNRHKKIKSE

SEQ ID NO: 1698736 - protein, 18 aa, Staphylococcus aureus
PDLPGIVESYEGYLSVFV

SEQ ID NO: 1698737 - protein, 31 aa, Staphylococcus aureus
PDLPGIVESYEGYLSVFVKDDANKLFNFTPS

SEQ ID NO: 1698738 - protein, 17 aa, Staphylococcus aureus
PDQLAIVIVIDIAYNLY

SEQ ID NO: 1698739 - protein, 17 aa, Staphylococcus aureus
PDREGEAIAWHLSKILE

SEQ ID NO: 1698740 - protein, 20 aa, Staphylococcus aureus
PDSIFVQHLLITMPQSFGRA

SEQ ID NO: 1698741 - protein, 20 aa, Staphylococcus aureus
PDSLIVIYHGGLNKISNSTK

SEQ ID NO: 1698742 - protein, 20 aa, Staphylococcus aureus
PDTWGKRYLLSGYSYDMKEL

SEQ ID NO: 1698743 - protein, 18 aa, Staphylococcus aureus
PDWLYKSPRTTYLQTWHG

SEQ ID NO: 1698744 - protein, 20 aa, Staphylococcus aureus
PDYMDIYDFTPIQYPADDQN

SEQ ID NO: 1698745 - protein, 25 aa, Staphylococcus aureus
PEAEKLYLTLHLLSTSVQWTDLQET

SEQ ID NO: 1698746 - protein, 17 aa, Staphylococcus aureus
PEAIKMAPLVKALEQEK

SEQ ID NO: 1698747 - protein, 18 aa, Staphylococcus aureus
PEAKYFEFGIKNVSTYLD

SEQ ID NO: 1698748 - protein, 18 aa, Staphylococcus aureus
PEATAVAGYKAWKNKFDR

SEQ ID NO: 1698749 - protein, 17 aa, Staphylococcus aureus
PEAYAIIHPMHPSFNYP

SEQ ID NO: 1698750 - protein, 25 aa, Staphylococcus aureus
PEAYTDFDILKRTHLLSTNYHYSVN

SEQ ID NO: 1698751 - protein, 26 aa, Staphylococcus aureus
PEDAEIIAWFDAIGKKRGLIRCGNEI

SEQ ID NO: 1698752 - protein, 25 aa, Staphylococcus aureus
PEDWGGETIFVPLSALSGDGIDDLL

SEQ ID NO: 1698753 - protein, 22 aa, Staphylococcus aureus
PEDYDALLIPGGFSPDHLRGDT

SEQ ID NO: 1698754 - protein, 25 aa, Staphylococcus aureus
PEEVGKLVVFLASDDSSFITGETIR

SEQ ID NO: 1698755 - protein, 22 aa, Staphylococcus aureus
PEEYLMLHKKFIKPINKNFIVK

SEQ ID NO: 1698756 - protein, 22 aa, Staphylococcus aureus
PEFIQAYLNYQVKGWKRYAASS

SEQ ID NO: 1698757 - protein, 26 aa, Staphylococcus aureus
PEGEYSKIYLFSSNLEKITAFRNELK

SEQ ID NO: 1698758 - protein, 26 aa, Staphylococcus aureus
PEGEYSKIYLFSSNLEKITAFRYELK

SEQ ID NO: 1698759 - protein, 25 aa, Staphylococcus aureus
PEGEYSKIYLFSSNLEKITTFRDEL

SEQ ID NO: 1698760 - protein, 18 aa, Staphylococcus aureus
PEILFSYQLYLTDHYNKI

SEQ ID NO: 1698761 - protein, 20 aa, Staphylococcus aureus
PEKFVTLKHQHILGTLMSLG

SEQ ID NO: 1698762 - protein, 24 aa, Staphylococcus aureus
PEKYKAYFIGDWYVSGDSAYKDED

SEQ ID NO: 1698763 - protein, 25 aa, Staphylococcus aureus
PEKYKSYFIGDWYVSGDSAYKDEDG

SEQ ID NO: 1698764 - protein, 28 aa, Staphylococcus aureus
PELAYFEVLHEMKLIVDLMYEGGTENVR

SEQ ID NO: 1698765 - protein, 21 aa, Staphylococcus aureus
PELDEYLITKNYEKANSGEND

SEQ ID NO: 1698766 - protein, 35 aa, Staphylococcus aureus
PELRNMKIFPRPIDNILPIWRAVGGPPASAIKAGK

SEQ ID NO: 1698767 - protein, 17 aa, Staphylococcus aureus
PEMVLLLDDPQKIVRWR

SEQ ID NO: 1698768 - protein, 26 aa, Staphylococcus aureus
PENRVEYFVSYYDYYQPEAYVPSTDA

SEQ ID NO: 1698769 - protein, 17 aa, Staphylococcus aureus
PESNQALRLVLERARTY

SEQ ID NO: 1698770 - protein, 23 aa, Staphylococcus aureus
PEVQKIIVYYANKQYFFNNETEL

SEQ ID NO: 1698771 - protein, 25 aa, Staphylococcus aureus
PEYYNQIRVFLKSLGLKSEDYRAIL

SEQ ID NO: 1698772 - protein, 29 aa, Staphylococcus aureus
PFKELPLYEIGWRLLPEFWGKGLATEGAN

SEQ ID NO: 1698773 - protein, 17 aa, Staphylococcus aureus
PFLLGKIVEKTNGKSLA

SEQ ID NO: 1698774 - protein, 20 aa, Staphylococcus aureus
PFLSCPVAYQFQPGGYCDYT

SEQ ID NO: 1698775 - protein, 20 aa, Staphylococcus aureus
PFLSCPVGYQFQPGGYCDYT

SEQ ID NO: 1698776 - protein, 20 aa, Staphylococcus aureus
PFMNEYWNHFDKGVYVDKIS

SEQ ID NO: 1698777 - protein, 17 aa, Staphylococcus aureus
PFNFASYMSASKFFKDY

SEQ ID NO: 1698778 - protein, 18 aa, Staphylococcus aureus
PFNKQFLGNIIAEVFNRF

SEQ ID NO: 1698779 - protein, 20 aa, Staphylococcus aureus
PFQLVFEPLIGAIAAGNTAI

SEQ ID NO: 1698780 - protein, 30 aa, Staphylococcus aureus
PFSIGSVTYILSNPFYVGKIQFAKYKDWNE

SEQ ID NO: 1698781 - protein, 31 aa, Staphylococcus aureus
PFSTSAIAYILSNPFYIGKIQFAKYKDWNEK

SEQ ID NO: 1698782 - protein, 28 aa, Staphylococcus aureus
PGCFPTETLLALHPLISEKIVDLSSIII

SEQ ID NO: 1698783 - protein, 23 aa, Staphylococcus aureus
PGDIVPIYLKKNPNFKFPMKQDI

SEQ ID NO: 1698784 - protein, 28 aa, Staphylococcus aureus
PGIVESYEGYLSVFVKDDANKLFNFTPS

SEQ ID NO: 1698785 - protein, 25 aa, Staphylococcus aureus
PGKLLNYILEAFGIDFNSLTKGMGI

SEQ ID NO: 1698786 - protein, 28 aa, Staphylococcus aureus
PGLDRLIRATYELLGLSTYFTAGVQEVH

SEQ ID NO: 1698787 - protein, 27 aa, Staphylococcus aureus
PGNSNEDFLSYKADFSRLLHIDMEKIN

SEQ ID NO: 1698788 - protein, 22 aa, Staphylococcus aureus
PGRGYIHHIAVNTPLMSDLDAI

SEQ ID NO: 1698789 - protein, 29 aa, Staphylococcus aureus
PGSLNPKFLNVLSLIQYIQAAYHEPLREE

SEQ ID NO: 1698790 - protein, 25 aa, Staphylococcus aureus
PGSLNPKFLNVSSLIQYIQAAYHEP

SEQ ID NO: 1698791 - protein, 22 aa, Staphylococcus aureus
PGTNLLEFIKSQDTFVPSICYN

SEQ ID NO: 1698792 - protein, 20 aa, Staphylococcus aureus
PGVDILSIIYQHGIEIEFPD

SEQ ID NO: 1698793 - protein, 17 aa, Staphylococcus aureus
PGVLITEALAQTGAVAI

SEQ ID NO: 1698794 - protein, 19 aa, Staphylococcus aureus
PGYNLQIATNSQFVLSYDL

SEQ ID NO: 1698795 - protein, 20 aa, Staphylococcus aureus
PHAYCLVTIIDGTGTLAVYD

SEQ ID NO: 1698796 - protein, 30 aa, Staphylococcus aureus
PHCWRCGNPLIYYAMEGWFIKTTNFKNEII

SEQ ID NO: 1698797 - protein, 21 aa, Staphylococcus aureus
PHDEILVSFDLYGGTFRLFQF

SEQ ID NO: 1698798 - protein, 19 aa, Staphylococcus aureus
PHEALLCLDATTGQNALSQ

SEQ ID NO: 1698799 - protein, 17 aa, Staphylococcus aureus
PHEALLCLDSTTGQNAL

SEQ ID NO: 1698800 - protein, 33 aa, Staphylococcus aureus
PHESEYQYFKKNQIIWGFLHLASSKEIVEKMQE

SEQ ID NO: 1698801 - protein, 18 aa, Staphylococcus aureus
PHEYGKVILPMTVIKRLH

SEQ ID NO: 1698802 - protein, 19 aa, Staphylococcus aureus
PHFDIQFLVRDLGGSRIDL

SEQ ID NO: 1698803 - protein, 18 aa, Staphylococcus aureus
PHHLIYEELLQQGITLGI

SEQ ID NO: 1698804 - protein, 19 aa, Staphylococcus aureus
PHHLIYEELLQQGITLGII

SEQ ID NO: 1698805 - protein, 18 aa, Staphylococcus aureus
PHIHADFALGIRDVAKRL

SEQ ID NO: 1698806 - protein, 17 aa, Staphylococcus aureus
PHKERIIPYLDYVDEQA

SEQ ID NO: 1698807 - protein, 33 aa, Staphylococcus aureus
PHKSEYQYFKKDQIIWGFLHLASSKEIVEKMQE

SEQ ID NO: 1698808 - protein, 18 aa, Staphylococcus aureus
PHLAFKMADQIFLNKQRV

SEQ ID NO: 1698809 - protein, 19 aa, Staphylococcus aureus
PIAARYLNHNSRLFKLYKG

SEQ ID NO: 1698810 - protein, 19 aa, Staphylococcus aureus
PIAIQIPTVIPTQIAIPTQ

SEQ ID NO: 1698811 - protein, 23 aa, Staphylococcus aureus
PIATHVPLVLDKKGDDYYISGHL

SEQ ID NO: 1698812 - protein, 26 aa, Staphylococcus aureus
PIDEETFLKLYHKILDYLDKKDELYV

SEQ ID NO: 1698813 - protein, 28 aa, Staphylococcus aureus
PIHDACTILYLLQPELFTMVPVNIEIEH

SEQ ID NO: 1698814 - protein, 19 aa, Staphylococcus aureus
PIIDTNISFYESDRGTGVL

SEQ ID NO: 1698815 - protein, 24 aa, Staphylococcus aureus
PIKVDGFKFFVHAIREVNGVAIKV

SEQ ID NO: 1698816 - protein, 26 aa, Staphylococcus aureus
PIQVGSHFHFYEANAALDFERELAYG

SEQ ID NO: 1698817 - protein, 29 aa, Staphylococcus aureus
PIRRYPDLTVHRLIRKYLIEKSMDNKEVK

SEQ ID NO: 1698818 - protein, 24 aa, Staphylococcus aureus
PISKFRIRKVLPPKIKNPVIDSSD

SEQ ID NO: 1698819 - protein, 20 aa, Staphylococcus aureus
PISVIGYPNPNGNKLQMYES

SEQ ID NO: 1698820 - protein, 17 aa, Staphylococcus aureus
PITHMAIVGFSASRALS

SEQ ID NO: 1698821 - protein, 20 aa, Staphylococcus aureus
PIYCEENLVDYIYFSRDKLN

SEQ ID NO: 1698822 - protein, 19 aa, Staphylococcus aureus
PIYVSLSYSYPYIVCVVDK

SEQ ID NO: 1698823 - protein, 21 aa, Staphylococcus aureus
PKEVFGDDFVFLPKNELLTFD

SEQ ID NO: 1698824 - protein, 22 aa, Staphylococcus aureus
PKEVFGDDFVFLPKNELLTFDE

SEQ ID NO: 1698825 - protein, 17 aa, Staphylococcus aureus
PKFDIKKLNLYTGDMDQ

SEQ ID NO: 1698826 - protein, 19 aa, Staphylococcus aureus
PKHLTIIKVAPLFSEDDRH

SEQ ID NO: 1698827 - protein, 20 aa, Staphylococcus aureus
PKHRDRIAFMRIVSGAFERG

SEQ ID NO: 1698828 - protein, 22 aa, Staphylococcus aureus
PKHVVYVWIDALVNYISSLGYL

SEQ ID NO: 1698829 - protein, 18 aa, Staphylococcus aureus
PKIDETILDPACGTGGFL

SEQ ID NO: 1698830 - protein, 20 aa, Staphylococcus aureus
PKIGAYHFTTIKPNLGVVSA

SEQ ID NO: 1698831 - protein, 20 aa, Staphylococcus aureus
PKIKKMVPSFGYRLTDHEDL

SEQ ID NO: 1698832 - protein, 29 aa, Staphylococcus aureus
PKKEVVLVKQYRKPVEKPLLEIPAGKLED

SEQ ID NO: 1698833 - protein, 39 aa, Staphylococcus aureus
PKLDNLFEKDLYSTYLSYLPSTDFSYPLLMNVDDRGSFT

SEQ ID NO: 1698834 - protein, 24 aa, Staphylococcus aureus
PKLIKKGSWWFYPNDDTNRKPKFN

SEQ ID NO: 1698835 - protein, 35 aa, Staphylococcus aureus
PKLNLENALKIELEFYFPLLKSWSKKKKNEMVGQY

SEQ ID NO: 1698836 - protein, 30 aa, Staphylococcus aureus
PKLNLENALKIELEFYFTPPKSWSKKKKTQ

SEQ ID NO: 1698837 - protein, 22 aa, Staphylococcus aureus
PKMTHIVKTVPKFDWLNGENLD

SEQ ID NO: 1698838 - protein, 32 aa, Staphylococcus aureus
PKRGPSLYSIIPMIEMMFGVHFIKGGMYGMAQ

SEQ ID NO: 1698839 - protein, 27 aa, Staphylococcus aureus
PKSERLRQFFDFITNFGIMIKGTGEDI

SEQ ID NO: 1698840 - protein, 21 aa, Staphylococcus aureus
PKVCEGNIKAWVNIMYGCDKF

SEQ ID NO: 1698841 - protein, 20 aa, Staphylococcus aureus
PLEYDTITARSLLSKLLVRA

SEQ ID NO: 1698842 - protein, 21 aa, Staphylococcus aureus
PLFEGVEWIIVSLGAQGAFAK

SEQ ID NO: 1698843 - protein, 29 aa, Staphylococcus aureus
PLIDVEIDVLLLVELLNDVDVLPDSELLS

SEQ ID NO: 1698844 - protein, 17 aa, Staphylococcus aureus
PLIDVKAKLYDGSYHDV

SEQ ID NO: 1698845 - protein, 18 aa, Staphylococcus aureus
PLNLMGKLAFQYLSQKFN

SEQ ID NO: 1698846 - protein, 18 aa, Staphylococcus aureus
PLPLINMAVGIPDGPTPQ

SEQ ID NO: 1698847 - protein, 19 aa, Staphylococcus aureus
PLSEMFGYATSLRSNTQGR

SEQ ID NO: 1698848 - protein, 22 aa, Staphylococcus aureus
PLTGFISILKTYMQLSRNRETI

SEQ ID NO: 1698849 - protein, 24 aa, Staphylococcus aureus
PLTGITAYETFFDTFKISHNPAEN

SEQ ID NO: 1698850 - protein, 17 aa, Staphylococcus aureus
PLTILELDDDTEISILE

SEQ ID NO: 1698851 - protein, 17 aa, Staphylococcus aureus
PLTVNYEEKMYAAGKIP

SEQ ID NO: 1698852 - protein, 17 aa, Staphylococcus aureus
PLVLEKMDVTGKDLAKK

SEQ ID NO: 1698853 - protein, 28 aa, Staphylococcus aureus
PLVQADRVFIALPPLYKLEKGKGKTKRV

SEQ ID NO: 1698854 - protein, 24 aa, Staphylococcus aureus
PLYSDIVLPAATWYEKHDLSSTDM

SEQ ID NO: 1698855 - protein, 26 aa, Staphylococcus aureus
PMGGLQERIWNLLQILNDFGTDVFKP

SEQ ID NO: 1698856 - protein, 21 aa, Staphylococcus aureus
PMQGIAYDAGVLYWYTGDSNP

SEQ ID NO: 1698857 - protein, 31 aa, Staphylococcus aureus
PMRAMGFEMKESIALFSQWEKSGVNTEIAFS

SEQ ID NO: 1698858 - protein, 20 aa, Staphylococcus aureus
PNDFAIYHEPFLGGGATLLS

SEQ ID NO: 1698859 - protein, 19 aa, Staphylococcus aureus
PNEILECILIEAPDLKNTA

SEQ ID NO: 1698860 - protein, 29 aa, Staphylococcus aureus
PNKFSTDPQYILKLLLSVITVSVKTLELV

SEQ ID NO: 1698861 - protein, 17 aa, Staphylococcus aureus
PNLWPRLKEIKAPTLIL

SEQ ID NO: 1698862 - protein, 22 aa, Staphylococcus aureus
PNLYPGIECKLLAFLEKKKVDA

SEQ ID NO: 1698863 - protein, 24 aa, Staphylococcus aureus
PNTDALIESLFIQFHSQCLKQNLI

SEQ ID NO: 1698864 - protein, 19 aa, Staphylococcus aureus
PNTLMSDIIYIPYKTPILE

SEQ ID NO: 1698865 - protein, 24 aa, Staphylococcus aureus
PNVISTYDLLFRSGLDLTVDFIIR

SEQ ID NO: 1698866 - protein, 27 aa, Staphylococcus aureus
PPELSEQFPYIRQLLDAYHIKRYELDN

SEQ ID NO: 1698867 - protein, 33 aa, Staphylococcus aureus
PPGAWGDWINGGGWLVINGYHVDLILRDIKRVE

SEQ ID NO: 1698868 - protein, 19 aa, Staphylococcus aureus
PPGITKWNRKMILNKSPNP

SEQ ID NO: 1698869 - protein, 18 aa, Staphylococcus aureus
PPHTINYGHIIDPESKEV

SEQ ID NO: 1698870 - protein, 26 aa, Staphylococcus aureus
PPHTPIAKYRFSERNRIISGLSKGVL

SEQ ID NO: 1698871 - protein, 25 aa, Staphylococcus aureus
PPRLQNGTSWFYFATDQWKYEESNV

SEQ ID NO: 1698872 - protein, 24 aa, Staphylococcus aureus
PPVNYDYWILPGRYKRHTKEYHEK

SEQ ID NO: 1698873 - protein, 18 aa, Staphylococcus aureus
PQDIAEAVLYALTQPKHV

SEQ ID NO: 1698874 - protein, 24 aa, Staphylococcus aureus
PQGSKLMGYYQNELYDYASQLDSK

SEQ ID NO: 1698875 - protein, 17 aa, Staphylococcus aureus
PQMAKVIKNYPKAHFHV

SEQ ID NO: 1698876 - protein, 20 aa, Staphylococcus aureus
PQQLQPFLNKYLSHPEYVAV

SEQ ID NO: 1698877 - protein, 20 aa, Staphylococcus aureus
PQQREIGFPISTDNASRRGP

SEQ ID NO: 1698878 - protein, 18 aa, Staphylococcus aureus
PQQREIVFPISTDNASWG

SEQ ID NO: 1698879 - protein, 24 aa, Staphylococcus aureus
PQVKGLIYHKFGPNNSLKHVYIDK

SEQ ID NO: 1698880 - protein, 18 aa, Staphylococcus aureus
PQYTMSVWMGFSKVKQYG

SEQ ID NO: 1698881 - protein, 25 aa, Staphylococcus aureus
PREAGLFHIALLLPTTEDLANFLYF

SEQ ID NO: 1698882 - protein, 22 aa, Staphylococcus aureus
PRGLPVIPEAYTPKLKRINRKP

SEQ ID NO: 1698883 - protein, 22 aa, Staphylococcus aureus
PRGLPVIPEAYTPKLKRVNRKP

SEQ ID NO: 1698884 - protein, 20 aa, Staphylococcus aureus
PRKCLNWKFPYEVLCDELLH

SEQ ID NO: 1698885 - protein, 21 aa, Staphylococcus aureus
PRKCLNWKFPYEVLCDELLHL

SEQ ID NO: 1698886 - protein, 27 aa, Staphylococcus aureus
PRKGVLDSYYVYTISNILKILAEKVSA

SEQ ID NO: 1698887 - protein, 32 aa, Staphylococcus aureus
PRKIRREGIYFKGLRYFSTTLIAYITEDVFIR

SEQ ID NO: 1698888 - protein, 17 aa, Staphylococcus aureus
PRKSLGYRTPLEVFMSF

SEQ ID NO: 1698889 - protein, 20 aa, Staphylococcus aureus
PRLLPKAKRLDIVSYEEMME

SEQ ID NO: 1698890 - protein, 18 aa, Staphylococcus aureus
PRLQNGTSWFYFATDQWK

SEQ ID NO: 1698891 - protein, 17 aa, Staphylococcus aureus
PRSLLDEYREGLLVGTA

SEQ ID NO: 1698892 - protein, 20 aa, Staphylococcus aureus
PSAHQFLVRNFGTGGVGKWS

SEQ ID NO: 1698893 - protein, 18 aa, Staphylococcus aureus
PSCLGLCIYKDSLIQLKR

SEQ ID NO: 1698894 - protein, 17 aa, Staphylococcus aureus
PSDLSNIRLGFKQEIEA

SEQ ID NO: 1698895 - protein, 21 aa, Staphylococcus aureus
PSDTRAFIKRGLLQFADGNGF

SEQ ID NO: 1698896 - protein, 26 aa, Staphylococcus aureus
PSEKYPLLEVNALGYYRPAYIKVSKF

SEQ ID NO: 1698897 - protein, 17 aa, Staphylococcus aureus
PSEWFKTCNLVDVEISE

SEQ ID NO: 1698898 - protein, 25 aa, Staphylococcus aureus
PSGGYFVWLVFKIDIDIKYLFYELL

SEQ ID NO: 1698899 - protein, 23 aa, Staphylococcus aureus
PSGLYASFYAGLRDMSVRLIDVQ

SEQ ID NO: 1698900 - protein, 26 aa, Staphylococcus aureus
PSGYPTSYLWENVLTSYQLLDIFERF

SEQ ID NO: 1698901 - protein, 22 aa, Staphylococcus aureus
PSIDYVIFTNDFKIDGLNRATA

SEQ ID NO: 1698902 - protein, 24 aa, Staphylococcus aureus
PSIENLMVYLEKRKPKYYENIKLM

SEQ ID NO: 1698903 - protein, 18 aa, Staphylococcus aureus
PSIFAIMEDVLKLPRAVF

SEQ ID NO: 1698904 - protein, 23 aa, Staphylococcus aureus
PSIPLKIMFPQLKVTIVDSLNKC

SEQ ID NO: 1698905 - protein, 17 aa, Staphylococcus aureus
PSKKSAYDQAVNAAKAI

SEQ ID NO: 1698906 - protein, 20 aa, Staphylococcus aureus
PSLIISFYPGYAVHPDHEAT

SEQ ID NO: 1698907 - protein, 18 aa, Staphylococcus aureus
PSNYGCLDPIVFLDGIEA

SEQ ID NO: 1698908 - protein, 21 aa, Staphylococcus aureus
PSPTGYLHIGNARTALFNYLY

SEQ ID NO: 1698909 - protein, 35 aa, Staphylococcus aureus
PSVEKLMKAFWPGPISFILPLKPGYLCRKVSGGLS

SEQ ID NO: 1698910 - protein, 25 aa, Staphylococcus aureus
PSVKVSQFKFIKYLVPIKDEQEKVA

SEQ ID NO: 1698911 - protein, 24 aa, Staphylococcus aureus
PTARDLKLPEHHSFIISYNGSKTI

SEQ ID NO: 1698912 - protein, 22 aa, Staphylococcus aureus
PTATLLALHPLISEKIVDLSSI

SEQ ID NO: 1698913 - protein, 23 aa, Staphylococcus aureus
PTATLLALHPLISEKIVDLSSII

SEQ ID NO: 1698914 - protein, 17 aa, Staphylococcus aureus
PTKAFYILNDGLTMTLI

SEQ ID NO: 1698915 - protein, 22 aa, Staphylococcus aureus
PTKEDFKKMTYTEQVELLNSDP

SEQ ID NO: 1698916 - protein, 17 aa, Staphylococcus aureus
PTKPLPNDKLKKEIENF

SEQ ID NO: 1698917 - protein, 26 aa, Staphylococcus aureus
PTNVKKEHWGFDDPAGKPWSEFQRVR

SEQ ID NO: 1698918 - protein, 23 aa, Staphylococcus aureus
PTQIVIQIQTATQTVFQIQTVTQ

SEQ ID NO: 1698919 - protein, 25 aa, Staphylococcus aureus
PTQRNWIPNFYRQCKLGAGPQHKSW

SEQ ID NO: 1698920 - protein, 32 aa, Staphylococcus aureus
PTTTNFLKRSIFICLFIISLFKTQGERTSFIR

SEQ ID NO: 1698921 - protein, 18 aa, Staphylococcus aureus
PVDYTLIKNVHKPSGAKP

SEQ ID NO: 1698922 - protein, 17 aa, Staphylococcus aureus
PVEIQLMSRFRTSKEIK

SEQ ID NO: 1698923 - protein, 18 aa, Staphylococcus aureus
PVEPMPHSKPTTSEAPPS

SEQ ID NO: 1698924 - protein, 31 aa, Staphylococcus aureus
PVFDAYHTDYFKPYNPAFRKASMEDGLHPNE

SEQ ID NO: 1698925 - protein, 17 aa, Staphylococcus aureus
PVFITNYPTKIKPFYMQ

SEQ ID NO: 1698926 - protein, 26 aa, Staphylococcus aureus
PVGRGMIKWAPFATLPEQFETIQQYI

SEQ ID NO: 1698927 - protein, 34 aa, Staphylococcus aureus
PVGVVTQITPWNYPLLQASWKIAPALATGCSLVM

SEQ ID NO: 1698928 - protein, 21 aa, Staphylococcus aureus
PVHFECEYVQTIRIPTGDPVS

SEQ ID NO: 1698929 - protein, 31 aa, Staphylococcus aureus
PVHQGISAMQYIVRRYGWGGFKRAGDYAYAT

SEQ ID NO: 1698930 - protein, 17 aa, Staphylococcus aureus
PVIVGPITFVKLSKGGH

SEQ ID NO: 1698931 - protein, 19 aa, Staphylococcus aureus
PVKIIPLEVVVRNIASGSI

SEQ ID NO: 1698932 - protein, 23 aa, Staphylococcus aureus
PVMRSDFMLRYKDKCLIIDAKFY

SEQ ID NO: 1698933 - protein, 26 aa, Staphylococcus aureus
PVNDKKVIPIPTKALFNPSQNKVRQS

SEQ ID NO: 1698934 - protein, 25 aa, Staphylococcus aureus
PVNDKKVLPIPTKALFNPSQNKVRQ

SEQ ID NO: 1698935 - protein, 25 aa, Staphylococcus aureus
PVNIQNYIKNLYRQVLLDMKNNNNK

SEQ ID NO: 1698936 - protein, 25 aa, Staphylococcus aureus
PVNKLPSDLGNGLYLFIDRKNKVGE

SEQ ID NO: 1698937 - protein, 25 aa, Staphylococcus aureus
PVQNVLITSWFWSHRPSHIEMAGLK

SEQ ID NO: 1698938 - protein, 26 aa, Staphylococcus aureus
PVQNVLITSWFWSHRPSHIEMAGLKT

SEQ ID NO: 1698939 - protein, 22 aa, Staphylococcus aureus
PVTVNVYQFEFPQTTYTTTVGG

SEQ ID NO: 1698940 - protein, 24 aa, Staphylococcus aureus
PVVAGNIVLLKPAEDTPYIAYKLM

SEQ ID NO: 1698941 - protein, 19 aa, Staphylococcus aureus
PVVKTIFVPKFFSKKPITK

SEQ ID NO: 1698942 - protein, 17 aa, Staphylococcus aureus
PWGIIDIVSFTTGEMKK

SEQ ID NO: 1698943 - protein, 25 aa, Staphylococcus aureus
PYDKNFINQIGWYLNYDQEINLIGD

SEQ ID NO: 1698944 - protein, 26 aa, Staphylococcus aureus
PYLDEDGEFKLFRVPAEQGIPIWTDK

SEQ ID NO: 1698945 - protein, 17 aa, Staphylococcus aureus
PYLLEEPFWTVDTLFYC

SEQ ID NO: 1698946 - protein, 17 aa, Staphylococcus aureus
PYPPNLPAIMRKEPKKV

SEQ ID NO: 1698947 - protein, 19 aa, Staphylococcus aureus
PYSLRHTHTSYLLSKGIPI

SEQ ID NO: 1698948 - protein, 19 aa, Staphylococcus aureus
PYVASITDAIYFAKPNMDK

SEQ ID NO: 1698949 - protein, 29 aa, Staphylococcus aureus
PYVVENGYLFIFVIDYYRHHLVDQHAETD

SEQ ID NO: 1698950 - protein, 19 aa, Staphylococcus aureus
QACCHDFIMKLPDGYKTVL

SEQ ID NO: 1698951 - protein, 19 aa, Staphylococcus aureus
QAFDEILEGLPNVCKMHSK

SEQ ID NO: 1698952 - protein, 25 aa, Staphylococcus aureus
QAFDYELLILGYRQTAHHAKVTLSE

SEQ ID NO: 1698953 - protein, 17 aa, Staphylococcus aureus
QAFIHMVGFSRGGLQGL

SEQ ID NO: 1698954 - protein, 20 aa, Staphylococcus aureus
QAIAMIQFKLEIPIIKRRPN

SEQ ID NO: 1698955 - protein, 20 aa, Staphylococcus aureus
QAIAMIQFKLEIPVIKRRSN

SEQ ID NO: 1698956 - protein, 23 aa, Staphylococcus aureus
QAIINNYLLPSYTTVSIQKLNEL

SEQ ID NO: 1698957 - protein, 30 aa, Staphylococcus aureus
QAKDNSLENLLFGLGIRHLGVKVSQVLAEK

SEQ ID NO: 1698958 - protein, 17 aa, Staphylococcus aureus
QALGFQFKYSNLKIALE

SEQ ID NO: 1698959 - protein, 18 aa, Staphylococcus aureus
QALKDRINQILQQGHNDI

SEQ ID NO: 1698960 - protein, 19 aa, Staphylococcus aureus
QALKDRINQILQQGHNDIN

SEQ ID NO: 1698961 - protein, 18 aa, Staphylococcus aureus
QALKDRINQILQQGHNGI

SEQ ID NO: 1698962 - protein, 21 aa, Staphylococcus aureus
QALLDKWRTFMNLRDDVNRAL

SEQ ID NO: 1698963 - protein, 20 aa, Staphylococcus aureus
QALNNAMKGLRDSIANETTV

SEQ ID NO: 1698964 - protein, 22 aa, Staphylococcus aureus
QALNNAMKGLRDSIANETTVKT

SEQ ID NO: 1698965 - protein, 17 aa, Staphylococcus aureus
QALRLVLERARTYSVPN

SEQ ID NO: 1698966 - protein, 19 aa, Staphylococcus aureus
QAMTQLKQGIANKDTVKAS

SEQ ID NO: 1698967 - protein, 23 aa, Staphylococcus aureus
QANNALMYPGLGLGLIASNAKKV

SEQ ID NO: 1698968 - protein, 19 aa, Staphylococcus aureus
QARIRLYIPLNERISADDY

SEQ ID NO: 1698969 - protein, 20 aa, Staphylococcus aureus
QARIRLYIPLNERISANDYR

SEQ ID NO: 1698970 - protein, 29 aa, Staphylococcus aureus
QATEIDNLIWYFSELFKSELKIAIGPVER

SEQ ID NO: 1698971 - protein, 23 aa, Staphylococcus aureus
QAVQQLNRTGTTTGKKPASITAY

SEQ ID NO: 1698972 - protein, 27 aa, Staphylococcus aureus
QCADLAVDYIYWLLEIRMWGNAKDAIN

SEQ ID NO: 1698973 - protein, 19 aa, Staphylococcus aureus
QCGYCLKGEYARCEKLFVI

SEQ ID NO: 1698974 - protein, 18 aa, Staphylococcus aureus
QCNDPVIVLAQLINRIQS

SEQ ID NO: 1698975 - protein, 25 aa, Staphylococcus aureus
QCNLELYFTSLSRKTIVYKGWLRSD

SEQ ID NO: 1698976 - protein, 17 aa, Staphylococcus aureus
QCNLGKRDFLWTQYVSI

SEQ ID NO: 1698977 - protein, 22 aa, Staphylococcus aureus
QCTQIYFVHPINKNNIYIRIDY

SEQ ID NO: 1698978 - protein, 22 aa, Staphylococcus aureus
QCVFLSWNRYLYRNAQNYINSS

SEQ ID NO: 1698979 - protein, 23 aa, Staphylococcus aureus
QCVFLSWNRYLYRNAQNYITRSD

SEQ ID NO: 1698980 - protein, 20 aa, Staphylococcus aureus
QDAALIMELGADGVFVGSGI

SEQ ID NO: 1698981 - protein, 24 aa, Staphylococcus aureus
QDAATNLPYIYLSAGVSAELFQET

SEQ ID NO: 1698982 - protein, 25 aa, Staphylococcus aureus
QDALEYWIKLIVEAYERLYANEKFT

SEQ ID NO: 1698983 - protein, 27 aa, Staphylococcus aureus
QDATIFLMNAVYEFDLVREHQIHMTLP

SEQ ID NO: 1698984 - protein, 27 aa, Staphylococcus aureus
QDFYHYNEIMSFLIELNRQGKTIIMIT

SEQ ID NO: 1698985 - protein, 19 aa, Staphylococcus aureus
QDINFIAKLIVTCGANVKV

SEQ ID NO: 1698986 - protein, 17 aa, Staphylococcus aureus
QDKIDFQIGTLSKAIGV

SEQ ID NO: 1698987 - protein, 28 aa, Staphylococcus aureus
QDKLIAKNKAEELAISIINNINKAISNQ

SEQ ID NO: 1698988 - protein, 23 aa, Staphylococcus aureus
QDKTETLNSINFTDADKAKKDAY

SEQ ID NO: 1698989 - protein, 27 aa, Staphylococcus aureus
QDLHDTLGHVFASLSLKSELAYKLIDA

SEQ ID NO: 1698990 - protein, 19 aa, Staphylococcus aureus
QDLPQFTPEIFMKVSAKNV

SEQ ID NO: 1698991 - protein, 23 aa, Staphylococcus aureus
QDNLFSFMKNCAYHFAPGDTPVS

SEQ ID NO: 1698992 - protein, 21 aa, Staphylococcus aureus
QDQFKPIGILLSALSVDINPI

SEQ ID NO: 1698993 - protein, 27 aa, Staphylococcus aureus
QDQIAQRFLIYVYARGTGKWINMINIS

SEQ ID NO: 1698994 - protein, 17 aa, Staphylococcus aureus
QDRHIPALLKLKDTVSL

SEQ ID NO: 1698995 - protein, 28 aa, Staphylococcus aureus
QDSWTLAKHLKTFPIRFKQSVENAQKIV

SEQ ID NO: 1698996 - protein, 17 aa, Staphylococcus aureus
QDTFIIDNLYPFVKHLK

SEQ ID NO: 1698997 - protein, 37 aa, Staphylococcus aureus
QDTKNALDFPLPKEFRDAGWFFDVLPGHYNGAVRQVL

SEQ ID NO: 1698998 - protein, 22 aa, Staphylococcus aureus
QDTLRYYEKVGVIPPVNRDENG

SEQ ID NO: 1698999 - protein, 34 aa, Staphylococcus aureus
QDTQNALDFPLPKAFRDAGWFFDVLPGHYNGALR

SEQ ID NO: 1699000 - protein, 35 aa, Staphylococcus aureus
QDTQNALDFPLPKAFRDAGWFFDVLPGHYNGALRQ

SEQ ID NO: 1699001 - protein, 37 aa, Staphylococcus aureus
QDTQNALDFPLPKAFRDAGWFFDVLPGRYNGALRQVL

SEQ ID NO: 1699002 - protein, 30 aa, Staphylococcus aureus
QDTQNALDFPLPKAFRDAGWFLDVLPGHYN

SEQ ID NO: 1699003 - protein, 18 aa, Staphylococcus aureus
QEAKIRFECKLSQIILLG

SEQ ID NO: 1699004 - protein, 23 aa, Staphylococcus aureus
QECARLLKKWGLPANRNTIRLHN

SEQ ID NO: 1699005 - protein, 20 aa, Staphylococcus aureus
QEDEHYFAKSGRIKYYPLVI

SEQ ID NO: 1699006 - protein, 18 aa, Staphylococcus aureus
QEDMFPPMQLDETESMVL

SEQ ID NO: 1699007 - protein, 27 aa, Staphylococcus aureus
QEEQLSNKIGGYFLNKLDLNMINSSDE

SEQ ID NO: 1699008 - protein, 17 aa, Staphylococcus aureus
QEFDNVCLILGNEFFYD

SEQ ID NO: 1699009 - protein, 17 aa, Staphylococcus aureus
QEIANGLIKIMTFAPEV

SEQ ID NO: 1699010 - protein, 22 aa, Staphylococcus aureus
QEIEKLILFLGDRPTINKQDVN

SEQ ID NO: 1699011 - protein, 23 aa, Staphylococcus aureus
QEINLMQFIKKLDKNMDFLDIDK

SEQ ID NO: 1699012 - protein, 17 aa, Staphylococcus aureus
QEINRLLVLNNIDVFQM

SEQ ID NO: 1699013 - protein, 23 aa, Staphylococcus aureus
QEIRKFDFSLLTNKIKKYEIQNN

SEQ ID NO: 1699014 - protein, 19 aa, Staphylococcus aureus
QEKEHLLSPLFKDWHKYNT

SEQ ID NO: 1699015 - protein, 23 aa, Staphylococcus aureus
QEKLKEERIVGTAGGGMVTVTVT

SEQ ID NO: 1699016 - protein, 26 aa, Staphylococcus aureus
QELDVQLRNYLNKKYKLYEQGGDIVK

SEQ ID NO: 1699017 - protein, 18 aa, Staphylococcus aureus
QELFDFYYDLFKSDDDTY

SEQ ID NO: 1699018 - protein, 26 aa, Staphylococcus aureus
QELHANEIVLLSYYIAAINIEATFDD

SEQ ID NO: 1699019 - protein, 26 aa, Staphylococcus aureus
QELHANEIVLLSYYIAAINIEATFDE

SEQ ID NO: 1699020 - protein, 25 aa, Staphylococcus aureus
QENKKLHSWLKISTLIDNVKVKDKY

SEQ ID NO: 1699021 - protein, 19 aa, Staphylococcus aureus
QEPQPFWNPAIDAGRKTFE

SEQ ID NO: 1699022 - protein, 22 aa, Staphylococcus aureus
QERKRRLRPWLYDGTPQKHSRD

SEQ ID NO: 1699023 - protein, 17 aa, Staphylococcus aureus
QESIFTKADKRELITAK

SEQ ID NO: 1699024 - protein, 17 aa, Staphylococcus aureus
QEVADTKAKVLDKINAI

SEQ ID NO: 1699025 - protein, 18 aa, Staphylococcus aureus
QEVADTKAKVLDKINAIQ

SEQ ID NO: 1699026 - protein, 17 aa, Staphylococcus aureus
QEVDQILTYSTIYDLPI

SEQ ID NO: 1699027 - protein, 19 aa, Staphylococcus aureus
QEYAPILYQIWKKKHKKAY

SEQ ID NO: 1699028 - protein, 18 aa, Staphylococcus aureus
QEYKYIKRILNEEVRADN

SEQ ID NO: 1699029 - protein, 20 aa, Staphylococcus aureus
QFDETFMMYLPRLCEHCLNP

SEQ ID NO: 1699030 - protein, 19 aa, Staphylococcus aureus
QFECNCSHEKFLNAIKGLG

SEQ ID NO: 1699031 - protein, 24 aa, Staphylococcus aureus
QFGESLPVYKPTLPPMVFGNRDKK

SEQ ID NO: 1699032 - protein, 22 aa, Staphylococcus aureus
QFIAKKLDLAGIKHAFYNIKGE

SEQ ID NO: 1699033 - protein, 32 aa, Staphylococcus aureus
QFKCHIDTIIKKQVPVCCFTFGIPSESIIKRL

SEQ ID NO: 1699034 - protein, 32 aa, Staphylococcus aureus
QFKCHINTIIKKQVPVCCFTFGIPNESIIKRL

SEQ ID NO: 1699035 - protein, 18 aa, Staphylococcus aureus
QFKLIFEFMNITNYRFLI

SEQ ID NO: 1699036 - protein, 21 aa, Staphylococcus aureus
QFKNYLHFSPKQFRSLVSKIT

SEQ ID NO: 1699037 - protein, 21 aa, Staphylococcus aureus
QFKPQQYYTLSLTVKGFDFQL

SEQ ID NO: 1699038 - protein, 19 aa, Staphylococcus aureus
QFKSKDWYWNAYFEGPIKL

SEQ ID NO: 1699039 - protein, 25 aa, Staphylococcus aureus
QFKSKDWYWNAYFEGPIKLHKEFTI

SEQ ID NO: 1699040 - protein, 19 aa, Staphylococcus aureus
QFNEFLYERDMDGYYLIVQ

SEQ ID NO: 1699041 - protein, 22 aa, Staphylococcus aureus
QFNQYILEISLPKQQLPYFISF

SEQ ID NO: 1699042 - protein, 23 aa, Staphylococcus aureus
QFQTYYCLLVEWNEKMNLTSITD

SEQ ID NO: 1699043 - protein, 18 aa, Staphylococcus aureus
QFQVALLDYNDYVGRIGI

SEQ ID NO: 1699044 - protein, 24 aa, Staphylococcus aureus
QFVVELLQFFKKTYKTHFNMDGGP

SEQ ID NO: 1699045 - protein, 18 aa, Staphylococcus aureus
QGALNLKAQLSEGTIVVV

SEQ ID NO: 1699046 - protein, 24 aa, Staphylococcus aureus
QGANAVKFLLYYDVDDTEEINVQK

SEQ ID NO: 1699047 - protein, 19 aa, Staphylococcus aureus
QGDANVFVFPSLEAGNIGY

SEQ ID NO: 1699048 - protein, 38 aa, Staphylococcus aureus
QGGGQRHTVNGQENLYRIAIQYYGSGSPENVEKIRRAN

SEQ ID NO: 1699049 - protein, 27 aa, Staphylococcus aureus
QGIAKMFDLMLPKKNIRMPLSKMNMFG

SEQ ID NO: 1699050 - protein, 19 aa, Staphylococcus aureus
QGITYDAGILYWYTGDSNT

SEQ ID NO: 1699051 - protein, 20 aa, Staphylococcus aureus
QGITYDAGILYWYTGDSNTA

SEQ ID NO: 1699052 - protein, 21 aa, Staphylococcus aureus
QGLYAYNIPFDNKARIEKYGQ

SEQ ID NO: 1699053 - protein, 21 aa, Staphylococcus aureus
QGMIDLIFVKDGVHYFVDYKT

SEQ ID NO: 1699054 - protein, 27 aa, Staphylococcus aureus
QGNTVCYMWLRFNIDLQFDDTTINQYF

SEQ ID NO: 1699055 - protein, 20 aa, Staphylococcus aureus
QGRDYFVKFNCPEFTSLCPI

SEQ ID NO: 1699056 - protein, 21 aa, Staphylococcus aureus
QGRQLLAYLGVPKELYEKTPT

SEQ ID NO: 1699057 - protein, 42 aa, Staphylococcus aureus
QGSEFPIVIMPIVKQYFRMLQRPILYTGLTRAKMSLVLLGDP

SEQ ID NO: 1699058 - protein, 41 aa, Staphylococcus aureus
QGSEFPIVIMPIVKQYFRMLQRPILYTGLTRAKTSLVLLGD

SEQ ID NO: 1699059 - protein, 24 aa, Staphylococcus aureus
QGSKLMGYYQNELYDYAPQLDSKM

SEQ ID NO: 1699060 - protein, 25 aa, Staphylococcus aureus
QGSKLMGYYQNELYDYASQLDLKMK

SEQ ID NO: 1699061 - protein, 25 aa, Staphylococcus aureus
QGTDDDWLHGYWQGVPIGDSKIDLK

SEQ ID NO: 1699062 - protein, 23 aa, Staphylococcus aureus
QGVKLFGAIVILSQSGYTGEDGF

SEQ ID NO: 1699063 - protein, 18 aa, Staphylococcus aureus
QGYDIVLEIHLDAAGESA

SEQ ID NO: 1699064 - protein, 23 aa, Staphylococcus aureus
QHAKDLINQTGNPTLDKSQVEQL

SEQ ID NO: 1699065 - protein, 23 aa, Staphylococcus aureus
QHAKDLINQTSNPTLDKAQVEQL

SEQ ID NO: 1699066 - protein, 17 aa, Staphylococcus aureus
QHIFLDEDILFPYYCDP

SEQ ID NO: 1699067 - protein, 35 aa, Staphylococcus aureus
QHISSYGLILEPKTQFYNMYRKGLLKLPNEDLCAD

SEQ ID NO: 1699068 - protein, 37 aa, Staphylococcus aureus
QHISSYGLILEPKTQFYNMYRKGLLKLPNKDLGADMY

SEQ ID NO: 1699069 - protein, 25 aa, Staphylococcus aureus
QHLITKPIFEALFSEYSFVNNNPVS

SEQ ID NO: 1699070 - protein, 18 aa, Staphylococcus aureus
QHMKALFKCKNYLQIDTK

SEQ ID NO: 1699071 - protein, 25 aa, Staphylococcus aureus
QHQRALKGYYQGNLPLGYNNIPDNK

SEQ ID NO: 1699072 - protein, 30 aa, Staphylococcus aureus
QIASERIEVLAPLKYLLIGGEVLNAKWVDL

SEQ ID NO: 1699073 - protein, 20 aa, Staphylococcus aureus
QIDLNDAMETLKHLVDNEIP

SEQ ID NO: 1699074 - protein, 21 aa, Staphylococcus aureus
QIDLNNAMETLKHLVDNEIPT

SEQ ID NO: 1699075 - protein, 19 aa, Staphylococcus aureus
QIDQIIDEAKAYNFKSVCV

SEQ ID NO: 1699076 - protein, 19 aa, Staphylococcus aureus
QIDRFRVAYGHYIEDFPRQ

SEQ ID NO: 1699077 - protein, 22 aa, Staphylococcus aureus
QIDSYNLWWYGCIEGKAISVNI

SEQ ID NO: 1699078 - protein, 17 aa, Staphylococcus aureus
QIEMFLGNKARLDMLEQ

SEQ ID NO: 1699079 - protein, 20 aa, Staphylococcus aureus
QIHMTLPSLTYYYNHKNDLA

SEQ ID NO: 1699080 - protein, 20 aa, Staphylococcus aureus
QIHNLLGIQPFARCFEMKEA

SEQ ID NO: 1699081 - protein, 26 aa, Staphylococcus aureus
QIIEATLDWTFYNDIPLSYKTSDLLK

SEQ ID NO: 1699082 - protein, 17 aa, Staphylococcus aureus
QIIGNAIIIKDIRQERI

SEQ ID NO: 1699083 - protein, 26 aa, Staphylococcus aureus
QIIKNYDSFLPQKLDIVVFPSKYGGG

SEQ ID NO: 1699084 - protein, 20 aa, Staphylococcus aureus
QIIVLCDGEIIQRGSHDELI

SEQ ID NO: 1699085 - protein, 30 aa, Staphylococcus aureus
QIKINNVLSSSSIKLFKADNTPLTITNTTY

SEQ ID NO: 1699086 - protein, 26 aa, Staphylococcus aureus
QIMHQIRVLRVLDFHFQLVIDANESL

SEQ ID NO: 1699087 - protein, 25 aa, Staphylococcus aureus
QINGIPFSYFMSYVSVAGLSLIRHW

SEQ ID NO: 1699088 - protein, 19 aa, Staphylococcus aureus
QIPTVTRIQIAIPTQTVTQ

SEQ ID NO: 1699089 - protein, 19 aa, Staphylococcus aureus
QIQALIRGVWLLSGTDKEL

SEQ ID NO: 1699090 - protein, 27 aa, Staphylococcus aureus
QIQTAIRIQIATPIQIAIRIQTVSQTQ

SEQ ID NO: 1699091 - protein, 24 aa, Staphylococcus aureus
QIQTAIRIQIATRIQIVTRTQIVT

SEQ ID NO: 1699092 - protein, 18 aa, Staphylococcus aureus
QIRMLSIPRDTISYIPKV

SEQ ID NO: 1699093 - protein, 32 aa, Staphylococcus aureus
QIRPEDLQAYGLIPEFIGRVPIVANLETLDVT

SEQ ID NO: 1699094 - protein, 20 aa, Staphylococcus aureus
QISRIPLIVLTSDRPHELRS

SEQ ID NO: 1699095 - protein, 17 aa, Staphylococcus aureus
QISYHFNYYGPIGNQRD

SEQ ID NO: 1699096 - protein, 19 aa, Staphylococcus aureus
QITAIINKLNEWTKQAKGN

SEQ ID NO: 1699097 - protein, 17 aa, Staphylococcus aureus
QIVEILKNQIDTLNNQI

SEQ ID NO: 1699098 - protein, 17 aa, Staphylococcus aureus
QIVEILKNQINTLNNQI

SEQ ID NO: 1699099 - protein, 18 aa, Staphylococcus aureus
QIVGYLLSGDPAYIPRQN

SEQ ID NO: 1699100 - protein, 25 aa, Staphylococcus aureus
QIVRHELLRMISWKVGIETGFKLSV

SEQ ID NO: 1699101 - protein, 18 aa, Staphylococcus aureus
QIVTKCGIILPSKQLDFT

SEQ ID NO: 1699102 - protein, 18 aa, Staphylococcus aureus
QKAALKSQIEGASTVAGV

SEQ ID NO: 1699103 - protein, 19 aa, Staphylococcus aureus
QKAIYYKEQQARITLYLKH

SEQ ID NO: 1699104 - protein, 26 aa, Staphylococcus aureus
QKAQALDHAMELLRNSVADNQATLAS

SEQ ID NO: 1699105 - protein, 25 aa, Staphylococcus aureus
QKEAKFENGVITRKADEKTPNNTAV

SEQ ID NO: 1699106 - protein, 17 aa, Staphylococcus aureus
QKEIIDFEFVIGKSFVE

SEQ ID NO: 1699107 - protein, 21 aa, Staphylococcus aureus
QKESPEILAFIKSFKKYIANE

SEQ ID NO: 1699108 - protein, 19 aa, Staphylococcus aureus
QKFWQTFQKKSLSQTFFAI

SEQ ID NO: 1699109 - protein, 23 aa, Staphylococcus aureus
QKHAYINKLLPRTLDVFQQIDVS

SEQ ID NO: 1699110 - protein, 20 aa, Staphylococcus aureus
QKIMRIVNHNIILRLKEEQN

SEQ ID NO: 1699111 - protein, 21 aa, Staphylococcus aureus
QKPVLLYAPIGLVSAQQLPLS

SEQ ID NO: 1699112 - protein, 23 aa, Staphylococcus aureus
QKRGYDIELAYEAGLLSRNEENF

SEQ ID NO: 1699113 - protein, 18 aa, Staphylococcus aureus
QKRNETFIIDANLDSVRS

SEQ ID NO: 1699114 - protein, 18 aa, Staphylococcus aureus
QKSFFDFYLKEENSDWKD

SEQ ID NO: 1699115 - protein, 29 aa, Staphylococcus aureus
QKVSMIFQHFNLLWSRTVLKNIMFPLEIA

SEQ ID NO: 1699116 - protein, 19 aa, Staphylococcus aureus
QKYLDAEPSKKSAYDQAVN

SEQ ID NO: 1699117 - protein, 17 aa, Staphylococcus aureus
QKYMFDYSACKYPIGVA

SEQ ID NO: 1699118 - protein, 18 aa, Staphylococcus aureus
QLAKVKALIDQYVADGNR

SEQ ID NO: 1699119 - protein, 22 aa, Staphylococcus aureus
QLAQYCSFYSDFVKASLILERE

SEQ ID NO: 1699120 - protein, 21 aa, Staphylococcus aureus
QLEIQYDLDITRWSELEEIKE

SEQ ID NO: 1699121 - protein, 17 aa, Staphylococcus aureus
QLEITEHHFVINSLALP

SEQ ID NO: 1699122 - protein, 20 aa, Staphylococcus aureus
QLEKILYKYSFSTKQMIEFL

SEQ ID NO: 1699123 - protein, 21 aa, Staphylococcus aureus
QLEMILYKYSFSTKQMIEFLG

SEQ ID NO: 1699124 - protein, 26 aa, Staphylococcus aureus
QLERVYIASVLMLEPKLIIADEPVAS

SEQ ID NO: 1699125 - protein, 36 aa, Staphylococcus aureus
QLETELFDYVNWYNNFRPHSSLQYLTPVAFKNLHMK

SEQ ID NO: 1699126 - protein, 23 aa, Staphylococcus aureus
QLEVPIPAIISAFEIAKAHDVTT

SEQ ID NO: 1699127 - protein, 19 aa, Staphylococcus aureus
QLFDNLLLSEKVNLELQGT

SEQ ID NO: 1699128 - protein, 19 aa, Staphylococcus aureus
QLFITSEHFAIDIDKVLFQ

SEQ ID NO: 1699129 - protein, 19 aa, Staphylococcus aureus
QLFSLPKNLMSRPLYLRIN

SEQ ID NO: 1699130 - protein, 24 aa, Staphylococcus aureus
QLGLENYYMYKKFGVIPEMEYEME

SEQ ID NO: 1699131 - protein, 26 aa, Staphylococcus aureus
QLGTKAINAIQPNIVKKPAALAQINQ

SEQ ID NO: 1699132 - protein, 24 aa, Staphylococcus aureus
QLGTKAINAIQPNIVKKPASLAQT

SEQ ID NO: 1699133 - protein, 29 aa, Staphylococcus aureus
QLGVVLFETLQLPVIKKTKTGYSTAVDVL

SEQ ID NO: 1699134 - protein, 18 aa, Staphylococcus aureus
QLIDFKTYHGTENTLEML

SEQ ID NO: 1699135 - protein, 17 aa, Staphylococcus aureus
QLIDKMAAVFILQGYLD

SEQ ID NO: 1699136 - protein, 17 aa, Staphylococcus aureus
QLKDYFIKQIRAYMDGK

SEQ ID NO: 1699137 - protein, 20 aa, Staphylococcus aureus
QLKPLPFISGYVGTCSFDLV

SEQ ID NO: 1699138 - protein, 20 aa, Staphylococcus aureus
QLKRNKFYLGSTNYTLLQYG

SEQ ID NO: 1699139 - protein, 19 aa, Staphylococcus aureus
QLKSMLRQVLFLIDTGDGN

SEQ ID NO: 1699140 - protein, 22 aa, Staphylococcus aureus
QLLKMFVSTMETRLNDHNKAEH

SEQ ID NO: 1699141 - protein, 22 aa, Staphylococcus aureus
QLLKMLVSTMETRLNDHNKAKH

SEQ ID NO: 1699142 - protein, 18 aa, Staphylococcus aureus
QLMKSLYEYTETSIIFIT

SEQ ID NO: 1699143 - protein, 32 aa, Staphylococcus aureus
QLMNDLNALYQHKLLLPLKLQYKDYSEWMSHR

SEQ ID NO: 1699144 - protein, 27 aa, Staphylococcus aureus
QLNDKSLPLIVMTIQKMAKAIQGNAHL

SEQ ID NO: 1699145 - protein, 22 aa, Staphylococcus aureus
QLNLISFNVLYTVLRPYLTSNA

SEQ ID NO: 1699146 - protein, 24 aa, Staphylococcus aureus
QLPMVGTISLVPQIVDVVSIPVIA

SEQ ID NO: 1699147 - protein, 31 aa, Staphylococcus aureus
QLPNDLFYNTGISTYIWIITKDKSPERQGKV

SEQ ID NO: 1699148 - protein, 19 aa, Staphylococcus aureus
QLPTHGFAVRIFAYRTQII

SEQ ID NO: 1699149 - protein, 30 aa, Staphylococcus aureus
QLQEEVPAGLIPLLKIQGLGSKKIAKLYKE

SEQ ID NO: 1699150 - protein, 23 aa, Staphylococcus aureus
QLRKRYDIPTKKAPELLLKGDGD

SEQ ID NO: 1699151 - protein, 21 aa, Staphylococcus aureus
QLRKRYDIPTKKAPKLLLKGD

SEQ ID NO: 1699152 - protein, 22 aa, Staphylococcus aureus
QLRKRYHIPTKQAPELKLKGSG

SEQ ID NO: 1699153 - protein, 30 aa, Staphylococcus aureus
QLRLYGLGAYELLSLMYDIHTIRMTIIQPR

SEQ ID NO: 1699154 - protein, 20 aa, Staphylococcus aureus
QLSLENYYMYKKFEVIPEME

SEQ ID NO: 1699155 - protein, 21 aa, Staphylococcus aureus
QLSLENYYMYKKFEVIPEMEY

SEQ ID NO: 1699156 - protein, 18 aa, Staphylococcus aureus
QLSRQIALQTAPQIRMIQ

SEQ ID NO: 1699157 - protein, 26 aa, Staphylococcus aureus
QLSSKQFYWYERSIKLFSEFFGENML

SEQ ID NO: 1699158 - protein, 17 aa, Staphylococcus aureus
QLTEQVMRIIGMDGKQN

SEQ ID NO: 1699159 - protein, 19 aa, Staphylococcus aureus
QLVISLTDHIIFAYKRLKQ

SEQ ID NO: 1699160 - protein, 18 aa, Staphylococcus aureus
QLVLLDINLPTLNGFHWC

SEQ ID NO: 1699161 - protein, 18 aa, Staphylococcus aureus
QLVSQMMLMAMSLEANQC

SEQ ID NO: 1699162 - protein, 19 aa, Staphylococcus aureus
QMDLLVSSIVYVFDFLNIR

SEQ ID NO: 1699163 - protein, 22 aa, Staphylococcus aureus
QMFDLFHLYIEQFDNIIEKFYE

SEQ ID NO: 1699164 - protein, 21 aa, Staphylococcus aureus
QMIIQSLFDLIDENKVLILAT

SEQ ID NO: 1699165 - protein, 26 aa, Staphylococcus aureus
QMPPEEWICTMINSMRIGLPASLDKV

SEQ ID NO: 1699166 - protein, 22 aa, Staphylococcus aureus
QMQKPSVFFLKDGKAREVVKRQ

SEQ ID NO: 1699167 - protein, 20 aa, Staphylococcus aureus
QMQNAIRFTPYAVTDDTLVR

SEQ ID NO: 1699168 - protein, 30 aa, Staphylococcus aureus
QMRSIDVQLIFCTLPLELRGFQIVSLDDIE

SEQ ID NO: 1699169 - protein, 17 aa, Staphylococcus aureus
QMSGGQMRKIAIVSVLA

SEQ ID NO: 1699170 - protein, 26 aa, Staphylococcus aureus
QMYGINEVYLISHALLETGNGTSQLA

SEQ ID NO: 1699171 - protein, 24 aa, Staphylococcus aureus
QNAESIIAGLNNPTINKGNVSSAT

SEQ ID NO: 1699172 - protein, 24 aa, Staphylococcus aureus
QNAGYWEYIPKNITKLSDLKIVGL

SEQ ID NO: 1699173 - protein, 23 aa, Staphylococcus aureus
QNAKDLINQTNNPTLDKAQVEQL

SEQ ID NO: 1699174 - protein, 18 aa, Staphylococcus aureus
QNANKFYKFAIYGKFGTG

SEQ ID NO: 1699175 - protein, 28 aa, Staphylococcus aureus
QNATGLPTDGFTYKWNNAATGTNDANWA

SEQ ID NO: 1699176 - protein, 19 aa, Staphylococcus aureus
QNDIKLYIRDPQGDYLPSE

SEQ ID NO: 1699177 - protein, 21 aa, Staphylococcus aureus
QNGVGFALTYFTEGIIFGSKA

SEQ ID NO: 1699178 - protein, 18 aa, Staphylococcus aureus
QNHSVQLMPAISQLFEQC

SEQ ID NO: 1699179 - protein, 29 aa, Staphylococcus aureus
QNIIQKRFTLNILYPYIETIHITKDKNLI

SEQ ID NO: 1699180 - protein, 20 aa, Staphylococcus aureus
QNIISKIKPATTVKATALQQ

SEQ ID NO: 1699181 - protein, 23 aa, Staphylococcus aureus
QNKLTAFVVLSKDLNDFGPAWIE

SEQ ID NO: 1699182 - protein, 17 aa, Staphylococcus aureus
QNLFRRPTPARLTRIEK

SEQ ID NO: 1699183 - protein, 17 aa, Staphylococcus aureus
QNMLLDNGKYIYGYFPH

SEQ ID NO: 1699184 - protein, 18 aa, Staphylococcus aureus
QNNGSYSLNIENLDKTYV

SEQ ID NO: 1699185 - protein, 18 aa, Staphylococcus aureus
QNNKLYIKNVLSNLIDLL

SEQ ID NO: 1699186 - protein, 22 aa, Staphylococcus aureus
QNQGIYNLKLYSYILSIMINEI

SEQ ID NO: 1699187 - protein, 18 aa, Staphylococcus aureus
QNTLYKMRWNPAHPGTHQ

SEQ ID NO: 1699188 - protein, 18 aa, Staphylococcus aureus
QNYLLTPEKWMQNSTGYF

SEQ ID NO: 1699189 - protein, 26 aa, Staphylococcus aureus
QPFVKQKLIFLVGMAGERDLTKTPEM

SEQ ID NO: 1699190 - protein, 24 aa, Staphylococcus aureus
QPGIKYDCMIILYGGQGVGKSTAV

SEQ ID NO: 1699191 - protein, 17 aa, Staphylococcus aureus
QPGVRVIVPFGPRTIQG

SEQ ID NO: 1699192 - protein, 23 aa, Staphylococcus aureus
QPGYKLMFNTLRAMYQQHPIRVD

SEQ ID NO: 1699193 - protein, 25 aa, Staphylococcus aureus
QPHIGHFPEMWLLSSSPSSAKIAAE

SEQ ID NO: 1699194 - protein, 22 aa, Staphylococcus aureus
QPKGRKFKDFTSKFNIASEAKE

SEQ ID NO: 1699195 - protein, 22 aa, Staphylococcus aureus
QPLYDIGAVGMRLLTKYMNDEK

SEQ ID NO: 1699196 - protein, 24 aa, Staphylococcus aureus
QPNRLYPKKPYDNYFYAYDVDEFY

SEQ ID NO: 1699197 - protein, 24 aa, Staphylococcus aureus
QPNRVIYDFYDYDPYQLAANNAKA

SEQ ID NO: 1699198 - protein, 48 aa, Staphylococcus aureus
QPPGKKLQHLSLLSGGERALTAIALLFAILKVRSAPFVILDEVEAALD

SEQ ID NO: 1699199 - protein, 21 aa, Staphylococcus aureus
QPQRDALRNQINQAQALATVE

SEQ ID NO: 1699200 - protein, 30 aa, Staphylococcus aureus
QPSPDCLMLFQHHNLLPWKTVNDNIRIGFQ

SEQ ID NO: 1699201 - protein, 25 aa, Staphylococcus aureus
QPSPDCLMLFQHHNLLSWKTINDNI

SEQ ID NO: 1699202 - protein, 30 aa, Staphylococcus aureus
QQADYTFASLDIFNGLKRRAQTILDENRNN

SEQ ID NO: 1699203 - protein, 28 aa, Staphylococcus aureus
QQARRILDRLVGYNISPVLWKKVKKGLS

SEQ ID NO: 1699204 - protein, 27 aa, Staphylococcus aureus
QQDLEKLQKILILKSFDFDIAKIKQYI

SEQ ID NO: 1699205 - protein, 21 aa, Staphylococcus aureus
QQDVDFVIIAGDLFDSENRTI

SEQ ID NO: 1699206 - protein, 21 aa, Staphylococcus aureus
QQEAARKLNFKARKTMIVAQQ

SEQ ID NO: 1699207 - protein, 22 aa, Staphylococcus aureus
QQEDYCIILAYFYEGKPMLSYV

SEQ ID NO: 1699208 - protein, 22 aa, Staphylococcus aureus
QQEYPQFLYENVMSKISSRDGE

SEQ ID NO: 1699209 - protein, 20 aa, Staphylococcus aureus
QQIANGTPTPVLTPDTVTQA

SEQ ID NO: 1699210 - protein, 17 aa, Staphylococcus aureus
QQLKKRFNLKTSKTPKL

SEQ ID NO: 1699211 - protein, 23 aa, Staphylococcus aureus
QQLMSQLGLTLLLNKLPSEISGG

SEQ ID NO: 1699212 - protein, 31 aa, Staphylococcus aureus; identical to SEQ ID NO: 1591900

SEQ ID NO: 1699213 - protein, 31 aa, Staphylococcus aureus; identical to SEQ ID NO: 1592459

SEQ ID NO: 1699214 - protein, 18 aa, Staphylococcus aureus
QQREIGFPISTDNASWRG

SEQ ID NO: 1699215 - protein, 24 aa, Staphylococcus aureus
QQRLGHVDFCFLELLKKGYNRDAI

SEQ ID NO: 1699216 - protein, 24 aa, Staphylococcus aureus
QQRLGHVDFCFLELLKKGYNRDTI

SEQ ID NO: 1699217 - protein, 21 aa, Staphylococcus aureus
QQRVMIARALISEPAVLVLDE

SEQ ID NO: 1699218 - protein, 23 aa, Staphylococcus aureus
QQSLKLFIQFIQQQLRDNVYFVV

SEQ ID NO: 1699219 - protein, 20 aa, Staphylococcus aureus
QQSPILSNKVFKYAIGYHYQ

SEQ ID NO: 1699220 - protein, 19 aa, Staphylococcus aureus
QQSPILSNKVFKYDIGYHY

SEQ ID NO: 1699221 - protein, 27 aa, Staphylococcus aureus
QQTYAKFKAIATPEQLAKVKVLIDQYV

SEQ ID NO: 1699222 - protein, 18 aa, Staphylococcus aureus
QQVIAEPVNIICTHGTMS

SEQ ID NO: 1699223 - protein, 27 aa, Staphylococcus aureus
QQVIHLIRIMCLIKKRLVITQLPMLKV

SEQ ID NO: 1699224 - protein, 33 aa, Staphylococcus aureus
QRAMITSEGAFKYFSKQYGITPGYIWEINTEKQ

SEQ ID NO: 1699225 - protein, 18 aa, Staphylococcus aureus
QRDINYENYLPMYDSKDI

SEQ ID NO: 1699226 - protein, 29 aa, Staphylococcus aureus
QRERGTLFERLVLAYLKNEPTYKNLYKNV

SEQ ID NO: 1699227 - protein, 24 aa, Staphylococcus aureus
QRFHDRIFINCQANQIPTVVEKVV

SEQ ID NO: 1699228 - protein, 18 aa, Staphylococcus aureus
QRFKGLKEWHFGLFEGES

SEQ ID NO: 1699229 - protein, 19 aa, Staphylococcus aureus
QRICDAAIQLMINIKYVNA

SEQ ID NO: 1699230 - protein, 24 aa, Staphylococcus aureus
QRICDAAIQLMINIKYVNAGTVEF

SEQ ID NO: 1699231 - protein, 23 aa, Staphylococcus aureus
QRISIARAILKDAPIIILDEATA

SEQ ID NO: 1699232 - protein, 22 aa, Staphylococcus aureus
QRKDMFFDYVSLKRMVIDEIQL

SEQ ID NO: 1699233 - protein, 22 aa, Staphylococcus aureus
QRKDRNGFIRNFKIYECEDCTG

SEQ ID NO: 1699234 - protein, 22 aa, Staphylococcus aureus
QRNAIFEYYRVALDSFEVMTRN

SEQ ID NO: 1699235 - protein, 22 aa, Staphylococcus aureus
QRQEFIYYFHPGDMKPPLNVYF

SEQ ID NO: 1699236 - protein, 31 aa, Staphylococcus aureus
QRRELINGVFIDINPYIKNMMYVLADNRHIS

SEQ ID NO: 1699237 - protein, 26 aa, Staphylococcus aureus
QRSADIFLGVPFNIASYALLTHLIAK

SEQ ID NO: 1699238 - protein, 17 aa, Staphylococcus aureus
QRVAIARALAMHPGVIL

SEQ ID NO: 1699239 - protein, 25 aa, Staphylococcus aureus
QRVALIRMMLKDPIVMLADEPTGAL

SEQ ID NO: 1699240 - protein, 22 aa, Staphylococcus aureus
QRVGFFYPEIAMYFKNPSRILG

SEQ ID NO: 1699241 - protein, 27 aa, Staphylococcus aureus
QRVNNAKDALNGDAKLIAAQNAAKQHL

SEQ ID NO: 1699242 - protein, 17 aa, Staphylococcus aureus
QRWLFYAYDRLRKTVVA

SEQ ID NO: 1699243 - protein, 20 aa, Staphylococcus aureus
QSECFVRHYTKGQVIYFLPQ

SEQ ID NO: 1699244 - protein, 23 aa, Staphylococcus aureus
QSFKFSRLPQDINFFSWLQHVKD

SEQ ID NO: 1699245 - protein, 28 aa, Staphylococcus aureus
QSGKEYLQSLVIEYYRIQKEQDSKFKLN

SEQ ID NO: 1699246 - protein, 28 aa, Staphylococcus aureus
QSGVDHFKIVPLLIFSAMHYLKDIPDIV

SEQ ID NO: 1699247 - protein, 18 aa, Staphylococcus aureus
QSHLLGLSLIGLNEILAI

SEQ ID NO: 1699248 - protein, 17 aa, Staphylococcus aureus
QSHPVCHYIYDLDELKS

SEQ ID NO: 1699249 - protein, 22 aa, Staphylococcus aureus
QSIAFMYEPGEGLAYEKTALDF

SEQ ID NO: 1699250 - protein, 18 aa, Staphylococcus aureus
QSIARIAQKARACGIHML

SEQ ID NO: 1699251 - protein, 31 aa, Staphylococcus aureus
QSIKAGNKVLPHSKVLLLTDGDLTMPDMSGW

SEQ ID NO: 1699252 - protein, 22 aa, Staphylococcus aureus
QSIKEFRMWVADKRIQHSDNTL

SEQ ID NO: 1699253 - protein, 46 aa, Staphylococcus aureus; identical to SEQ ID NO: 1597325

SEQ ID NO: 1699254 - protein, 24 aa, Staphylococcus aureus
QSKHNLIQGILKIYDLTLTTKSNV

SEQ ID NO: 1699255 - protein, 17 aa, Staphylococcus aureus
QSKSYLYNYWLAMHKWL

SEQ ID NO: 1699256 - protein, 17 aa, Staphylococcus aureus
QSLIRPSGFYKSKSLTI

SEQ ID NO: 1699257 - protein, 24 aa, Staphylococcus aureus
QSLNTAMTGLKRGVANHNQVVQSD

SEQ ID NO: 1699258 - protein, 25 aa, Staphylococcus aureus
QSLYDSYIKAIRWSSDRLNNKGIIG

SEQ ID NO: 1699259 - protein, 28 aa, Staphylococcus aureus
QSNKEYLQSLVIEYFRIEKEKDKKFKLN

SEQ ID NO: 1699260 - protein, 31 aa, Staphylococcus aureus
QSNWQINPMLRLLKTDVLTTSYLKSAYLVDL

SEQ ID NO: 1699261 - protein, 17 aa, Staphylococcus aureus
QSPRLMLGFKNKPLQEA

SEQ ID NO: 1699262 - protein, 29 aa, Staphylococcus aureus
QSQHSVLRNYPLLARIRYISEKMGPELRQ

SEQ ID NO: 1699263 - protein, 22 aa, Staphylococcus aureus
QSSDFLKFRGLVDQYKEIELNK

SEQ ID NO: 1699264 - protein, 31 aa, Staphylococcus aureus
QSYHYYMDAMLFKQYPYFNRKNIHIPNGDAD

SEQ ID NO: 1699265 - protein, 32 aa, Staphylococcus aureus
QSYHYYMDDMLFKQYPYFNRKKIHIPNGDAYD

SEQ ID NO: 1699266 - protein, 21 aa, Staphylococcus aureus
QSYSILFDRYQRDVGYSEAKE

SEQ ID NO: 1699267 - protein, 25 aa, Staphylococcus aureus
QTAGLYAERLATLGYVTMAYDASYQ

SEQ ID NO: 1699268 - protein, 19 aa, Staphylococcus aureus
QTAIRIQIAIQIQTAIQNQ

SEQ ID NO: 1699269 - protein, 37 aa, Staphylococcus aureus
QTDFEKRLFLMAIFNRNRTLFYKLTSEHLVEFMPIIY

SEQ ID NO: 1699270 - protein, 21 aa, Staphylococcus aureus
QTDILKFSFPKHINYKIYGNI

SEQ ID NO: 1699271 - protein, 22 aa, Staphylococcus aureus
QTDTNVHLFLHDENLRQLVSYD

SEQ ID NO: 1699272 - protein, 35 aa, Staphylococcus aureus
QTETMNMGILNSRFVVVFLSPNFIESGWSRYEFLS

SEQ ID NO: 1699273 - protein, 18 aa, Staphylococcus aureus
QTHLKWGAQKEVIKLIPG

SEQ ID NO: 1699274 - protein, 21 aa, Staphylococcus aureus
QTHPFSQLLHDAIHLAFDNDI

SEQ ID NO: 1699275 - protein, 20 aa, Staphylococcus aureus
QTKIALFEALRSWLDDEIVA

SEQ ID NO: 1699276 - protein, 23 aa, Staphylococcus aureus
QTKKPVIIYFYGGSFENGHGTTE

SEQ ID NO: 1699277 - protein, 17 aa, Staphylococcus aureus
QTKLGWLDLYYQAGFNH

SEQ ID NO: 1699278 - protein, 20 aa, Staphylococcus aureus
QTLITNITYLLKETAYKNSS

SEQ ID NO: 1699279 - protein, 25 aa, Staphylococcus aureus
QTNQKILLPLSELARPLLLAALSKD

SEQ ID NO: 1699280 - protein, 29 aa, Staphylococcus aureus
QTNQNINFVFQYFQKLYKFLRSLSNEGSQ

SEQ ID NO: 1699281 - protein, 17 aa, Staphylococcus aureus
QTPHIMSIDDYEFDYNL

SEQ ID NO: 1699282 - protein, 19 aa, Staphylococcus aureus
QTQLKFVLFYTIHIKKLTK

SEQ ID NO: 1699283 - protein, 25 aa, Staphylococcus aureus
QTQQQIVYKAPKPLAGLNGESHDFT

SEQ ID NO: 1699284 - protein, 28 aa, Staphylococcus aureus
QTQTVIQIQTAIQIQIATQIQTAIQIQT

SEQ ID NO: 1699285 - protein, 17 aa, Staphylococcus aureus
QTRHRLHKVETLRVNWI

SEQ ID NO: 1699286 - protein, 24 aa, Staphylococcus aureus
QTTNAEIATVKNSALEQLKAQRIN

SEQ ID NO: 1699287 - protein, 25 aa, Staphylococcus aureus
QTVAALHFATIVPGTYCWHHTDDNE

SEQ ID NO: 1699288 - protein, 26 aa, Staphylococcus aureus
QTVGKGGLLITLAKLSAHYGLGLKSS

SEQ ID NO: 1699289 - protein, 18 aa, Staphylococcus aureus
QTVKYRGFAIKQEVLKEL

SEQ ID NO: 1699290 - protein, 25 aa, Staphylococcus aureus
QTYAKFKAIATPEQLAKVKVLIDQY

SEQ ID NO: 1699291 - protein, 17 aa, Staphylococcus aureus
QTYFKMMQNFLKPNDVI

SEQ ID NO: 1699292 - protein, 25 aa, Staphylococcus aureus
QVDQALQNILNAKQALNGDERVALA

SEQ ID NO: 1699293 - protein, 24 aa, Staphylococcus aureus
QVEKNLPGVTLKIKQLPFKQRVSL

SEQ ID NO: 1699294 - protein, 19 aa, Staphylococcus aureus
QVELLADLELPLAKILSEM

SEQ ID NO: 1699295 - protein, 21 aa, Staphylococcus aureus
QVEQEMLLQHLPDYVQLNLKH

SEQ ID NO: 1699296 - protein, 17 aa, Staphylococcus aureus
QVFFIRQGNMIKRDTTM

SEQ ID NO: 1699297 - protein, 32 aa, Staphylococcus aureus
QVINAKYDVIYNGHTFATSLPAKFVVKDVQPA

SEQ ID NO: 1699298 - protein, 20 aa, Staphylococcus aureus
QVINLFQRKAQFDNSKINDT

SEQ ID NO: 1699299 - protein, 26 aa, Staphylococcus aureus
QVIQTQVVPLIQIVTRIQRVIQTQVV

SEQ ID NO: 1699300 - protein, 20 aa, Staphylococcus aureus
QVKKLLLEPYNSFESQVKTI

SEQ ID NO: 1699301 - protein, 17 aa, Staphylococcus aureus
QVLYDLVSLLHVSIDEF

SEQ ID NO: 1699302 - protein, 23 aa, Staphylococcus aureus
QVNDRLSIVGYPNPYKNKHHMFE

SEQ ID NO: 1699303 - protein, 23 aa, Staphylococcus aureus
QVNKIIQSINFIGTFTVEFFIDS

SEQ ID NO: 1699304 - protein, 17 aa, Staphylococcus aureus
QVRNIILNPNYCGRVIN

SEQ ID NO: 1699305 - protein, 19 aa, Staphylococcus aureus
QVVFFIMPSILKSKKYHVR

SEQ ID NO: 1699306 - protein, 18 aa, Staphylococcus aureus
QVVFFIMPSILKSKNTMS

SEQ ID NO: 1699307 - protein, 17 aa, Staphylococcus aureus
QVYDEAVDKAKQALDKS

SEQ ID NO: 1699308 - protein, 18 aa, Staphylococcus aureus
QVYDEAVDKAKQALDKSS

SEQ ID NO: 1699309 - protein, 21 aa, Staphylococcus aureus
QWDDQYPLLEHFEEDIAKDYL

SEQ ID NO: 1699310 - protein, 19 aa, Staphylococcus aureus
QYFNQILVHTGQNYDYTLN

SEQ ID NO: 1699311 - protein, 30 aa, Staphylococcus aureus
QYGPRPQFNKTPKYVKYRDAGTGIREYNDG

SEQ ID NO: 1699312 - protein, 17 aa, Staphylococcus aureus
QYHLKLNYVHNKGFNII

SEQ ID NO: 1699313 - protein, 20 aa, Staphylococcus aureus
QYIDWDGGSLIELIIAEGLA

SEQ ID NO: 1699314 - protein, 18 aa, Staphylococcus aureus
QYIPQTFRHYAVRGHNNI

SEQ ID NO: 1699315 - protein, 19 aa, Staphylococcus aureus
QYIQAAYHEPLREEFKNLT

SEQ ID NO: 1699316 - protein, 17 aa, Staphylococcus aureus
QYISFIPMTDDVELSLA

SEQ ID NO: 1699317 - protein, 21 aa, Staphylococcus aureus
QYKNLCTKLNKLLGKFHKALK

SEQ ID NO: 1699318 - protein, 17 aa, Staphylococcus aureus
QYLATRKVYTTQSIGVI

SEQ ID NO: 1699319 - protein, 23 aa, Staphylococcus aureus
QYMGAYHLQWHMIKYAKSDNINR

SEQ ID NO: 1699320 - protein, 20 aa, Staphylococcus aureus
QYMGDSMFIGRPVHIMALTI

SEQ ID NO: 1699321 - protein, 30 aa, Staphylococcus aureus
QYNVNNLLNMPFGVCHFAVAAKPETTNYRK

SEQ ID NO: 1699322 - protein, 18 aa, Staphylococcus aureus
QYQLIQPVIGISSAGVVD

SEQ ID NO: 1699323 - protein, 17 aa, Staphylococcus aureus
QYQLPLFMDGARLGYGL

SEQ ID NO: 1699324 - protein, 19 aa, Staphylococcus aureus
QYTDMPFLIMLDEDENGYK

SEQ ID NO: 1699325 - protein, 29 aa, Staphylococcus aureus
QYTVDREYFISRVLKLKNNLKKKYEINQK

SEQ ID NO: 1699326 - protein, 17 aa, Staphylococcus aureus
QYVLMTYYNIICHYGEQ

SEQ ID NO: 1699327 - protein, 24 aa, Staphylococcus aureus
RAESFDILPLFISSRNKQIEYWSS

SEQ ID NO: 1699328 - protein, 17 aa, Staphylococcus aureus
RAETILNKTQGANTSKQ

SEQ ID NO: 1699329 - protein, 22 aa, Staphylococcus aureus
RAEYRLLLRHDNADLRLTDMGH

SEQ ID NO: 1699330 - protein, 23 aa, Staphylococcus aureus
RAHSIYLYEYYWSEAYKNYKEGY

SEQ ID NO: 1699331 - protein, 19 aa, Staphylococcus aureus
RAIAGYFLSFDASNAQNTA

SEQ ID NO: 1699332 - protein, 17 aa, Staphylococcus aureus
RAIAKYQSLHPWVLRQK

SEQ ID NO: 1699333 - protein, 26 aa, Staphylococcus aureus
RAIDWQAIILDWRRKPRAMHYSRYWK

SEQ ID NO: 1699334 - protein, 28 aa, Staphylococcus aureus
RAILVHPWQYDHTIGKYFEAWIAKKNIN

SEQ ID NO: 1699335 - protein, 21 aa, Staphylococcus aureus
RAKAWMINTRTPDWLYKSPRT

SEQ ID NO: 1699336 - protein, 22 aa, Staphylococcus aureus
RAKAWMINTRTPDWLYKSPRTT

SEQ ID NO: 1699337 - protein, 18 aa, Staphylococcus aureus
RAKRYNRWLQFDYVIHSA

SEQ ID NO: 1699338 - protein, 17 aa, Staphylococcus aureus
RAKVLEGLEFMGVYWDP

SEQ ID NO: 1699339 - protein, 21 aa, Staphylococcus aureus
RANLYGLFNKSIEFENSSFRG

SEQ ID NO: 1699340 - protein, 20 aa, Staphylococcus aureus
RAQKLFGQKIHVFDIRKHEM

SEQ ID NO: 1699341 - protein, 23 aa, Staphylococcus aureus
RAQSFGMKVLAFDPYLTDEKAKS

SEQ ID NO: 1699342 - protein, 18 aa, Staphylococcus aureus
RAREFNGMEEASINMDYH

SEQ ID NO: 1699343 - protein, 19 aa, Staphylococcus aureus
RAREFNGMEEASINMDYHK

SEQ ID NO: 1699344 - protein, 23 aa, Staphylococcus aureus
RARENLKIYWSPRTEKKIIDNII

SEQ ID NO: 1699345 - protein, 26 aa, Staphylococcus aureus
RARMFEIMETYKPYAVYHAAAHKHVP

SEQ ID NO: 1699346 - protein, 25 aa, Staphylococcus aureus
RARRDIEMLLGSKVYLELWVKVQRD

SEQ ID NO: 1699347 - protein, 20 aa, Staphylococcus aureus
RASFIRLANPSKNTAKEMKK

SEQ ID NO: 1699348 - protein, 22 aa, Staphylococcus aureus
RASQMYYHELNLTTPIVNFNGA

SEQ ID NO: 1699349 - protein, 25 aa, Staphylococcus aureus
RATETLNNLSNLNTPQRQALENQIN

SEQ ID NO: 1699350 - protein, 17 aa, Staphylococcus aureus
RATFLPLNVIQSRVVAT

SEQ ID NO: 1699351 - protein, 25 aa, Staphylococcus aureus
RAVKPPIIYGDVKWIAPLTVDETVY

SEQ ID NO: 1699352 - protein, 21 aa, Staphylococcus aureus
RAYFFQYINKGPYPGEEEKMK

SEQ ID NO: 1699353 - protein, 17 aa, Staphylococcus aureus
RAYNLVIPPSGRTLSGG

SEQ ID NO: 1699354 - protein, 20 aa, Staphylococcus aureus
RCAMQNLKPLFDSPARIVIS

SEQ ID NO: 1699355 - protein, 17 aa, Staphylococcus aureus
RCEKFSGWLLKEGFEDI

SEQ ID NO: 1699356 - protein, 24 aa, Staphylococcus aureus
RCQDGIVLFWPIDGEIELQKFRES

SEQ ID NO: 1699357 - protein, 19 aa, Staphylococcus aureus
RDASIIKSEYPRLSDGEIS

SEQ ID NO: 1699358 - protein, 23 aa, Staphylococcus aureus
RDDAQIIFIDTPGIHKPKHKLGD

SEQ ID NO: 1699359 - protein, 21 aa, Staphylococcus aureus
RDDIMVYLMYAGLEPSMAFKI

SEQ ID NO: 1699360 - protein, 17 aa, Staphylococcus aureus
RDEAMNRVMPLLKTFRL

SEQ ID NO: 1699361 - protein, 27 aa, Staphylococcus aureus
RDFYDTVYQLLAKDYYRWLRSQKADNF

SEQ ID NO: 1699362 - protein, 25 aa, Staphylococcus aureus
RDGTMDEILVFDIEPSYDAIITLKD

SEQ ID NO: 1699363 - protein, 24 aa, Staphylococcus aureus
RDHDTVRIYKPWLTAHHLSLPKYV

SEQ ID NO: 1699364 - protein, 17 aa, Staphylococcus aureus
RDIELLDTLYDKNKQYF

SEQ ID NO: 1699365 - protein, 26 aa, Staphylococcus aureus
RDIKRDIGMIFQHFNLLNSATVFKNV

SEQ ID NO: 1699366 - protein, 26 aa, Staphylococcus aureus
RDKTGLLLDPYFAGTKVKWILDNVEC

SEQ ID NO: 1699367 - protein, 30 aa, Staphylococcus aureus
RDLLAEKGLELGCLFVFYGHTHVAKYEYIN

SEQ ID NO: 1699368 - protein, 17 aa, Staphylococcus aureus
RDLTTKIDQATTVAGVE

SEQ ID NO: 1699369 - protein, 18 aa, Staphylococcus aureus
RDMDGYYLIVQQERDLSD

SEQ ID NO: 1699370 - protein, 19 aa, Staphylococcus aureus
RDMLGKYHKLFTEKHDKNG

SEQ ID NO: 1699371 - protein, 25 aa, Staphylococcus aureus
RDNATIYMRYADYVKIISVLSNGTT

SEQ ID NO: 1699372 - protein, 18 aa, Staphylococcus aureus
RDNHSAYAFIKRLIKQFG

SEQ ID NO: 1699373 - protein, 25 aa, Staphylococcus aureus
RDNHSAYAFIKRLIKQFGKPQKVIT

SEQ ID NO: 1699374 - protein, 26 aa, Staphylococcus aureus
RDNHSAYAFIKRLIKQFGKPQKVVTD

SEQ ID NO: 1699375 - protein, 26 aa, Staphylococcus aureus
RDNHSAYTFIKRLIKQFGKPQMIITD

SEQ ID NO: 1699376 - protein, 24 aa, Staphylococcus aureus
RDNMIKHPMILITVLEEPLALPSI

SEQ ID NO: 1699377 - protein, 25 aa, Staphylococcus aureus
RDNMIKHPMILITVLEEPLILPSIQ

SEQ ID NO: 1699378 - protein, 32 aa, Staphylococcus aureus
RDPKELIFQFNSRFLVYFAVDHFNVLMTTKLA

SEQ ID NO: 1699379 - protein, 17 aa, Staphylococcus aureus
RDQLQAVTTVNALPNLN

SEQ ID NO: 1699380 - protein, 20 aa, Staphylococcus aureus
RDTLLRVPHGAGGIVLDVKV

SEQ ID NO: 1699381 - protein, 17 aa, Staphylococcus aureus
RDVFGYSVDKGWMCIQV

SEQ ID NO: 1699382 - protein, 26 aa, Staphylococcus aureus
RDVLIPLQMLVLFDKTIFKDEKQFTN

SEQ ID NO: 1699383 - protein, 19 aa, Staphylococcus aureus
REEFNKRLNIIHQKLNDNI

SEQ ID NO: 1699384 - protein, 24 aa, Staphylococcus aureus
REEVLAHLNVVIPNIQIIKNQVTN

SEQ ID NO: 1699385 - protein, 27 aa, Staphylococcus aureus
REFMDVGVYSMLGFVKGIDNHSSKVIR

SEQ ID NO: 1699386 - protein, 29 aa, Staphylococcus aureus
REFRKEILQAMRVGVWAPTQRISKRISTD

SEQ ID NO: 1699387 - protein, 20 aa, Staphylococcus aureus
REGFLLAQDISSYSLTIVAH

SEQ ID NO: 1699388 - protein, 19 aa, Staphylococcus aureus
REHDFRWEPTILSKSIKDL

SEQ ID NO: 1699389 - protein, 26 aa, Staphylococcus aureus
REIGYLLGFSDTYFIKLRNGSRRITD

SEQ ID NO: 1699390 - protein, 29 aa, Staphylococcus aureus
REINEEHVIILPIWHKVSVEDVRAYNPYL

SEQ ID NO: 1699391 - protein, 22 aa, Staphylococcus aureus
REKHLELIMKWCAQELKNNFQL

SEQ ID NO: 1699392 - protein, 19 aa, Staphylococcus aureus
REKIPSKLILLGDGPELAP

SEQ ID NO: 1699393 - protein, 19 aa, Staphylococcus aureus
REKKIVDKPYYKLNYLFEC

SEQ ID NO: 1699394 - protein, 17 aa, Staphylococcus aureus
REKLLHLSDILHKRVVG

SEQ ID NO: 1699395 - protein, 19 aa, Staphylococcus aureus
RELAKKYLKNRLITGDIAF

SEQ ID NO: 1699396 - protein, 25 aa, Staphylococcus aureus
RELEYYLSEYLGRATPLTYAASYTE

SEQ ID NO: 1699397 - protein, 17 aa, Staphylococcus aureus
RELITAKNHLDDPVSTE

SEQ ID NO: 1699398 - protein, 27 aa, Staphylococcus aureus
RELKLYDMIVERFLEALMPPHEYDAIT

SEQ ID NO: 1699399 - protein, 26 aa, Staphylococcus aureus
RELKTKFEVLKKRGKFPSNLEYIDSH

SEQ ID NO: 1699400 - protein, 19 aa, Staphylococcus aureus
RENQDVYGILPTNLQRYQC

SEQ ID NO: 1699401 - protein, 17 aa, Staphylococcus aureus
RENSKLSVIEFLSYKPA

SEQ ID NO: 1699402 - protein, 18 aa, Staphylococcus aureus
REPALGPTFGIKGGATGG

SEQ ID NO: 1699403 - protein, 25 aa, Staphylococcus aureus
REQMRRYHHAFKDSGLKYNISYASK

SEQ ID NO: 1699404 - protein, 25 aa, Staphylococcus aureus
REQMRRYHHAFKESGLKYNISYASK

SEQ ID NO: 1699405 - protein, 26 aa, Staphylococcus aureus
REQMRRYHRAFKDSGLKYNISYASKA

SEQ ID NO: 1699406 - protein, 30 aa, Staphylococcus aureus
REQRTLISHLGMAGVFFIVDELEDIMIPNY

SEQ ID NO: 1699407 - protein, 28 aa, Staphylococcus aureus
RERGTLFERLVLAYLKNEPTYKNLYKNV

SEQ ID NO: 1699408 - protein, 26 aa, Staphylococcus aureus
RERLQESAFLLKNLKITLNDLRSGKE

SEQ ID NO: 1699409 - protein, 22 aa, Staphylococcus aureus
REVNDILFVTYLLISDYSSLIY

SEQ ID NO: 1699410 - protein, 18 aa, Staphylococcus aureus
REYDLTPSALGKWIKQHQ

SEQ ID NO: 1699411 - protein, 27 aa, Staphylococcus aureus
RFATRYNKMLFLPTSFKWNGSEYPIQY

SEQ ID NO: 1699412 - protein, 17 aa, Staphylococcus aureus
RFDANDAWKKLTDKLKE

SEQ ID NO: 1699413 - protein, 20 aa, Staphylococcus aureus
RFDEIYYLYTIICVDIGEQV

SEQ ID NO: 1699414 - protein, 18 aa, Staphylococcus aureus
RFEGFTFDYCISNPPFGV

SEQ ID NO: 1699415 - protein, 19 aa, Staphylococcus aureus
RFIHLVWDVRNVINDNIKE

SEQ ID NO: 1699416 - protein, 31 aa, Staphylococcus aureus
RFKETFHAIQGHFTAVFKQLFGGGNAELQLT

SEQ ID NO: 1699417 - protein, 18 aa, Staphylococcus aureus
RFKKCVMGLPGGCPLGPR

SEQ ID NO: 1699418 - protein, 22 aa, Staphylococcus aureus
RFKTSSLFGFTKFSMELHKNKE

SEQ ID NO: 1699419 - protein, 18 aa, Staphylococcus aureus
RFREALIFMGRKNGKTTT

SEQ ID NO: 1699420 - protein, 17 aa, Staphylococcus aureus
RFRPYAMKILKENHYDF

SEQ ID NO: 1699421 - protein, 34 aa, Staphylococcus aureus
RGEKIEFLNKPPSAWVILAKPNLGISSPDIFKVI

SEQ ID NO: 1699422 - protein, 20 aa, Staphylococcus aureus
RGFAVYFSPEIKKFIADNLD

SEQ ID NO: 1699423 - protein, 25 aa, Staphylococcus aureus
RGGVPYTVFIDPPLSRVGLTSKEAA

SEQ ID NO: 1699424 - protein, 17 aa, Staphylococcus aureus
RGGWALLEALNAPYGMR

SEQ ID NO: 1699425 - protein, 18 aa, Staphylococcus aureus
RGHFISDHDYHIALNIAI

SEQ ID NO: 1699426 - protein, 22 aa, Staphylococcus aureus
RGKFDLLIVLSHCGIFFDETLC

SEQ ID NO: 1699427 - protein, 31 aa, Staphylococcus aureus
RGKGVMVVAPLEILDSFKGILKFQIPNDVIK

SEQ ID NO: 1699428 - protein, 21 aa, Staphylococcus aureus
RGKIKWQAFATLPKQFEILEQ

SEQ ID NO: 1699429 - protein, 23 aa, Staphylococcus aureus
RGKQGTGLGLFICKMIIEEHGGS

SEQ ID NO: 1699430 - protein, 24 aa, Staphylococcus aureus
RGKQGTGLGLFICKMIIEEHGGSI

SEQ ID NO: 1699431 - protein, 17 aa, Staphylococcus aureus
RGLISSEEMAKELVELS

SEQ ID NO: 1699432 - protein, 18 aa, Staphylococcus aureus
RGLTYKLEAFRGKVILVV

SEQ ID NO: 1699433 - protein, 26 aa, Staphylococcus aureus
RGNKKARRLLFWVVMNIIRGQHHYDN

SEQ ID NO: 1699434 - protein, 19 aa, Staphylococcus aureus
RGQFINMDYLDDIRVNIVY

SEQ ID NO: 1699435 - protein, 22 aa, Staphylococcus aureus
RGRIRIVNDMALKMLGMAKEDI

SEQ ID NO: 1699436 - protein, 23 aa, Staphylococcus aureus
RGRIRIVNDMALKMLGMAKEDII

SEQ ID NO: 1699437 - protein, 22 aa, Staphylococcus aureus
RGSFIMRYLLDGRVPNLPLAIC

SEQ ID NO: 1699438 - protein, 17 aa, Staphylococcus aureus
RGSRKQHFIAEKDFFIF

SEQ ID NO: 1699439 - protein, 25 aa, Staphylococcus aureus
RGSVPYTVFIDPPLSRVGLTGKEAA

SEQ ID NO: 1699440 - protein, 19 aa, Staphylococcus aureus
RGTYTMYFDHYAEIPKSIA

SEQ ID NO: 1699441 - protein, 17 aa, Staphylococcus aureus
RGVSFKVVYFQPASSLN

SEQ ID NO: 1699442 - protein, 17 aa, Staphylococcus aureus
RGYGIINHTFEEFRPRI

SEQ ID NO: 1699443 - protein, 22 aa, Staphylococcus aureus
RGYGPLLDGFRKVDFRDVDALK

SEQ ID NO: 1699444 - protein, 17 aa, Staphylococcus aureus
RHDIKVTAWMPLMRNRG

SEQ ID NO: 1699445 - protein, 22 aa, Staphylococcus aureus
RHGQTLFNFKGLIQGFGDSPIT

SEQ ID NO: 1699446 - protein, 23 aa, Staphylococcus aureus
RHGQTLFNFKGLIQGFGDSPLTE

SEQ ID NO: 1699447 - protein, 24 aa, Staphylococcus aureus
RHGTMPLTMFITKKGKQVKVNHLE

SEQ ID NO: 1699448 - protein, 20 aa, Staphylococcus aureus
RHIPALLKLKDTVSLVAVQD

SEQ ID NO: 1699449 - protein, 22 aa, Staphylococcus aureus
RHLDDKASVAMILQLLKKLKEE

SEQ ID NO: 1699450 - protein, 23 aa, Staphylococcus aureus
RHLDDKASVAMILQLLKKLKEEQ

SEQ ID NO: 1699451 - protein, 25 aa, Staphylococcus aureus
RHRLHKVETLRANWIQITGGPLSSS

SEQ ID NO: 1699452 - protein, 24 aa, Staphylococcus aureus
RHRLHKVETLRVNWIQTTGGSLSS

SEQ ID NO: 1699453 - protein, 17 aa, Staphylococcus aureus
RHSFLVEKLRLLIQQLK

SEQ ID NO: 1699454 - protein, 17 aa, Staphylococcus aureus
RHSYASYLINNGVDMYL

SEQ ID NO: 1699455 - protein, 31 aa, Staphylococcus aureus
RHVLFGKLGEPQLLYIDLHLIHEVTSPQAFE

SEQ ID NO: 1699456 - protein, 17 aa, Staphylococcus aureus
RIAFMRIVSGAFERGMD

SEQ ID NO: 1699457 - protein, 19 aa, Staphylococcus aureus
RIAQTINRFGYTIRGIYGE

SEQ ID NO: 1699458 - protein, 25 aa, Staphylococcus aureus
RIAQTINRFGYTIRGIYGEGSQVYG

SEQ ID NO: 1699459 - protein, 19 aa, Staphylococcus aureus
RIATIFDLMASQYGVRRFD

SEQ ID NO: 1699460 - protein, 28 aa, Staphylococcus aureus
RIFRGTEIVYRFLKYLFTHTYEHKNEEQ

SEQ ID NO: 1699461 - protein, 36 aa, Staphylococcus aureus
RIGLLKIDFLGLRNLSIIHQILIQVKKDLGINIDIE

SEQ ID NO: 1699462 - protein, 25 aa, Staphylococcus aureus
RIHVANFHFYIIDSGIDNAVQKEVS

SEQ ID NO: 1699463 - protein, 18 aa, Staphylococcus aureus
RIILQNFKELGISDNTVQ

SEQ ID NO: 1699464 - protein, 25 aa, Staphylococcus aureus
RIIQKYELDYIIDDDWNYAAKLDAE

SEQ ID NO: 1699465 - protein, 18 aa, Staphylococcus aureus
RILTYFKDIQYSQNSWVV

SEQ ID NO: 1699466 - protein, 19 aa, Staphylococcus aureus
RILTYFKDIQYSQNSWVVP

SEQ ID NO: 1699467 - protein, 18 aa, Staphylococcus aureus
RIMLALKSIFVKSRGQTA

SEQ ID NO: 1699468 - protein, 19 aa, Staphylococcus aureus
RIMLALKSIFVKSRGQTAI

SEQ ID NO: 1699469 - protein, 17 aa, Staphylococcus aureus
RINQILQQGHNDINNAM

SEQ ID NO: 1699470 - protein, 17 aa, Staphylococcus aureus
RIPINVWTGDSIARTGK

SEQ ID NO: 1699471 - protein, 17 aa, Staphylococcus aureus
RIPYMEIVAKYMERILL

SEQ ID NO: 1699472 - protein, 26 aa, Staphylococcus aureus
RIRHYDFEKVLGFSDFLKPQHLNKSY

SEQ ID NO: 1699473 - protein, 17 aa, Staphylococcus aureus
RIRIARALAVEPEFIIA

SEQ ID NO: 1699474 - protein, 17 aa, Staphylococcus aureus
RIRLYIPLNERISANDY

SEQ ID NO: 1699475 - protein, 25 aa, Staphylococcus aureus
RIRNHSVIYGLLRFDSYQLISTDGE

SEQ ID NO: 1699476 - protein, 17 aa, Staphylococcus aureus
RIRYYSCSNFRNKGSKV

SEQ ID NO: 1699477 - protein, 38 aa, Staphylococcus aureus
RISHQMDMLFTHFGISGPAALRCSQFVYKEQKIKRHSI

SEQ ID NO: 1699478 - protein, 26 aa, Staphylococcus aureus
RISIVGYPEPYINKFQMYESTGKVLS

SEQ ID NO: 1699479 - protein, 25 aa, Staphylococcus aureus
RISKTKGLIGNLMKIKPIGTLDDGR

SEQ ID NO: 1699480 - protein, 27 aa, Staphylococcus aureus
RIVKLALELYNSPWIAWYHQQMQDKKA

SEQ ID NO: 1699481 - protein, 17 aa, Staphylococcus aureus
RIVMMPFTTIKDAKNLA

SEQ ID NO: 1699482 - protein, 20 aa, Staphylococcus aureus
RIYGTHLWSGYPTGTIHSRA

SEQ ID NO: 1699483 - protein, 23 aa, Staphylococcus aureus
RIYKANVNALLPLKPQTIDMPIG

SEQ ID NO: 1699484 - protein, 24 aa, Staphylococcus aureus
RIYKANVNALLPLKPQTIDMPIGK

SEQ ID NO: 1699485 - protein, 18 aa, Staphylococcus aureus
RIYPYRKCDKMPDKLCLY

SEQ ID NO: 1699486 - protein, 17 aa, Staphylococcus aureus
RKALNGHFKENIFTSFI

SEQ ID NO: 1699487 - protein, 18 aa, Staphylococcus aureus
RKALNGHFKENIFTSFIN

SEQ ID NO: 1699488 - protein, 25 aa, Staphylococcus aureus
RKASVGLAIFGASIGPAVLAGGLLI

SEQ ID NO: 1699489 - protein, 27 aa, Staphylococcus aureus
RKCEQMYDHFLYLKHKMNYSEDAMIRM

SEQ ID NO: 1699490 - protein, 19 aa, Staphylococcus aureus
RKDRLLLGTLFLNHVSKMN

SEQ ID NO: 1699491 - protein, 27 aa, Staphylococcus aureus
RKEILQAMRVGVWAPTKRISKRNSTGN

SEQ ID NO: 1699492 - protein, 19 aa, Staphylococcus aureus
RKEILQAMRVGVWGPQHRE

SEQ ID NO: 1699493 - protein, 18 aa, Staphylococcus aureus
RKELVVVGIFYKNEKRDL

SEQ ID NO: 1699494 - protein, 30 aa, Staphylococcus aureus
RKEMQQEIPYPFFVIKMPESNRSKYTFDSY

SEQ ID NO: 1699495 - protein, 30 aa, Staphylococcus aureus
RKEMQQEVPYPFFVIKMPESNRSKYTFDSY

SEQ ID NO: 1699496 - protein, 23 aa, Staphylococcus aureus
RKEYPNALLHWEDFGRGHAKNIL

SEQ ID NO: 1699497 - protein, 19 aa, Staphylococcus aureus
RKFHPLEKLGRYLMDSFVN

SEQ ID NO: 1699498 - protein, 18 aa, Staphylococcus aureus
RKGLNALQTFLYSSEFNQ

SEQ ID NO: 1699499 - protein, 26 aa, Staphylococcus aureus
RKHKQLNMLPLFEEHYHLYAPSDDPI

SEQ ID NO: 1699500 - protein, 17 aa, Staphylococcus aureus
RKIDVEPVFGFMKAILG

SEQ ID NO: 1699501 - protein, 36 aa, Staphylococcus aureus
RKIIDHWIWTDSKRLKWWMDLLLLTNHSDKKVMLGG

SEQ ID NO: 1699502 - protein, 21 aa, Staphylococcus aureus
RKINILVGLLGQPQILILDEP

SEQ ID NO: 1699503 - protein, 19 aa, Staphylococcus aureus
RKIPRKYLNPKIPQGRGKI

SEQ ID NO: 1699504 - protein, 18 aa, Staphylococcus aureus
RKKKFAMCRDIELHWGEP

SEQ ID NO: 1699505 - protein, 27 aa, Staphylococcus aureus
RKNAIEMYYSLQNYYNTRIETIKVSEK

SEQ ID NO: 1699506 - protein, 21 aa, Staphylococcus aureus
RKNIYQMIPQEVTPMIPSSLV

SEQ ID NO: 1699507 - protein, 30 aa, Staphylococcus aureus
RKPRAMHYSRYWKYLPERIKLFLSHSDWKE

SEQ ID NO: 1699508 - protein, 24 aa, Staphylococcus aureus
RKQALLYEWSRINSMLDTQLYITR

SEQ ID NO: 1699509 - protein, 19 aa, Staphylococcus aureus
RKRYDIPTKQAPKLLLKGD

SEQ ID NO: 1699510 - protein, 18 aa, Staphylococcus aureus
RKSDLVFTIGYDPIEYEA

SEQ ID NO: 1699511 - protein, 20 aa, Staphylococcus aureus
RKVAVKRIVLTRPAVEAGES

SEQ ID NO: 1699512 - protein, 26 aa, Staphylococcus aureus
RLADSDVLVCTVIGFPLGASTTATKA

SEQ ID NO: 1699513 - protein, 35 aa, Staphylococcus aureus
RLALSFLRAIDNPLQDIYLVGLMRSVIYQFKEDEL

SEQ ID NO: 1699514 - protein, 26 aa, Staphylococcus aureus
RLDDSGVLVCTVIGFPLGASTTATKA

SEQ ID NO: 1699515 - protein, 22 aa, Staphylococcus aureus
RLDHFFGAIQLLLKKAYYKHDV

SEQ ID NO: 1699516 - protein, 23 aa, Staphylococcus aureus
RLDHFFGAIQLLLKKAYYKHDVH

SEQ ID NO: 1699517 - protein, 23 aa, Staphylococcus aureus
RLDHFFGAIQLLLKKAYYKYDVH

SEQ ID NO: 1699518 - protein, 18 aa, Staphylococcus aureus
RLFAVKKQKELAAEKGIV

SEQ ID NO: 1699519 - protein, 29 aa, Staphylococcus aureus
RLGIRLEKTFEYIDTPHKFKMGVSGCPRS

SEQ ID NO: 1699520 - protein, 17 aa, Staphylococcus aureus
RLGKRTGITFTAHILRH

SEQ ID NO: 1699521 - protein, 17 aa, Staphylococcus aureus
RLHTNPMRILDCKVDRD

SEQ ID NO: 1699522 - protein, 34 aa, Staphylococcus aureus
RLILDKVGNKKPLRRLWIRSVTKKAIQQGFKNLK

SEQ ID NO: 1699523 - protein, 33 aa, Staphylococcus aureus
RLILDKVGNKKPLRRLWISSVTKKAIQQGFKNL

SEQ ID NO: 1699524 - protein, 21 aa, Staphylococcus aureus
RLINYNFLHKCFIDKEIRLCV

SEQ ID NO: 1699525 - protein, 17 aa, Staphylococcus aureus
RLITNKAAYFKKSQLIE

SEQ ID NO: 1699526 - protein, 17 aa, Staphylococcus aureus
RLKYRYLDLRRQELAQT

SEQ ID NO: 1699527 - protein, 17 aa, Staphylococcus aureus
RLLFHPRFEKELRAQGI

SEQ ID NO: 1699528 - protein, 20 aa, Staphylococcus aureus
RLMDSLINYLDVIEYTKLSE

SEQ ID NO: 1699529 - protein, 23 aa, Staphylococcus aureus
RLNKFTIEKLALGLSRYLNAQTN

SEQ ID NO: 1699530 - protein, 23 aa, Staphylococcus aureus
RLNKYSIRKFTIGTASILVGSTL

SEQ ID NO: 1699531 - protein, 28 aa, Staphylococcus aureus
RLNLDYLDLVLIHQPYNDVYGSWRALEE

SEQ ID NO: 1699532 - protein, 20 aa, Staphylococcus aureus
RLNVFYATQVALEPPTFVVF

SEQ ID NO: 1699533 - protein, 19 aa, Staphylococcus aureus
RLQKWYDKGYLPKAATHDV

SEQ ID NO: 1699534 - protein, 17 aa, Staphylococcus aureus
RLRKLNHPIPLKKYQHG

SEQ ID NO: 1699535 - protein, 24 aa, Staphylococcus aureus
RLRNKGSLIILTENAFFKLNKNGQ

SEQ ID NO: 1699536 - protein, 29 aa, Staphylococcus aureus
RLTSILTLSDLFNWSRFKVKTFLDLLESD

SEQ ID NO: 1699537 - protein, 29 aa, Staphylococcus aureus
RLTSILTLSDLFNWSRFKVKTFLDLLESG

SEQ ID NO: 1699538 - protein, 20 aa, Staphylococcus aureus
RLYNFLLPKDKIVDNRFMNI

SEQ ID NO: 1699539 - protein, 24 aa, Staphylococcus aureus
RMAQDFSYRYPLVDGQGNFGSMDG

SEQ ID NO: 1699540 - protein, 17 aa, Staphylococcus aureus
RMEILNPTKELDTNIVY

SEQ ID NO: 1699541 - protein, 19 aa, Staphylococcus aureus
RMENTPAYYKLYGDKIVGF

SEQ ID NO: 1699542 - protein, 30 aa, Staphylococcus aureus
RMIPYFIQQQYWFLFYHDENYFAVKYSDNG

SEQ ID NO: 1699543 - protein, 19 aa, Staphylococcus aureus
RMKIALTIVLSHDVKLLIL

SEQ ID NO: 1699544 - protein, 19 aa, Staphylococcus aureus
RMLISAGLKDYYPLQNRFN

SEQ ID NO: 1699545 - protein, 17 aa, Staphylococcus aureus
RMSNYSKNNLRNVVTMN

SEQ ID NO: 1699546 - protein, 28 aa, Staphylococcus aureus
RMVKLALELYNNPWIAWYHQQMQDKKAK

SEQ ID NO: 1699547 - protein, 26 aa, Staphylococcus aureus
RMVKLALELYNSPWIAWYHQQMQDKK

SEQ ID NO: 1699548 - protein, 20 aa, Staphylococcus aureus
RNAESIISGLNNPTINKGNV

SEQ ID NO: 1699549 - protein, 17 aa, Staphylococcus aureus
RNDIFGVIGYSGAGKST

SEQ ID NO: 1699550 - protein, 17 aa, Staphylococcus aureus
RNEPFDWLSYWTDECHY

SEQ ID NO: 1699551 - protein, 25 aa, Staphylococcus aureus
RNEVVLWQIVAHRLMTWKKEYANNA

SEQ ID NO: 1699552 - protein, 18 aa, Staphylococcus aureus
RNFKDYTGILKIASEAKE

SEQ ID NO: 1699553 - protein, 17 aa, Staphylococcus aureus
RNFKGVTNVTGIVLTKL

SEQ ID NO: 1699554 - protein, 18 aa, Staphylococcus aureus
RNGFIQSLKDDPSQSANV

SEQ ID NO: 1699555 - protein, 23 aa, Staphylococcus aureus
RNINNIMVLFSLTSKLNITINGE

SEQ ID NO: 1699556 - protein, 19 aa, Staphylococcus aureus
RNKDLEKKASTWDRYCKSV

SEQ ID NO: 1699557 - protein, 24 aa, Staphylococcus aureus
RNKIQQINQVLAGSPTVEQINTNT

SEQ ID NO: 1699558 - protein, 24 aa, Staphylococcus aureus
RNLENVITFVPLLSMSNKEVKTMV

SEQ ID NO: 1699559 - protein, 27 aa, Staphylococcus aureus
RNMIIINESGLYSLIFDASKQSKNEKI

SEQ ID NO: 1699560 - protein, 17 aa, Staphylococcus aureus
RNMVDKGVVIWKGKEFE

SEQ ID NO: 1699561 - protein, 18 aa, Staphylococcus aureus
RNRILLCSKLYAPKSKKE

SEQ ID NO: 1699562 - protein, 22 aa, Staphylococcus aureus
RNSILAQLQNIYDTAIGQIDQD

SEQ ID NO: 1699563 - protein, 17 aa, Staphylococcus aureus
RNSLREWLPWVDATEQP

SEQ ID NO: 1699564 - protein, 26 aa, Staphylococcus aureus
RNSNGPMIRALAEKLGLEVGIYKTQK

SEQ ID NO: 1699565 - protein, 24 aa, Staphylococcus aureus
RNSSIYVHPPLFMNDFSLKAIFEG

SEQ ID NO: 1699566 - protein, 29 aa, Staphylococcus aureus
RPASIIAIYSAKYKGYKWMEMNGLGSFNT

SEQ ID NO: 1699567 - protein, 19 aa, Staphylococcus aureus
RPDLPASKIAQYIRKDILE

SEQ ID NO: 1699568 - protein, 24 aa, Staphylococcus aureus
RPEAIKMAPLVKALEQKKMLEPIV

SEQ ID NO: 1699569 - protein, 37 aa, Staphylococcus aureus
RPELRNMKIFPRPIDNILPIWRAVGGPSASAIKAGKQ

SEQ ID NO: 1699570 - protein, 31 aa, Staphylococcus aureus
RPEQGLLKLRKSLNLFANIRPTTVFKGASSL

SEQ ID NO: 1699571 - protein, 30 aa, Staphylococcus aureus
RPNVAFSMISKFNLFIALGIRDAIQHFSQD

SEQ ID NO: 1699572 - protein, 28 aa, Staphylococcus aureus
RPNVAFSMISKFNLFIALGIRDAIQHSS

SEQ ID NO: 1699573 - protein, 18 aa, Staphylococcus aureus
RPQQLYLAETILDQLMHS

SEQ ID NO: 1699574 - protein, 19 aa, Staphylococcus aureus
RPVLQEALNFLRMGDRFVV

SEQ ID NO: 1699575 - protein, 19 aa, Staphylococcus aureus
RPYVVTTLFSTKDNFTKDN

SEQ ID NO: 1699576 - protein, 24 aa, Staphylococcus aureus
RQCDVLCCYRLNRLHRNLKNALKL

SEQ ID NO: 1699577 - protein, 25 aa, Staphylococcus aureus
RQENYQVLRQTKVPAVLLELGYISN

SEQ ID NO: 1699578 - protein, 27 aa, Staphylococcus aureus
RQENYQVLRQTKVPAVLLELGYISNPT

SEQ ID NO: 1699579 - protein, 17 aa, Staphylococcus aureus
RQFSFNIENDLVSGFDG

SEQ ID NO: 1699580 - protein, 19 aa, Staphylococcus aureus
RQGQLFLLDVFEGNIFKVN

SEQ ID NO: 1699581 - protein, 19 aa, Staphylococcus aureus
RQIAEKRFIARKAASLIED

SEQ ID NO: 1699582 - protein, 17 aa, Staphylococcus aureus
RQLGRFLQKKGYTSYTP

SEQ ID NO: 1699583 - protein, 28 aa, Staphylococcus aureus
RQLNDKSLPLIVTTIQKMAKAIQGNAPL

SEQ ID NO: 1699584 - protein, 24 aa, Staphylococcus aureus
RQPGDTITRPKYAYIGAAEDLQEG

SEQ ID NO: 1699585 - protein, 26 aa, Staphylococcus aureus
RQRAYIAMTIAQDTEYILLDEPLNNL

SEQ ID NO: 1699586 - protein, 17 aa, Staphylococcus aureus
RQRFTIAHELGHAVLGH

SEQ ID NO: 1699587 - protein, 24 aa, Staphylococcus aureus
RQRISIARAILKDAPIIILDEATA

SEQ ID NO: 1699588 - protein, 26 aa, Staphylococcus aureus
RQRVLRAIEYYLKTKKLLSNRKKVQQ

SEQ ID NO: 1699589 - protein, 45 aa, Staphylococcus aureus
RQSKVFRSRFRMLVEAQLDLLKNEDWDYLLNYDLDAEQVTLENIH

SEQ ID NO: 1699590 - protein, 45 aa, Staphylococcus aureus
RQSKVFRSRFRMLVEAQLDLLKNKDWDYLLNYDLDAEQVTLENIH

SEQ ID NO: 1699591 - protein, 19 aa, Staphylococcus aureus
RQTGHIIQWYIMTSDINHE

SEQ ID NO: 1699592 - protein, 23 aa, Staphylococcus aureus
RQTQQQIVYKTPKPLAGLNGESH

SEQ ID NO: 1699593 - protein, 19 aa, Staphylococcus aureus
RQVRRMFEHFGHQVTKLSR

SEQ ID NO: 1699594 - protein, 20 aa, Staphylococcus aureus
RQWFQHDPKLFGGFKEKYEK

SEQ ID NO: 1699595 - protein, 20 aa, Staphylococcus aureus
RRFRFTALVVVGDKNGRVGF

SEQ ID NO: 1699596 - protein, 22 aa, Staphylococcus aureus
RRGELVSCFLLEVDDSLNSINF

SEQ ID NO: 1699597 - protein, 21 aa, Staphylococcus aureus
RRHPYYVIISQMPGVKYAVNT

SEQ ID NO: 1699598 - protein, 18 aa, Staphylococcus aureus
RRIELCRLLVMKPDLVIF

SEQ ID NO: 1699599 - protein, 19 aa, Staphylococcus aureus
RRIPYMEIVGQVHGTYIIA

SEQ ID NO: 1699600 - protein, 27 aa, Staphylococcus aureus
RRKHAYDFPMWFIRPNFKSEIAPRSVQ

SEQ ID NO: 1699601 - protein, 17 aa, Staphylococcus aureus
RRKTDGFMAFVHALYRA

SEQ ID NO: 1699602 - protein, 18 aa, Staphylococcus aureus
RRKTDGFMAFVHALYRAD

SEQ ID NO: 1699603 - protein, 23 aa, Staphylococcus aureus
RRKVKRELYDGRGFLICSRILGE

SEQ ID NO: 1699604 - protein, 23 aa, Staphylococcus aureus
RRKVKREWYDGRGFLSCSRILGE

SEQ ID NO: 1699605 - protein, 25 aa, Staphylococcus aureus
RRNSDFLLQSIIKPALESDFEIQRS

SEQ ID NO: 1699606 - protein, 17 aa, Staphylococcus aureus
RRPTLARLTRIEKSLLQ

SEQ ID NO: 1699607 - protein, 27 aa, Staphylococcus aureus
RRQHAYDFPMWFIRPNFKSEIAPRSVQ

SEQ ID NO: 1699608 - protein, 28 aa, Staphylococcus aureus
RRSMQTVLYQILVDMTKLLAPILVHTAE

SEQ ID NO: 1699609 - protein, 25 aa, Staphylococcus aureus
RRSTIFPNFIGHTFAVYDGRKHVPV

SEQ ID NO: 1699610 - protein, 22 aa, Staphylococcus aureus
RRTKLLETILKNTWSIDANKDF

SEQ ID NO: 1699611 - protein, 24 aa, Staphylococcus aureus
RRVGTRVLYLYPQVLDAYQTLINR

SEQ ID NO: 1699612 - protein, 26 aa, Staphylococcus aureus
RRVICKHLIALLFTASPEEANKHIIM

SEQ ID NO: 1699613 - protein, 25 aa, Staphylococcus aureus
RSAYHILDMVFWFGNLQILAAHQYP

SEQ ID NO: 1699614 - protein, 22 aa, Staphylococcus aureus
RSDELFYYTSVIKKYNISRSGF

SEQ ID NO: 1699615 - protein, 20 aa, Staphylococcus aureus
RSDIPLARGLGSSASALVGA

SEQ ID NO: 1699616 - protein, 21 aa, Staphylococcus aureus
RSDIPLARGLGSSASALVGAI

SEQ ID NO: 1699617 - protein, 34 aa, Staphylococcus aureus
RSFKENGDWYKLEKLWEKAIKSGKPIENIKIEVK

SEQ ID NO: 1699618 - protein, 20 aa, Staphylococcus aureus
RSFKSFSMPKWSKLVNKLSV

SEQ ID NO: 1699619 - protein, 28 aa, Staphylococcus aureus
RSIDVQLIICTLPLELRGFQIVSLDDIE

SEQ ID NO: 1699620 - protein, 26 aa, Staphylococcus aureus
RSKDKPLSLFIDKPEDWKLYGDNQNT

SEQ ID NO: 1699621 - protein, 25 aa, Staphylococcus aureus
RSKDKSLSLFIDKPEDWKLYGDNQN

SEQ ID NO: 1699622 - protein, 18 aa, Staphylococcus aureus
RSKLKVKYLVFVDDSVRR

SEQ ID NO: 1699623 - protein, 20 aa, Staphylococcus aureus
RSLALFLMAEVDISILSMVP

SEQ ID NO: 1699624 - protein, 20 aa, Staphylococcus aureus
RSLQQIDRSLFWVNPDCGLK

SEQ ID NO: 1699625 - protein, 26 aa, Staphylococcus aureus
RSLVTTEFIWSVPDRFDIYGPQMLIQ

SEQ ID NO: 1699626 - protein, 25 aa, Staphylococcus aureus
RSLVTTEFIWSVPGHFDIYGPQILI

SEQ ID NO: 1699627 - protein, 31 aa, Staphylococcus aureus
RSNKHYISIFINGRYIKNFMLNKAILEGYHT

SEQ ID NO: 1699628 - protein, 23 aa, Staphylococcus aureus
RSQQLITTDLFLNVFGISSIDDL

SEQ ID NO: 1699629 - protein, 23 aa, Staphylococcus aureus
RSQQLITTDLFLNVFGISSIEDL

SEQ ID NO: 1699630 - protein, 18 aa, Staphylococcus aureus
RSRYNIPTEKAPILKMHI

SEQ ID NO: 1699631 - protein, 18 aa, Staphylococcus aureus
RSWRKVSIQKCASWRGPN

SEQ ID NO: 1699632 - protein, 23 aa, Staphylococcus aureus
RTALVLRQAIWKKSDSNWPICGI

SEQ ID NO: 1699633 - protein, 23 aa, Staphylococcus aureus
RTATIKNGTAMPTNLAGGSTTTI

SEQ ID NO: 1699634 - protein, 17 aa, Staphylococcus aureus
RTDVYDFYSLGFGEPYP

SEQ ID NO: 1699635 - protein, 17 aa, Staphylococcus aureus
RTEQARIRLYIPLNERI

SEQ ID NO: 1699636 - protein, 25 aa, Staphylococcus aureus
RTGKWFAMEWEQVIPDIYILGKALG

SEQ ID NO: 1699637 - protein, 26 aa, Staphylococcus aureus
RTKQHVIMLMLEAILLLKNADVLEKP

SEQ ID NO: 1699638 - protein, 20 aa, Staphylococcus aureus
RTLKFFKYFYTHRGPVMDYT

SEQ ID NO: 1699639 - protein, 20 aa, Staphylococcus aureus
RTLLDFRYQRHFKASKGENG

SEQ ID NO: 1699640 - protein, 27 aa, Staphylococcus aureus
RTLSELKKYFYRFSLKARKRVKTVSID

SEQ ID NO: 1699641 - protein, 17 aa, Staphylococcus aureus
RTRMGLENYTREGKRLG

SEQ ID NO: 1699642 - protein, 19 aa, Staphylococcus aureus
RTRSSLALFIMICTGCRVS

SEQ ID NO: 1699643 - protein, 20 aa, Staphylococcus aureus
RTSRKLFIEKLKSVQYDLQN

SEQ ID NO: 1699644 - protein, 25 aa, Staphylococcus aureus
RTTKQLINLASWLQEHNIELKILDG

SEQ ID NO: 1699645 - protein, 22 aa, Staphylococcus aureus
RTVKFNGFIYVSNIIKQPTYIK

SEQ ID NO: 1699646 - protein, 25 aa, Staphylococcus aureus
RVALDYALTGLEFACGIPGSIGGAV

SEQ ID NO: 1699647 - protein, 25 aa, Staphylococcus aureus
RVANDKEFYIFDSLIQGRSYQDISG

SEQ ID NO: 1699648 - protein, 26 aa, Staphylococcus aureus
RVDALVMSKLRPLLHYARAKDIDNYR

SEQ ID NO: 1699649 - protein, 17 aa, Staphylococcus aureus
RVDNVFPTKHAIGLKAD

SEQ ID NO: 1699650 - protein, 17 aa, Staphylococcus aureus
RVKDIVNILYNLQQKTD

SEQ ID NO: 1699651 - protein, 31 aa, Staphylococcus aureus
RVKHNHIPPWILIIPLNFGETIKWLSILKPK

SEQ ID NO: 1699652 - protein, 35 aa, Staphylococcus aureus
RVKPLPMRPDKLKNLGMLTEPGLYYLYTDHTVQID

SEQ ID NO: 1699653 - protein, 25 aa, Staphylococcus aureus
RVKPLPMRPDKLTNLGMLTEPGLYY

SEQ ID NO: 1699654 - protein, 18 aa, Staphylococcus aureus
RVLDMNDRALRHVNVGLG

SEQ ID NO: 1699655 - protein, 29 aa, Staphylococcus aureus
RVMKPGCKFDYMLTLYGPQGVGKSALLKK

SEQ ID NO: 1699656 - protein, 25 aa, Staphylococcus aureus
RVMPLAVSGPFHSLLMKVIEEDFSS

SEQ ID NO: 1699657 - protein, 17 aa, Staphylococcus aureus
RVNAISAGPIRTLSAKG

SEQ ID NO: 1699658 - protein, 31 aa, Staphylococcus aureus
RVNERLTQAINQLVPLADNSALKTAKTKLDE

SEQ ID NO: 1699659 - protein, 29 aa, Staphylococcus aureus
RVNNNNLPSFIYYMLSYKGNQKKIKRIQM

SEQ ID NO: 1699660 - protein, 26 aa, Staphylococcus aureus
RVNTAKNALNGDAKLIAAQNAAKQHL

SEQ ID NO: 1699661 - protein, 18 aa, Staphylococcus aureus
RVNWLEKWQRLEKKGRKE

SEQ ID NO: 1699662 - protein, 18 aa, Staphylococcus aureus
RVTFNEYGTKWYTYYDDD

SEQ ID NO: 1699663 - protein, 17 aa, Staphylococcus aureus
RVTLRNFNKWYNYIAQI

SEQ ID NO: 1699664 - protein, 34 aa, Staphylococcus aureus
RVTSVFLETFLFFSGFYYPLYLAGQGKMTTSGEI

SEQ ID NO: 1699665 - protein, 25 aa, Staphylococcus aureus
RVTVNWHHFLRPEIKFDGIDPLVKQ

SEQ ID NO: 1699666 - protein, 22 aa, Staphylococcus aureus
RVTYHNKGLDFAFGLSMTSKNV

SEQ ID NO: 1699667 - protein, 18 aa, Staphylococcus aureus
RVVAYIFANGYQSDVVAY

SEQ ID NO: 1699668 - protein, 47 aa, Staphylococcus aureus
RVVIFEIKAQRYVLRIVLEPMSLKNMLWTKYLKLSKVIKFSNKLSNV

SEQ ID NO: 1699669 - protein, 17 aa, Staphylococcus aureus
RVYDEAVDKAKEALNKA

SEQ ID NO: 1699670 - protein, 23 aa, Staphylococcus aureus
RVYIASVLMLELKLIIADEPVAS

SEQ ID NO: 1699671 - protein, 23 aa, Staphylococcus aureus
RVYTRSIINGKLDSQWTVPNEHK

SEQ ID NO: 1699672 - protein, 22 aa, Staphylococcus aureus
RWLRKVINSLVYDYGYPIGCSY

SEQ ID NO: 1699673 - protein, 28 aa, Staphylococcus aureus
RWNSSHHQLIFFGRYHCLARKPKCDICP

SEQ ID NO: 1699674 - protein, 18 aa, Staphylococcus aureus
RYAKLLDDTKRKAFESVI

SEQ ID NO: 1699675 - protein, 21 aa, Staphylococcus aureus
RYEVLKQLCTTYKMALDFYIE

SEQ ID NO: 1699676 - protein, 17 aa, Staphylococcus aureus
RYGTMYISMDETLARVV

SEQ ID NO: 1699677 - protein, 26 aa, Staphylococcus aureus
RYMEAEPFMWPVYEVIRKSTVEELKA

SEQ ID NO: 1699678 - protein, 18 aa, Staphylococcus aureus
RYPKLNMIIGHWGEFIPF

SEQ ID NO: 1699679 - protein, 21 aa, Staphylococcus aureus
RYTMNVLYDRYQLPLFIVKNG

SEQ ID NO: 1699680 - protein, 18 aa, Staphylococcus aureus
RYYAMDRDKRWEREEKAY

SEQ ID NO: 1699681 - protein, 17 aa, Staphylococcus aureus
RYYNKISEWLAEHPYVN

SEQ ID NO: 1699682 - protein, 23 aa, Staphylococcus aureus
SAAFFIVAALITPGSDVTIHNIG

SEQ ID NO: 1699683 - protein, 22 aa, Staphylococcus aureus
SADDLCDYFKEKQIKHVYVSDL

SEQ ID NO: 1699684 - protein, 29 aa, Staphylococcus aureus
SADKYVFVTPMWNLSFPPVVKAYIDAISI

SEQ ID NO: 1699685 - protein, 21 aa, Staphylococcus aureus
SAEALKALGYKVYIGSRNDVR

SEQ ID NO: 1699686 - protein, 24 aa, Staphylococcus aureus
SAEALNYMALAGWDSKQMMEGLSG

SEQ ID NO: 1699687 - protein, 23 aa, Staphylococcus aureus
SAEWEVMNIIWMKKYASTNNIIE

SEQ ID NO: 1699688 - protein, 22 aa, Staphylococcus aureus
SAGDIIRLLEGPITFVESIESE

SEQ ID NO: 1699689 - protein, 21 aa, Staphylococcus aureus
SAHGGYLIKVLNNWAKENVKT

SEQ ID NO: 1699690 - protein, 24 aa, Staphylococcus aureus
SAKDNLYLICSLYNRKIDQITIEK

SEQ ID NO: 1699691 - protein, 32 aa, Staphylococcus aureus
SAKEIARTDLGRYFDRFADKLDKTQTNTEVDE

SEQ ID NO: 1699692 - protein, 18 aa, Staphylococcus aureus
SAKNAMVNAIRLGEQFDS

SEQ ID NO: 1699693 - protein, 20 aa, Staphylococcus aureus
SALTAKGYNYTSVDSSYAST

SEQ ID NO: 1699694 - protein, 17 aa, Staphylococcus aureus
SALVGAIYIANYFGDIQ

SEQ ID NO: 1699695 - protein, 19 aa, Staphylococcus aureus
SALYITHLTAFIDQLISLE

SEQ ID NO: 1699696 - protein, 25 aa, Staphylococcus aureus
SAMEILRRYCFDKAFIGMNGLDIEL

SEQ ID NO: 1699697 - protein, 23 aa, Staphylococcus aureus
SANAIIQKPIRTVQEVQSALTNV

SEQ ID NO: 1699698 - protein, 17 aa, Staphylococcus aureus
SANIIICHGLAEHLDRY

SEQ ID NO: 1699699 - protein, 22 aa, Staphylococcus aureus
SANLKMELIFSKVGIPKGRGKI

SEQ ID NO: 1699700 - protein, 31 aa, Staphylococcus aureus
SANQFAAKLLRPKILVKSLLKEEIEKLSFDS

SEQ ID NO: 1699701 - protein, 26 aa, Staphylococcus aureus
SAPKIFRKVTELVKEQVKHITGLDVV

SEQ ID NO: 1699702 - protein, 17 aa, Staphylococcus aureus
SAQMQNAIRFTPYAVTD

SEQ ID NO: 1699703 - protein, 31 aa, Staphylococcus aureus
SATGIRIGFLLGPQYLIDKLTFMHAYNCICA

SEQ ID NO: 1699704 - protein, 23 aa, Staphylococcus aureus
SATSLAIEAFGAKAGPDLADAIK

SEQ ID NO: 1699705 - protein, 23 aa, Staphylococcus aureus
SAVFQKVYLFNDTIENNILFGNP

SEQ ID NO: 1699706 - protein, 27 aa, Staphylococcus aureus
SAVNNNIVYWYGWNKQAFNLVSDLVND

SEQ ID NO: 1699707 - protein, 24 aa, Staphylococcus aureus
SAVRYYFNEGFVPKFKSYFAIGEQ

SEQ ID NO: 1699708 - protein, 30 aa, Staphylococcus aureus
SAWSNAKSVFNGFRKWLSKTYEWIRDIGKD

SEQ ID NO: 1699709 - protein, 25 aa, Staphylococcus aureus
SCGTTYHLVFNPPRSKVFVISMVVN

SEQ ID NO: 1699710 - protein, 26 aa, Staphylococcus aureus
SCLQEKYYILNFLKSIAIAKQFYKTN

SEQ ID NO: 1699711 - protein, 33 aa, Staphylococcus aureus
SDDYRYFPEPDIVPLYIDDAWKKRVRQTIPELP

SEQ ID NO: 1699712 - protein, 24 aa, Staphylococcus aureus
SDELAYDLMRKWLHKMRNTHKRKS

SEQ ID NO: 1699713 - protein, 23 aa, Staphylococcus aureus
SDEQLNVSGFLTWAVGHLVELQE

SEQ ID NO: 1699714 - protein, 19 aa, Staphylococcus aureus
SDEQQVIFIDYLQLMDTDA

SEQ ID NO: 1699715 - protein, 23 aa, Staphylococcus aureus
SDGRPKLMGIRQIIDSYLNHQIE

SEQ ID NO: 1699716 - protein, 18 aa, Staphylococcus aureus
SDHAYLPIYAIQNHLCEC

SEQ ID NO: 1699717 - protein, 21 aa, Staphylococcus aureus
SDIIYIPYKTPILEEAERKGN

SEQ ID NO: 1699718 - protein, 21 aa, Staphylococcus aureus
SDILEVNNPFLGKVFELVDIS

SEQ ID NO: 1699719 - protein, 35 aa, Staphylococcus aureus
SDIPDNLIFYIYDSLIEGFIHWIKDEKIDWLGEDI

SEQ ID NO: 1699720 - protein, 33 aa, Staphylococcus aureus
SDIPDNLIFYIYDSLIEGFMHWIKDEKIDWPGE

SEQ ID NO: 1699721 - protein, 19 aa, Staphylococcus aureus
SDIPLARGLGSSASALVGA

SEQ ID NO: 1699722 - protein, 24 aa, Staphylococcus aureus
SDKDVVFDWDLVQRAITHLDIHDH

SEQ ID NO: 1699723 - protein, 24 aa, Staphylococcus aureus
SDKKHLPDFILKKSFQKIKKQMIS

SEQ ID NO: 1699724 - protein, 26 aa, Staphylococcus aureus
SDKNELYLMILLYDKVGGIGFDLRNF

SEQ ID NO: 1699725 - protein, 24 aa, Staphylococcus aureus
SDLKKIKHPYLKKTFIEIVETLKN

SEQ ID NO: 1699726 - protein, 22 aa, Staphylococcus aureus
SDNIFFARVALELGSKKFEKGM

SEQ ID NO: 1699727 - protein, 26 aa, Staphylococcus aureus
SDNNLTFTSPYYHTMRKSFSGEQGWI

SEQ ID NO: 1699728 - protein, 17 aa, Staphylococcus aureus
SDPLIEYLIKEISDDKN

SEQ ID NO: 1699729 - protein, 24 aa, Staphylococcus aureus
SDQLKVIEIIKLYQSFYENPLTLD

SEQ ID NO: 1699730 - protein, 34 aa, Staphylococcus aureus
SDQYFNMAEKILPLLHIIDIPKRVFAKLDIPANT

SEQ ID NO: 1699731 - protein, 25 aa, Staphylococcus aureus
SDRNVYTAPIFNLTPKSIPVVAVLH

SEQ ID NO: 1699732 - protein, 17 aa, Staphylococcus aureus
SDRRIMMALQHVAQHKN

SEQ ID NO: 1699733 - protein, 29 aa, Staphylococcus aureus
SDSKNLKVIYMPHWLEFYSIAIHSDVTSN

SEQ ID NO: 1699734 - protein, 31 aa, Staphylococcus aureus
SDSKNLKVIYMPHWLKFYSIAIHSDVTSNKK

SEQ ID NO: 1699735 - protein, 25 aa, Staphylococcus aureus
SDSSVLLFNIIKNNQPLFLSEENIK

SEQ ID NO: 1699736 - protein, 25 aa, Staphylococcus aureus
SDSSVLLFNISKNNQPLLLSEENIK

SEQ ID NO: 1699737 - protein, 27 aa, Staphylococcus aureus
SDTAVMIAWLVKIPHSIMPILGTSQLK

SEQ ID NO: 1699738 - protein, 27 aa, Staphylococcus aureus
SDTAVMIAWLVKIPHSIMPVLGTSQLK

SEQ ID NO: 1699739 - protein, 20 aa, Staphylococcus aureus
SDVLIDFESLVLNDIDVLCE

SEQ ID NO: 1699740 - protein, 27 aa, Staphylococcus aureus
SDWYNASYIIMWGSNVPLTRTPDAHFM

SEQ ID NO: 1699741 - protein, 24 aa, Staphylococcus aureus
SEATAQDLLKWTNGKALIGTGIPY

SEQ ID NO: 1699742 - protein, 19 aa, Staphylococcus aureus
SEDALYDEAYLFVVEQQKA

SEQ ID NO: 1699743 - protein, 23 aa, Staphylococcus aureus
SEDIRFLIYPQDFPKREKKNSSQ

SEQ ID NO: 1699744 - protein, 20 aa, Staphylococcus aureus
SEDLRCKELILTDQARTLIS

SEQ ID NO: 1699745 - protein, 30 aa, Staphylococcus aureus
SEEAVLQMNLLGHDFFVFIDRETDGTSIVY

SEQ ID NO: 1699746 - protein, 19 aa, Staphylococcus aureus
SEGFLKFLPKSEKYRIIYS

SEQ ID NO: 1699747 - protein, 26 aa, Staphylococcus aureus
SEGFYRRMVIIPMLRKFGKGGQKKDP

SEQ ID NO: 1699748 - protein, 29 aa, Staphylococcus aureus
SEGMDLPLKEFALITGAALLARRCTKNEK

SEQ ID NO: 1699749 - protein, 21 aa, Staphylococcus aureus
SEHLSLDLQILLWNMVKERDN

SEQ ID NO: 1699750 - protein, 25 aa, Staphylococcus aureus
SEHLVEFMPIIYDPVVAQSIEQYNE

SEQ ID NO: 1699751 - protein, 25 aa, Staphylococcus aureus
SEIDERYYYRLNKQPFYDELEKEMK

SEQ ID NO: 1699752 - protein, 24 aa, Staphylococcus aureus
SEIERQFINTLLKKGTDNFKISVP

SEQ ID NO: 1699753 - protein, 19 aa, Staphylococcus aureus
SEIGFILQATNLVPFLTVK

SEQ ID NO: 1699754 - protein, 27 aa, Staphylococcus aureus
SEIPKDFILLPIHPYQINVLQQHPQYL

SEQ ID NO: 1699755 - protein, 17 aa, Staphylococcus aureus
SEISLITFFKPEYNKQH

SEQ ID NO: 1699756 - protein, 18 aa, Staphylococcus aureus
SEISLITFFKPEYNKQHV

SEQ ID NO: 1699757 - protein, 20 aa, Staphylococcus aureus
SEIYNYIKQVVQMKGYPPSV

SEQ ID NO: 1699758 - protein, 29 aa, Staphylococcus aureus
SEKEFYDLWTDLYRLFKKLRNAFKEDLEP

SEQ ID NO: 1699759 - protein, 17 aa, Staphylococcus aureus
SEKETYLESIKASLKRL

SEQ ID NO: 1699760 - protein, 17 aa, Staphylococcus aureus
SEKLLFAEITSLSNKYG

SEQ ID NO: 1699761 - protein, 25 aa, Staphylococcus aureus
SELGSRMRLRIMPELMYEYDQSIEY

SEQ ID NO: 1699762 - protein, 25 aa, Staphylococcus aureus
SELITPRAFANLYDTLLMNYNFVII

SEQ ID NO: 1699763 - protein, 20 aa, Staphylococcus aureus
SELKNRIPLVLEVKTDQYQS

SEQ ID NO: 1699764 - protein, 23 aa, Staphylococcus aureus
SELSKLFFNPISGHGIETFEISG

SEQ ID NO: 1699765 - protein, 17 aa, Staphylococcus aureus
SEMMLWSSQQRSQYTVQ

SEQ ID NO: 1699766 - protein, 25 aa, Staphylococcus aureus
SENDAKNFVLFVKSKENQEQYNEQI

SEQ ID NO: 1699767 - protein, 30 aa, Staphylococcus aureus
SENNKYVVVEYPYFTPIPDSQLNKAKMVED

SEQ ID NO: 1699768 - protein, 25 aa, Staphylococcus aureus
SEQLSLDLQILLWNMVKERDNQPHT

SEQ ID NO: 1699769 - protein, 28 aa, Staphylococcus aureus
SEQNGITLMLLIGKFLQKFGSRRQIQTT

SEQ ID NO: 1699770 - protein, 24 aa, Staphylococcus aureus
SERELILVLMAQNKPIYGACFGAQ

SEQ ID NO: 1699771 - protein, 24 aa, Staphylococcus aureus
SERIEVLVSLKYLLIGGEVLNAKW

SEQ ID NO: 1699772 - protein, 20 aa, Staphylococcus aureus
SERIVNHIKYYLNLITEKPS

SEQ ID NO: 1699773 - protein, 28 aa, Staphylococcus aureus
SERVSYLYQPYNPSILRLVKKVIEASHK

SEQ ID NO: 1699774 - protein, 22 aa, Staphylococcus aureus
SESESLSDVSSSKYPLSSVKSS

SEQ ID NO: 1699775 - protein, 29 aa, Staphylococcus aureus
SESLSESESLSESLSESESLSESESLSES

SEQ ID NO: 1699776 - protein, 24 aa, Staphylococcus aureus
SETNYLLDVWVLEEPHLKYKSDKI

SEQ ID NO: 1699777 - protein, 25 aa, Staphylococcus aureus
SEVSLKVLPIIDILSLFILHSKYCS

SEQ ID NO: 1699778 - protein, 26 aa, Staphylococcus aureus
SEVSLKVLPIIDILSLFILHSKYCSE

SEQ ID NO: 1699779 - protein, 19 aa, Staphylococcus aureus
SEVYSPISPIKIATQDNSG

SEQ ID NO: 1699780 - protein, 17 aa, Staphylococcus aureus
SEYAIYVNYGTGIYATG

SEQ ID NO: 1699781 - protein, 19 aa, Staphylococcus aureus
SEYELYKQFQKLRNIFKKE

SEQ ID NO: 1699782 - protein, 18 aa, Staphylococcus aureus
SEYKIYCHTGDFNNLISG

SEQ ID NO: 1699783 - protein, 23 aa, Staphylococcus aureus
SEYKKKIIELIESNLTGYEISKK

SEQ ID NO: 1699784 - protein, 23 aa, Staphylococcus aureus
SEYKLQMVRLYENGKPRNEIIRE

SEQ ID NO: 1699785 - protein, 25 aa, Staphylococcus aureus
SFAEIKRNFKTLNSDLKLTGNNFKY

SEQ ID NO: 1699786 - protein, 17 aa, Staphylococcus aureus
SFAFFKICHDEIDLLRL

SEQ ID NO: 1699787 - protein, 24 aa, Staphylococcus aureus
SFAKTLEMYPIKNLEDLYDKEGYR

SEQ ID NO: 1699788 - protein, 21 aa, Staphylococcus aureus
SFEALWELYRGLANVRPALPV

SEQ ID NO: 1699789 - protein, 25 aa, Staphylococcus aureus
SFIKKAIAYYRFRPYAKKILEENHY

SEQ ID NO: 1699790 - protein, 25 aa, Staphylococcus aureus
SFKFSRLPQDINFFAWLQHVKDSDK

SEQ ID NO: 1699791 - protein, 22 aa, Staphylococcus aureus
SFKKAMFLKGYNLSDLSIETGV

SEQ ID NO: 1699792 - protein, 18 aa, Staphylococcus aureus
SFLKYGELALLNSLIEIG

SEQ ID NO: 1699793 - protein, 38 aa, Staphylococcus aureus
SFMDKIGPIAILVPALNLKPLKWGINKVDSQLQSGIER

SEQ ID NO: 1699794 - protein, 17 aa, Staphylococcus aureus
SFMGLPTPNIFTGCGNF

SEQ ID NO: 1699795 - protein, 18 aa, Staphylococcus aureus
SFNSFSKINWSKLVNKLS

SEQ ID NO: 1699796 - protein, 23 aa, Staphylococcus aureus
SFPKEVFEYYLGISNNIMNDKIN

SEQ ID NO: 1699797 - protein, 19 aa, Staphylococcus aureus
SFQLYQNLKRQNPSPYMYY

SEQ ID NO: 1699798 - protein, 17 aa, Staphylococcus aureus
SFRRLFKYKKISKNLIG

SEQ ID NO: 1699799 - protein, 27 aa, Staphylococcus aureus
SFTIDPKIYNLGIPVLGICYGMQLTTK

SEQ ID NO: 1699800 - protein, 21 aa, Staphylococcus aureus
SGAIAQYLGVLDPGLSVTTTN

SEQ ID NO: 1699801 - protein, 27 aa, Staphylococcus aureus
SGANVLRYLLFVFNNRIIRLQLPYNRN

SEQ ID NO: 1699802 - protein, 25 aa, Staphylococcus aureus
SGELTYQRFLNGYPTFNKEGANQIQ

SEQ ID NO: 1699803 - protein, 24 aa, Staphylococcus aureus
SGELTYQRFLNGYPTFNKEGSNQI

SEQ ID NO: 1699804 - protein, 25 aa, Staphylococcus aureus
SGELTYQRFLNGYPTFNKEGSNQIQ

SEQ ID NO: 1699805 - protein, 25 aa, Staphylococcus aureus
SGFFKQKSRLFWTQMNQAPSLAKED

SEQ ID NO: 1699806 - protein, 25 aa, Staphylococcus aureus
SGHGTAYYPFFKIDFERLARYCEKN

SEQ ID NO: 1699807 - protein, 28 aa, Staphylococcus aureus
SGIAIGVSNFYYAPILKGTENEWETGAG

SEQ ID NO: 1699808 - protein, 24 aa, Staphylococcus aureus
SGIFAFNNKTLFEKLIQVKNDNAQ

SEQ ID NO: 1699809 - protein, 28 aa, Staphylococcus aureus
SGKDRFKGLPYWHRSKSNWLFKEYNGKI

SEQ ID NO: 1699810 - protein, 23 aa, Staphylococcus aureus
SGKIRMNYIRILPGDKVTVEMSS

SEQ ID NO: 1699811 - protein, 25 aa, Staphylococcus aureus
SGKKQSLVFYHLKLDVEFASILGLT

SEQ ID NO: 1699812 - protein, 27 aa, Staphylococcus aureus
SGKSTLAALLLGLLKPINGSIYMSDDT

SEQ ID NO: 1699813 - protein, 57 aa, Staphylococcus aureus
SGKSVCINSILMSLLYKNHPEELRLLLIDPKMVELAPYNGLPHLVAPVITDVKAATQ

SEQ ID NO: 1699814 - protein, 23 aa, Staphylococcus aureus
SGKTLLAQTLAKTLNVPFAIADA

SEQ ID NO: 1699815 - protein, 21 aa, Staphylococcus aureus
SGLDPGQYPLLPQVSRDDAIQ

SEQ ID NO: 1699816 - protein, 22 aa, Staphylococcus aureus
SGPAALRCSQFVYKEKKIKRHS

SEQ ID NO: 1699817 - protein, 25 aa, Staphylococcus aureus
SGPLLKNGHRFGFYRGYNGHSYIHI

SEQ ID NO: 1699818 - protein, 26 aa, Staphylococcus aureus
SGRYKNLIIWYLKTEGKRFGEIKKFF

SEQ ID NO: 1699819 - protein, 17 aa, Staphylococcus aureus
SGRYYAMDRDKRWEREE

SEQ ID NO: 1699820 - protein, 25 aa, Staphylococcus aureus
SGSSDFLDCFCLVGATALTFSLISI

SEQ ID NO: 1699821 - protein, 26 aa, Staphylococcus aureus
SGTAVLVRVKLPKSAIGFRKLMSEER

SEQ ID NO: 1699822 - protein, 21 aa, Staphylococcus aureus
SGVGLDYPLSREKLSPVLALV

SEQ ID NO: 1699823 - protein, 27 aa, Staphylococcus aureus
SGVKQLKVVPLLLFSAMHYLKDIPNIV

SEQ ID NO: 1699824 - protein, 24 aa, Staphylococcus aureus
SHEIEKLILFLGDRPTINKQDVNQ

SEQ ID NO: 1699825 - protein, 28 aa, Staphylococcus aureus
SHEYLKQHNIHVIPLSLTIDGKSYTDQV

SEQ ID NO: 1699826 - protein, 19 aa, Staphylococcus aureus
SHGAGFRLQNGEKLNFAVV

SEQ ID NO: 1699827 - protein, 21 aa, Staphylococcus aureus
SHGGSYWKLINNKGKRIASLT

SEQ ID NO: 1699828 - protein, 21 aa, Staphylococcus aureus
SHGLVLGRLRGVEFDVAIFSN

SEQ ID NO: 1699829 - protein, 19 aa, Staphylococcus aureus
SHHLRLLKNLGIAKYRKEG

SEQ ID NO: 1699830 - protein, 21 aa, Staphylococcus aureus
SHLDIPLERALENLSTFKPFE

SEQ ID NO: 1699831 - protein, 33 aa, Staphylococcus aureus
SHNDDLPYVELALGAGMAFLIRRFTKKDQQTEE

SEQ ID NO: 1699832 - protein, 18 aa, Staphylococcus aureus
SHNTFQLIKLFQKRINLG

SEQ ID NO: 1699833 - protein, 26 aa, Staphylococcus aureus
SHQMDMLFTHFGISGPATLRCSQFVY

SEQ ID NO: 1699834 - protein, 33 aa, Staphylococcus aureus
SHRGPLFDYFDAKLVCYFFKELSKFIYKNRGVF

SEQ ID NO: 1699835 - protein, 17 aa, Staphylococcus aureus
SHTINYGHIIDPESKEV

SEQ ID NO: 1699836 - protein, 18 aa, Staphylococcus aureus
SHYALSDIPLPKKTKFET

SEQ ID NO: 1699837 - protein, 28 aa, Staphylococcus aureus
SHYKKIDYEFLYLLSMDKLFGNKRNRLT

SEQ ID NO: 1699838 - protein, 17 aa, Staphylococcus aureus
SIAPSFYFDFNQPISIC

SEQ ID NO: 1699839 - protein, 22 aa, Staphylococcus aureus
SIARFISTIRSFHQFAIREKYA

SEQ ID NO: 1699840 - protein, 23 aa, Staphylococcus aureus
SIARFISTIRSFHQFAIREKYAV

SEQ ID NO: 1699841 - protein, 25 aa, Staphylococcus aureus
SIATYELYIAALKLGVAIIPCSEML

SEQ ID NO: 1699842 - protein, 35 aa, Staphylococcus aureus
SICKKWYINSFKYFRNMYKGFYYSRPDKLNKCFYK

SEQ ID NO: 1699843 - protein, 30 aa, Staphylococcus aureus
SIEELKINLTKWTDFLHDLKAASPILENHL

SEQ ID NO: 1699844 - protein, 27 aa, Staphylococcus aureus
SIEPAIQFNYRLSPLVAACLKLSLIKG

SEQ ID NO: 1699845 - protein, 35 aa, Staphylococcus aureus
SIFEQRFGVEALYQDAIDILLPDAYGEAIDETDIK

SEQ ID NO: 1699846 - protein, 24 aa, Staphylococcus aureus
SIGKGLMIGVTAPVLGIAAASGKA

SEQ ID NO: 1699847 - protein, 36 aa, Staphylococcus aureus
SIIASTNMIFKYAYDMKLIRILPSEGIKRPKKKVSV

SEQ ID NO: 1699848 - protein, 35 aa, Staphylococcus aureus
SIITSTNMIFKYAYDMKLIRIMPSEDIKRPKKKTS

SEQ ID NO: 1699849 - protein, 18 aa, Staphylococcus aureus
SIIVLQRFVAMKNITHII

SEQ ID NO: 1699850 - protein, 23 aa, Staphylococcus aureus
SIKAIILSFAYDKNKFKVIGPFV

SEQ ID NO: 1699851 - protein, 17 aa, Staphylococcus aureus
SIKITFIRRYFMISINV

SEQ ID NO: 1699852 - protein, 17 aa, Staphylococcus aureus
SIKLVNAINLLLSTKHS

SEQ ID NO: 1699853 - protein, 20 aa, Staphylococcus aureus
SILAQLQNIYDTAIGQIDQD

SEQ ID NO: 1699854 - protein, 33 aa, Staphylococcus aureus
SILKTLTFHSLLDEWLEYHIKTSGFKVTTLDNL

SEQ ID NO: 1699855 - protein, 26 aa, Staphylococcus aureus
SILKTLTFHTLLDEWFEYHTKTSGFK

SEQ ID NO: 1699856 - protein, 30 aa, Staphylococcus aureus
SILSNDHLLTFYDFPLAIRKSIYSTNLIES

SEQ ID NO: 1699857 - protein, 20 aa, Staphylococcus aureus
SIMEDFYIEKLITGGATSTA

SEQ ID NO: 1699858 - protein, 20 aa, Staphylococcus aureus
SIMNIKWETILPDDNNDWIN

SEQ ID NO: 1699859 - protein, 44 aa, Staphylococcus aureus
SINQFPFISFDRIIEFTAFDLVDKLLTQPVLFIAGSEAGTLWQS

SEQ ID NO: 1699860 - protein, 21 aa, Staphylococcus aureus
SIPFNFASYMSASKFFKDYAL

SEQ ID NO: 1699861 - protein, 18 aa, Staphylococcus aureus
SISFLLTDLGGGSSVPMG

SEQ ID NO: 1699862 - protein, 29 aa, Staphylococcus aureus
SISKKITGYGLKTTAVIGGAFTVNMLHDQ

SEQ ID NO: 1699863 - protein, 30 aa, Staphylococcus aureus
SISKKMTGYGLKTTAVIGGAFTVNMLHDQQ

SEQ ID NO: 1699864 - protein, 25 aa, Staphylococcus aureus
SITEGTIAEWLKNLGDSVEKGEAIL

SEQ ID NO: 1699865 - protein, 17 aa, Staphylococcus aureus
SIVIEIFIPNDNKILLT

SEQ ID NO: 1699866 - protein, 27 aa, Staphylococcus aureus
SIYDALRQSFNIPALKAWQSVKQNAGN

SEQ ID NO: 1699867 - protein, 21 aa, Staphylococcus aureus
SIYKAMVRMAQDFSYRYPLVD

SEQ ID NO: 1699868 - protein, 19 aa, Staphylococcus aureus
SIYNYPTHQTFFSSSDKLS

SEQ ID NO: 1699869 - protein, 25 aa, Staphylococcus aureus
SKAEKPIEQLFAKRLKEIKQIIADM

SEQ ID NO: 1699870 - protein, 21 aa, Staphylococcus aureus
SKCLVLFTSYKMMHMVQDMLN

SEQ ID NO: 1699871 - protein, 22 aa, Staphylococcus aureus
SKDDYQFEYLSTYSGYIAKNMP

SEQ ID NO: 1699872 - protein, 24 aa, Staphylococcus aureus
SKDGLSPEYLLSRDYLEDDPEGFI

SEQ ID NO: 1699873 - protein, 24 aa, Staphylococcus aureus
SKDGLSPEYLLSRNYLEDDPEGFI

SEQ ID NO: 1699874 - protein, 23 aa, Staphylococcus aureus
SKDKKYYLSIDKTVFENASNRLK

SEQ ID NO: 1699875 - protein, 20 aa, Staphylococcus aureus
SKDPDYIQGYLFLQSLYENE

SEQ ID NO: 1699876 - protein, 25 aa, Staphylococcus aureus
SKDPDYIQGYLFLQSLYENEKKLSR

SEQ ID NO: 1699877 - protein, 19 aa, Staphylococcus aureus
SKDPKRRIPYMEIVGQVHG

SEQ ID NO: 1699878 - protein, 24 aa, Staphylococcus aureus
SKDPKRRIPYMEIVGQVHGTYIIA

SEQ ID NO: 1699879 - protein, 23 aa, Staphylococcus aureus
SKEKFKQLFRILEDTFARTLSPY

SEQ ID NO: 1699880 - protein, 24 aa, Staphylococcus aureus
SKEKFKQLFRLLEDTFARPLSPYE

SEQ ID NO: 1699881 - protein, 25 aa, Staphylococcus aureus
SKENKKFLLDLMLNNKSGDTLIKDG

SEQ ID NO: 1699882 - protein, 20 aa, Staphylococcus aureus
SKEPVRLFAVKKQKELAAEK

SEQ ID NO: 1699883 - protein, 26 aa, Staphylococcus aureus
SKEVALVMMVLRLNTLLKGHSGATLE

SEQ ID NO: 1699884 - protein, 20 aa, Staphylococcus aureus
SKFDLFKKYANSELILTKSA

SEQ ID NO: 1699885 - protein, 21 aa, Staphylococcus aureus
SKFGLSIQYGLAKKAIDKVQQ

SEQ ID NO: 1699886 - protein, 17 aa, Staphylococcus aureus
SKFGLSIQYGLAKKAIN

SEQ ID NO: 1699887 - protein, 25 aa, Staphylococcus aureus
SKFKDEVPILSLPTDYVRPNIKTTN

SEQ ID NO: 1699888 - protein, 25 aa, Staphylococcus aureus
SKGIYKFKYVILEAVRKVFDYKSIY

SEQ ID NO: 1699889 - protein, 23 aa, Staphylococcus aureus
SKGNLYYHFKTKENLFLEILNIE

SEQ ID NO: 1699890 - protein, 23 aa, Staphylococcus aureus
SKHFKSNRLLYKHISDRLKNTIE

SEQ ID NO: 1699891 - protein, 22 aa, Staphylococcus aureus
SKHLTISFYLTTHSIPETYGVI

SEQ ID NO: 1699892 - protein, 25 aa, Staphylococcus aureus
SKIDILIVVNMFLTGFDSKVLNTLY

SEQ ID NO: 1699893 - protein, 19 aa, Staphylococcus aureus
SKINWSKLVNKLSVPIEAN

SEQ ID NO: 1699894 - protein, 24 aa, Staphylococcus aureus
SKIQTIGVILPSLTNPFFSALMQS

SEQ ID NO: 1699895 - protein, 26 aa, Staphylococcus aureus
SKKADAFCFTFLPIDIVETYKINTQN

SEQ ID NO: 1699896 - protein, 23 aa, Staphylococcus aureus
SKLIAIPGTPPNLLKPPIGDAFA

SEQ ID NO: 1699897 - protein, 22 aa, Staphylococcus aureus
SKLIQPIMQLFIDNAILNNVQN

SEQ ID NO: 1699898 - protein, 21 aa, Staphylococcus aureus
SKLIQPIMQLFIDNAILNNVS

SEQ ID NO: 1699899 - protein, 24 aa, Staphylococcus aureus
SKLNWVYKYFFANGVQMEGVLIRQ

SEQ ID NO: 1699900 - protein, 25 aa, Staphylococcus aureus
SKMALLQMLSYLNNHQWLLKERDQR

SEQ ID NO: 1699901 - protein, 24 aa, Staphylococcus aureus
SKMALLQMLSYLNNHQWLLKGRDQ

SEQ ID NO: 1699902 - protein, 21 aa, Staphylococcus aureus
SKMNRDLLAKCYLSCLKLADQ

SEQ ID NO: 1699903 - protein, 26 aa, Staphylococcus aureus
SKNHDEILILLKTGLRISEFGGLTLP

SEQ ID NO: 1699904 - protein, 27 aa, Staphylococcus aureus
SKPDWKIFQAIANKLGFDWNYKHPSEI

SEQ ID NO: 1699905 - protein, 18 aa, Staphylococcus aureus
SKQLAAIKQWLLNPETNS

SEQ ID NO: 1699906 - protein, 28 aa, Staphylococcus aureus
SKRDIQFDVIFLDPPYNKGLIDKALKQI

SEQ ID NO: 1699907 - protein, 22 aa, Staphylococcus aureus
SKSEIVVPIFKDDKIIGVLDID

SEQ ID NO: 1699908 - protein, 24 aa, Staphylococcus aureus
SKSIFPSCRVAYMVLPYSIMKKYH

SEQ ID NO: 1699909 - protein, 19 aa, Staphylococcus aureus
SKTEMIILEILITKKNQIV

SEQ ID NO: 1699910 - protein, 17 aa, Staphylococcus aureus
SKTILDYVWDQYPLMNE

SEQ ID NO: 1699911 - protein, 24 aa, Staphylococcus aureus
SKTRRHLIEFWMIEGEMAFINHAE

SEQ ID NO: 1699912 - protein, 17 aa, Staphylococcus aureus
SKVPWISIYDENITKET

SEQ ID NO: 1699913 - protein, 28 aa, Staphylococcus aureus
SKVQPCCFKLYNDPFDMAYVMMNSKLFG

SEQ ID NO: 1699914 - protein, 31 aa, Staphylococcus aureus
SKVQPCCFKLYNDPFDMAYVMMNSKLFGHVY

SEQ ID NO: 1699915 - protein, 34 aa, Staphylococcus aureus
SKVQPYCFKLYNDPFDMVYVMMNSKLFGHVYIKD

SEQ ID NO: 1699916 - protein, 25 aa, Staphylococcus aureus
SKVRKRYERFKYKKTYANVLNITTI

SEQ ID NO: 1699917 - protein, 29 aa, Staphylococcus aureus
SLDAILLNARPIKIGLAVLVDRGHRELPI

SEQ ID NO: 1699918 - protein, 21 aa, Staphylococcus aureus
SLDYLLQFKIDNKTLLHCIEA

SEQ ID NO: 1699919 - protein, 21 aa, Staphylococcus aureus
SLEGVLYNLYTVYLALIEVMN

SEQ ID NO: 1699920 - protein, 23 aa, Staphylococcus aureus
SLEPWTSCEFDFTKKSKLKVSFD

SEQ ID NO: 1699921 - protein, 30 aa, Staphylococcus aureus
SLFEDVRSCLIFFKIWDLCKWNKTDNKVVL

SEQ ID NO: 1699922 - protein, 19 aa, Staphylococcus aureus
SLFQKSLTYYKSYSPGSSK

SEQ ID NO: 1699923 - protein, 25 aa, Staphylococcus aureus
SLGAFLAQYNLIKHNLDNGTTFAAP

SEQ ID NO: 1699924 - protein, 18 aa, Staphylococcus aureus
SLGYLSGWGQNISDDELK

SEQ ID NO: 1699925 - protein, 17 aa, Staphylococcus aureus
SLGYYLDKQFEGHGIMT

SEQ ID NO: 1699926 - protein, 20 aa, Staphylococcus aureus
SLHIVVSIPVFLAERVEVLP

SEQ ID NO: 1699927 - protein, 17 aa, Staphylococcus aureus
SLHQSAIQWIWETVKQE

SEQ ID NO: 1699928 - protein, 18 aa, Staphylococcus aureus
SLHQSAIQWIWETVKQEG

SEQ ID NO: 1699929 - protein, 17 aa, Staphylococcus aureus
SLIYENIVVYKASYQDG

SEQ ID NO: 1699930 - protein, 19 aa, Staphylococcus aureus
SLKSRGMILKLDRNKRTAK

SEQ ID NO: 1699931 - protein, 18 aa, Staphylococcus aureus
SLLQLKGIGPKKIEVLQQ

SEQ ID NO: 1699932 - protein, 20 aa, Staphylococcus aureus
SLLTRTIITHILKDDLGPEV

SEQ ID NO: 1699933 - protein, 18 aa, Staphylococcus aureus
SLLTVLPLDKERLADMEV

SEQ ID NO: 1699934 - protein, 20 aa, Staphylococcus aureus
SLNLQTIHDLDVHPIKKPDA

SEQ ID NO: 1699935 - protein, 29 aa, Staphylococcus aureus
SLNLTLDEYFNYLKKIYKLPTYSKMIDYM

SEQ ID NO: 1699936 - protein, 26 aa, Staphylococcus aureus
SLNNRFQLFDPFGIKSRFFDSIKIDS

SEQ ID NO: 1699937 - protein, 22 aa, Staphylococcus aureus
SLNTAMTGLKRGVANHNQVVQS

SEQ ID NO: 1699938 - protein, 27 aa, Staphylococcus aureus
SLNTYYKRTIKISGLKAMYALKSKDFK

SEQ ID NO: 1699939 - protein, 34 aa, Staphylococcus aureus
SLPIRAGYSLEIKVPLNAIKIPKSVLTKGNNVFI

SEQ ID NO: 1699940 - protein, 25 aa, Staphylococcus aureus
SLPVPKYRYFKLNNNIQKMLYRILQ

SEQ ID NO: 1699941 - protein, 25 aa, Staphylococcus aureus
SLQDSYIRALRWSTDRIGDTGIIGF

SEQ ID NO: 1699942 - protein, 25 aa, Staphylococcus aureus
SLRAGIIDIFPLIGEPIRIELFDTE

SEQ ID NO: 1699943 - protein, 26 aa, Staphylococcus aureus
SLRASYYMMGAMLGRFKKCVMGLPGG

SEQ ID NO: 1699944 - protein, 26 aa, Staphylococcus aureus
SLRGGIIDIFPLIGEPIRIELFDTKI

SEQ ID NO: 1699945 - protein, 21 aa, Staphylococcus aureus
SLRLDVVIKYLIRKSRTIAKG

SEQ ID NO: 1699946 - protein, 24 aa, Staphylococcus aureus
SLSNTELLAILINTGRKGFLSIDI

SEQ ID NO: 1699947 - protein, 29 aa, Staphylococcus aureus
SLVIVIRSVFKYAFKYYDLHDISVLDKID

SEQ ID NO: 1699948 - protein, 25 aa, Staphylococcus aureus
SMIFNFNEIFRERMPKYINNQYKGK

SEQ ID NO: 1699949 - protein, 25 aa, Staphylococcus aureus
SMIRTNLEIPPFIQALTSIEEKMLQ

SEQ ID NO: 1699950 - protein, 29 aa, Staphylococcus aureus
SMIYVDTGAMYRALTYKYLKLNKTEDFAK

SEQ ID NO: 1699951 - protein, 25 aa, Staphylococcus aureus
SMLHKPELLILDEPFSGLDPVNVEL

SEQ ID NO: 1699952 - protein, 17 aa, Staphylococcus aureus
SMPLNLMGKLAFQYLSQ

SEQ ID NO: 1699953 - protein, 18 aa, Staphylococcus aureus
SMSQIRWLSVLDLKDKTE

SEQ ID NO: 1699954 - protein, 17 aa, Staphylococcus aureus
SMVLKRHIYKQLLNINI

SEQ ID NO: 1699955 - protein, 18 aa, Staphylococcus aureus
SMVTDFEDLKELGKEMEQ

SEQ ID NO: 1699956 - protein, 26 aa, Staphylococcus aureus
SNAGLKLLSAPSLDYGLIGFVSHDYD

SEQ ID NO: 1699957 - protein, 31 aa, Staphylococcus aureus
SNAKSVWKGTSKWFSSSYKSLKSWTGDMYSR

SEQ ID NO: 1699958 - protein, 24 aa, Staphylococcus aureus
SNDELMSMLPAEWNDWIIGARQAL

SEQ ID NO: 1699959 - protein, 25 aa, Staphylococcus aureus
SNDELMSMLPAEWNDWIIGARQALI

SEQ ID NO: 1699960 - protein, 26 aa, Staphylococcus aureus
SNDHNLFFMNYYLNFKELRAFVIGNA

SEQ ID NO: 1699961 - protein, 26 aa, Staphylococcus aureus
SNEEIYNLMIYQLGALQVFCRIHQVK

SEQ ID NO: 1699962 - protein, 20 aa, Staphylococcus aureus
SNEVGYLLKDGKVIKVYGDQ

SEQ ID NO: 1699963 - protein, 21 aa, Staphylococcus aureus
SNFFADKLSNILDKNNLSFDD

SEQ ID NO: 1699964 - protein, 21 aa, Staphylococcus aureus
SNFFADKLSNILEKNNLSFDD

SEQ ID NO: 1699965 - protein, 29 aa, Staphylococcus aureus
SNHKDTVYNVLFLWRLSSELNVAQLRQAV

SEQ ID NO: 1699966 - protein, 24 aa, Staphylococcus aureus
SNILLQYTFILSSFLKYIHIIEER

SEQ ID NO: 1699967 - protein, 24 aa, Staphylococcus aureus
SNIMAVMIAVWSKGTSLEMIIKAV

SEQ ID NO: 1699968 - protein, 27 aa, Staphylococcus aureus
SNINLLLVPETLRIIALISIVDACTPT

SEQ ID NO: 1699969 - protein, 25 aa, Staphylococcus aureus
SNIVKLDSQFLLTLQVRETGPTLKL

SEQ ID NO: 1699970 - protein, 22 aa, Staphylococcus aureus
SNKKYFLKLQPNTKSNFFDYEL

SEQ ID NO: 1699971 - protein, 17 aa, Staphylococcus aureus
SNKYGYCTASNGYFATL

SEQ ID NO: 1699972 - protein, 17 aa, Staphylococcus aureus
SNLKALGFVPKYTVETG

SEQ ID NO: 1699973 - protein, 24 aa, Staphylococcus aureus
SNNDNLNYILTKLSLHNDNFVKKI

SEQ ID NO: 1699974 - protein, 20 aa, Staphylococcus aureus
SNNRWLQRYDLISERNHFNY

SEQ ID NO: 1699975 - protein, 17 aa, Staphylococcus aureus
SNPLNKSFEKPGASENL

SEQ ID NO: 1699976 - protein, 23 aa, Staphylococcus aureus
SNQAILHFGKVYGPSPMTLHSPI

SEQ ID NO: 1699977 - protein, 17 aa, Staphylococcus aureus
SNRRIMMALQHVAQHKN

SEQ ID NO: 1699978 - protein, 26 aa, Staphylococcus aureus
SNTYSYNLISLMIEYLRFAKCTQELT

SEQ ID NO: 1699979 - protein, 19 aa, Staphylococcus aureus
SNVAWFWHTSFSHTTETPR

SEQ ID NO: 1699980 - protein, 26 aa, Staphylococcus aureus
SNVNTLNKLLENQQILALESNKKIQK

SEQ ID NO: 1699981 - protein, 29 aa, Staphylococcus aureus
SNWQVNPMLRLLKTDVLTASYLKSAYLVD

SEQ ID NO: 1699982 - protein, 22 aa, Staphylococcus aureus
SNYYEFLVRYNKIDTLLTENES

SEQ ID NO: 1699983 - protein, 23 aa, Staphylococcus aureus
SPDKILGAILFEQTMDREVEGKY

SEQ ID NO: 1699984 - protein, 21 aa, Staphylococcus aureus
SPGLKIVIPSGPYDAKGLLIS

SEQ ID NO: 1699985 - protein, 20 aa, Staphylococcus aureus
SPILKLHIDGDIKGSSVGYK

SEQ ID NO: 1699986 - protein, 32 aa, Staphylococcus aureus
SPKSNVIRVLFDEGFIALRPSGTEPKIKLYVS

SEQ ID NO: 1699987 - protein, 25 aa, Staphylococcus aureus
SPKTIRTLITRLYKKGFIDRKKDNK

SEQ ID NO: 1699988 - protein, 20 aa, Staphylococcus aureus
SPLGKMIFTVMSGFAELETD

SEQ ID NO: 1699989 - protein, 18 aa, Staphylococcus aureus
SPLGWHKYVGTAGEVIAI

SEQ ID NO: 1699990 - protein, 18 aa, Staphylococcus aureus
SPMHPWRRSTTVPHLGNW

SEQ ID NO: 1699991 - protein, 20 aa, Staphylococcus aureus
SPNLKLYIDGDIKGSSVGYK

SEQ ID NO: 1699992 - protein, 17 aa, Staphylococcus aureus
SPQIIIGAQYIQAAGVA

SEQ ID NO: 1699993 - protein, 35 aa, Staphylococcus aureus
SPSEFKFGLSFLTRSIALARFPWLSANIEYNVTKE

SEQ ID NO: 1699994 - protein, 17 aa, Staphylococcus aureus
SPSFSPYKILGAILFEQ

SEQ ID NO: 1699995 - protein, 21 aa, Staphylococcus aureus
SPVIAFLINPILPNNNWNIAV

SEQ ID NO: 1699996 - protein, 21 aa, Staphylococcus aureus
SQAHKLCPNGYFVTSNFGAYR

SEQ ID NO: 1699997 - protein, 22 aa, Staphylococcus aureus
SQAIVKIETLFSYITLSHFGIN

SEQ ID NO: 1699998 - protein, 36 aa, Staphylococcus aureus
SQANQYQQLPQQNQYQYVPPQQQAPTKQRPAKEEND

SEQ ID NO: 1699999 - protein, 17 aa, Staphylococcus aureus
SQDFNVGGLFNKKKKKL

SEQ ID NO: 1700000 - protein, 27 aa, Staphylococcus aureus
SQEDISLYVINLNRYIYKDIKGEFIEI

SEQ ID NO: 1700001 - protein, 25 aa, Staphylococcus aureus
SQFVLSYDLFQNPTDTRTLIPFLTM

SEQ ID NO: 1700002 - protein, 17 aa, Staphylococcus aureus
SQLEKIFRKVKKLKRPD

SEQ ID NO: 1700003 - protein, 20 aa, Staphylococcus aureus
SQLKALYLTVIDRIDIRKDE

SEQ ID NO: 1700004 - protein, 18 aa, Staphylococcus aureus
SQLTIMCKLGWDDEINFA

SEQ ID NO: 1700005 - protein, 39 aa, Staphylococcus aureus
SQNFKNMINYHSKFDILSWLQDPFATPTLGKRVNLETGV

SEQ ID NO: 1700006 - protein, 24 aa, Staphylococcus aureus
SQNGVPIILYGELYTKYGAIVSKI

SEQ ID NO: 1700007 - protein, 36 aa, Staphylococcus aureus
SQPTLPAFKQMYALYFKFVMPIFGKLFAKSKEEYEW

SEQ ID NO: 1700008 - protein, 34 aa, Staphylococcus aureus
SQQHQCLYVKLDPYWLYHLYDKDIVPFEGREKND

SEQ ID NO: 1700009 - protein, 20 aa, Staphylococcus aureus
SQQQWLSGFLLANSSDMTND

SEQ ID NO: 1700010 - protein, 24 aa, Staphylococcus aureus
SQTLNTAMKGLRDSIANEATIKAG

SEQ ID NO: 1700011 - protein, 22 aa, Staphylococcus aureus
SQTPDLTMAYPVYINAMTGGSE

SEQ ID NO: 1700012 - protein, 18 aa, Staphylococcus aureus
SQVANAKGALNGNHNLEQ

SEQ ID NO: 1700013 - protein, 23 aa, Staphylococcus aureus
SREKELLKYFPSDYKKPEEKTSD

SEQ ID NO: 1700014 - protein, 23 aa, Staphylococcus aureus
SRESLDLLLLTTSKPRKIRREGI

SEQ ID NO: 1700015 - protein, 25 aa, Staphylococcus aureus
SRFKTGMTLQKNPLTLLVSTAGDNL

SEQ ID NO: 1700016 - protein, 17 aa, Staphylococcus aureus
SRITALQDDIKMALAAK

SEQ ID NO: 1700017 - protein, 33 aa, Staphylococcus aureus
SRKQHFIAEKDFFIFFRNFFTKKFQREIDINVE

SEQ ID NO: 1700018 - protein, 24 aa, Staphylococcus aureus
SRMKMQGYMPVKRLEKPVFQEQKD

SEQ ID NO: 1700019 - protein, 27 aa, Staphylococcus aureus
SRPVKMNSLLKLYFDRNILTPQKLLNY

SEQ ID NO: 1700020 - protein, 26 aa, Staphylococcus aureus
SRPVKMNSLLKLYFDRNLLTPQKLLN

SEQ ID NO: 1700021 - protein, 18 aa, Staphylococcus aureus
SRQDALAGKIDWVNEFPE

SEQ ID NO: 1700022 - protein, 26 aa, Staphylococcus aureus
SRRISNLTNFGYLKIEIIKEGNEVKQ

SEQ ID NO: 1700023 - protein, 25 aa, Staphylococcus aureus
SRSISKNMLFIPFKGENVDGHRFVS

SEQ ID NO: 1700024 - protein, 20 aa, Staphylococcus aureus
SRTGIFDLFGYDLKDYDELF

SEQ ID NO: 1700025 - protein, 19 aa, Staphylococcus aureus
SRVFKGQKMPGRMGGNTVT

SEQ ID NO: 1700026 - protein, 18 aa, Staphylococcus aureus
SSAIILLEYDGVVHIGYD

SEQ ID NO: 1700027 - protein, 24 aa, Staphylococcus aureus
SSAKILPVGTILFTSRAGIGKTAI

SEQ ID NO: 1700028 - protein, 26 aa, Staphylococcus aureus
SSAMEILRRYCFDKVFIGMNGLDIEL

SEQ ID NO: 1700029 - protein, 29 aa, Staphylococcus aureus
SSFECLSIMLLFVYFKSALKINPKNSNIL

SEQ ID NO: 1700030 - protein, 17 aa, Staphylococcus aureus
SSFLFTRLNFYLIDLFR

SEQ ID NO: 1700031 - protein, 22 aa, Staphylococcus aureus
SSFLFTRLNYYLIDLFRQQNQL

SEQ ID NO: 1700032 - protein, 28 aa, Staphylococcus aureus
SSFSLTDLYLFIFNNSIKTLTIVTNKGQ

SEQ ID NO: 1700033 - protein, 24 aa, Staphylococcus aureus
SSGAAIYAAIQKAKELGKGKTVVT

SEQ ID NO: 1700034 - protein, 21 aa, Staphylococcus aureus
SSGTIQWWDKTYSDSGMNGIT

SEQ ID NO: 1700035 - protein, 23 aa, Staphylococcus aureus
SSGYYDAYYKKSHKVRTLIKNDF

SEQ ID NO: 1700036 - protein, 23 aa, Staphylococcus aureus
SSHGLIIQRFGMTYVLTTKKEAA

SEQ ID NO: 1700037 - protein, 25 aa, Staphylococcus aureus
SSIQRLMGIIISENLVECVKMSEEN

SEQ ID NO: 1700038 - protein, 23 aa, Staphylococcus aureus
SSIRKAFKNILPKEKTYGFYKEG

SEQ ID NO: 1700039 - protein, 21 aa, Staphylococcus aureus
SSIVQYIEKLVWMGGTFLSKG

SEQ ID NO: 1700040 - protein, 23 aa, Staphylococcus aureus
SSKEFIEMIKPKISLISSGKNNM

SEQ ID NO: 1700041 - protein, 21 aa, Staphylococcus aureus
SSKHYLIPEMHLKPILSYMKA

SEQ ID NO: 1700042 - protein, 30 aa, Staphylococcus aureus
SSKRKYDDTLPPLFDELPKEEPKSKPVVEP

SEQ ID NO: 1700043 - protein, 31 aa, Staphylococcus aureus
SSKTILDYVWDQYPLMNEKDIRSVLGRFLFV

SEQ ID NO: 1700044 - protein, 21 aa, Staphylococcus aureus
SSLFSVKKITFDLSDAKKTSK

SEQ ID NO: 1700045 - protein, 24 aa, Staphylococcus aureus
SSLSLETIFHCYHQMMPCCNDVIE

SEQ ID NO: 1700046 - protein, 25 aa, Staphylococcus aureus
SSNEKFAYYVSLALLKTKNLNSYFL

SEQ ID NO: 1700047 - protein, 26 aa, Staphylococcus aureus
SSNERWLRRVINSLVYDYGYPIGCSY

SEQ ID NO: 1700048 - protein, 22 aa, Staphylococcus aureus
SSQFHLLMGMGFKKYIDTLKIG

SEQ ID NO: 1700049 - protein, 23 aa, Staphylococcus aureus
SSRIGYAYFLHPENKVLTETAED

SEQ ID NO: 1700050 - protein, 18 aa, Staphylococcus aureus
SSTLTTLILKELGVKKVT

SEQ ID NO: 1700051 - protein, 18 aa, Staphylococcus aureus
SSVIQPLYDIGAVGMRLL

SEQ ID NO: 1700052 - protein, 24 aa, Staphylococcus aureus
SSVSDFLTYLNGRFSNMILGHNGD

SEQ ID NO: 1700053 - protein, 17 aa, Staphylococcus aureus
SSYLIKPNIAIVTGIGA

SEQ ID NO: 1700054 - protein, 24 aa, Staphylococcus aureus
STAGYTFPLAMLKNEAGINATKDM

SEQ ID NO: 1700055 - protein, 24 aa, Staphylococcus aureus
STDEEVLSIYLLEKYKSVFDKSYI

SEQ ID NO: 1700056 - protein, 19 aa, Staphylococcus aureus
STGDMFRKAIKEETELGKE

SEQ ID NO: 1700057 - protein, 27 aa, Staphylococcus aureus
STGKSHAFLLPLMQLIDSEIKEPQAIV

SEQ ID NO: 1700058 - protein, 19 aa, Staphylococcus aureus
STIEFYFSYSFKSLHSLEI

SEQ ID NO: 1700059 - protein, 19 aa, Staphylococcus aureus
STIFLHCLPAFHDTNTLYG

SEQ ID NO: 1700060 - protein, 19 aa, Staphylococcus aureus
STIFNRIVGERVSIVEDTP

SEQ ID NO: 1700061 - protein, 22 aa, Staphylococcus aureus
STIIYNPLDSITRQRFTIAHEL

SEQ ID NO: 1700062 - protein, 19 aa, Staphylococcus aureus
STIYKPLLGEDCRRTMDIF

SEQ ID NO: 1700063 - protein, 25 aa, Staphylococcus aureus
STKEFLIIAYLYYRKNEDVPLKEII

SEQ ID NO: 1700064 - protein, 17 aa, Staphylococcus aureus
STLELIKYIQAKDIIVV

SEQ ID NO: 1700065 - protein, 22 aa, Staphylococcus aureus
STNPYTIDIIMNKDALQAEVDR

SEQ ID NO: 1700066 - protein, 22 aa, Staphylococcus aureus
STPIIPHQGYLKEKKRAHKQNQ

SEQ ID NO: 1700067 - protein, 28 aa, Staphylococcus aureus
STSNDAEFFFTYEDLPLLNPDKILNEYV

SEQ ID NO: 1700068 - protein, 24 aa, Staphylococcus aureus
STSQSLLSFALINEANQLATQYIY

SEQ ID NO: 1700069 - protein, 25 aa, Staphylococcus aureus
STTADFLYAVLNYPLYRDGDAKDVD

SEQ ID NO: 1700070 - protein, 18 aa, Staphylococcus aureus
STVAYLRTALVENGYEVG

SEQ ID NO: 1700071 - protein, 30 aa, Staphylococcus aureus
STVETQKLMELYYFKKPRTLNLTGVAQEIN

SEQ ID NO: 1700072 - protein, 26 aa, Staphylococcus aureus
STWQHKVPFGVWWETLQQEHRLPWTT

SEQ ID NO: 1700073 - protein, 21 aa, Staphylococcus aureus
STWRYRISLGKDVKTGKYKYI

SEQ ID NO: 1700074 - protein, 24 aa, Staphylococcus aureus
STYKIYLAMFGLDRHIINDENSRM

SEQ ID NO: 1700075 - protein, 18 aa, Staphylococcus aureus
STYLVRNNEFLYGINKEG

SEQ ID NO: 1700076 - protein, 22 aa, Staphylococcus aureus
STYYFHGHIVPGWQGVKKTFDT

SEQ ID NO: 1700077 - protein, 28 aa, Staphylococcus aureus
SVAQFVVELLQFFKKTYKTHFNMDGGPI

SEQ ID NO: 1700078 - protein, 18 aa, Staphylococcus aureus
SVDFLKPIKTGEILQYVA

SEQ ID NO: 1700079 - protein, 18 aa, Staphylococcus aureus
SVDLPILCIEMRSDIPLA

SEQ ID NO: 1700080 - protein, 26 aa, Staphylococcus aureus
SVDQLKSVVIAYEPIWAIGTGKSSTS

SEQ ID NO: 1700081 - protein, 24 aa, Staphylococcus aureus
SVDQNWYTANWSGSPPYKIKHTYH

SEQ ID NO: 1700082 - protein, 18 aa, Staphylococcus aureus
SVDSFHILMLFDDYKRID

SEQ ID NO: 1700083 - protein, 29 aa, Staphylococcus aureus
SVEDFVRILTELKLSLIKQYEALLQTEEV

SEQ ID NO: 1700084 - protein, 25 aa, Staphylococcus aureus
SVEDVRAYNPYLVDKYALNTSDFSI

SEQ ID NO: 1700085 - protein, 17 aa, Staphylococcus aureus
SVFGFKVVDADKAAREA

SEQ ID NO: 1700086 - protein, 23 aa, Staphylococcus aureus
SVFHDEALQPLYKDRIPVVIKNT

SEQ ID NO: 1700087 - protein, 25 aa, Staphylococcus aureus
SVGYINYQPIPRFPGMSRDIALEVN

SEQ ID NO: 1700088 - protein, 17 aa, Staphylococcus aureus
SVIGWRTIDDTEQMMNV

SEQ ID NO: 1700089 - protein, 20 aa, Staphylococcus aureus
SVIMPVHVHGLPADLLEIQK

SEQ ID NO: 1700090 - protein, 17 aa, Staphylococcus aureus
SVKKLYFLEGIDAIEKI

SEQ ID NO: 1700091 - protein, 23 aa, Staphylococcus aureus
SVMPGFDFYFVPTVLNSTDVAFH

SEQ ID NO: 1700092 - protein, 20 aa, Staphylococcus aureus
SVPTARKRLKELEGMNIIST

SEQ ID NO: 1700093 - protein, 20 aa, Staphylococcus aureus
SVQLMPAISQLFEQCKIAKQ

SEQ ID NO: 1700094 - protein, 27 aa, Staphylococcus aureus
SVSITQLIERFLFPSATHGKKVYKLSG

SEQ ID NO: 1700095 - protein, 17 aa, Staphylococcus aureus
SVSYYFKNSFYITPSGM

SEQ ID NO: 1700096 - protein, 23 aa, Staphylococcus aureus
SVTLKLIAKIYKPTSGKLISDGV

SEQ ID NO: 1700097 - protein, 17 aa, Staphylococcus aureus
SVTTTLFSKKKNYTKKS

SEQ ID NO: 1700098 - protein, 17 aa, Staphylococcus aureus
SVWMGFSKVKPYGENSF

SEQ ID NO: 1700099 - protein, 19 aa, Staphylococcus aureus
SVYFIINFYNKNGTKLSTE

SEQ ID NO: 1700100 - protein, 33 aa, Staphylococcus aureus
SWRGPNKFKIQCVILICYYYDNLQNYMKNERGC

SEQ ID NO: 1700101 - protein, 28 aa, Staphylococcus aureus
SWSDDHKSLIYRYDATLGTQITTNDILT

SEQ ID NO: 1700102 - protein, 17 aa, Staphylococcus aureus
SYAERVIFIKDGRLYHE

SEQ ID NO: 1700103 - protein, 31 aa, Staphylococcus aureus
SYEPPIVACGTWRLVYQRLKALEVLTHEHVH

SEQ ID NO: 1700104 - protein, 29 aa, Staphylococcus aureus
SYGVHALTKILAAAIPLLDDFDIELTEAH

SEQ ID NO: 1700105 - protein, 20 aa, Staphylococcus aureus
SYHGNVMMLKRDAGAQDVVA

SEQ ID NO: 1700106 - protein, 21 aa, Staphylococcus aureus
SYHGNVMMLKRDAGAQDVVAQ

SEQ ID NO: 1700107 - protein, 20 aa, Staphylococcus aureus
SYHSLWHQYNNSIFYYYMVD

SEQ ID NO: 1700108 - protein, 24 aa, Staphylococcus aureus
SYIATFMMPKFLKSFFNEHPFIDV

SEQ ID NO: 1700109 - protein, 26 aa, Staphylococcus aureus
SYKVAMFLVPMMIKSLLLVYNNEHTI

SEQ ID NO: 1700110 - protein, 20 aa, Staphylococcus aureus
SYLFSNINWKEKKYMAREFS

SEQ ID NO: 1700111 - protein, 32 aa, Staphylococcus aureus
SYLNLPEEMNPFLGYRAIRLCLAQQDIFRPQL

SEQ ID NO: 1700112 - protein, 18 aa, Staphylococcus aureus
SYPSFLEIAPEPFSNEAL

SEQ ID NO: 1700113 - protein, 17 aa, Staphylococcus aureus
SYPSTVLMTATLAQVAG

SEQ ID NO: 1700114 - protein, 27 aa, Staphylococcus aureus
SYPVSHVLINGIRYKIIDTRIYRHETS

SEQ ID NO: 1700115 - protein, 27 aa, Staphylococcus aureus
SYPVSSPRGWLYFGGARPQDVKGTINV

SEQ ID NO: 1700116 - protein, 26 aa, Staphylococcus aureus
SYQDMLKIWGHLFQYIKSEHIEDTYL

SEQ ID NO: 1700117 - protein, 22 aa, Staphylococcus aureus
SYQPKHLVIVGGGYIALEFASM

SEQ ID NO: 1700118 - protein, 26 aa, Staphylococcus aureus
SYTQGQLLYQNDFQFLKDVLQSVDAK

SEQ ID NO: 1700119 - protein, 23 aa, Staphylococcus aureus
SYTSYLIDMLIEENISAVLINGI

SEQ ID NO: 1700120 - protein, 18 aa, Staphylococcus aureus
SYVFFNIAVPRQFDNDRT

SEQ ID NO: 1700121 - protein, 21 aa, Staphylococcus aureus
SYYEFKYHSTVLYACRCISLD

SEQ ID NO: 1700122 - protein, 19 aa, Staphylococcus aureus
TAAKAILNKQHGPNTAQNA

SEQ ID NO: 1700123 - protein, 24 aa, Staphylococcus aureus
TACYLLVNKAIRRGYKSMPEHVNM

SEQ ID NO: 1700124 - protein, 24 aa, Staphylococcus aureus
TAEKKIDLYNFQLGGFAPVSPISM

SEQ ID NO: 1700125 - protein, 21 aa, Staphylococcus aureus
TAEQVIKLNDAVTAAKKALNG

SEQ ID NO: 1700126 - protein, 19 aa, Staphylococcus aureus
TAKFKSNENVLILGYTKHM

SEQ ID NO: 1700127 - protein, 17 aa, Staphylococcus aureus
TAKGGIVLAIRNELHIP

SEQ ID NO: 1700128 - protein, 25 aa, Staphylococcus aureus
TAKGHYFVTTFYRNGKLPDEKNYKI

SEQ ID NO: 1700129 - protein, 23 aa, Staphylococcus aureus
TAKQVIKLNDAVTAAKKALNGEE

SEQ ID NO: 1700130 - protein, 20 aa, Staphylococcus aureus
TALMFNKINFYLHGSDVILN

SEQ ID NO: 1700131 - protein, 24 aa, Staphylococcus aureus
TALPNRTKLLGVGLWFVPKPVRNF

SEQ ID NO: 1700132 - protein, 22 aa, Staphylococcus aureus
TAPVVAGFAVAAKKGIEFDDSM

SEQ ID NO: 1700133 - protein, 24 aa, Staphylococcus aureus
TARSLLSKLLVRATKKWPTDKSFN

SEQ ID NO: 1700134 - protein, 24 aa, Staphylococcus aureus
TATMPLYLNALSGKGTYLITTNDY

SEQ ID NO: 1700135 - protein, 32 aa, Staphylococcus aureus
TATPINIWVSTPSFMEMCLLLPTLNEEQYGSL

SEQ ID NO: 1700136 - protein, 25 aa, Staphylococcus aureus
TATQTQIVIQIQTATQIQTATQTQI

SEQ ID NO: 1700137 - protein, 25 aa, Staphylococcus aureus
TATQTQTVIPIQKATQTQIVNQTQT

SEQ ID NO: 1700138 - protein, 22 aa, Staphylococcus aureus
TAVHQIEQNANTLNLAMHGLRE

SEQ ID NO: 1700139 - protein, 19 aa, Staphylococcus aureus
TAYIEPYGQLFEYGFNIDH

SEQ ID NO: 1700140 - protein, 24 aa, Staphylococcus aureus
TAYNPKMHHLIDTEQFKMMKSTVY

SEQ ID NO: 1700141 - protein, 22 aa, Staphylococcus aureus
TCKECLFYPYLLVQGEAGIGKS

SEQ ID NO: 1700142 - protein, 19 aa, Staphylococcus aureus
TCKFILKSVVQVEDNIERE

SEQ ID NO: 1700143 - protein, 19 aa, Staphylococcus aureus
TCYQFNVPFVVVRAVSDLA

SEQ ID NO: 1700144 - protein, 23 aa, Staphylococcus aureus
TDANLDYLSTLKPYITCVCAELN

SEQ ID NO: 1700145 - protein, 38 aa, Staphylococcus aureus
TDDERLVRDFLHDAFFFINIAEIILFIEKQYDIDEKLQ

SEQ ID NO: 1700146 - protein, 38 aa, Staphylococcus aureus
TDDERLVRDFLHDAFFFINIAEIILFIEKQYGIDEQLQ

SEQ ID NO: 1700147 - protein, 24 aa, Staphylococcus aureus
TDDKDTFKLLDSKSTFVVYDTSLD

SEQ ID NO: 1700148 - protein, 26 aa, Staphylococcus aureus
TDDNLTMILHEFLPFIEIKQVPTSSA

SEQ ID NO: 1700149 - protein, 23 aa, Staphylococcus aureus
TDERQVFYFYSTSQKKLLDKITK

SEQ ID NO: 1700150 - protein, 17 aa, Staphylococcus aureus
TDEYYLHLFDVSQADLN

SEQ ID NO: 1700151 - protein, 34 aa, Staphylococcus aureus
TDGAHIQVLLLTFFFKYMKPLVQADRVFIALPPL

SEQ ID NO: 1700152 - protein, 17 aa, Staphylococcus aureus
TDGGLSWSDDHKSLIYR

SEQ ID NO: 1700153 - protein, 26 aa, Staphylococcus aureus
TDGLNAILGFLVLTGVIQDPTTKGIG

SEQ ID NO: 1700154 - protein, 26 aa, Staphylococcus aureus
TDIDYPITIVFQASCFNEFVVKGRLS

SEQ ID NO: 1700155 - protein, 27 aa, Staphylococcus aureus
TDINPYIKNMMYVLANNRHISLIADVF

SEQ ID NO: 1700156 - protein, 18 aa, Staphylococcus aureus
TDKDWQITGIPRTLHIEN

SEQ ID NO: 1700157 - protein, 23 aa, Staphylococcus aureus
TDKITWNWKGVFYPNPEKAIRVR

SEQ ID NO: 1700158 - protein, 23 aa, Staphylococcus aureus
TDKPSMLKRIFSRAKSSINEIFS

SEQ ID NO: 1700159 - protein, 26 aa, Staphylococcus aureus
TDLYYNTMLELIKPLGHITTIVAFNE

SEQ ID NO: 1700160 - protein, 17 aa, Staphylococcus aureus
TDNLLVLKTLPGNAQSI

SEQ ID NO: 1700161 - protein, 30 aa, Staphylococcus aureus; identical to SEQ ID NO: 1594901

SEQ ID NO: 1700162 - protein, 21 aa, Staphylococcus aureus
TDQLWWSYRETFTGGVTPAAK

SEQ ID NO: 1700163 - protein, 23 aa, Staphylococcus aureus
TDSQYFLRRFLKYTGQNEITKIN

SEQ ID NO: 1700164 - protein, 17 aa, Staphylococcus aureus
TDVRFQPGQVLTVVHNN

SEQ ID NO: 1700165 - protein, 24 aa, Staphylococcus aureus
TEAQALDQLMDALQQSIADKDATR

SEQ ID NO: 1700166 - protein, 25 aa, Staphylococcus aureus
TEARTLKFFKFFYTHRGPVMDYTNQ

SEQ ID NO: 1700167 - protein, 37 aa, Staphylococcus aureus
TEDVEKALAMKAPLGIFSHQLQRFIHLVWDVRNVIND

SEQ ID NO: 1700168 - protein, 29 aa, Staphylococcus aureus
TEEKEAFTNALEYILSKATEDISDQTTNA

SEQ ID NO: 1700169 - protein, 23 aa, Staphylococcus aureus
TEEVQESIFTKADKRELITAKNH

SEQ ID NO: 1700170 - protein, 23 aa, Staphylococcus aureus
TEFLMDHRHLWLRSKKQHAVMKI

SEQ ID NO: 1700171 - protein, 24 aa, Staphylococcus aureus
TEGAIYEGFLEYARNFKKYEGKDK

SEQ ID NO: 1700172 - protein, 26 aa, Staphylococcus aureus
TEGFARCIPMIFLNPAPGQELENALY

SEQ ID NO: 1700173 - protein, 22 aa, Staphylococcus aureus
TEGLLKEIEDVYKKARAFDEIL

SEQ ID NO: 1700174 - protein, 27 aa, Staphylococcus aureus
TEHKLMFQATQLLLDYIHHTQKRDLSH

SEQ ID NO: 1700175 - protein, 25 aa, Staphylococcus aureus
TEIERIILQMYAEIAKELLAFYAKY

SEQ ID NO: 1700176 - protein, 26 aa, Staphylococcus aureus
TEIERLRYLVDNDFYFNVFDIYSEAD

SEQ ID NO: 1700177 - protein, 24 aa, Staphylococcus aureus
TEIESLLFNLLDSPVKYTKHIGGT

SEQ ID NO: 1700178 - protein, 25 aa, Staphylococcus aureus
TEIKNFKFFVQYGNFKDLSKYKDGD

SEQ ID NO: 1700179 - protein, 26 aa, Staphylococcus aureus
TEIVDKLVEIFWSGPLNIILKNKTSY

SEQ ID NO: 1700180 - protein, 24 aa, Staphylococcus aureus
TEKQWDLLHLLERELQQLGLPTDL

SEQ ID NO: 1700181 - protein, 29 aa, Staphylococcus aureus
TELEPLEKYAYIVRLVFAGSTTTEPIVSS

SEQ ID NO: 1700182 - protein, 26 aa, Staphylococcus aureus
TELGAFFIKQLYQHGDLFFSDRNVYT

SEQ ID NO: 1700183 - protein, 23 aa, Staphylococcus aureus
TELRQWFQHDPKLFGAFKEKYEK

SEQ ID NO: 1700184 - protein, 23 aa, Staphylococcus aureus
TEPKIKLYVSLKCPDFDDVAQKI

SEQ ID NO: 1700185 - protein, 28 aa, Staphylococcus aureus
TEQFVADLIKKYALPVQFIIVNEAGASV

SEQ ID NO: 1700186 - protein, 24 aa, Staphylococcus aureus
TEQPDLLTMMSFDGKLFSAKFAEL

SEQ ID NO: 1700187 - protein, 20 aa, Staphylococcus aureus
TERQGGYTRILKQGPRRGDG

SEQ ID NO: 1700188 - protein, 25 aa, Staphylococcus aureus
TESQQQWLSGFLLANSNDTTSDSNQ

SEQ ID NO: 1700189 - protein, 32 aa, Staphylococcus aureus
TETFETNVYPLFWTVQKALEYLKPGASITTTS

SEQ ID NO: 1700190 - protein, 23 aa, Staphylococcus aureus
TETGIFVTIIRSFSHFSNQLFPP

SEQ ID NO: 1700191 - protein, 26 aa, Staphylococcus aureus
TEVAPLKYKQKLPCAFCSYQSVCHVD

SEQ ID NO: 1700192 - protein, 29 aa, Staphylococcus aureus
TEVDELQNVTIPAIEAIVPQKDPNANDTN

SEQ ID NO: 1700193 - protein, 24 aa, Staphylococcus aureus
TEYDYYPTMFYKRGKKSFVIHIKK

SEQ ID NO: 1700194 - protein, 22 aa, Staphylococcus aureus
TEYPVLLATSRKRFTKKMMGYD

SEQ ID NO: 1700195 - protein, 19 aa, Staphylococcus aureus
TFDFINGHGGFLNEDFRLF

SEQ ID NO: 1700196 - protein, 24 aa, Staphylococcus aureus
TFDNWFNMYIDEVKDHLLLELTVI

SEQ ID NO: 1700197 - protein, 17 aa, Staphylococcus aureus
TFEDIPLLDLALSDEKA

SEQ ID NO: 1700198 - protein, 17 aa, Staphylococcus aureus
TFEDIPLLDLALSDEKV

SEQ ID NO: 1700199 - protein, 19 aa, Staphylococcus aureus
TFEHIEVSQLIVVKKDGAR

SEQ ID NO: 1700200 - protein, 20 aa, Staphylococcus aureus
TFGITIMMITHKMRVIKDIC

SEQ ID NO: 1700201 - protein, 19 aa, Staphylococcus aureus
TFISWTRGLTQKFSKGKNI

SEQ ID NO: 1700202 - protein, 19 aa, Staphylococcus aureus
TFKPLHIFSDLSSKMFTWN

SEQ ID NO: 1700203 - protein, 20 aa, Staphylococcus aureus
TFLCRFNVAILDDGYYLPMD

SEQ ID NO: 1700204 - protein, 24 aa, Staphylococcus aureus
TFLHNIIFDVARHHRPDQAHMYLF

SEQ ID NO: 1700205 - protein, 19 aa, Staphylococcus aureus
TFLNHLAGINLKLFKDYVN

SEQ ID NO: 1700206 - protein, 27 aa, Staphylococcus aureus
TFLNKDLLTLYLVYMNLLDSMEDFGLP

SEQ ID NO: 1700207 - protein, 18 aa, Staphylococcus aureus
TFMFDKTAKKFATEQEDN

SEQ ID NO: 1700208 - protein, 18 aa, Staphylococcus aureus
TFMFDKTAQKFATEQEDN

SEQ ID NO: 1700209 - protein, 26 aa, Staphylococcus aureus
TFPESEIIFITLHLLGSKMTDCTIST

SEQ ID NO: 1700210 - protein, 23 aa, Staphylococcus aureus
TFPTFLEMLMATYKLIQKAKVEG

SEQ ID NO: 1700211 - protein, 20 aa, Staphylococcus aureus
TFQDFDINYNGDTKVMTVKY

SEQ ID NO: 1700212 - protein, 21 aa, Staphylococcus aureus
TFQLIKLFQKRINLGQSIVMV

SEQ ID NO: 1700213 - protein, 20 aa, Staphylococcus aureus
TFRILIKNLIYNKIKQQPYN

SEQ ID NO: 1700214 - protein, 24 aa, Staphylococcus aureus
TFSHKFFVSKSWINNAPTKEDIAI

SEQ ID NO: 1700215 - protein, 32 aa, Staphylococcus aureus
TFSQEEVSQLIKERIARERKKSDERIKDAKES

SEQ ID NO: 1700216 - protein, 21 aa, Staphylococcus aureus
TFTSPFIETFNERIGLNGVPI

SEQ ID NO: 1700217 - protein, 29 aa, Staphylococcus aureus
TFVKTVRIVLMHDWLKGKIIVDSLGLHSN

SEQ ID NO: 1700218 - protein, 21 aa, Staphylococcus aureus
TGAAYIEPYGQLFEYGFNIDH

SEQ ID NO: 1700219 - protein, 26 aa, Staphylococcus aureus
TGANEWNWYMHLSKQLVRQGQRIKAG

SEQ ID NO: 1700220 - protein, 25 aa, Staphylococcus aureus
TGATVSVIYVPAPFAADSILEAADA

SEQ ID NO: 1700221 - protein, 17 aa, Staphylococcus aureus
TGDMFRKAIKEETELGK

SEQ ID NO: 1700222 - protein, 29 aa, Staphylococcus aureus
TGDVKDVVLLDVTPLSLGIEILGGRMNTL

SEQ ID NO: 1700223 - protein, 17 aa, Staphylococcus aureus
TGDYNFPKKPFKYGIHY

SEQ ID NO: 1700224 - protein, 24 aa, Staphylococcus aureus
TGFALNMMLNIARNGYKTSFFSLE

SEQ ID NO: 1700225 - protein, 30 aa, Staphylococcus aureus
TGIVIFAKYGYIHHLFSKVNLKKIYTCLVY

SEQ ID NO: 1700226 - protein, 33 aa, Staphylococcus aureus
TGKGKSFLAKLLWLYTSFFKGQMIYWDPKSEFA

SEQ ID NO: 1700227 - protein, 25 aa, Staphylococcus aureus
TGKKPASITAYNNSIRALQSDLTSA

SEQ ID NO: 1700228 - protein, 24 aa, Staphylococcus aureus
TGKNALLSDSLLRDIKVLSSNVKG

SEQ ID NO: 1700229 - protein, 23 aa, Staphylococcus aureus
TGKTFLAVVYAAKQLRKVAVKRI

SEQ ID NO: 1700230 - protein, 30 aa, Staphylococcus aureus
TGKTGAFGIPLIEKVVWKQGVQSLILAPTR

SEQ ID NO: 1700231 - protein, 32 aa, Staphylococcus aureus
TGKTITATALQWLLFDKGLDGSTKSFNPVPLN

SEQ ID NO: 1700232 - protein, 18 aa, Staphylococcus aureus
TGKVIIGMTGTNFKKEAL

SEQ ID NO: 1700233 - protein, 18 aa, Staphylococcus aureus
TGKWLAMEWEQVVPDIYI

SEQ ID NO: 1700234 - protein, 21 aa, Staphylococcus aureus
TGKYFGPYPNAYSAQETKKLL

SEQ ID NO: 1700235 - protein, 22 aa, Staphylococcus aureus
TGKYFGPYPNAYSAQETKKLLD

SEQ ID NO: 1700236 - protein, 22 aa, Staphylococcus aureus
TGLIKANIPTRIAFMVSSSVDS

SEQ ID NO: 1700237 - protein, 25 aa, Staphylococcus aureus
TGPVTILNWSFERVDLPRKVVQDQI

SEQ ID NO: 1700238 - protein, 23 aa, Staphylococcus aureus
TGQLLFHLFAAFAEFERNLILER

SEQ ID NO: 1700239 - protein, 26 aa, Staphylococcus aureus
TGQTYDWTILKHIKDIPYLIAGGINS

SEQ ID NO: 1700240 - protein, 24 aa, Staphylococcus aureus
TGRINGIKFDYINKLPKNGKIILK

SEQ ID NO: 1700241 - protein, 19 aa, Staphylococcus aureus
TGRMRYLGVLLYDADRVHE

SEQ ID NO: 1700242 - protein, 21 aa, Staphylococcus aureus
TGSLYLSLISLLQNHTFQPEE

SEQ ID NO: 1700243 - protein, 17 aa, Staphylococcus aureus
TGSRPIEIPNFKFGKRV

SEQ ID NO: 1700244 - protein, 26 aa, Staphylococcus aureus
TGTDSNFQILLYDAKHFNPYLALDNQ

SEQ ID NO: 1700245 - protein, 29 aa, Staphylococcus aureus
TGTPIHPMSPLAKIFWMKHEWQDVFQRTT

SEQ ID NO: 1700246 - protein, 29 aa, Staphylococcus aureus
TGTPIHPMSPLVKIFWMKHEWQDVFQRTA

SEQ ID NO: 1700247 - protein, 20 aa, Staphylococcus aureus
TGYIYQEIILRPVDEVKVLL

SEQ ID NO: 1700248 - protein, 19 aa, Staphylococcus aureus
THCVTRLRLVLKDESKVDK

SEQ ID NO: 1700249 - protein, 28 aa, Staphylococcus aureus
THEADGVFIYIGMKPLTALFKDLGITND

SEQ ID NO: 1700250 - protein, 26 aa, Staphylococcus aureus
THEQFEEWWKLYNKKKDKKMSFAKFK

SEQ ID NO: 1700251 - protein, 24 aa, Staphylococcus aureus
THETLKRYLLEETFELFEAIDNED

SEQ ID NO: 1700252 - protein, 27 aa, Staphylococcus aureus
THEVRRKLLGLGGYYETTIQRKDKRKL

SEQ ID NO: 1700253 - protein, 19 aa, Staphylococcus aureus
THFDNWFSETSLYEKCEIL

SEQ ID NO: 1700254 - protein, 19 aa, Staphylococcus aureus
THGLRFYMKKGFLMIELPS

SEQ ID NO: 1700255 - protein, 25 aa, Staphylococcus aureus
THISLVPQTLNWLMQQGLHEPHDLQ

SEQ ID NO: 1700256 - protein, 31 aa, Staphylococcus aureus
THISLVPQTLNWLMQQGLHEPYDLQKILLGG

SEQ ID NO: 1700257 - protein, 17 aa, Staphylococcus aureus
THKKQIHFLNYMKTKNL

SEQ ID NO: 1700258 - protein, 18 aa, Staphylococcus aureus
THLLIDAMTLDNALTQVS

SEQ ID NO: 1700259 - protein, 25 aa, Staphylococcus aureus
THNPNVFYELGYRHALERPTITMIN

SEQ ID NO: 1700260 - protein, 25 aa, Staphylococcus aureus
THPDFIVPMPHRIFDFYNAFIGTSD

SEQ ID NO: 1700261 - protein, 18 aa, Staphylococcus aureus
THPLMRRLIEQRICDALA

SEQ ID NO: 1700262 - protein, 20 aa, Staphylococcus aureus
THQLKQLDIVYYFGNVTVGS

SEQ ID NO: 1700263 - protein, 26 aa, Staphylococcus aureus
THYMGIPIEESFLKLADRPLDEVALA

SEQ ID NO: 1700264 - protein, 26 aa, Staphylococcus aureus
TIAQVMTVLFNFDKTKTFSAPNGYNI

SEQ ID NO: 1700265 - protein, 27 aa, Staphylococcus aureus
TICHGLSSQILMLMTMNLHFESNEVSD

SEQ ID NO: 1700266 - protein, 21 aa, Staphylococcus aureus
TIDMVLMINGIPLVALELKNQ

SEQ ID NO: 1700267 - protein, 24 aa, Staphylococcus aureus
TIDPEIYNLGIPALGICYGMQLTT

SEQ ID NO: 1700268 - protein, 18 aa, Staphylococcus aureus
TIDSMPYIDAERLYHFAM

SEQ ID NO: 1700269 - protein, 27 aa, Staphylococcus aureus
TIEANDAWKKLVDKLKEKHIVKVGDKV

SEQ ID NO: 1700270 - protein, 17 aa, Staphylococcus aureus
TIEDGVVCFYSRSKQRL

SEQ ID NO: 1700271 - protein, 25 aa, Staphylococcus aureus
TIEHPYPLNVFTLNIATYIFRHREE

SEQ ID NO: 1700272 - protein, 18 aa, Staphylococcus aureus
TIFLTDIENMGFSKSSLD

SEQ ID NO: 1700273 - protein, 17 aa, Staphylococcus aureus
TIFNYLGENLKFEKSRQ

SEQ ID NO: 1700274 - protein, 19 aa, Staphylococcus aureus
TIFSKYRWNKSFKAYKRSS

SEQ ID NO: 1700275 - protein, 18 aa, Staphylococcus aureus
TIGKLAYRYKMEGKKVML

SEQ ID NO: 1700276 - protein, 20 aa, Staphylococcus aureus
TIGWLVVQRGFEIPSFNFVT

SEQ ID NO: 1700277 - protein, 18 aa, Staphylococcus aureus
TIHAIPLKMKDPLNVEVR

SEQ ID NO: 1700278 - protein, 21 aa, Staphylococcus aureus
TIHWQFGHVLTIFESALAVAS

SEQ ID NO: 1700279 - protein, 19 aa, Staphylococcus aureus
TIIDEFFGEIGQQRPTSIP

SEQ ID NO: 1700280 - protein, 26 aa, Staphylococcus aureus
TIIFASPVYWYSISSPLKAFIEHWSE

SEQ ID NO: 1700281 - protein, 18 aa, Staphylococcus aureus
TIIKYTIKNGRYSETFIA

SEQ ID NO: 1700282 - protein, 23 aa, Staphylococcus aureus
TIKDLIVVFLLNKYNYIKNKDDF

SEQ ID NO: 1700283 - protein, 23 aa, Staphylococcus aureus
TIKDRLLFHPRFEKELRAQGIVH

SEQ ID NO: 1700284 - protein, 19 aa, Staphylococcus aureus
TIKFKGFMTLYVETKDDID

SEQ ID NO: 1700285 - protein, 24 aa, Staphylococcus aureus
TIKKPIDYFVAPVSTTGSIMGMSR

SEQ ID NO: 1700286 - protein, 21 aa, Staphylococcus aureus
TIKQRALNRMAVNTVAAPQQG

SEQ ID NO: 1700287 - protein, 17 aa, Staphylococcus aureus
TIKVVLTDPYKYSVTGN

SEQ ID NO: 1700288 - protein, 27 aa, Staphylococcus aureus
TILDSARFRLLLSEAFDVAPRSVDAQI

SEQ ID NO: 1700289 - protein, 29 aa, Staphylococcus aureus
TILKYVKEGILYPLSYYDSDWYGEDKVKS

SEQ ID NO: 1700290 - protein, 20 aa, Staphylococcus aureus
TILLVLEKGEDIIECITTFA

SEQ ID NO: 1700291 - protein, 19 aa, Staphylococcus aureus
TILLVLEKGEDIVECITIF

SEQ ID NO: 1700292 - protein, 17 aa, Staphylococcus aureus
TIMYKVHLMKECLDREI

SEQ ID NO: 1700293 - protein, 23 aa, Staphylococcus aureus
TINDWLVIGYTPLSLFNPKESDF

SEQ ID NO: 1700294 - protein, 26 aa, Staphylococcus aureus
TINKKFMYYNLLSNMFWNWYNSNNQG

SEQ ID NO: 1700295 - protein, 33 aa, Staphylococcus aureus
TINKPYLLEAPFWTVDTLFYCTPKKETDILFIL

SEQ ID NO: 1700296 - protein, 22 aa, Staphylococcus aureus
TINYEVLCNLSRRLPRIYHDGD

SEQ ID NO: 1700297 - protein, 17 aa, Staphylococcus aureus
TIRDVFGYSVDKGWMCI

SEQ ID NO: 1700298 - protein, 19 aa, Staphylococcus aureus
TIRDVFGYSVDKGWMCIQV

SEQ ID NO: 1700299 - protein, 23 aa, Staphylococcus aureus
TIRLDRTYLNIPELRKRIKLVAE

SEQ ID NO: 1700300 - protein, 18 aa, Staphylococcus aureus
TISDSLTAKVEVTLLDGS

SEQ ID NO: 1700301 - protein, 24 aa, Staphylococcus aureus
TISYPLPDNQLLTQLFTELEEGAV

SEQ ID NO: 1700302 - protein, 18 aa, Staphylococcus aureus
TIVKMFVNLSEGFEDGVR

SEQ ID NO: 1700303 - protein, 17 aa, Staphylococcus aureus
TIVLSHDVKLLILDEAT

SEQ ID NO: 1700304 - protein, 18 aa, Staphylococcus aureus
TIVNNAKRLNISFEKENG

SEQ ID NO: 1700305 - protein, 17 aa, Staphylococcus aureus
TIVSLLEKVGLGQSFLY

SEQ ID NO: 1700306 - protein, 18 aa, Staphylococcus aureus
TIVVVFPDGSDRYMSKQI

SEQ ID NO: 1700307 - protein, 26 aa, Staphylococcus aureus
TIYENAYPILKKYKIPATGFIITGHV

SEQ ID NO: 1700308 - protein, 18 aa, Staphylococcus aureus
TKAALNGTQNLEKAKQHA

SEQ ID NO: 1700309 - protein, 21 aa, Staphylococcus aureus
TKAALNGTQNLEKAKQHANTA

SEQ ID NO: 1700310 - protein, 25 aa, Staphylococcus aureus
TKALFEKWFHPKDASTKVFRFNAVS

SEQ ID NO: 1700311 - protein, 23 aa, Staphylococcus aureus
TKDDFIIKTLPKDSYQLSEDNDC

SEQ ID NO: 1700312 - protein, 18 aa, Staphylococcus aureus
TKDNCFISIMAGIPIDYI

SEQ ID NO: 1700313 - protein, 26 aa, Staphylococcus aureus
TKDQQYILSVLYKDYLESVKLGSVKL

SEQ ID NO: 1700314 - protein, 30 aa, Staphylococcus aureus
TKEDFQNLILLFLESWYLKASFSQKFGAVE

SEQ ID NO: 1700315 - protein, 19 aa, Staphylococcus aureus
TKEGLFTKGLRRRTKLLET

SEQ ID NO: 1700316 - protein, 27 aa, Staphylococcus aureus
TKELHANEIILLSYYIAAINIETTFNE

SEQ ID NO: 1700317 - protein, 35 aa, Staphylococcus aureus; identical to SEQ ID NO: 1598581

SEQ ID NO: 1700318 - protein, 25 aa, Staphylococcus aureus
TKEQLKIFVYDYDTNLIKNIMVAAD

SEQ ID NO: 1700319 - protein, 25 aa, Staphylococcus aureus
TKEQLKIFVYDYDTNLIKNVMVAAD

SEQ ID NO: 1700320 - protein, 23 aa, Staphylococcus aureus
TKFNILQFILDLSLKDSKLTNRC

SEQ ID NO: 1700321 - protein, 23 aa, Staphylococcus aureus
TKGKPLITAKDLIKTEFENSNDY

SEQ ID NO: 1700322 - protein, 18 aa, Staphylococcus aureus
TKHAWFVEDRFVKKELET

SEQ ID NO: 1700323 - protein, 18 aa, Staphylococcus aureus
TKHAWFVEDRFVKNELET

SEQ ID NO: 1700324 - protein, 19 aa, Staphylococcus aureus
TKHAWFVEDRFVKNELETK

SEQ ID NO: 1700325 - protein, 24 aa, Staphylococcus aureus
TKHEHFVFVIPVSETLDMKKAAAL

SEQ ID NO: 1700326 - protein, 35 aa, Staphylococcus aureus
TKHLVDILDLLSAKGISLYIINLNKNLIADTNENF

SEQ ID NO: 1700327 - protein, 18 aa, Staphylococcus aureus
TKIAKIKPPITGAGIQIR

SEQ ID NO: 1700328 - protein, 24 aa, Staphylococcus aureus
TKIQEIDRVLASHPDVATIRQNVT

SEQ ID NO: 1700329 - protein, 19 aa, Staphylococcus aureus
TKKFNEMWLNTDKMHYYLN

SEQ ID NO: 1700330 - protein, 24 aa, Staphylococcus aureus
TKKGYFPMWVTMNVLTLGNIVNMY

SEQ ID NO: 1700331 - protein, 21 aa, Staphylococcus aureus
TKLLHTIIKNFGEHNLTFAIE

SEQ ID NO: 1700332 - protein, 29 aa, Staphylococcus aureus
TKRLAQDPALKYQFLRLDQPQNISIDKIN

SEQ ID NO: 1700333 - protein, 22 aa, Staphylococcus aureus
TKSSFYYDLFDFKVKKRVDFLK

SEQ ID NO: 1700334 - protein, 27 aa, Staphylococcus aureus
TKTATYKVVRTVPKQVFETARGVLYPG

SEQ ID NO: 1700335 - protein, 22 aa, Staphylococcus aureus
TKTFFEYFLRIVNKTHDYAILE

SEQ ID NO: 1700336 - protein, 30 aa, Staphylococcus aureus
TKTQYTDLLFLYLEHAILSQDFFDIPSIHS

SEQ ID NO: 1700337 - protein, 17 aa, Staphylococcus aureus
TKVPAVLLELGYISNPT

SEQ ID NO: 1700338 - protein, 22 aa, Staphylococcus aureus
TKYELDVAPMFKSLIGKDISEE

SEQ ID NO: 1700339 - protein, 25 aa, Staphylococcus aureus
TLDMRLRYMLLPMCLDIEHSLKTDI

SEQ ID NO: 1700340 - protein, 32 aa, Staphylococcus aureus
TLDYDIVFSPMFVLTHKKLFITKVALSENEQR

SEQ ID NO: 1700341 - protein, 23 aa, Staphylococcus aureus
TLEAWIELYLATFRLNNIAYSTY

SEQ ID NO: 1700342 - protein, 17 aa, Staphylococcus aureus
TLGIITRGDGLSDYPKN

SEQ ID NO: 1700343 - protein, 23 aa, Staphylococcus aureus
TLGKSGLLVVYVVDDSTARATWY

SEQ ID NO: 1700344 - protein, 20 aa, Staphylococcus aureus
TLHQFPIDYVFPLMGQTITT

SEQ ID NO: 1700345 - protein, 17 aa, Staphylococcus aureus
TLHTPLTPKTKGLINAD

SEQ ID NO: 1700346 - protein, 31 aa, Staphylococcus aureus
TLIEFDRSWEKIGVRLVQSLLETFPVHNKEA

SEQ ID NO: 1700347 - protein, 27 aa, Staphylococcus aureus
TLIYVFEIIDGWCRIYWNNHNEWIWHE

SEQ ID NO: 1700348 - protein, 25 aa, Staphylococcus aureus
TLIYVFEIIDGWCRIYWNNHNEWVW

SEQ ID NO: 1700349 - protein, 27 aa, Staphylococcus aureus
TLIYVFEIINGWCRIYWNNHNEWIWHE

SEQ ID NO: 1700350 - protein, 33 aa, Staphylococcus aureus
TLLNEDKVEWIILAGYMRLIGPDLLDSFEGKIL

SEQ ID NO: 1700351 - protein, 18 aa, Staphylococcus aureus
TLMTSFFVDKKPLTPKEQ

SEQ ID NO: 1700352 - protein, 18 aa, Staphylococcus aureus
TLMTSFFVDKNPLTPKEQ

SEQ ID NO: 1700353 - protein, 23 aa, Staphylococcus aureus
TLNEAMNQLRQSIASKDATKASE

SEQ ID NO: 1700354 - protein, 26 aa, Staphylococcus aureus
TLNFYNIDEQLIFVDVPGYGYAKVSK

SEQ ID NO: 1700355 - protein, 24 aa, Staphylococcus aureus
TLNGNGNVLIIYQGAHAYVSSSWY

SEQ ID NO: 1700356 - protein, 19 aa, Staphylococcus aureus
TLNILPKHLTIIKVAPLFS

SEQ ID NO: 1700357 - protein, 31 aa, Staphylococcus aureus
TLNLNESLDQFILLIFYGTFPGGDFTEFGNP

SEQ ID NO: 1700358 - protein, 22 aa, Staphylococcus aureus
TLNQAMNQLRQSIASKDATKSS

SEQ ID NO: 1700359 - protein, 25 aa, Staphylococcus aureus
TLPCSTGLEGFLGSSFAGGTGLPGS

SEQ ID NO: 1700360 - protein, 31 aa, Staphylococcus aureus
TLPCSTGLEGFLGSSFAGGTGLPGSAGTSGV

SEQ ID NO: 1700361 - protein, 21 aa, Staphylococcus aureus
TLRLYEMFMGPLDAAIAWSEK

SEQ ID NO: 1700362 - protein, 19 aa, Staphylococcus aureus
TLRYYICPKNMNESRFVCS

SEQ ID NO: 1700363 - protein, 25 aa, Staphylococcus aureus
TLSKRPFNVFMTPSDKKRMMDRKKH

SEQ ID NO: 1700364 - protein, 19 aa, Staphylococcus aureus
TLTFHTLLDEWLEYHIKTS

SEQ ID NO: 1700365 - protein, 18 aa, Staphylococcus aureus
TLTHLIAGVYQPTIGTIS

SEQ ID NO: 1700366 - protein, 18 aa, Staphylococcus aureus
TLTIFRVFIIDSQALKRS

SEQ ID NO: 1700367 - protein, 18 aa, Staphylococcus aureus
TLYGLKRLNYQGVATVCG

SEQ ID NO: 1700368 - protein, 28 aa, Staphylococcus aureus
TMASITFQNYFRMYNKLAGMTGTAKTEE

SEQ ID NO: 1700369 - protein, 24 aa, Staphylococcus aureus
TMAVVLPHGILFRGAAEGVIRRYL

SEQ ID NO: 1700370 - protein, 17 aa, Staphylococcus aureus
TMGHFDAIVGRRVLMYL

SEQ ID NO: 1700371 - protein, 23 aa, Staphylococcus aureus
TMGRDCGDLALWAGLSVGAETIV

SEQ ID NO: 1700372 - protein, 24 aa, Staphylococcus aureus
TMMELTRILGYYNITLYEFIENNK

SEQ ID NO: 1700373 - protein, 38 aa, Staphylococcus aureus
TMNEMLMANYLFNTSDKPRFKRWVIGSILSRTYYHNMV

SEQ ID NO: 1700374 - protein, 27 aa, Staphylococcus aureus
TMNKNVFKNLWLIAWEMTYESQVKQKI

SEQ ID NO: 1700375 - protein, 27 aa, Staphylococcus aureus
TMNKNVLKNLWLIAWEMTYESQLKQKI

SEQ ID NO: 1700376 - protein, 26 aa, Staphylococcus aureus
TMPEKAYLYSLPYHYYKDYGIRKYGF

SEQ ID NO: 1700377 - protein, 17 aa, Staphylococcus aureus
TMRLKESGLILGIDLLD

SEQ ID NO: 1700378 - protein, 17 aa, Staphylococcus aureus
TMRSVESNSWENEKNKK

SEQ ID NO: 1700379 - protein, 22 aa, Staphylococcus aureus
TMYHSPIRLLVVIQAPDYVVTR

SEQ ID NO: 1700380 - protein, 21 aa, Staphylococcus aureus
TMYSFGTIPRGDTGYFFNQAY

SEQ ID NO: 1700381 - protein, 22 aa, Staphylococcus aureus
TNADVAYLLHDGKNEIREIEPV

SEQ ID NO: 1700382 - protein, 27 aa, Staphylococcus aureus
TNAGQSVTYYFTDVKAPTVTVGNQTIE

SEQ ID NO: 1700383 - protein, 17 aa, Staphylococcus aureus
TNAVSHAEGILSKANGS

SEQ ID NO: 1700384 - protein, 24 aa, Staphylococcus aureus
TNDKEVLSLNYLPSLKFDYAQNEA

SEQ ID NO: 1700385 - protein, 29 aa, Staphylococcus aureus
TNDRLLKHDLLFHDMFVNVASKKDFKVEF

SEQ ID NO: 1700386 - protein, 24 aa, Staphylococcus aureus
TNEILQLLLLKIDLNFYPQFCKDM

SEQ ID NO: 1700387 - protein, 28 aa, Staphylococcus aureus
TNEVQDLLIPLTFHFSKDEQLVIDQYKN

SEQ ID NO: 1700388 - protein, 27 aa, Staphylococcus aureus
TNGLDIPAISWLEDFLINFDNTVIVVS

SEQ ID NO: 1700389 - protein, 24 aa, Staphylococcus aureus
TNGVSAIKIIQPETKVKPAAREKI

SEQ ID NO: 1700390 - protein, 26 aa, Staphylococcus aureus
TNGVSYLAVTQWWVASLNPPHLKAMI

SEQ ID NO: 1700391 - protein, 19 aa, Staphylococcus aureus
TNIAQLEDLFIITSTHGEG

SEQ ID NO: 1700392 - protein, 22 aa, Staphylococcus aureus
TNIDFMSDYYFYLIEIGQMEQA

SEQ ID NO: 1700393 - protein, 26 aa, Staphylococcus aureus
TNIDYPIAIVFQASCFNEFVVKGRLS

SEQ ID NO: 1700394 - protein, 21 aa, Staphylococcus aureus
TNIEIIYLKSCDLTTILHNLY

SEQ ID NO: 1700395 - protein, 26 aa, Staphylococcus aureus
TNKDFENFYLLTCNMTDSLNRQLENC

SEQ ID NO: 1700396 - protein, 25 aa, Staphylococcus aureus
TNKGDMTFKLFLNIAPKTVENFVTH

SEQ ID NO: 1700397 - protein, 29 aa, Staphylococcus aureus
TNKKDMDWIKKNYDLYSKLIAGAIHGKPI

SEQ ID NO: 1700398 - protein, 20 aa, Staphylococcus aureus
TNKLVLYVPTYREDKADNRA

SEQ ID NO: 1700399 - protein, 21 aa, Staphylococcus aureus
TNKWYFSIRYKDVYGNNKRKM

SEQ ID NO: 1700400 - protein, 23 aa, Staphylococcus aureus
TNLDGTRLLDQAKQTAKQQLNNM

SEQ ID NO: 1700401 - protein, 23 aa, Staphylococcus aureus
TNLGMLTEPGLYYLYTDHTVQID

SEQ ID NO: 1700402 - protein, 22 aa, Staphylococcus aureus
TNLLTGIVHCPQCGAPMAASNT

SEQ ID NO: 1700403 - protein, 22 aa, Staphylococcus aureus
TNLYEITKPYIAEGRRYTGSFT

SEQ ID NO: 1700404 - protein, 18 aa, Staphylococcus aureus
TNPLSAIIDAKLTMVMSG

SEQ ID NO: 1700405 - protein, 22 aa, Staphylococcus aureus
TNQKILLPSSELARPLLSAALS

SEQ ID NO: 1700406 - protein, 25 aa, Staphylococcus aureus
TNSKAMKSLGLQTLFLGTTTGKTSK

SEQ ID NO: 1700407 - protein, 25 aa, Staphylococcus aureus
TNTERRIQRLYQALEPLGDSKPDWK

SEQ ID NO: 1700408 - protein, 25 aa, Staphylococcus aureus
TNTIDGLPNLTQLQKDNLKHQVEQA

SEQ ID NO: 1700409 - protein, 24 aa, Staphylococcus aureus
TNTINGLPNLTQLQKDNLKHQVEQ

SEQ ID NO: 1700410 - protein, 25 aa, Staphylococcus aureus
TNTINGLPNLTQLQKDNLKHQVEQA

SEQ ID NO: 1700411 - protein, 26 aa, Staphylococcus aureus
TNVKKLRDIYPITTKKAPILKLHIDG

SEQ ID NO: 1700412 - protein, 19 aa, Staphylococcus aureus
TNVLIAKLQAIYRRVYEFT

SEQ ID NO: 1700413 - protein, 19 aa, Staphylococcus aureus
TPEFKLQMVRLFENGKSKS

SEQ ID NO: 1700414 - protein, 24 aa, Staphylococcus aureus
TPELGNIIKYYLKCHWSPEQIVGR

SEQ ID NO: 1700415 - protein, 31 aa, Staphylococcus aureus
TPGQKKLYVLAKILNVSEAWLLGYDVESKRI

SEQ ID NO: 1700416 - protein, 19 aa, Staphylococcus aureus
TPITLGLGAALKTSADFEG

SEQ ID NO: 1700417 - protein, 23 aa, Staphylococcus aureus
TPKAGAIMQTTQGYYGHVAYVEG

SEQ ID NO: 1700418 - protein, 26 aa, Staphylococcus aureus
TPKVSGVLALIIDKYHLEKHPDKAIE

SEQ ID NO: 1700419 - protein, 18 aa, Staphylococcus aureus
TPLIIKPSVIKGINYQME

SEQ ID NO: 1700420 - protein, 25 aa, Staphylococcus aureus
TPPENPVNDMLWYDTSNPDVAVLRR

SEQ ID NO: 1700421 - protein, 24 aa, Staphylococcus aureus
TPQIIYHVLSPNKMPVKSLLECVK

SEQ ID NO: 1700422 - protein, 21 aa, Staphylococcus aureus
TPQYTMSVWMGFSKVKPYGEN

SEQ ID NO: 1700423 - protein, 18 aa, Staphylococcus aureus
TPSRMRALLDKYGFNFKK

SEQ ID NO: 1700424 - protein, 25 aa, Staphylococcus aureus
TPYIAYKLMEIIEEAGLPKGVVNFV

SEQ ID NO: 1700425 - protein, 32 aa, Staphylococcus aureus
TPYSPQVRKLKEGFFFAALTPTLRHLGKLEAK

SEQ ID NO: 1700426 - protein, 31 aa, Staphylococcus aureus
TQDTQNALDFPLPKAFRDAGWFLDVLPGHYN

SEQ ID NO: 1700427 - protein, 27 aa, Staphylococcus aureus
TQEDISLYVINLNRYIYKDIKGEFIEI

SEQ ID NO: 1700428 - protein, 23 aa, Staphylococcus aureus
TQEEWVNLWQKALQVDYRPVVNI

SEQ ID NO: 1700429 - protein, 18 aa, Staphylococcus aureus
TQFLMKKYNIPVKSILGF

SEQ ID NO: 1700430 - protein, 25 aa, Staphylococcus aureus
TQGKAAIDAIQVDATVKPKANQAIE

SEQ ID NO: 1700431 - protein, 17 aa, Staphylococcus aureus
TQIAIPTRIAIQNQIVT

SEQ ID NO: 1700432 - protein, 27 aa, Staphylococcus aureus
TQITTNDILTLLKATTTVPGLRNNIAG

SEQ ID NO: 1700433 - protein, 17 aa, Staphylococcus aureus
TQKLPSLMKYGFSINEK

SEQ ID NO: 1700434 - protein, 18 aa, Staphylococcus aureus
TQKLPSLMKYGFSINEKY

SEQ ID NO: 1700435 - protein, 22 aa, Staphylococcus aureus
TQKYLDAEPSKKSAYDQAVNAA

SEQ ID NO: 1700436 - protein, 23 aa, Staphylococcus aureus
TQLEFQWDKYEKAIFGKIVEKVG

SEQ ID NO: 1700437 - protein, 22 aa, Staphylococcus aureus
TQLEFQWDKYEQAIFGKIVEKV

SEQ ID NO: 1700438 - protein, 40 aa, Staphylococcus aureus; identical to SEQ ID NO: 1597783

SEQ ID NO: 1700439 - protein, 26 aa, Staphylococcus aureus
TQNGKINFLLQTYLKEFRKGGISKKT

SEQ ID NO: 1700440 - protein, 20 aa, Staphylococcus aureus
TQNIVVIQPATQVKTDARNA

SEQ ID NO: 1700441 - protein, 18 aa, Staphylococcus aureus
TQNQIVIQIPTATQIHQV

SEQ ID NO: 1700442 - protein, 25 aa, Staphylococcus aureus
TQNTCLFRLLAFTGMRKGEVLALHW

SEQ ID NO: 1700443 - protein, 26 aa, Staphylococcus aureus
TQPALLTHSSALLAALKILNPDFTMG

SEQ ID NO: 1700444 - protein, 24 aa, Staphylococcus aureus
TQPALLTHSSALLAALKNLNPEFT

SEQ ID NO: 1700445 - protein, 23 aa, Staphylococcus aureus
TQQTFEHIFPYDIASTTTSLLRE

SEQ ID NO: 1700446 - protein, 17 aa, Staphylococcus aureus
TQVKQVYDEAVDKAKQA

SEQ ID NO: 1700447 - protein, 19 aa, Staphylococcus aureus
TQVKRVYDEAVDKAKEALN

SEQ ID NO: 1700448 - protein, 25 aa, Staphylococcus aureus
TREGLALGVYIILSGSRSSAIKSAI

SEQ ID NO: 1700449 - protein, 18 aa, Staphylococcus aureus
TRFIRAKATLTSAGATVV

SEQ ID NO: 1700450 - protein, 24 aa, Staphylococcus aureus
TRGVSPYKFLLSHGFVMDGEGKKM

SEQ ID NO: 1700451 - protein, 21 aa, Staphylococcus aureus
TRKKIIELIESNLTGYEISKK

SEQ ID NO: 1700452 - protein, 23 aa, Staphylococcus aureus
TRKKYDIPIIAQLTASNTNYLVN

SEQ ID NO: 1700453 - protein, 22 aa, Staphylococcus aureus
TRKKYNIPIIAQLTASNTNYLV

SEQ ID NO: 1700454 - protein, 21 aa, Staphylococcus aureus
TRLARAYNLVIPPSGRTLSGG

SEQ ID NO: 1700455 - protein, 24 aa, Staphylococcus aureus
TRLSLAQMLLNEPDLLLLDEPTNH

SEQ ID NO: 1700456 - protein, 22 aa, Staphylococcus aureus
TRNAFFIGRTIDYNVSLEGALK

SEQ ID NO: 1700457 - protein, 17 aa, Staphylococcus aureus
TRNVEVPVKVYPVANAK

SEQ ID NO: 1700458 - protein, 19 aa, Staphylococcus aureus
TRPPRLLNNDILLKFNRVS

SEQ ID NO: 1700459 - protein, 27 aa, Staphylococcus aureus
TRQLIDDFAYKHRIPWIYGGVVQSTYT

SEQ ID NO: 1700460 - protein, 24 aa, Staphylococcus aureus
TRTKIQLLAPVIAHRKGSHEKLIE

SEQ ID NO: 1700461 - protein, 29 aa, Staphylococcus aureus
TRTLIPFLTMIQNTFGYLPEYIVADAGYG

SEQ ID NO: 1700462 - protein, 25 aa, Staphylococcus aureus
TRVETLRGMQISELTPRKPSKSPRS

SEQ ID NO: 1700463 - protein, 22 aa, Staphylococcus aureus
TRVKIAYVLSLEGELCVCDVAN

SEQ ID NO: 1700464 - protein, 34 aa, Staphylococcus aureus; identical to SEQ ID NO: 1594964

SEQ ID NO: 1700465 - protein, 25 aa, Staphylococcus aureus
TSDNRVLPFLDGEYWPGCHSCGEEE

SEQ ID NO: 1700466 - protein, 26 aa, Staphylococcus aureus
TSEHLVEFMPIIYDPVIAQSIEQYNE

SEQ ID NO: 1700467 - protein, 23 aa, Staphylococcus aureus
TSELFLTKYFDQDAFLSQSGQLY

SEQ ID NO: 1700468 - protein, 24 aa, Staphylococcus aureus
TSFDMYALCDSFKKYNLPLPSNQY

SEQ ID NO: 1700469 - protein, 21 aa, Staphylococcus aureus
TSFFGAYDLALYKSNTFIGQP

SEQ ID NO: 1700470 - protein, 24 aa, Staphylococcus aureus
TSFFGDYDLALYKSNTFIGQPLWG

SEQ ID NO: 1700471 - protein, 26 aa, Staphylococcus aureus
TSFSKKWRPYLRYRDVYHYDLKSFED

SEQ ID NO: 1700472 - protein, 28 aa, Staphylococcus aureus
TSHYKKIDYEFLYLLSMDKLFGNKRNRL

SEQ ID NO: 1700473 - protein, 24 aa, Staphylococcus aureus
TSIATMIHLIQRKLQKNSAYLGTN

SEQ ID NO: 1700474 - protein, 24 aa, Staphylococcus aureus
TSIATMVHLIQRKLQKNSAYLGTN

SEQ ID NO: 1700475 - protein, 36 aa, Staphylococcus aureus
TSICKKWYINSFKYFRNMYKGFYYSRPDKLNKCFYK

SEQ ID NO: 1700476 - protein, 17 aa, Staphylococcus aureus
TSIFNSISNMTAIKPKQ

SEQ ID NO: 1700477 - protein, 17 aa, Staphylococcus aureus
TSILTLSDLFNWSRFKV

SEQ ID NO: 1700478 - protein, 30 aa, Staphylococcus aureus
TSINLTEPYTNYSILLVSGTYPGGVIEGFG

SEQ ID NO: 1700479 - protein, 25 aa, Staphylococcus aureus
TSIYGDFQRFYQPAIKALHTLGATD

SEQ ID NO: 1700480 - protein, 31 aa, Staphylococcus aureus
TSKGFKGLAGAMLFNLKPINVLKNTANLAIL

SEQ ID NO: 1700481 - protein, 17 aa, Staphylococcus aureus
TSKPFFLEFMAKDVSKG

SEQ ID NO: 1700482 - protein, 21 aa, Staphylococcus aureus
TSKPFVVITPIYDLPSDFMSD

SEQ ID NO: 1700483 - protein, 22 aa, Staphylococcus aureus
TSKPFVVITPVYDLPSDFMSDK

SEQ ID NO: 1700484 - protein, 21 aa, Staphylococcus aureus
TSKPFVVITPVYDLPSDYMSD

SEQ ID NO: 1700485 - protein, 17 aa, Staphylococcus aureus
TSKTIFSKYRWNKSFKA

SEQ ID NO: 1700486 - protein, 19 aa, Staphylococcus aureus
TSLAIFKEATQWLDAYFKG

SEQ ID NO: 1700487 - protein, 25 aa, Staphylococcus aureus
TSLFTGKLGLCYIGLRLLNPETIDS

SEQ ID NO: 1700488 - protein, 18 aa, Staphylococcus aureus
TSLGYYLDKQFEGRGIMT

SEQ ID NO: 1700489 - protein, 22 aa, Staphylococcus aureus
TSLMFLITPMHDKPGLLASMLN

SEQ ID NO: 1700490 - protein, 24 aa, Staphylococcus aureus
TSLRILDFSFYNSGIEKIYGSPII

SEQ ID NO: 1700491 - protein, 26 aa, Staphylococcus aureus
TSNDVEFFFTYEDLPLLDPDKILNEY

SEQ ID NO: 1700492 - protein, 17 aa, Staphylococcus aureus
TSPDKQGAYTDAYNAAK

SEQ ID NO: 1700493 - protein, 17 aa, Staphylococcus aureus
TSQYNPIIDTNISFYES

SEQ ID NO: 1700494 - protein, 17 aa, Staphylococcus aureus
TSSMPLNLMGKLAFQYL

SEQ ID NO: 1700495 - protein, 25 aa, Staphylococcus aureus
TSSVSDFLTYLNGRFSNMVLGHNGD

SEQ ID NO: 1700496 - protein, 34 aa, Staphylococcus aureus; identical to SEQ ID NO: 1599460

SEQ ID NO: 1700497 - protein, 23 aa, Staphylococcus aureus
TSVPIVPELLKSLNFNQFNLVEA

SEQ ID NO: 1700498 - protein, 28 aa, Staphylococcus aureus
TSYHPKMMLKIILYAYTQSVFSGRRIEK

SEQ ID NO: 1700499 - protein, 18 aa, Staphylococcus aureus
TSYLGFGNYELRLPLVSL

SEQ ID NO: 1700500 - protein, 29 aa, Staphylococcus aureus
TTAINLIYRIMKYDWANILVVRRFSNTNK

SEQ ID NO: 1700501 - protein, 42 aa, Staphylococcus aureus
TTEDVEKALAMKAPLGIFSHQLQRFIHLVWDVRNVINDNIKE

SEQ ID NO: 1700502 - protein, 25 aa, Staphylococcus aureus
TTEFEDLLYMVDGTYYYAVYFDSHV

SEQ ID NO: 1700503 - protein, 23 aa, Staphylococcus aureus
TTELGKFFIGKYSIKTDKTIEDS

SEQ ID NO: 1700504 - protein, 24 aa, Staphylococcus aureus
TTEQARIRLYIPLNERISADDYCK

SEQ ID NO: 1700505 - protein, 23 aa, Staphylococcus aureus
TTETPRIRLYIPLNERISADDYR

SEQ ID NO: 1700506 - protein, 17 aa, Staphylococcus aureus
TTEYYYPLQNAIIEFYT

SEQ ID NO: 1700507 - protein, 18 aa, Staphylococcus aureus
TTEYYYPLQNAIIEFYTE

SEQ ID NO: 1700508 - protein, 30 aa, Staphylococcus aureus
TTFIERYSQALIPPLIAFIQNYGIALEAHM

SEQ ID NO: 1700509 - protein, 21 aa, Staphylococcus aureus
TTFLPSLTVQVAMAGAMLIGL

SEQ ID NO: 1700510 - protein, 24 aa, Staphylococcus aureus
TTGFCLWCQLAFSTYLENATQPHL

SEQ ID NO: 1700511 - protein, 24 aa, Staphylococcus aureus
TTGFCLWCQLAFSTYLENATQTHL

SEQ ID NO: 1700512 - protein, 17 aa, Staphylococcus aureus
TTGKDIIPPKTYSGNVD

SEQ ID NO: 1700513 - protein, 28 aa, Staphylococcus aureus
TTGKKPASITAYNNSIRALQSDLTSAKN

SEQ ID NO: 1700514 - protein, 17 aa, Staphylococcus aureus
TTHAPFGYTYRNGTFTI

SEQ ID NO: 1700515 - protein, 26 aa, Staphylococcus aureus
TTIEDTFHFTLFTAITDLIDKVVNVS

SEQ ID NO: 1700516 - protein, 23 aa, Staphylococcus aureus
TTIESMHLDWPLIEVGQSFKALS

SEQ ID NO: 1700517 - protein, 17 aa, Staphylococcus aureus
TTIFIDEGWAFTASRQG

SEQ ID NO: 1700518 - protein, 22 aa, Staphylococcus aureus
TTKAALNGTQNLEKAKQHANTA

SEQ ID NO: 1700519 - protein, 18 aa, Staphylococcus aureus
TTKEDIARFKEIFIIIYE

SEQ ID NO: 1700520 - protein, 17 aa, Staphylococcus aureus
TTKFKAKYFQGFHNKFE

SEQ ID NO: 1700521 - protein, 31 aa, Staphylococcus aureus
TTLHNSLIEMIDYFKALFPNGGLYIHLDQAT

SEQ ID NO: 1700522 - protein, 26 aa, Staphylococcus aureus
TTNENIKALYFYQKNKYRITDVIFNA

SEQ ID NO: 1700523 - protein, 26 aa, Staphylococcus aureus
TTNENIKALYFYQKNKYRITEVIFDA

SEQ ID NO: 1700524 - protein, 24 aa, Staphylococcus aureus
TTNNRRNLIAIKLVEDKQLEQSEA

SEQ ID NO: 1700525 - protein, 20 aa, Staphylococcus aureus
TTNQDGTVSYGARPTQNKPS

SEQ ID NO: 1700526 - protein, 25 aa, Staphylococcus aureus
TTPERMLLPMHKGGTFGKFSTSIGL

SEQ ID NO: 1700527 - protein, 36 aa, Staphylococcus aureus; identical to SEQ ID NO: 1594048

SEQ ID NO: 1700528 - protein, 31 aa, Staphylococcus aureus
TVALKTLGLIIVMAQSGLLIPTLDGSQLSVF

SEQ ID NO: 1700529 - protein, 32 aa, Staphylococcus aureus
TVDAHLFFRTFLRLRMYITFYTHLICKKCFDL

SEQ ID NO: 1700530 - protein, 19 aa, Staphylococcus aureus
TVDFYLAKGIVDRVSEKLN

SEQ ID NO: 1700531 - protein, 18 aa, Staphylococcus aureus
TVDLCLDVLALPSGEYEL

SEQ ID NO: 1700532 - protein, 27 aa, Staphylococcus aureus
TVDLFTSHGVYRYLTSRTSGLKLTPRE

SEQ ID NO: 1700533 - protein, 25 aa, Staphylococcus aureus
TVEDIRWLRCDIKSLNLLGNVLAKE

SEQ ID NO: 1700534 - protein, 17 aa, Staphylococcus aureus
TVHQLFPDLIKQLENEF

SEQ ID NO: 1700535 - protein, 20 aa, Staphylococcus aureus
TVIEWSQFIKDLLPATHLSI

SEQ ID NO: 1700536 - protein, 18 aa, Staphylococcus aureus
TVIEWYIGEYNPKPAWMQ

SEQ ID NO: 1700537 - protein, 19 aa, Staphylococcus aureus
TVISGLKGPLSTLGGGVMN

SEQ ID NO: 1700538 - protein, 24 aa, Staphylococcus aureus
TVKAVFNYYLQGYGYKKIAQYLED

SEQ ID NO: 1700539 - protein, 23 aa, Staphylococcus aureus
TVKGAYKTYAYVVSYKPTNGNEK

SEQ ID NO: 1700540 - protein, 20 aa, Staphylococcus aureus
TVKQSVKFTDADKAKRDAYT

SEQ ID NO: 1700541 - protein, 24 aa, Staphylococcus aureus
TVLNALAVIAISYLEKLDLTNIKE

SEQ ID NO: 1700542 - protein, 21 aa, Staphylococcus aureus
TVLTTAFLNAAIGRLYDIADS

SEQ ID NO: 1700543 - protein, 22 aa, Staphylococcus aureus
TVNDLYLIVKKLSQGDVKKAVV

SEQ ID NO: 1700544 - protein, 24 aa, Staphylococcus aureus
TVNTGHAYLAYAGKFADKATVLDA

SEQ ID NO: 1700545 - protein, 19 aa, Staphylococcus aureus
TVQLHLEGFLNKYPSEISG

SEQ ID NO: 1700546 - protein, 28 aa, Staphylococcus aureus
TVSQIQTAIRIQIATRIQIVTRTQIVTQ

SEQ ID NO: 1700547 - protein, 17 aa, Staphylococcus aureus
TVTFNETLTYKTYTQDF

SEQ ID NO: 1700548 - protein, 20 aa, Staphylococcus aureus
TVTGLPSGLTFDSTNNTISG

SEQ ID NO: 1700549 - protein, 41 aa, Staphylococcus aureus
TVTGYPGDKPVATMWESKGKITYLKGEAMQYDLSTTGGNSG

SEQ ID NO: 1700550 - protein, 31 aa, Staphylococcus aureus
TVTLKTLGLIIIMAQSGLLIPTLDGSQLSVF

SEQ ID NO: 1700551 - protein, 31 aa, Staphylococcus aureus
TVTQIQIAIQTQIVIQIQKATQIQKAIQTQI

SEQ ID NO: 1700552 - protein, 29 aa, Staphylococcus aureus
TVTQTQIAIQIQIATQIRIATQIQMQENI

SEQ ID NO: 1700553 - protein, 20 aa, Staphylococcus aureus
TVVAPQPNQATTKIWQNGHI

SEQ ID NO: 1700554 - protein, 23 aa, Staphylococcus aureus
TVVPFENLGLLPYFEADFIATAS

SEQ ID NO: 1700555 - protein, 25 aa, Staphylococcus aureus
TVVPFENLGLLPYFEADFIATASDV

SEQ ID NO: 1700556 - protein, 26 aa, Staphylococcus aureus
TVVPFENLGLLPYFEADFIATASDVL

SEQ ID NO: 1700557 - protein, 24 aa, Staphylococcus aureus
TVVSNFYDYLYRSKKLDVNFYDFI

SEQ ID NO: 1700558 - protein, 26 aa, Staphylococcus aureus
TVWTDRGVHFYFKKPENFKGANAISA

SEQ ID NO: 1700559 - protein, 19 aa, Staphylococcus aureus
TWSQQIEMFLGNKARLDML

SEQ ID NO: 1700560 - protein, 20 aa, Staphylococcus aureus
TYDLGIRAIMFFGVPNSKDD

SEQ ID NO: 1700561 - protein, 19 aa, Staphylococcus aureus
TYIADFSLWKEGKLVEVID

SEQ ID NO: 1700562 - protein, 19 aa, Staphylococcus aureus
TYIELLASKLHQAKQPIII

SEQ ID NO: 1700563 - protein, 19 aa, Staphylococcus aureus
TYIKIKGKWNYLYRAIDAE

SEQ ID NO: 1700564 - protein, 19 aa, Staphylococcus aureus
TYITYTRLLEQFTMEDIAA

SEQ ID NO: 1700565 - protein, 19 aa, Staphylococcus aureus
TYKKFLIQLKGRKFAHRTK

SEQ ID NO: 1700566 - protein, 23 aa, Staphylococcus aureus
TYKVVRTVPKHVFETARGVLYPG

SEQ ID NO: 1700567 - protein, 21 aa, Staphylococcus aureus
TYLQTWHGTPLKKIGLDISNV

SEQ ID NO: 1700568 - protein, 22 aa, Staphylococcus aureus
TYNFKNAIIATGSRPIEIPNFK

SEQ ID NO: 1700569 - protein, 22 aa, Staphylococcus aureus
TYNTLLLEPSVINTLDKIKQAN

SEQ ID NO: 1700570 - protein, 25 aa, Staphylococcus aureus
TYPHHHPKFNISEKSLLISAEAVGT

SEQ ID NO: 1700571 - protein, 24 aa, Staphylococcus aureus
TYQPHRLMYWPSTSNDVEFFFTYE

SEQ ID NO: 1700572 - protein, 20 aa, Staphylococcus aureus
TYRGYLNIDAFNKTLEQPVL

SEQ ID NO: 1700573 - protein, 17 aa, Staphylococcus aureus
TYRPQQLYLAETILDQL

SEQ ID NO: 1700574 - protein, 18 aa, Staphylococcus aureus
TYRTASDVVINNAQPEVT

SEQ ID NO: 1700575 - protein, 24 aa, Staphylococcus aureus
TYSKNMFRLLKQYKHTGYLKIHID

SEQ ID NO: 1700576 - protein, 33 aa, Staphylococcus aureus; identical to SEQ ID NO: 1592878

SEQ ID NO: 1700577 - protein, 19 aa, Staphylococcus aureus
TYVNLLNHSYMKYINAESY

SEQ ID NO: 1700578 - protein, 21 aa, Staphylococcus aureus
TYYFHGHIVPGWQGVKKMFDT

SEQ ID NO: 1700579 - protein, 19 aa, Staphylococcus aureus
TYYFHGHIVPGWQGVKKTF

SEQ ID NO: 1700580 - protein, 28 aa, Staphylococcus aureus
VAALQHALDVWLLGKLQFAEFEHFPSVD

SEQ ID NO: 1700581 - protein, 27 aa, Staphylococcus aureus
VADELYHLFVLMHALGIDFSEIEAELA

SEQ ID NO: 1700582 - protein, 20 aa, Staphylococcus aureus
VADIIAQAQALNEAMKALKE

SEQ ID NO: 1700583 - protein, 20 aa, Staphylococcus aureus
VAEIIAQAQALNEAMKALKE

SEQ ID NO: 1700584 - protein, 25 aa, Staphylococcus aureus
VAGAKYRGEFEERLKVVLKEVKESD

SEQ ID NO: 1700585 - protein, 24 aa, Staphylococcus aureus
VAGGGAFGAFVTTDSYGVATTYTS

SEQ ID NO: 1700586 - protein, 17 aa, Staphylococcus aureus
VAILDNGYYLPEDKYLL

SEQ ID NO: 1700587 - protein, 22 aa, Staphylococcus aureus
VAIYGLNFLIQNDLARLKAHYK

SEQ ID NO: 1700588 - protein, 33 aa, Staphylococcus aureus
VAMGYRINNEPLLMDIAKTPHALIAGATGSGKS

SEQ ID NO: 1700589 - protein, 17 aa, Staphylococcus aureus
VAMILQLLKKLKEEQII

SEQ ID NO: 1700590 - protein, 23 aa, Staphylococcus aureus
VANDKEFYIFDSLIQGRSFKDIS

SEQ ID NO: 1700591 - protein, 24 aa, Staphylococcus aureus
VAQKLAEAKALNQAMEALRNSIQD

SEQ ID NO: 1700592 - protein, 25 aa, Staphylococcus aureus
VARELIELIIAFMFHHQIPMSIETS

SEQ ID NO: 1700593 - protein, 28 aa, Staphylococcus aureus
VARELIELIIAFMFHHQIPMSIETSKLL

SEQ ID NO: 1700594 - protein, 25 aa, Staphylococcus aureus
VARMILHIIDQMNGIPFTERADRIL

SEQ ID NO: 1700595 - protein, 30 aa, Staphylococcus aureus
VASEFVYNMPLLSEKPLFVYISQSGETADS

SEQ ID NO: 1700596 - protein, 21 aa, Staphylococcus aureus
VASKRWIRYIHEVEEPDFLIV

SEQ ID NO: 1700597 - protein, 24 aa, Staphylococcus aureus
VASKRWIRYIHEVEEPDFLIVIYH

SEQ ID NO: 1700598 - protein, 26 aa, Staphylococcus aureus
VASSRDIILFSLLLAAKGISGAVSDS

SEQ ID NO: 1700599 - protein, 32 aa, Staphylococcus aureus
VATPDMMGEVGKLGRVLGPKDLMPNPKTGTVT

SEQ ID NO: 1700600 - protein, 28 aa, Staphylococcus aureus
VATVTEIYDYIRLLYARVGKPYCPNHHI

SEQ ID NO: 1700601 - protein, 26 aa, Staphylococcus aureus
VAVVMGPGPIGLLVAQMLKSKGATVV

SEQ ID NO: 1700602 - protein, 18 aa, Staphylococcus aureus
VCEILSQQQLRYFFSHNH

SEQ ID NO: 1700603 - protein, 17 aa, Staphylococcus aureus
VCFYGQIALFDLCKRLS

SEQ ID NO: 1700604 - protein, 21 aa, Staphylococcus aureus
VCNAFDHMWGYFKKFANEEER

SEQ ID NO: 1700605 - protein, 17 aa, Staphylococcus aureus
VCRFNVAILDNGYYLPE

SEQ ID NO: 1700606 - protein, 18 aa, Staphylococcus aureus
VCRSTVYNWLKYYRKDNL

SEQ ID NO: 1700607 - protein, 17 aa, Staphylococcus aureus
VDATYRTFYQHVLVYEI

SEQ ID NO: 1700608 - protein, 21 aa, Staphylococcus aureus
VDAVLKRFNVALSDIEAVITE

SEQ ID NO: 1700609 - protein, 23 aa, Staphylococcus aureus
VDDQIWSNSKFKLALKVQDRQDS

SEQ ID NO: 1700610 - protein, 25 aa, Staphylococcus aureus
VDGFKSLRFLRPRTAGRHYIIITLW

SEQ ID NO: 1700611 - protein, 23 aa, Staphylococcus aureus
VDGNKFIDYLQAYGPIITGHTHP

SEQ ID NO: 1700612 - protein, 22 aa, Staphylococcus aureus
VDGNRFIDYLQAYGPIITGHAH

SEQ ID NO: 1700613 - protein, 26 aa, Staphylococcus aureus
VDIALQQDVDFVIIAGDLFDSENRTL

SEQ ID NO: 1700614 - protein, 17 aa, Staphylococcus aureus
VDIETIIDYYLYQNVSS

SEQ ID NO: 1700615 - protein, 27 aa, Staphylococcus aureus
VDIGQNRLFKWLRNNGYLIKKSGESYN

SEQ ID NO: 1700616 - protein, 17 aa, Staphylococcus aureus
VDKILTQLNIRLLEQRI

SEQ ID NO: 1700617 - protein, 25 aa, Staphylococcus aureus
VDLFTSNGVYRYLTSRTSGLKLTPR

SEQ ID NO: 1700618 - protein, 17 aa, Staphylococcus aureus
VDLVNWVENALQSGLAA

SEQ ID NO: 1700619 - protein, 24 aa, Staphylococcus aureus
VDMTIKEFILLTYLFHQQENTLPF

SEQ ID NO: 1700620 - protein, 22 aa, Staphylococcus aureus
VDNNDCDVIFFATPAPVSKTCI

SEQ ID NO: 1700621 - protein, 24 aa, Staphylococcus aureus
VDNNDCDVIFFATPAPVSKTCIPP

SEQ ID NO: 1700622 - protein, 28 aa, Staphylococcus aureus
VDPDVLRFFMISVHYRSPINYNLELVES

SEQ ID NO: 1700623 - protein, 24 aa, Staphylococcus aureus
VDQALQNILNAKQALNGDERVALA

SEQ ID NO: 1700624 - protein, 32 aa, Staphylococcus aureus
VDQIHTGRYYIQRFLARAFGFEVDDIKAMSEV

SEQ ID NO: 1700625 - protein, 32 aa, Staphylococcus aureus
VDQIHTGRYYVQRFLARAFGFEVDDIKAMSEV

SEQ ID NO: 1700626 - protein, 29 aa, Staphylococcus aureus
VDSDSTVLCEPLILIEVESLILSDVDNDV

SEQ ID NO: 1700627 - protein, 19 aa, Staphylococcus aureus
VDSFHYFYQEDCANVGYIK

SEQ ID NO: 1700628 - protein, 17 aa, Staphylococcus aureus
VDSIQTIYRPEISSAPG

SEQ ID NO: 1700629 - protein, 26 aa, Staphylococcus aureus
VDSVKNEFDLLWQKSTPLTEQWINSY

SEQ ID NO: 1700630 - protein, 26 aa, Staphylococcus aureus
VDSVKNEFDLLWQNSTPLTQQWINSY

SEQ ID NO: 1700631 - protein, 25 aa, Staphylococcus aureus
VDYKYNIIRVWHYSDDYLGRIASIN

SEQ ID NO: 1700632 - protein, 17 aa, Staphylococcus aureus
VDYLTTLDFVDNDRIGA

SEQ ID NO: 1700633 - protein, 18 aa, Staphylococcus aureus
VEAALQRVKTAKNALNGD

SEQ ID NO: 1700634 - protein, 18 aa, Staphylococcus aureus
VEAEGHFDFIYIQAPYSE

SEQ ID NO: 1700635 - protein, 17 aa, Staphylococcus aureus
VEAQRMAESGWGKTSKV

SEQ ID NO: 1700636 - protein, 35 aa, Staphylococcus aureus
VECAIPMIQGILEKIPFFGICLGHQLFALSQGASS

SEQ ID NO: 1700637 - protein, 35 aa, Staphylococcus aureus
VECAIPMTQGILGKIPFFGICLGHQLFALSQGASS

SEQ ID NO: 1700638 - protein, 17 aa, Staphylococcus aureus
VEDKTIYMINDYGQLQA

SEQ ID NO: 1700639 - protein, 28 aa, Staphylococcus aureus
VEDLIRLIAADLVEFDWLEGFDIECRNE

SEQ ID NO: 1700640 - protein, 29 aa, Staphylococcus aureus
VEELTRIGLDLPFPIKINQMLGHQTSFLT

SEQ ID NO: 1700641 - protein, 25 aa, Staphylococcus aureus
VEGIPAGLLTYPPLMAADIVLYNTN

SEQ ID NO: 1700642 - protein, 17 aa, Staphylococcus aureus
VEGLIHFVSRQAMNIDG

SEQ ID NO: 1700643 - protein, 22 aa, Staphylococcus aureus
VEGVKSIFHVMDFISVDKENDA

SEQ ID NO: 1700644 - protein, 24 aa, Staphylococcus aureus
VEHIVKLSRYYLQGLRSLNGGRMA

SEQ ID NO: 1700645 - protein, 18 aa, Staphylococcus aureus
VEHRTLISFLACLSFMSR

SEQ ID NO: 1700646 - protein, 18 aa, Staphylococcus aureus
VEHRTLIYFPACLSFMSR

SEQ ID NO: 1700647 - protein, 36 aa, Staphylococcus aureus
VEKFDFNKGFKFSTYATWWIRQAITRAIADQARTIR

SEQ ID NO: 1700648 - protein, 23 aa, Staphylococcus aureus
VELAQLDYLLSRLQGHGKSLSRL

SEQ ID NO: 1700649 - protein, 20 aa, Staphylococcus aureus
VELDSQFLLTLQVRETGPTL

SEQ ID NO: 1700650 - protein, 25 aa, Staphylococcus aureus
VELKIRYKVPKIAYASHLKSDVQAL

SEQ ID NO: 1700651 - protein, 18 aa, Staphylococcus aureus
VELKIWERWLHTQGYKDI

SEQ ID NO: 1700652 - protein, 21 aa, Staphylococcus aureus
VELRRNIGYVIQQIGLMTHMT

SEQ ID NO: 1700653 - protein, 18 aa, Staphylococcus aureus
VELVNWVENALQSGLAAK

SEQ ID NO: 1700654 - protein, 23 aa, Staphylococcus aureus
VENVEMIAFCDVDISKAASASEA

SEQ ID NO: 1700655 - protein, 32 aa, Staphylococcus aureus
VENVLKICRLYAFRNWPIAALSYGQKKRVTIA

SEQ ID NO: 1700656 - protein, 31 aa, Staphylococcus aureus
VENVWLKTELKYFYYLHLNNGAWNAKSVWIR

SEQ ID NO: 1700657 - protein, 18 aa, Staphylococcus aureus
VEPQYLAALIYTSGTTGS

SEQ ID NO: 1700658 - protein, 17 aa, Staphylococcus aureus
VEPSFYGVKYVEYTKRL

SEQ ID NO: 1700659 - protein, 26 aa, Staphylococcus aureus
VEPYIGAFIYLYFKNQPRNVTKKQIK

SEQ ID NO: 1700660 - protein, 18 aa, Staphylococcus aureus
VEQALQRVNNAKTALNGD

SEQ ID NO: 1700661 - protein, 25 aa, Staphylococcus aureus
VERARRMQFFLSQNFHVAEQFTGQK

SEQ ID NO: 1700662 - protein, 19 aa, Staphylococcus aureus
VEREYMYHGVKTIFTKEKE

SEQ ID NO: 1700663 - protein, 26 aa, Staphylococcus aureus
VERVSKMITTLRPLGRKPTDIENALH

SEQ ID NO: 1700664 - protein, 27 aa, Staphylococcus aureus
VESKSLKLYLFSFRNHGDFHEDCMNII

SEQ ID NO: 1700665 - protein, 21 aa, Staphylococcus aureus
VESLISIPALMTHASIPADIR

SEQ ID NO: 1700666 - protein, 29 aa, Staphylococcus aureus
VESQITQALDHAMELLRNSIADNQATLAS

SEQ ID NO: 1700667 - protein, 23 aa, Staphylococcus aureus
VESVFGFMKAILGFTRMSVRGIN

SEQ ID NO: 1700668 - protein, 25 aa, Staphylococcus aureus
VESVKNEFELLWQKSTPLTEQWINS

SEQ ID NO: 1700669 - protein, 19 aa, Staphylococcus aureus
VETNGIATLKGVQPHIVIK

SEQ ID NO: 1700670 - protein, 20 aa, Staphylococcus aureus
VFANLDLNITKARAQVVKAL

SEQ ID NO: 1700671 - protein, 28 aa, Staphylococcus aureus
VFDDLWMDLYDLFEELRNIFKEEGHEPW

SEQ ID NO: 1700672 - protein, 24 aa, Staphylococcus aureus
VFDDLWMDLYDLFENLRNLFKKEG

SEQ ID NO: 1700673 - protein, 17 aa, Staphylococcus aureus
VFFHERKALSHFEKRYT

SEQ ID NO: 1700674 - protein, 18 aa, Staphylococcus aureus
VFGILQLETLLGDINSIF

SEQ ID NO: 1700675 - protein, 18 aa, Staphylococcus aureus
VFHSAALKQVPSCEFFPV

SEQ ID NO: 1700676 - protein, 19 aa, Staphylococcus aureus
VFIVIKDFENRIIEEGELK

SEQ ID NO: 1700677 - protein, 19 aa, Staphylococcus aureus
VFKGFEYLVYEKPTEMPFS

SEQ ID NO: 1700678 - protein, 19 aa, Staphylococcus aureus
VFMEWSCLFVIKSDDLRDC

SEQ ID NO: 1700679 - protein, 27 aa, Staphylococcus aureus
VFNEKNEVIGIHWGGVPNEFNGAVFIN

SEQ ID NO: 1700680 - protein, 38 aa, Staphylococcus aureus
VFNEKNEVIGIHWGGVPNQFNGAVFINENVRNFLKQNI

SEQ ID NO: 1700681 - protein, 17 aa, Staphylococcus aureus
VFNGRFSPETYLELLQK

SEQ ID NO: 1700682 - protein, 18 aa, Staphylococcus aureus
VFPIRFIVDKENEVSDPK

SEQ ID NO: 1700683 - protein, 24 aa, Staphylococcus aureus
VFREPFVEFFYKNDALNDPLITDD

SEQ ID NO: 1700684 - protein, 25 aa, Staphylococcus aureus
VFSRIDSCIKFLYLTQEEKQKVIEN

SEQ ID NO: 1700685 - protein, 36 aa, Staphylococcus aureus
VFTDVNGYPLVIKKLQLWIKVILKKTDITNKQISTH

SEQ ID NO: 1700686 - protein, 25 aa, Staphylococcus aureus
VFTSYLRYPTVTKPMLRISLSYFHT

SEQ ID NO: 1700687 - protein, 17 aa, Staphylococcus aureus
VFVNTNCYFMDGGQITI

SEQ ID NO: 1700688 - protein, 17 aa, Staphylococcus aureus
VGAKFVKLFTDIDLNVD

SEQ ID NO: 1700689 - protein, 23 aa, Staphylococcus aureus
VGEKKLQLMPLDNLKNVTGYIRG

SEQ ID NO: 1700690 - protein, 21 aa, Staphylococcus aureus
VGFNMQLDEYLEASKNGKTWL

SEQ ID NO: 1700691 - protein, 19 aa, Staphylococcus aureus
VGFNTNRDFWSFNFSKKEV

SEQ ID NO: 1700692 - protein, 17 aa, Staphylococcus aureus
VGFVIDRATDQVTLMAS

SEQ ID NO: 1700693 - protein, 19 aa, Staphylococcus aureus
VGGYFYTNITCDCDSWFVN

SEQ ID NO: 1700694 - protein, 27 aa, Staphylococcus aureus
VGIGGLSNAFGFKLDTYHNTSKPNSAA

SEQ ID NO: 1700695 - protein, 19 aa, Staphylococcus aureus
VGKHIFLENGVSTFGALVP

SEQ ID NO: 1700696 - protein, 25 aa, Staphylococcus aureus
VGNKKPLRRLWISSVTKKAIQQSFK

SEQ ID NO: 1700697 - protein, 21 aa, Staphylococcus aureus
VGQRGFVPASLISTDFIEDFS

SEQ ID NO: 1700698 - protein, 26 aa, Staphylococcus aureus
VGRHAGDNGLLLAETFGGGTSDEGLS

SEQ ID NO: 1700699 - protein, 17 aa, Staphylococcus aureus
VGRRNKFFENIISVPLP

SEQ ID NO: 1700700 - protein, 19 aa, Staphylococcus aureus
VGTFTLAVNRTFTNAQGER

SEQ ID NO: 1700701 - protein, 33 aa, Staphylococcus aureus
VGVVTQITPWNYPLLQASWKIAPALATGCSIVM

SEQ ID NO: 1700702 - protein, 23 aa, Staphylococcus aureus
VGYKNEYFYITYSSRSLKEYRKY

SEQ ID NO: 1700703 - protein, 25 aa, Staphylococcus aureus
VGYLNRYRILQSLQLLDRHYKHYEI

SEQ ID NO: 1700704 - protein, 18 aa, Staphylococcus aureus
VHGAWYAILRGGTQQFRL

SEQ ID NO: 1700705 - protein, 18 aa, Staphylococcus aureus
VHIEEDLLPLVLEKMDVT

SEQ ID NO: 1700706 - protein, 20 aa, Staphylococcus aureus
VHLLRKYYAFIKLNHNDIIK

SEQ ID NO: 1700707 - protein, 29 aa, Staphylococcus aureus
VHNACVVVTRYFGGIKLGGGGLIRAYSSA

SEQ ID NO: 1700708 - protein, 18 aa, Staphylococcus aureus
VHTVYKMMTLFNNQSYID

SEQ ID NO: 1700709 - protein, 18 aa, Staphylococcus aureus
VHVHGLPADLLEIQKICD

SEQ ID NO: 1700710 - protein, 31 aa, Staphylococcus aureus
VHYHTKIFRTFTPDIFVIDKLSTAYNPNAYD

SEQ ID NO: 1700711 - protein, 17 aa, Staphylococcus aureus
VIAPFNGLVSMIVPTKH

SEQ ID NO: 1700712 - protein, 21 aa, Staphylococcus aureus
VIDDLVIYKLADDNYLLVVNA

SEQ ID NO: 1700713 - protein, 25 aa, Staphylococcus aureus
VIDKNTGYFPFYSGIKYSYADLNIS

SEQ ID NO: 1700714 - protein, 30 aa, Staphylococcus aureus
VIDQPNSFKPLYELELPLEQKIEKIVTEIY

SEQ ID NO: 1700715 - protein, 17 aa, Staphylococcus aureus
VIDYYLKHSQIETIISQ

SEQ ID NO: 1700716 - protein, 17 aa, Staphylococcus aureus
VIEENFTFYNVDLEDGL

SEQ ID NO: 1700717 - protein, 18 aa, Staphylococcus aureus
VIEIFIPNDNKILLTIMN

SEQ ID NO: 1700718 - protein, 20 aa, Staphylococcus aureus
VIEKLLKLKQRLILQKITVS

SEQ ID NO: 1700719 - protein, 19 aa, Staphylococcus aureus
VIELCKANHYTYGYRKITA

SEQ ID NO: 1700720 - protein, 24 aa, Staphylococcus aureus
VIEMIANWFPSQATLYRIKQIEMK

SEQ ID NO: 1700721 - protein, 20 aa, Staphylococcus aureus
VIENNKIRFLKLKVGKIINV

SEQ ID NO: 1700722 - protein, 18 aa, Staphylococcus aureus
VIERLKVDIYKVESIKRQ

SEQ ID NO: 1700723 - protein, 19 aa, Staphylococcus aureus
VIERLKVDIYKVESIKRQE

SEQ ID NO: 1700724 - protein, 18 aa, Staphylococcus aureus
VIEVFSLTSIPNAIQLSK

SEQ ID NO: 1700725 - protein, 45 aa, Staphylococcus aureus
VIFEIKAQRYVLRIVLEPMSLKNMLWTKYLKLSKVIKFSNKLSNV

SEQ ID NO: 1700726 - protein, 30 aa, Staphylococcus aureus
VIFSIETRRYYLMLMLFSKENPMSLNHFSI

SEQ ID NO: 1700727 - protein, 27 aa, Staphylococcus aureus
VIGNPLLDKFMKDIIIQILAMVSEQER

SEQ ID NO: 1700728 - protein, 27 aa, Staphylococcus aureus
VIGNPLLDKFMKDLIIQILAMISEQER

SEQ ID NO: 1700729 - protein, 26 aa, Staphylococcus aureus
VIGNPLLDKFMKDLIIQILAMVSEQE

SEQ ID NO: 1700730 - protein, 27 aa, Staphylococcus aureus
VIGNPLLDKFMKDLIIQILAMVSEQER

SEQ ID NO: 1700731 - protein, 26 aa, Staphylococcus aureus
VIHLMSRVRRYPLPLVLEISNIESVI

SEQ ID NO: 1700732 - protein, 20 aa, Staphylococcus aureus
VIIETVLLDHDEIVKASELT

SEQ ID NO: 1700733 - protein, 19 aa, Staphylococcus aureus
VIIIELNDDRIKYLQDMYA

SEQ ID NO: 1700734 - protein, 19 aa, Staphylococcus aureus
VIKKTAMVFGQMNEPPGAR

SEQ ID NO: 1700735 - protein, 36 aa, Staphylococcus aureus
VILDWQGKSYFFPSKLAFVLFFIKQLEITEHHFVIN

SEQ ID NO: 1700736 - protein, 18 aa, Staphylococcus aureus
VIMGIANKRSIAFGVAKV

SEQ ID NO: 1700737 - protein, 18 aa, Staphylococcus aureus
VIMGYMIRSQEMPIFITY

SEQ ID NO: 1700738 - protein, 24 aa, Staphylococcus aureus
VINMFSFFIGYHFNKLDIGIERIF

SEQ ID NO: 1700739 - protein, 19 aa, Staphylococcus aureus
VIPDIYILGKALGGGLYPV

SEQ ID NO: 1700740 - protein, 24 aa, Staphylococcus aureus
VIQKKYVNILPSKEGYMLSINKNV

SEQ ID NO: 1700741 - protein, 24 aa, Staphylococcus aureus
VIQSDLVIGAVLIPGAKAPRLVTE

SEQ ID NO: 1700742 - protein, 20 aa, Staphylococcus aureus
VIQWFYKEVDWFEAKLKDDK

SEQ ID NO: 1700743 - protein, 17 aa, Staphylococcus aureus
VIREDDVDVFYYVMLLP

SEQ ID NO: 1700744 - protein, 20 aa, Staphylococcus aureus
VISGTQFIIELLGVNADQFR

SEQ ID NO: 1700745 - protein, 19 aa, Staphylococcus aureus
VISSKNALDGVERLAQDKQ

SEQ ID NO: 1700746 - protein, 24 aa, Staphylococcus aureus
VITEWEMMGLRKVKIGKTIRYDRQ

SEQ ID NO: 1700747 - protein, 18 aa, Staphylococcus aureus
VITMILFGENNGFKPLCL

SEQ ID NO: 1700748 - protein, 24 aa, Staphylococcus aureus
VIVDTKINPYLIGGFRVKVGTTVL

SEQ ID NO: 1700749 - protein, 19 aa, Staphylococcus aureus
VIVPAFTFIATAQAIVAAK

SEQ ID NO: 1700750 - protein, 19 aa, Staphylococcus aureus
VIYDLDFLKTLPFEQILSG

SEQ ID NO: 1700751 - protein, 22 aa, Staphylococcus aureus
VIYSILKDWLSFIRQTTEVSDF

SEQ ID NO: 1700752 - protein, 26 aa, Staphylococcus aureus
VIYTHPINNYILNGITRIVIKKIAED

SEQ ID NO: 1700753 - protein, 21 aa, Staphylococcus aureus
VKAGAMSLVPLLKSNTPFADT

SEQ ID NO: 1700754 - protein, 20 aa, Staphylococcus aureus
VKAKATFMFDKTAKKFATEQ

SEQ ID NO: 1700755 - protein, 20 aa, Staphylococcus aureus
VKAKATFMFDKTAQKFATEQ

SEQ ID NO: 1700756 - protein, 20 aa, Staphylococcus aureus
VKCIFFNQPYLKKKIELNQT

SEQ ID NO: 1700757 - protein, 18 aa, Staphylococcus aureus
VKDVLLIMAKFQEELVQP

SEQ ID NO: 1700758 - protein, 22 aa, Staphylococcus aureus
VKDVLLIMAKFQEELVQPMADH

SEQ ID NO: 1700759 - protein, 24 aa, Staphylococcus aureus
VKEANLKIIYWLQGTGVVSINLQQ

SEQ ID NO: 1700760 - protein, 20 aa, Staphylococcus aureus
VKEHIYLNEKYKFGIVLKEV

SEQ ID NO: 1700761 - protein, 25 aa, Staphylococcus aureus
VKEHIYLNEKYKFGIVLKEVTPLEI

SEQ ID NO: 1700762 - protein, 27 aa, Staphylococcus aureus
VKEKPTARWLFLTLSTKNAIDGDHLEQ

SEQ ID NO: 1700763 - protein, 18 aa, Staphylococcus aureus
VKEYYLDYFGLEQSAYMD

SEQ ID NO: 1700764 - protein, 23 aa, Staphylococcus aureus
VKEYYLNIMYGEYDLFYGFIEND

SEQ ID NO: 1700765 - protein, 26 aa, Staphylococcus aureus
VKGEHQLPLFRYLTAAQHGFLNEKIK

SEQ ID NO: 1700766 - protein, 17 aa, Staphylococcus aureus
VKGFITYKIPKKVIKHA

SEQ ID NO: 1700767 - protein, 24 aa, Staphylococcus aureus
VKHKFSELHVFPYSPRIGTPAVRM

SEQ ID NO: 1700768 - protein, 17 aa, Staphylococcus aureus
VKHVIPEIVAHSHYTVQ

SEQ ID NO: 1700769 - protein, 25 aa, Staphylococcus aureus
VKHYRDNFWATADMKRLAGTTTLDN

SEQ ID NO: 1700770 - protein, 22 aa, Staphylococcus aureus
VKHYRDNFWATADMTCLPGTTT

SEQ ID NO: 1700771 - protein, 19 aa, Staphylococcus aureus
VKIKMLTRLGLITNPNDIN

SEQ ID NO: 1700772 - protein, 28 aa, Staphylococcus aureus
VKITSGVIDMLFAHLKNFSKSPPSGTMV

SEQ ID NO: 1700773 - protein, 24 aa, Staphylococcus aureus
VKKAKDWYRALSKEEIKALEEENF

SEQ ID NO: 1700774 - protein, 19 aa, Staphylococcus aureus
VKKALPEHALFNNVGDASN

SEQ ID NO: 1700775 - protein, 22 aa, Staphylococcus aureus
VKLEPPIKEWGKMGLLTIVDDD

SEQ ID NO: 1700776 - protein, 25 aa, Staphylococcus aureus
VKNFYNTGLPAIPHTKLRDALAHEI

SEQ ID NO: 1700777 - protein, 17 aa, Staphylococcus aureus
VKNLLIKGFKMATAENK

SEQ ID NO: 1700778 - protein, 27 aa, Staphylococcus aureus
VKPDTLKFMLKVFLDLNFVTQEDGLIR

SEQ ID NO: 1700779 - protein, 18 aa, Staphylococcus aureus
VKPIISHFLPLEKGPETF

SEQ ID NO: 1700780 - protein, 22 aa, Staphylococcus aureus
VKPIISHFLPLEKGTETFDKLV

SEQ ID NO: 1700781 - protein, 21 aa, Staphylococcus aureus
VKQAFINAKRDVITLAEGDIS

SEQ ID NO: 1700782 - protein, 26 aa, Staphylococcus aureus
VKQDLTEVQALDQLMDALQQSIADKD

SEQ ID NO: 1700783 - protein, 28 aa, Staphylococcus aureus
VKQDLTEVQALDQLMDALQQSIADKDAT

SEQ ID NO: 1700784 - protein, 23 aa, Staphylococcus aureus
VKQLYSPVQFINSTEWLIDQGVD

SEQ ID NO: 1700785 - protein, 23 aa, Staphylococcus aureus
VKQLYSPVQFINSTEWLIEQGVD

SEQ ID NO: 1700786 - protein, 17 aa, Staphylococcus aureus
VKQRKMYPLTQSSMPID

SEQ ID NO: 1700787 - protein, 18 aa, Staphylococcus aureus
VKQVFAIPGNEAMTPIAE

SEQ ID NO: 1700788 - protein, 19 aa, Staphylococcus aureus
VKRDAIIKVSQLFENIREC

SEQ ID NO: 1700789 - protein, 19 aa, Staphylococcus aureus
VKRDAVIKLGQLFENIREC

SEQ ID NO: 1700790 - protein, 20 aa, Staphylococcus aureus
VKRNAVIKLGQLFENIRECG

SEQ ID NO: 1700791 - protein, 23 aa, Staphylococcus aureus
VKRPYLIEYIDSFATPQGAKDTK

SEQ ID NO: 1700792 - protein, 23 aa, Staphylococcus aureus
VKSAPFFELYQDGDTTSGKYITE

SEQ ID NO: 1700793 - protein, 20 aa, Staphylococcus aureus
VKSYVKHALVFKGNFKMFYD

SEQ ID NO: 1700794 - protein, 24 aa, Staphylococcus aureus
VKTPYKKWFERMSDYGFEENIDYI

SEQ ID NO: 1700795 - protein, 26 aa, Staphylococcus aureus
VKVAGTWHYICLFIDLFNREIVGYSA

SEQ ID NO: 1700796 - protein, 26 aa, Staphylococcus aureus
VKVGGTWHYICLFIDLFNREIVGYSA

SEQ ID NO: 1700797 - protein, 23 aa, Staphylococcus aureus
VKVIIETVLLDHDEIVKASELTK

SEQ ID NO: 1700798 - protein, 22 aa, Staphylococcus aureus
VKVIKSKYIYWKNIEITKKGDN

SEQ ID NO: 1700799 - protein, 24 aa, Staphylococcus aureus
VKYDDIFLGNEYENFVFTNDKKKS

SEQ ID NO: 1700800 - protein, 25 aa, Staphylococcus aureus
VLAARLGWLPSYPQFNKNSLLFAEE

SEQ ID NO: 1700801 - protein, 23 aa, Staphylococcus aureus
VLAGYPLIDVKAKLYDGSYHDVD

SEQ ID NO: 1700802 - protein, 18 aa, Staphylococcus aureus
VLDDAKILDALNGAVRGR

SEQ ID NO: 1700803 - protein, 25 aa, Staphylococcus aureus
VLDHRNVLGVLPTGGGKSICYQVPG

SEQ ID NO: 1700804 - protein, 29 aa, Staphylococcus aureus
VLDIKVIMPMFDDALPYYKQFITEVTTFL

SEQ ID NO: 1700805 - protein, 20 aa, Staphylococcus aureus
VLDYIKKIIHLKNIHFVGLA

SEQ ID NO: 1700806 - protein, 24 aa, Staphylococcus aureus
VLEHPSVLEVVRYLEAHEGFKVKY

SEQ ID NO: 1700807 - protein, 23 aa, Staphylococcus aureus
VLEQFDNAVILFMGAGDIQKLQN

SEQ ID NO: 1700808 - protein, 17 aa, Staphylococcus aureus
VLEVEKVDFIPTGNGDV

SEQ ID NO: 1700809 - protein, 27 aa, Staphylococcus aureus
VLFNEGQKVNIIIIASGLYSDTIGAFD

SEQ ID NO: 1700810 - protein, 18 aa, Staphylococcus aureus
VLIHACWLANIEIAMINT

SEQ ID NO: 1700811 - protein, 27 aa, Staphylococcus aureus
VLKDGHRAPFSSIYFLLTDDNISHFHR

SEQ ID NO: 1700812 - protein, 28 aa, Staphylococcus aureus
VLKDNEHSPLLFAKRRKDKEEDVETTTS

SEQ ID NO: 1700813 - protein, 29 aa, Staphylococcus aureus
VLKNTANLAILPFKLLGKGIGLASKSVFA

SEQ ID NO: 1700814 - protein, 23 aa, Staphylococcus aureus
VLNALAVIAISYLEKLDLTNIKE

SEQ ID NO: 1700815 - protein, 33 aa, Staphylococcus aureus
VLNDTVEFMVFVDKYKLPLSVSKYIYDKYNNKQ

SEQ ID NO: 1700816 - protein, 23 aa, Staphylococcus aureus
VLPSEVAHTCAYLYHPNARSVTG

SEQ ID NO: 1700817 - protein, 23 aa, Staphylococcus aureus
VLQRLVNRIIVIKDGAIVDDFET

SEQ ID NO: 1700818 - protein, 17 aa, Staphylococcus aureus
VLQTRWTQKGRLKIHEI

SEQ ID NO: 1700819 - protein, 28 aa, Staphylococcus aureus
VLSDLNTTFYRKFIKWYGSNHSTETVRK

SEQ ID NO: 1700820 - protein, 18 aa, Staphylococcus aureus
VLSHILGVELPNPSMIDE

SEQ ID NO: 1700821 - protein, 18 aa, Staphylococcus aureus
VLSMLFHMQQEQGLWYVE

SEQ ID NO: 1700822 - protein, 24 aa, Staphylococcus aureus
VLSNHFDMFWTLTFDPKKYDGEVS

SEQ ID NO: 1700823 - protein, 18 aa, Staphylococcus aureus
VLSTYEFCYHGVALKNLC

SEQ ID NO: 1700824 - protein, 35 aa, Staphylococcus aureus
VLTGPKLQYVRNYILKRFKVVGVVSLPYETFIPHG

SEQ ID NO: 1700825 - protein, 22 aa, Staphylococcus aureus
VLVEVLLKENVDYLFGYPGGAV

SEQ ID NO: 1700826 - protein, 25 aa, Staphylococcus aureus
VLVQTLYISVDPYIRGRMTKADSYV

SEQ ID NO: 1700827 - protein, 17 aa, Staphylococcus aureus
VLYQAFGLKMQPEQQKL

SEQ ID NO: 1700828 - protein, 18 aa, Staphylococcus aureus
VLYTVLRPYLTSNAHIVG

SEQ ID NO: 1700829 - protein, 17 aa, Staphylococcus aureus
VMDARLKKMRKQRDEYK

SEQ ID NO: 1700830 - protein, 18 aa, Staphylococcus aureus
VMGKIDFQLTPMNTLIEG

SEQ ID NO: 1700831 - protein, 18 aa, Staphylococcus aureus
VMKKMIANLLIEKSLDVI

SEQ ID NO: 1700832 - protein, 18 aa, Staphylococcus aureus
VMKPSEITPLTTIRVFEL

SEQ ID NO: 1700833 - protein, 23 aa, Staphylococcus aureus
VMLGGKLVVLKRGSFHTSELKLS

SEQ ID NO: 1700834 - protein, 17 aa, Staphylococcus aureus
VMLYYGPSGVGKTELAK

SEQ ID NO: 1700835 - protein, 24 aa, Staphylococcus aureus
VMNKGYWTGNLSRNIRYKKTGDLQ

SEQ ID NO: 1700836 - protein, 19 aa, Staphylococcus aureus
VMTDYRLHKNWITPYSTRY

SEQ ID NO: 1700837 - protein, 17 aa, Staphylococcus aureus
VMTTLFLIGQALQDDEI

SEQ ID NO: 1700838 - protein, 26 aa, Staphylococcus aureus
VNAAPFSFFNIVNNHPPMIAIAVQRA

SEQ ID NO: 1700839 - protein, 23 aa, Staphylococcus aureus
VNCVAPGPFWSPLQISGGQPQSK

SEQ ID NO: 1700840 - protein, 24 aa, Staphylococcus aureus
VNDGDAVIFYNFRPDRAAQLSEIF

SEQ ID NO: 1700841 - protein, 17 aa, Staphylococcus aureus
VNDLGIELIINEALREV

SEQ ID NO: 1700842 - protein, 24 aa, Staphylococcus aureus
VNDQLDLMKLLYQNVTRTKHKLVL

SEQ ID NO: 1700843 - protein, 19 aa, Staphylococcus aureus
VNDTLWYDTSNPDVAVLRR

SEQ ID NO: 1700844 - protein, 25 aa, Staphylococcus aureus
VNEEKSKIFFTCYSKILAQDLNERI

SEQ ID NO: 1700845 - protein, 18 aa, Staphylococcus aureus
VNELLFGQYPKFNRQIYV

SEQ ID NO: 1700846 - protein, 25 aa, Staphylococcus aureus
VNFENKQIILLPGPPKEMQPMVKNE

SEQ ID NO: 1700847 - protein, 30 aa, Staphylococcus aureus
VNIADKIIIGGGMVYTFLKAQGKEIGISLL

SEQ ID NO: 1700848 - protein, 17 aa, Staphylococcus aureus
VNIGKKLLDLHLNYEAV

SEQ ID NO: 1700849 - protein, 29 aa, Staphylococcus aureus
VNIGQRRLFEWLRQNGFLIKRKGVDYNMP

SEQ ID NO: 1700850 - protein, 25 aa, Staphylococcus aureus
VNKAAKFLLALYNVFIEKDCSIIEI

SEQ ID NO: 1700851 - protein, 22 aa, Staphylococcus aureus
VNKLRDGYLLSDKKYKDWTEHN

SEQ ID NO: 1700852 - protein, 17 aa, Staphylococcus aureus
VNLPELIQWAWDNPKLS

SEQ ID NO: 1700853 - protein, 20 aa, Staphylococcus aureus
VNMIALVNGRPKLINLKEAL

SEQ ID NO: 1700854 - protein, 18 aa, Staphylococcus aureus
VNNHLRQLHEIRPQHFVF

SEQ ID NO: 1700855 - protein, 23 aa, Staphylococcus aureus
VNNSKFIQYTFGNEPDDLEVLDF

SEQ ID NO: 1700856 - protein, 20 aa, Staphylococcus aureus
VNRHHLKCKIFAPYGFSEEK

SEQ ID NO: 1700857 - protein, 25 aa, Staphylococcus aureus
VNRLINDMIYFVRDTIMNKTSEKDT

SEQ ID NO: 1700858 - protein, 21 aa, Staphylococcus aureus
VNRNDIFGVIGYSGAGKSTLV

SEQ ID NO: 1700859 - protein, 21 aa, Staphylococcus aureus
VNTLEFFKNWKKQPGKPLDTQ

SEQ ID NO: 1700860 - protein, 21 aa, Staphylococcus aureus
VNTLYPKYKYYKTHGIETLLT

SEQ ID NO: 1700861 - protein, 41 aa, Staphylococcus aureus
VNVAKTGTAHLFKVPTDADRLDLEFIPDNTAVADASRITTN

SEQ ID NO: 1700862 - protein, 28 aa, Staphylococcus aureus
VNVITGLIKANIPTRIAFMVSSSVDSRT

SEQ ID NO: 1700863 - protein, 20 aa, Staphylococcus aureus
VNVPPMHLWCRSTTVPHVGN

SEQ ID NO: 1700864 - protein, 22 aa, Staphylococcus aureus
VPDFLLNRVYRTDPKTLMFAHA

SEQ ID NO: 1700865 - protein, 19 aa, Staphylococcus aureus
VPDHLSGLLFDDIPYLKVA

SEQ ID NO: 1700866 - protein, 24 aa, Staphylococcus aureus
VPEDHAYIRFPVSDGTQELKIVSS

SEQ ID NO: 1700867 - protein, 18 aa, Staphylococcus aureus
VPFQLQLLFVESGNGITI

SEQ ID NO: 1700868 - protein, 18 aa, Staphylococcus aureus
VPFRTLTGRQSYYVDHEV

SEQ ID NO: 1700869 - protein, 19 aa, Staphylococcus aureus
VPMGLFSGDFIFVGDIGRP

SEQ ID NO: 1700870 - protein, 20 aa, Staphylococcus aureus
VPMGLFSGDFIFVGDIGRPD

SEQ ID NO: 1700871 - protein, 23 aa, Staphylococcus aureus
VPNATFMMIYDADRFGLSILHQL

SEQ ID NO: 1700872 - protein, 23 aa, Staphylococcus aureus
VPRGLPVIPEAYTPKLKRVNRKP

SEQ ID NO: 1700873 - protein, 24 aa, Staphylococcus aureus
VPSAIFGTMKHKKLENGRIPVSKP

SEQ ID NO: 1700874 - protein, 17 aa, Staphylococcus aureus
VPYDLPIAKNNLFEYEG

SEQ ID NO: 1700875 - protein, 18 aa, Staphylococcus aureus
VQAVQLITRAMGDAGIEA

SEQ ID NO: 1700876 - protein, 29 aa, Staphylococcus aureus
VQEAYNNYFEPVLNYILEVIHSVETAVRH

SEQ ID NO: 1700877 - protein, 24 aa, Staphylococcus aureus
VQEVHAWTFKQGMTAPQCAGIIHT

SEQ ID NO: 1700878 - protein, 24 aa, Staphylococcus aureus
VQEYAPILYQIWKKKHKKAYYKWR

SEQ ID NO: 1700879 - protein, 17 aa, Staphylococcus aureus
VQHLLITMPQSFGRATM

SEQ ID NO: 1700880 - protein, 22 aa, Staphylococcus aureus
VQIWIADYVLSTYGTGAIMAVP

SEQ ID NO: 1700881 - protein, 25 aa, Staphylococcus aureus
VQKDHKLVMLFGDNLLDFTDPKEAT

SEQ ID NO: 1700882 - protein, 27 aa, Staphylococcus aureus
VQKNQFAWVVAAFPSKAWAKRVYPELP

SEQ ID NO: 1700883 - protein, 27 aa, Staphylococcus aureus
VQKNQFPWVVAAFPSKAWAKSVYPELS

SEQ ID NO: 1700884 - protein, 25 aa, Staphylococcus aureus
VQNGVGFVLTYFTEGIIFGSKANDP

SEQ ID NO: 1700885 - protein, 33 aa, Staphylococcus aureus
VQPCCFKLYNDPFDMVYVMMNGKLFGHVYIKDC

SEQ ID NO: 1700886 - protein, 32 aa, Staphylococcus aureus
VQPCCFKLYNDPFDMVYVMMNSKLFGHVYIKD

SEQ ID NO: 1700887 - protein, 20 aa, Staphylococcus aureus
VQPLLHIDFNDMLNALPKQL

SEQ ID NO: 1700888 - protein, 26 aa, Staphylococcus aureus
VQPNRVIYDFYDYDPYQLAANNAKAL

SEQ ID NO: 1700889 - protein, 33 aa, Staphylococcus aureus
VQQLASINVPEARLLVISPYDKSSVADIEKAII

SEQ ID NO: 1700890 - protein, 26 aa, Staphylococcus aureus
VQQNKKLHSWLKISTLIDNVKVKDKY

SEQ ID NO: 1700891 - protein, 27 aa, Staphylococcus aureus
VQRNQFPWVVAAFPSKAWAKRVYPELS

SEQ ID NO: 1700892 - protein, 22 aa, Staphylococcus aureus
VQRYETLFKAYKSLHDIHGYKK

SEQ ID NO: 1700893 - protein, 18 aa, Staphylococcus aureus
VQVLATCQNFFQNQQLYS

SEQ ID NO: 1700894 - protein, 21 aa, Staphylococcus aureus
VREHDFRWEPTILSKSIKDLK

SEQ ID NO: 1700895 - protein, 18 aa, Staphylococcus aureus
VRFMFKLVDGNDKDLPKF

SEQ ID NO: 1700896 - protein, 24 aa, Staphylococcus aureus
VRGQNNQWTIANKPDYVTLDAHTG

SEQ ID NO: 1700897 - protein, 33 aa, Staphylococcus aureus
VRHILFDKQTWPFKQILLPLLYQHDSGGGSMPS

SEQ ID NO: 1700898 - protein, 35 aa, Staphylococcus aureus
VRHILFDKQTWPFKQILLPLLYQRGSGGGSMPSGL

SEQ ID NO: 1700899 - protein, 20 aa, Staphylococcus aureus
VRHYTKGQVIYFLPQESSNI

SEQ ID NO: 1700900 - protein, 20 aa, Staphylococcus aureus
VRIIRACREYGIETVAVYAK

SEQ ID NO: 1700901 - protein, 20 aa, Staphylococcus aureus
VRIQWRVADIKIPTSEIKNI

SEQ ID NO: 1700902 - protein, 18 aa, Staphylococcus aureus
VRNINLALRAQYLFESNI

SEQ ID NO: 1700903 - protein, 26 aa, Staphylococcus aureus
VRNLLAINDLIILSPPVYEESLKSII

SEQ ID NO: 1700904 - protein, 24 aa, Staphylococcus aureus
VRNMKPLIVNQIFEPSHYDDMFIL

SEQ ID NO: 1700905 - protein, 18 aa, Staphylococcus aureus
VRVFEDFATLDLISHGRA

SEQ ID NO: 1700906 - protein, 25 aa, Staphylococcus aureus
VSAASSCYIISLAATLERAKFTDIS

SEQ ID NO: 1700907 - protein, 25 aa, Staphylococcus aureus
VSDKCDFYIKIPMVGHVNSLNASVA

SEQ ID NO: 1700908 - protein, 18 aa, Staphylococcus aureus
VSIYLKKNPNFKFPMKQD

SEQ ID NO: 1700909 - protein, 25 aa, Staphylococcus aureus
VSKRVLSHILGVELPNPSMIDESVV

SEQ ID NO: 1700910 - protein, 30 aa, Staphylococcus aureus
VSLGGILIHRTPILILDELLANLDPATGHE

SEQ ID NO: 1700911 - protein, 22 aa, Staphylococcus aureus
VSLKAAHLRFVTSSPGILKNIN

SEQ ID NO: 1700912 - protein, 29 aa, Staphylococcus aureus
VSNTPIQSYLFIYILIITGGRFGEVQRLC

SEQ ID NO: 1700913 - protein, 31 aa, Staphylococcus aureus
VSQMMLYELRNLFPEIIFLDAISLRIFENYT

SEQ ID NO: 1700914 - protein, 32 aa, Staphylococcus aureus
VSQMMLYELRNLFPEIIFLDVISLRTFENYTL

SEQ ID NO: 1700915 - protein, 30 aa, Staphylococcus aureus
VSQMMLYELRNLFSEIIFLDAISLRTFENY

SEQ ID NO: 1700916 - protein, 27 aa, Staphylococcus aureus
VSRQTISLIERNNFMPSVLTAIKIARI

SEQ ID NO: 1700917 - protein, 25 aa, Staphylococcus aureus
VSVAEHAVMDLLILLRNYEEGHRQS

SEQ ID NO: 1700918 - protein, 21 aa, Staphylococcus aureus
VSVATFTLAVNRTFTNAQGER

SEQ ID NO: 1700919 - protein, 28 aa, Staphylococcus aureus
VSVGYINYQPIPIFPGMSRDIALEVDQN

SEQ ID NO: 1700920 - protein, 18 aa, Staphylococcus aureus
VSVLKRFKAMLLQKNETV

SEQ ID NO: 1700921 - protein, 24 aa, Staphylococcus aureus
VSVSYPLDKLVLYIIEEKDKLEYY

SEQ ID NO: 1700922 - protein, 28 aa, Staphylococcus aureus
VTDLDSANWVFKKLDAITTKENEINDLA

SEQ ID NO: 1700923 - protein, 28 aa, Staphylococcus aureus
VTDLDSANWVFKKLDAITTKENEINELA

SEQ ID NO: 1700924 - protein, 33 aa, Staphylococcus aureus
VTEKPKPWDVYAFPYYYVYNDFSDHYPIKAYSK

SEQ ID NO: 1700925 - protein, 23 aa, Staphylococcus aureus
VTEMKMFEFKQGVKLFAANVILS

SEQ ID NO: 1700926 - protein, 24 aa, Staphylococcus aureus
VTEMKMFEFKQGVKLFGAIVILSQ

SEQ ID NO: 1700927 - protein, 18 aa, Staphylococcus aureus
VTFQLPSIFAIMEDVLKL

SEQ ID NO: 1700928 - protein, 17 aa, Staphylococcus aureus
VTGIVYQDKETPSYESQ

SEQ ID NO: 1700929 - protein, 20 aa, Staphylococcus aureus
VTGLPSGLSYDSATNSIIGT

SEQ ID NO: 1700930 - protein, 27 aa, Staphylococcus aureus
VTHPDFIVPMPHRIFDFYNAFIGTSDF

SEQ ID NO: 1700931 - protein, 27 aa, Staphylococcus aureus
VTHTGGCGLFLFPKKCLLKSLWYMAQP

SEQ ID NO: 1700932 - protein, 25 aa, Staphylococcus aureus
VTIQPFAATIPYYFTGHEGPDSCCI

SEQ ID NO: 1700933 - protein, 25 aa, Staphylococcus aureus
VTLSHGIPGLILFLDAYQKAYNTNT

SEQ ID NO: 1700934 - protein, 26 aa, Staphylococcus aureus
VTLSHGIPGLILFLDAYQKAYNTNTE

SEQ ID NO: 1700935 - protein, 26 aa, Staphylococcus aureus
VTLSYGIPGLILFLDAYQKAYNTNTE

SEQ ID NO: 1700936 - protein, 30 aa, Staphylococcus aureus
VTPKKEVLLVKQYRKPVEKPLLEIPAGKLE

SEQ ID NO: 1700937 - protein, 21 aa, Staphylococcus aureus
VTQIQIAIPTQIATQIPTAIQ

SEQ ID NO: 1700938 - protein, 26 aa, Staphylococcus aureus
VTQIQTAIRIQIAIQIQTAIQNQTAI

SEQ ID NO: 1700939 - protein, 17 aa, Staphylococcus aureus
VTQVRYVDVTTGKDIIP

SEQ ID NO: 1700940 - protein, 19 aa, Staphylococcus aureus
VTRTQIVTQIQTAIRIQIA

SEQ ID NO: 1700941 - protein, 23 aa, Staphylococcus aureus
VTSTPVLRPLLTYDKEEIIIKSK

SEQ ID NO: 1700942 - protein, 27 aa, Staphylococcus aureus
VTWGYAKSILNTWLNANLKSIEQVRAF

SEQ ID NO: 1700943 - protein, 20 aa, Staphylococcus aureus
VTYVNLLNHSYMKYINAESY

SEQ ID NO: 1700944 - protein, 17 aa, Staphylococcus aureus
VVAAICMYALKTAGYQS

SEQ ID NO: 1700945 - protein, 23 aa, Staphylococcus aureus
VVANPILYEHALSKAYIEAIINE

SEQ ID NO: 1700946 - protein, 27 aa, Staphylococcus aureus
VVDSDAKFIIWTTTPWTIPSNVAITVH

SEQ ID NO: 1700947 - protein, 18 aa, Staphylococcus aureus
VVEHARENNLKIIASCSF

SEQ ID NO: 1700948 - protein, 18 aa, Staphylococcus aureus
VVGFIGGQTAPLGKRMGH

SEQ ID NO: 1700949 - protein, 23 aa, Staphylococcus aureus
VVHNFDFFISAKKNQKEKFINVF

SEQ ID NO: 1700950 - protein, 17 aa, Staphylococcus aureus
VVIEEMKPNHYGVAGVR

SEQ ID NO: 1700951 - protein, 18 aa, Staphylococcus aureus
VVKLYFKKQRHGLKNINF

SEQ ID NO: 1700952 - protein, 17 aa, Staphylococcus aureus
VVPDYMDIYDFTPIQYP

SEQ ID NO: 1700953 - protein, 17 aa, Staphylococcus aureus
VVQVIHELPFDKGLSRV

SEQ ID NO: 1700954 - protein, 26 aa, Staphylococcus aureus
VVRGQNNQWTIANKPDYVTLDAQTGK

SEQ ID NO: 1700955 - protein, 25 aa, Staphylococcus aureus
VVRLANFGAFVEIASGVQGLVHISE

SEQ ID NO: 1700956 - protein, 19 aa, Staphylococcus aureus
VVSLDFRMTATPLYSDIVL

SEQ ID NO: 1700957 - protein, 19 aa, Staphylococcus aureus
VVSLLHGSYALGLLDAEDK

SEQ ID NO: 1700958 - protein, 22 aa, Staphylococcus aureus
VVTHFLAILEMSKAGIINIEQQ

SEQ ID NO: 1700959 - protein, 22 aa, Staphylococcus aureus
VVTKLLDIELSIGRTGVVTPTA

SEQ ID NO: 1700960 - protein, 18 aa, Staphylococcus aureus
VVVLFKMHPFVKNRLNIS

SEQ ID NO: 1700961 - protein, 34 aa, Staphylococcus aureus
VVVVAPLEILDPFKGILKFQLPNDVIKRDGSYQA

SEQ ID NO: 1700962 - protein, 17 aa, Staphylococcus aureus
VVWRLDRLGRNMADLIT

SEQ ID NO: 1700963 - protein, 30 aa, Staphylococcus aureus
VVYTAKKLNLNAVIFMPVTTPLQKVNQVKF

SEQ ID NO: 1700964 - protein, 20 aa, Staphylococcus aureus
VWARSRGLISSEEMAKELVE

SEQ ID NO: 1700965 - protein, 31 aa, Staphylococcus aureus
VWATAAPGWQKWVWSPFLSVLGSGATAFVFN

SEQ ID NO: 1700966 - protein, 20 aa, Staphylococcus aureus
VYAEFYDNTYYYVFRGEGID

SEQ ID NO: 1700967 - protein, 17 aa, Staphylococcus aureus
VYAGNIQIWKKPSSFVI

SEQ ID NO: 1700968 - protein, 17 aa, Staphylococcus aureus
VYAGNIQVWKKPSSFVI

SEQ ID NO: 1700969 - protein, 18 aa, Staphylococcus aureus
VYATDTRLLPKAKRLDIV

SEQ ID NO: 1700970 - protein, 21 aa, Staphylococcus aureus
VYEEFNYIYIYNLRGDQRTQG

SEQ ID NO: 1700971 - protein, 17 aa, Staphylococcus aureus
VYEIFQNTLLKRANEDE

SEQ ID NO: 1700972 - protein, 18 aa, Staphylococcus aureus
VYKMMTLFNNQSYIDYKG

SEQ ID NO: 1700973 - protein, 24 aa, Staphylococcus aureus
VYLNGIQLPLYAEQVRWMHGTCWI

SEQ ID NO: 1700974 - protein, 21 aa, Staphylococcus aureus
VYLVNGKFWVNNHAHILSPLN

SEQ ID NO: 1700975 - protein, 19 aa, Staphylococcus aureus
VYMRLRRVGNKFSIKTWKF

SEQ ID NO: 1700976 - protein, 23 aa, Staphylococcus aureus
VYNKVCYQVFYDEKGYPYISRNI

SEQ ID NO: 1700977 - protein, 20 aa, Staphylococcus aureus
VYPEDDVEKWFYDTAPQRVE

SEQ ID NO: 1700978 - protein, 23 aa, Staphylococcus aureus
VYRDDFRVIFEVQDFGIGIKLED

SEQ ID NO: 1700979 - protein, 28 aa, Staphylococcus aureus
VYTDTKWCRMIIRQILSNALKYSENFNI

SEQ ID NO: 1700980 - protein, 17 aa, Staphylococcus aureus
WASMMYRIWKNPEKYKS

SEQ ID NO: 1700981 - protein, 17 aa, Staphylococcus aureus
WAYDVKGIEPNKAEIIA

SEQ ID NO: 1700982 - protein, 19 aa, Staphylococcus aureus
WDIAAQFLFAELLNLKMTT

SEQ ID NO: 1700983 - protein, 20 aa, Staphylococcus aureus
WDIAAQFLFAELLNLKMTTL

SEQ ID NO: 1700984 - protein, 25 aa, Staphylococcus aureus
WEERRFADIFKFHNKLRKPIKENLR

SEQ ID NO: 1700985 - protein, 19 aa, Staphylococcus aureus
WELLDLPEEIKQYGTPLPL

SEQ ID NO: 1700986 - protein, 26 aa, Staphylococcus aureus
WENEWKNYFHPFRASKNFTIVPSWET

SEQ ID NO: 1700987 - protein, 25 aa, Staphylococcus aureus
WENKFIKDIFIFENNRRKPITSSLR

SEQ ID NO: 1700988 - protein, 42 aa, Staphylococcus aureus
WEVSSGGYFVWLVFKIDIDIKYLFYELLSKEKILINPGYIYG

SEQ ID NO: 1700989 - protein, 20 aa, Staphylococcus aureus
WFEEEPIKKINLDPSFINWS

SEQ ID NO: 1700990 - protein, 20 aa, Staphylococcus aureus
WFGFDVVVATPDMMGEVGKL

SEQ ID NO: 1700991 - protein, 18 aa, Staphylococcus aureus
WFTDPITLEHLRSKLKKE

SEQ ID NO: 1700992 - protein, 17 aa, Staphylococcus aureus
WFVWNMATYDLREAVNL

SEQ ID NO: 1700993 - protein, 23 aa, Staphylococcus aureus
WGEFIPFFLERMDEALFAEHLNH

SEQ ID NO: 1700994 - protein, 17 aa, Staphylococcus aureus
WGIKLERTFYVSKFAHP

SEQ ID NO: 1700995 - protein, 27 aa, Staphylococcus aureus
WHYSNLRQYINISPYPATANLLEGVTI

SEQ ID NO: 1700996 - protein, 17 aa, Staphylococcus aureus
WICDVLVELRTSTKLKE

SEQ ID NO: 1700997 - protein, 17 aa, Staphylococcus aureus
WIEKHFEFGMQEDQSIL

SEQ ID NO: 1700998 - protein, 17 aa, Staphylococcus aureus
WINTTNAIGLITKSGRY

SEQ ID NO: 1700999 - protein, 19 aa, Staphylococcus aureus
WIPNFYRQCKLGWDDEINF

SEQ ID NO: 1701000 - protein, 19 aa, Staphylococcus aureus
WKAIQLLGIPVEKIHLYFF

SEQ ID NO: 1701001 - protein, 27 aa, Staphylococcus aureus
WKEEYASFIRAQWAKLGLGLDYSRERF

SEQ ID NO: 1701002 - protein, 24 aa, Staphylococcus aureus
WKGTSKWFGNSYKSLKGWTGDMYS

SEQ ID NO: 1701003 - protein, 25 aa, Staphylococcus aureus
WKGTSKWFGNSYKSLKGWTGDMYSR

SEQ ID NO: 1701004 - protein, 18 aa, Staphylococcus aureus
WKKNTVKKIFYMRQYIWM

SEQ ID NO: 1701005 - protein, 17 aa, Staphylococcus aureus
WLEFYSIAIHSDVTSNK

SEQ ID NO: 1701006 - protein, 17 aa, Staphylococcus aureus
WMEIVEALLSEGYQFDL

SEQ ID NO: 1701007 - protein, 19 aa, Staphylococcus aureus
WMHDKYWVDKSVVRIIFSE

SEQ ID NO: 1701008 - protein, 26 aa, Staphylococcus aureus
WNNDNIGPYLPPYKKAADIIEASSLD

SEQ ID NO: 1701009 - protein, 19 aa, Staphylococcus aureus
WNQINKKSGLRIYKQPAIK

SEQ ID NO: 1701010 - protein, 27 aa, Staphylococcus aureus
WNRSHHQLIFFGRYHCLARKPKCGICP

SEQ ID NO: 1701011 - protein, 18 aa, Staphylococcus aureus
WNVTFLPEEINANAFIRP

SEQ ID NO: 1701012 - protein, 32 aa, Staphylococcus aureus
WPTAYSEIYDYQWIEKLIPYWQDLAEFAKEQD

SEQ ID NO: 1701013 - protein, 17 aa, Staphylococcus aureus
WQDFFDKCLSVNANFTR

SEQ ID NO: 1701014 - protein, 25 aa, Staphylococcus aureus
WQEEYKYLRTLIFNETELEEAYKWM

SEQ ID NO: 1701015 - protein, 29 aa, Staphylococcus aureus
WRDWLIGGQDRYLDQRQLLIEQAQANGLV

SEQ ID NO: 1701016 - protein, 22 aa, Staphylococcus aureus
WRHLSKIWYTDRQLLINNLISQ

SEQ ID NO: 1701017 - protein, 31 aa, Staphylococcus aureus
WSNQAVFFTRQLWNMLVLARVITIGAYNRNE

SEQ ID NO: 1701018 - protein, 17 aa, Staphylococcus aureus
WSRRSTIFPNFIGHTFA

SEQ ID NO: 1701019 - protein, 20 aa, Staphylococcus aureus
WTKAFNILRAIDGATLNDCR

SEQ ID NO: 1701020 - protein, 17 aa, Staphylococcus aureus
WTKQFLAVAIRPMIHML

SEQ ID NO: 1701021 - protein, 21 aa, Staphylococcus aureus
WTRQKAFEEYEWLKNTAKNDI

SEQ ID NO: 1701022 - protein, 22 aa, Staphylococcus aureus
WTSPDKAILGGAKFIRNEYFEN

SEQ ID NO: 1701023 - protein, 17 aa, Staphylococcus aureus
WVEDTLTALQQLAQAYL

SEQ ID NO: 1701024 - protein, 30 aa, Staphylococcus aureus
WVISRQRVWGVPLPVFYAENGDIIMTKETV

SEQ ID NO: 1701025 - protein, 35 aa, Staphylococcus aureus
WVKSGIKEIEMFKIMGLPFISHSIVSQDNQSISKK

SEQ ID NO: 1701026 - protein, 35 aa, Staphylococcus aureus; identical to SEQ ID NO: 1600025

SEQ ID NO: 1701027 - protein, 17 aa, Staphylococcus aureus
WVLYSSIVSEFKGESLK

SEQ ID NO: 1701028 - protein, 23 aa, Staphylococcus aureus
WVNQAQLLTSKKMLYIANVGEDE

SEQ ID NO: 1701029 - protein, 18 aa, Staphylococcus aureus
WVTSEVLPTLRKTGAYQI

SEQ ID NO: 1701030 - protein, 19 aa, Staphylococcus aureus
WVTSEVLPTLRKTGAYQIP

SEQ ID NO: 1701031 - protein, 27 aa, Staphylococcus aureus
WYDTSNPDVAVLRRYWNGRWIEATPND

SEQ ID NO: 1701032 - protein, 19 aa, Staphylococcus aureus
WYNYIAQIDRTFDKELLEE

SEQ ID NO: 1701033 - protein, 23 aa, Staphylococcus aureus
WYTDRQLLINNLISQAIPVIKYP

SEQ ID NO: 1701034 - protein, 17 aa, Staphylococcus aureus
YAAIHQGIKDNKAEFEK

SEQ ID NO: 1701035 - protein, 28 aa, Staphylococcus aureus
YAEIAKELLAFYAKYATTAGLTMLEVKK

SEQ ID NO: 1701036 - protein, 30 aa, Staphylococcus aureus
YAHNEWISMLGVVPVIRALREKAMAIQAET

SEQ ID NO: 1701037 - protein, 18 aa, Staphylococcus aureus
YAIYVNYGTGIYATGAGG

SEQ ID NO: 1701038 - protein, 21 aa, Staphylococcus aureus
YAMNSLKLKLVPKNSVLIAMY

SEQ ID NO: 1701039 - protein, 19 aa, Staphylococcus aureus
YAMPIAILIRHMMSFDNTH

SEQ ID NO: 1701040 - protein, 18 aa, Staphylococcus aureus
YANHIEDLLTFPLIALIV

SEQ ID NO: 1701041 - protein, 23 aa, Staphylococcus aureus
YANQPFIKAFNFLTNLLDITYTL

SEQ ID NO: 1701042 - protein, 21 aa, Staphylococcus aureus
YANQPFVRIRDIGIFPTTKEV

SEQ ID NO: 1701043 - protein, 24 aa, Staphylococcus aureus
YAQKIRGIDKPKISLLNIGTEPAK

SEQ ID NO: 1701044 - protein, 17 aa, Staphylococcus aureus
YARFLCDSLKNEMKQYD

SEQ ID NO: 1701045 - protein, 18 aa, Staphylococcus aureus
YARLRPKKLKANIEYTTP

SEQ ID NO: 1701046 - protein, 25 aa, Staphylococcus aureus
YARVKSEWIVKLPDTLTLEESMIYG

SEQ ID NO: 1701047 - protein, 29 aa, Staphylococcus aureus
YATFEPTLDYVISKIPRFPFDKFEKGERE

SEQ ID NO: 1701048 - protein, 17 aa, Staphylococcus aureus
YCTEMMVRFGKNKKAFD

SEQ ID NO: 1701049 - protein, 28 aa, Staphylococcus aureus
YCVDHQITFIPYFPLVSGILAGKYDENT

SEQ ID NO: 1701050 - protein, 17 aa, Staphylococcus aureus
YDALTKFFIAGQKDGWI

SEQ ID NO: 1701051 - protein, 19 aa, Staphylococcus aureus
YDDIPSTLPVFDKVTSGQL

SEQ ID NO: 1701052 - protein, 19 aa, Staphylococcus aureus
YDDMFILNTQAHARLDQMA

SEQ ID NO: 1701053 - protein, 29 aa, Staphylococcus aureus
YDEKYKNFSTYPILLEKDDFQFKVSDKTK

SEQ ID NO: 1701054 - protein, 17 aa, Staphylococcus aureus
YDELSKFANYYIKAGVN

SEQ ID NO: 1701055 - protein, 26 aa, Staphylococcus aureus
YDERMPKIVIVIDELADLMMMAPQEV

SEQ ID NO: 1701056 - protein, 30 aa, Staphylococcus aureus
YDGAYCINGYRWITYIANSGQRRYIATGEV

SEQ ID NO: 1701057 - protein, 29 aa, Staphylococcus aureus
YDIAGKNYIDIAWLARKKGYQVTLKDDSL

SEQ ID NO: 1701058 - protein, 24 aa, Staphylococcus aureus
YDKCIKDILLYSYIGLIDKYSTEL

SEQ ID NO: 1701059 - protein, 24 aa, Staphylococcus aureus
YDKGIYLYQPISHSLLKIVAQKDI

SEQ ID NO: 1701060 - protein, 17 aa, Staphylococcus aureus
YDKKYAFISQNDGELNL

SEQ ID NO: 1701061 - protein, 23 aa, Staphylococcus aureus
YDKLYSLYSLLYTMKKISANLQG

SEQ ID NO: 1701062 - protein, 17 aa, Staphylococcus aureus
YDKVEIVGLMTMAPLTD

SEQ ID NO: 1701063 - protein, 20 aa, Staphylococcus aureus
YDMTNKSEGLFWVLSNLLIQ

SEQ ID NO: 1701064 - protein, 26 aa, Staphylococcus aureus
YDNAITAAKAILNKSTGPNTAQNAVE

SEQ ID NO: 1701065 - protein, 27 aa, Staphylococcus aureus
YDNHQTQIIKILSKVKPDPPRIDGNSV

SEQ ID NO: 1701066 - protein, 18 aa, Staphylococcus aureus
YDNLNVITMILFGENNGF

SEQ ID NO: 1701067 - protein, 27 aa, Staphylococcus aureus
YDNPFNPPMFARVFRKHLEGGIIESIK

SEQ ID NO: 1701068 - protein, 29 aa, Staphylococcus aureus
YDNYEDVYKLLNWIKLIIIEYISNIVKKN

SEQ ID NO: 1701069 - protein, 19 aa, Staphylococcus aureus
YDPYQLAANNAKALKDHIE

SEQ ID NO: 1701070 - protein, 20 aa, Staphylococcus aureus
YDVTILINGLPLVQVELKRR

SEQ ID NO: 1701071 - protein, 22 aa, Staphylococcus aureus
YDYDYKRLHLFLTLTKEDGTLA

SEQ ID NO: 1701072 - protein, 17 aa, Staphylococcus aureus
YDYMIERKYNFMGYRQM

SEQ ID NO: 1701073 - protein, 17 aa, Staphylococcus aureus
YDYVNWYNNFRPHSSSQ

SEQ ID NO: 1701074 - protein, 24 aa, Staphylococcus aureus
YEDWFKSNPLFTRAVYPLANYYFE

SEQ ID NO: 1701075 - protein, 19 aa, Staphylococcus aureus
YEEKLYQVYRYNEKMKTRI

SEQ ID NO: 1701076 - protein, 22 aa, Staphylococcus aureus
YEEMNHLLYCSSAGHEPGYIYR

SEQ ID NO: 1701077 - protein, 31 aa, Staphylococcus aureus
YEFQYAYGLPDYGIIGMQLPLTIVIIGESLD

SEQ ID NO: 1701078 - protein, 26 aa, Staphylococcus aureus
YEHANPTSLIFALKNRLPHKYRDKVE

SEQ ID NO: 1701079 - protein, 24 aa, Staphylococcus aureus
YEHILDIPKYKQAFELDYVDGRQL

SEQ ID NO: 1701080 - protein, 20 aa, Staphylococcus aureus
YEIRNEIAQIKVIFKTVLKS

SEQ ID NO: 1701081 - protein, 23 aa, Staphylococcus aureus
YEKAWELLDLPEKIKQYGTPLPV

SEQ ID NO: 1701082 - protein, 20 aa, Staphylococcus aureus
YEKFAFATLGVRNGATFIST

SEQ ID NO: 1701083 - protein, 17 aa, Staphylococcus aureus
YEKNQLFATLDPKTRQI

SEQ ID NO: 1701084 - protein, 17 aa, Staphylococcus aureus
YELIEDMAKLRERNKEL

SEQ ID NO: 1701085 - protein, 26 aa, Staphylococcus aureus
YENIWEALFLCHQLFRAVSGEVAERL

SEQ ID NO: 1701086 - protein, 17 aa, Staphylococcus aureus
YESDRGTGVLNFAVTKN

SEQ ID NO: 1701087 - protein, 19 aa, Staphylococcus aureus
YETFLKNEIARWIKIQEDI

SEQ ID NO: 1701088 - protein, 19 aa, Staphylococcus aureus
YEVLKQLCTTYKMVLDFYI

SEQ ID NO: 1701089 - protein, 18 aa, Staphylococcus aureus
YFDERSYFIFGGMAPKHY

SEQ ID NO: 1701090 - protein, 32 aa, Staphylococcus aureus
YFDYYKNRWGLFGYCRFIPYLKKRLNNKIVLM

SEQ ID NO: 1701091 - protein, 17 aa, Staphylococcus aureus
YFEKCLPGYTLINKLHP

SEQ ID NO: 1701092 - protein, 17 aa, Staphylococcus aureus
YFIDLDLLQLINSVKRM

SEQ ID NO: 1701093 - protein, 17 aa, Staphylococcus aureus
YFIFSNKHLCEYLGYGE

SEQ ID NO: 1701094 - protein, 19 aa, Staphylococcus aureus
YFLIVSDLIHYAKMNDVMV

SEQ ID NO: 1701095 - protein, 17 aa, Staphylococcus aureus
YFLQKQTYLLKLLQHFQ

SEQ ID NO: 1701096 - protein, 19 aa, Staphylococcus aureus
YFNDALRAYGLTVKTGEFG

SEQ ID NO: 1701097 - protein, 17 aa, Staphylococcus aureus
YFQPLIKEDDKTFRDGM

SEQ ID NO: 1701098 - protein, 29 aa, Staphylococcus aureus
YFSNRMFEKEWILALSPQGGYTYTFGTSL

SEQ ID NO: 1701099 - protein, 20 aa, Staphylococcus aureus
YGAFDMERILRLMRPSKDEV

SEQ ID NO: 1701100 - protein, 17 aa, Staphylococcus aureus
YGAHNYLPLPIVISEAE

SEQ ID NO: 1701101 - protein, 19 aa, Staphylococcus aureus
YGASFLVLSPEHALVDSIT

SEQ ID NO: 1701102 - protein, 23 aa, Staphylococcus aureus
YGDNPLMRWFTNNVAVKIKPDGN

SEQ ID NO: 1701103 - protein, 22 aa, Staphylococcus aureus
YGDNPLMRWFTNNVAVKVKPDG

SEQ ID NO: 1701104 - protein, 26 aa, Staphylococcus aureus
YGEWTAILAGDALLTKAFELISSDDR

SEQ ID NO: 1701105 - protein, 26 aa, Staphylococcus aureus
YGIDDLPLGIYKYLKTHDKVYARTLD

SEQ ID NO: 1701106 - protein, 17 aa, Staphylococcus aureus
YGKDGMIYNQFMDGQVT

SEQ ID NO: 1701107 - protein, 22 aa, Staphylococcus aureus
YGKFNMLKRRDGNRYIHIQSTD

SEQ ID NO: 1701108 - protein, 24 aa, Staphylococcus aureus
YGKLGVKVWIYRGEVLPTKNTNTS

SEQ ID NO: 1701109 - protein, 27 aa, Staphylococcus aureus
YGLYRDNFLQVAFFYYSPGGNGKTTLL

SEQ ID NO: 1701110 - protein, 26 aa, Staphylococcus aureus
YGMQMQMMTYMDIVLQNKQRLGLTDI

SEQ ID NO: 1701111 - protein, 26 aa, Staphylococcus aureus
YGMSLTRNTSRFYQYWFDHIDEDLAE

SEQ ID NO: 1701112 - protein, 31 aa, Staphylococcus aureus
YGNAETFYPMPFLSPQTMWYYKSAFNTDQMK

SEQ ID NO: 1701113 - protein, 17 aa, Staphylococcus aureus
YGNRKFWCKGFYVDTVG

SEQ ID NO: 1701114 - protein, 23 aa, Staphylococcus aureus
YGPLLNGFYHIPFPDKYRGMYEQ

SEQ ID NO: 1701115 - protein, 17 aa, Staphylococcus aureus
YGRFPHQKGFGRLTAED

SEQ ID NO: 1701116 - protein, 18 aa, Staphylococcus aureus
YGRFPHQKGFGRLTAEDK

SEQ ID NO: 1701117 - protein, 20 aa, Staphylococcus aureus
YGSWQEYWAFESRFIKLNYL

SEQ ID NO: 1701118 - protein, 26 aa, Staphylococcus aureus
YGTFKYMHVRMMPAQQPPYTRLIDSA

SEQ ID NO: 1701119 - protein, 25 aa, Staphylococcus aureus
YGVHALTKILAAAVPLLDDFDIELT

SEQ ID NO: 1701120 - protein, 17 aa, Staphylococcus aureus
YGVKYVEYTKRLGYKIL

SEQ ID NO: 1701121 - protein, 26 aa, Staphylococcus aureus
YGVNGRFQRGFATLPEAVTKKLKATG

SEQ ID NO: 1701122 - protein, 23 aa, Staphylococcus aureus
YGVPRIVFVNKMDKLGANFEYSV

SEQ ID NO: 1701123 - protein, 17 aa, Staphylococcus aureus
YHAMAHKFGDNWKKAQE

SEQ ID NO: 1701124 - protein, 26 aa, Staphylococcus aureus
YHDSKLPLEIYVELVYSIQQEMVYKP

SEQ ID NO: 1701125 - protein, 19 aa, Staphylococcus aureus
YHIVASNAYHKDTEDFYIS

SEQ ID NO: 1701126 - protein, 18 aa, Staphylococcus aureus
YHLVKYFLQKQTYLLKLL

SEQ ID NO: 1701127 - protein, 17 aa, Staphylococcus aureus
YHNVFGIAAYDNDPLRE

SEQ ID NO: 1701128 - protein, 17 aa, Staphylococcus aureus
YHPLESVGIYVPGGKAS

SEQ ID NO: 1701129 - protein, 24 aa, Staphylococcus aureus
YHTDEMMIIFVTNGKKWSQKNAVV

SEQ ID NO: 1701130 - protein, 17 aa, Staphylococcus aureus
YIAALKLGVAIIPCSEM

SEQ ID NO: 1701131 - protein, 20 aa, Staphylococcus aureus
YIALGKMMTTAALLGIDSCP

SEQ ID NO: 1701132 - protein, 24 aa, Staphylococcus aureus
YICEDDVIQWIPLKSLYQPDRDVL

SEQ ID NO: 1701133 - protein, 19 aa, Staphylococcus aureus
YIDEHHLDVISSTNYINAD

SEQ ID NO: 1701134 - protein, 17 aa, Staphylococcus aureus
YIDLYYIHFPDDNTPKD

SEQ ID NO: 1701135 - protein, 18 aa, Staphylococcus aureus
YIFGESYEIFYANALDVQ

SEQ ID NO: 1701136 - protein, 26 aa, Staphylococcus aureus
YIGEMLTFLKYFDAPQPFKIMASHYL

SEQ ID NO: 1701137 - protein, 22 aa, Staphylococcus aureus
YIGRFKTGYFSPLANLARLTEE

SEQ ID NO: 1701138 - protein, 23 aa, Staphylococcus aureus
YIKIKAKWNYLYRAIDAEGHSLD

SEQ ID NO: 1701139 - protein, 23 aa, Staphylococcus aureus
YIKIKGKWNYLYRAIDAEGHTLD

SEQ ID NO: 1701140 - protein, 18 aa, Staphylococcus aureus
YIKIKGKWSYLYRAIDAE

SEQ ID NO: 1701141 - protein, 23 aa, Staphylococcus aureus
YIKIKGKWSYLYRAIDAEGHTLD

SEQ ID NO: 1701142 - protein, 28 aa, Staphylococcus aureus
YIKKGLVEPFIVFYNQENIFYISNTVID

SEQ ID NO: 1701143 - protein, 18 aa, Staphylococcus aureus
YIKQLIKQKPFQLSASVE

SEQ ID NO: 1701144 - protein, 17 aa, Staphylococcus aureus
YIKQLYASRMYTPNEIS

SEQ ID NO: 1701145 - protein, 23 aa, Staphylococcus aureus
YIKVQPFCYDLVDQKLKPNQYAE

SEQ ID NO: 1701146 - protein, 24 aa, Staphylococcus aureus
YILSSFPGIFIRRPLRDNNGIFEN

SEQ ID NO: 1701147 - protein, 25 aa, Staphylococcus aureus
YILSSFPGIFIRRPLRDNNGIFENI

SEQ ID NO: 1701148 - protein, 28 aa, Staphylococcus aureus
YINTPNWEGLLNYLINENTMINKPLQYY

SEQ ID NO: 1701149 - protein, 17 aa, Staphylococcus aureus
YIPIPNSKKFHESNPDF

SEQ ID NO: 1701150 - protein, 23 aa, Staphylococcus aureus
YIRARPFCYDLIDDKLKPNQHAK

SEQ ID NO: 1701151 - protein, 21 aa, Staphylococcus aureus
YISKLQQHFQFHLAISGHEGI

SEQ ID NO: 1701152 - protein, 19 aa, Staphylococcus aureus
YISLYNKYGSPLPLMHLYK

SEQ ID NO: 1701153 - protein, 17 aa, Staphylococcus aureus
YISYPTIYRYIREGLVK

SEQ ID NO: 1701154 - protein, 17 aa, Staphylococcus aureus
YISYPTIYRYMREGLVE

SEQ ID NO: 1701155 - protein, 17 aa, Staphylococcus aureus
YIVMDNQIYGLTKGQTS

SEQ ID NO: 1701156 - protein, 19 aa, Staphylococcus aureus
YIYHFIVEGNRRLEKPKGI

SEQ ID NO: 1701157 - protein, 25 aa, Staphylococcus aureus
YKDARNYLSYLYSNHLKRTSVSRKI

SEQ ID NO: 1701158 - protein, 18 aa, Staphylococcus aureus
YKEELIEFILSIQKNEFN

SEQ ID NO: 1701159 - protein, 19 aa, Staphylococcus aureus
YKEELIEFILSIQKNEFNI

SEQ ID NO: 1701160 - protein, 23 aa, Staphylococcus aureus
YKEELIEFILSIQKNEFNIKIDR

SEQ ID NO: 1701161 - protein, 22 aa, Staphylococcus aureus
YKEKYITTILYYEPGDIVTIKR

SEQ ID NO: 1701162 - protein, 18 aa, Staphylococcus aureus
YKEQFDTLSYFQLKVLIV

SEQ ID NO: 1701163 - protein, 17 aa, Staphylococcus aureus
YKHFLEKYFGLNVTINR

SEQ ID NO: 1701164 - protein, 18 aa, Staphylococcus aureus
YKHKMAIYALKDVKKILN

SEQ ID NO: 1701165 - protein, 17 aa, Staphylococcus aureus
YKKMPTEEQWLKDLKRQ

SEQ ID NO: 1701166 - protein, 27 aa, Staphylococcus aureus
YKKSDDILINLYIETFEFYCRLRDELK

SEQ ID NO: 1701167 - protein, 18 aa, Staphylococcus aureus
YKKWGHTFKVCHLVMNFQ

SEQ ID NO: 1701168 - protein, 18 aa, Staphylococcus aureus
YKKWGHTLKVCHLVMNFQ

SEQ ID NO: 1701169 - protein, 19 aa, Staphylococcus aureus
YKMPVIYSTHPRSWKKIEE

SEQ ID NO: 1701170 - protein, 24 aa, Staphylococcus aureus
YKNPFPSRWRYVVDILQQLLQTKK

SEQ ID NO: 1701171 - protein, 30 aa, Staphylococcus aureus
YKNQQILGEWILQGVFQLAPREILTGDKLN

SEQ ID NO: 1701172 - protein, 19 aa, Staphylococcus aureus
YKPSPDGIIYILQKYDLHN

SEQ ID NO: 1701173 - protein, 20 aa, Staphylococcus aureus
YKQAFELDYVDGRQLFVGLV

SEQ ID NO: 1701174 - protein, 20 aa, Staphylococcus aureus
YKRGTIIYVDFGINVGSEIS

SEQ ID NO: 1701175 - protein, 17 aa, Staphylococcus aureus
YKRTMFWSEFEIRQYTH

SEQ ID NO: 1701176 - protein, 30 aa, Staphylococcus aureus
YKTNVFGIVRMMNTFVPLLEKSEQPVVVNV

SEQ ID NO: 1701177 - protein, 24 aa, Staphylococcus aureus
YKTYLKVPLLIKKAEKAECVSRFR

SEQ ID NO: 1701178 - protein, 17 aa, Staphylococcus aureus
YKVFDFFQENGFGFITQ

SEQ ID NO: 1701179 - protein, 22 aa, Staphylococcus aureus
YKVFTSFYRKWRSYLRHRDVYH

SEQ ID NO: 1701180 - protein, 17 aa, Staphylococcus aureus
YKVYFKNGSSKYVDLKT

SEQ ID NO: 1701181 - protein, 19 aa, Staphylococcus aureus
YKYFDENYFIFGGLEPIRY

SEQ ID NO: 1701182 - protein, 32 aa, Staphylococcus aureus
YKYMDSFGDPQFVYSWKLVPTDRIPAGKRDCI

SEQ ID NO: 1701183 - protein, 17 aa, Staphylococcus aureus
YLAFFTINNSIKTMTIV

SEQ ID NO: 1701184 - protein, 17 aa, Staphylococcus aureus
YLAHTYGCHIQGVDINK

SEQ ID NO: 1701185 - protein, 21 aa, Staphylococcus aureus
YLEKSRCIPINLWVNGNHKTI

SEQ ID NO: 1701186 - protein, 20 aa, Staphylococcus aureus
YLENFKKLYKIVRKTRYAIH

SEQ ID NO: 1701187 - protein, 17 aa, Staphylococcus aureus
YLIKPNIAIVTGIGAAH

SEQ ID NO: 1701188 - protein, 17 aa, Staphylococcus aureus
YLIVVMDGRQCVAFFTL

SEQ ID NO: 1701189 - protein, 26 aa, Staphylococcus aureus
YLKDNHVLEYVLYKAINLEFDRFTIP

SEQ ID NO: 1701190 - protein, 25 aa, Staphylococcus aureus
YLKHSQIETIISQFNLIDNRPESLL

SEQ ID NO: 1701191 - protein, 32 aa, Staphylococcus aureus
YLKIKSEYQDCLLFFRLGDFYEMFYEDAKEAS

SEQ ID NO: 1701192 - protein, 17 aa, Staphylococcus aureus
YLKIPRLIKKAERGECI

SEQ ID NO: 1701193 - protein, 22 aa, Staphylococcus aureus
YLLNNNFLLQIKLDLDSLTAFH

SEQ ID NO: 1701194 - protein, 19 aa, Staphylococcus aureus
YLLQNGKWGYFNREFFDLL

SEQ ID NO: 1701195 - protein, 18 aa, Staphylococcus aureus
YLMQHESIPYVIDPVMLA

SEQ ID NO: 1701196 - protein, 19 aa, Staphylococcus aureus
YLMQHESIPYVIDPVMLAK

SEQ ID NO: 1701197 - protein, 17 aa, Staphylococcus aureus
YLNADPDKQNAYKQAVA

SEQ ID NO: 1701198 - protein, 23 aa, Staphylococcus aureus
YLNLSHYLILNRYPSRNRYLSLS

SEQ ID NO: 1701199 - protein, 18 aa, Staphylococcus aureus
YLPAMLQQQLWKLVAQRE

SEQ ID NO: 1701200 - protein, 17 aa, Staphylococcus aureus
YLPEIYKSVKAEVLFNK

SEQ ID NO: 1701201 - protein, 20 aa, Staphylococcus aureus
YLPIYAIQNHLCDCGIAGEV

SEQ ID NO: 1701202 - protein, 35 aa, Staphylococcus aureus
YLQQHQCLYVKLDPYWLYHLYNKDIVPFEGREKND

SEQ ID NO: 1701203 - protein, 19 aa, Staphylococcus aureus
YLSFLDTKSWCKNKFQVTN

SEQ ID NO: 1701204 - protein, 17 aa, Staphylococcus aureus
YLSGKNIALLFEKNSTR

SEQ ID NO: 1701205 - protein, 17 aa, Staphylococcus aureus
YLSMIRGQVLTTFSTMK

SEQ ID NO: 1701206 - protein, 26 aa, Staphylococcus aureus
YLYNELSLTTEYYYPLQNAIIEFCTE

SEQ ID NO: 1701207 - protein, 23 aa, Staphylococcus aureus
YMAEIRVFYRDEFLCTAISPDLA

SEQ ID NO: 1701208 - protein, 24 aa, Staphylococcus aureus
YMEAEPFMWPVYEVIRKSTVEELK

SEQ ID NO: 1701209 - protein, 26 aa, Staphylococcus aureus
YMIERKYHFMGYRQMKTFKTELIKMN

SEQ ID NO: 1701210 - protein, 21 aa, Staphylococcus aureus
YMNSWCLEYSEFLLDEVRLLK

SEQ ID NO: 1701211 - protein, 24 aa, Staphylococcus aureus
YMNSWCLEYSEFLLDEVRLLKENK

SEQ ID NO: 1701212 - protein, 19 aa, Staphylococcus aureus
YMQKPFYTNVLIAKLQAIY

SEQ ID NO: 1701213 - protein, 21 aa, Staphylococcus aureus
YMRHMFIEYVRTYYGYDERIS

SEQ ID NO: 1701214 - protein, 25 aa, Staphylococcus aureus
YMRQMFQDYVKFLYGYEERISLSNC

SEQ ID NO: 1701215 - protein, 17 aa, Staphylococcus aureus
YMYKKFGVLPETEYEIN

SEQ ID NO: 1701216 - protein, 19 aa, Staphylococcus aureus
YNADPTFNDAWKKMGILGI

SEQ ID NO: 1701217 - protein, 18 aa, Staphylococcus aureus
YNDPFDMVYVMMNSKLFS

SEQ ID NO: 1701218 - protein, 25 aa, Staphylococcus aureus
YNDSDLNWIYLVENLRNAGVSIESL

SEQ ID NO: 1701219 - protein, 25 aa, Staphylococcus aureus
YNDSDLNWIYLVKNLRNAGVSIESL

SEQ ID NO: 1701220 - protein, 30 aa, Staphylococcus aureus
YNDVKVFYTHGHLYQVNRTRDLLAEKGLEL

SEQ ID NO: 1701221 - protein, 23 aa, Staphylococcus aureus
YNEGELVGAWFTPPIDEEEMAER

SEQ ID NO: 1701222 - protein, 17 aa, Staphylococcus aureus
YNEIHMWDYKALPAVFG

SEQ ID NO: 1701223 - protein, 21 aa, Staphylococcus aureus
YNELSLTTEYYYPLQNAIIEF

SEQ ID NO: 1701224 - protein, 29 aa, Staphylococcus aureus
YNEQKERITLYLKYNIKNFKSVEFTSIES

SEQ ID NO: 1701225 - protein, 22 aa, Staphylococcus aureus
YNFPKKPFKYGIHYSEIEDFDN

SEQ ID NO: 1701226 - protein, 17 aa, Staphylococcus aureus
YNGLIDFYQLIIDYDEC

SEQ ID NO: 1701227 - protein, 18 aa, Staphylococcus aureus
YNGRWHMRNIRTNRFSMV

SEQ ID NO: 1701228 - protein, 30 aa, Staphylococcus aureus
YNISEKVFYDLWTDLYRLFKKLRSAFKEED

SEQ ID NO: 1701229 - protein, 19 aa, Staphylococcus aureus
YNKIDLTLLPLEELDNYLK

SEQ ID NO: 1701230 - protein, 20 aa, Staphylococcus aureus
YNNLGIIWYDAHGDLNIPEE

SEQ ID NO: 1701231 - protein, 23 aa, Staphylococcus aureus
YNNVQVGVWAPTKRISKRNSTDN

SEQ ID NO: 1701232 - protein, 20 aa, Staphylococcus aureus
YNQFIRIRHILNPSLKVLTK

SEQ ID NO: 1701233 - protein, 19 aa, Staphylococcus aureus
YNRGLINELFIKLANEFNI

SEQ ID NO: 1701234 - protein, 17 aa, Staphylococcus aureus
YNRIGYLPEERGLHGKL

SEQ ID NO: 1701235 - protein, 17 aa, Staphylococcus aureus
YNRRYLSGFTGASGALI

SEQ ID NO: 1701236 - protein, 17 aa, Staphylococcus aureus
YNTFRKLVKGGLKTVTV

SEQ ID NO: 1701237 - protein, 30 aa, Staphylococcus aureus
YNVSEKVFYDLWTDLYRLFKKLRNAFKEEG

SEQ ID NO: 1701238 - protein, 32 aa, Staphylococcus aureus
YNVSEKVFYDLWTDLYRLFKKLRNAFKEEGLE

SEQ ID NO: 1701239 - protein, 31 aa, Staphylococcus aureus
YNVSEKVFYDLWTDLYRLFKKLRNTFKEEGL

SEQ ID NO: 1701240 - protein, 20 aa, Staphylococcus aureus
YNYQICHFIYIFSNQLIEYR

SEQ ID NO: 1701241 - protein, 17 aa, Staphylococcus aureus
YNYRIYAKEYEMLTQEF

SEQ ID NO: 1701242 - protein, 17 aa, Staphylococcus aureus
YPDFKNKNLRLAIAQAI

SEQ ID NO: 1701243 - protein, 18 aa, Staphylococcus aureus
YPGYQVSPYYDSLVAKVI

SEQ ID NO: 1701244 - protein, 17 aa, Staphylococcus aureus
YPQARPLGKPNPFSYIA

SEQ ID NO: 1701245 - protein, 18 aa, Staphylococcus aureus
YPQARPLGKPNPFSYIAA

SEQ ID NO: 1701246 - protein, 29 aa, Staphylococcus aureus
YPVSHVLINGIRYKIVDTRAYRHETSYYI

SEQ ID NO: 1701247 - protein, 22 aa, Staphylococcus aureus
YQAIILGTRGLNSFQKMVLGSV

SEQ ID NO: 1701248 - protein, 19 aa, Staphylococcus aureus
YQEYKYIKRILNEEVRADN

SEQ ID NO: 1701249 - protein, 25 aa, Staphylococcus aureus
YQGKPLVCVGILKGSAMFMSDLIKR

SEQ ID NO: 1701250 - protein, 29 aa, Staphylococcus aureus
YQLPQSKHFLPSQTNFIFVKTKRVNELYE

SEQ ID NO: 1701251 - protein, 23 aa, Staphylococcus aureus
YQMGLNHFIAARDALDNYKFEER

SEQ ID NO: 1701252 - protein, 23 aa, Staphylococcus aureus
YQNKPIMYNLDRIVVYMRLRRVG

SEQ ID NO: 1701253 - protein, 32 aa, Staphylococcus aureus
YQREMDLYQIRWNGFYWAGANYKNFKTRTFKS

SEQ ID NO: 1701254 - protein, 20 aa, Staphylococcus aureus
YQTPMIKYKVPRAFVEISPE

SEQ ID NO: 1701255 - protein, 17 aa, Staphylococcus aureus
YQWRRRYVRANKSGVVP

SEQ ID NO: 1701256 - protein, 17 aa, Staphylococcus aureus
YQYLMHQPHIDVIKGII

SEQ ID NO: 1701257 - protein, 24 aa, Staphylococcus aureus
YRDIKDYYLYIYEKRVSELTIDDF

SEQ ID NO: 1701258 - protein, 18 aa, Staphylococcus aureus
YRDLVEEKIIPEIKEDGD

SEQ ID NO: 1701259 - protein, 23 aa, Staphylococcus aureus
YREIKNYYLYIYKKRVSELTIDD

SEQ ID NO: 1701260 - protein, 18 aa, Staphylococcus aureus
YRELPFVVNQALVDQLPQ

SEQ ID NO: 1701261 - protein, 18 aa, Staphylococcus aureus
YRETGIYAERTAPWLRRL

SEQ ID NO: 1701262 - protein, 32 aa, Staphylococcus aureus
YRGGDYSPSIKPWILPNFTALVNHEKIDMEFN

SEQ ID NO: 1701263 - protein, 22 aa, Staphylococcus aureus
YRKIPRKYLKPKIPQGRGKIKW

SEQ ID NO: 1701264 - protein, 24 aa, Staphylococcus aureus
YRKVLEFYHPEFKKEYVILAEEGA

SEQ ID NO: 1701265 - protein, 22 aa, Staphylococcus aureus
YRKYYEPLINKNNLNFKKGMKE

SEQ ID NO: 1701266 - protein, 22 aa, Staphylococcus aureus
YRPKRVIDTLEIFKIAFPTDKS

SEQ ID NO: 1701267 - protein, 22 aa, Staphylococcus aureus
YRRRAHQYFFVGQIVVPGEPKG

SEQ ID NO: 1701268 - protein, 20 aa, Staphylococcus aureus
YRRYSRALILPGNDQIFWLP

SEQ ID NO: 1701269 - protein, 31 aa, Staphylococcus aureus
YRSAYHILDMVFWFVNLQILAAHQYPTTAHL

SEQ ID NO: 1701270 - protein, 25 aa, Staphylococcus aureus
YRTIGLTTQSINLLKKLMLENKKEN

SEQ ID NO: 1701271 - protein, 34 aa, Staphylococcus aureus
YSDIPDNLIFYIYDSLIEGFIHWIKDEKIDWPGE

SEQ ID NO: 1701272 - protein, 25 aa, Staphylococcus aureus
YSDMADRILFNNSLKYYMNEHPAVT

SEQ ID NO: 1701273 - protein, 26 aa, Staphylococcus aureus
YSDNPKYILNLILSIITVSMKTLELV

SEQ ID NO: 1701274 - protein, 26 aa, Staphylococcus aureus
YSFSGHKMLGPIGIGVLFGKRELLQK

SEQ ID NO: 1701275 - protein, 27 aa, Staphylococcus aureus
YSIDALYQFLFEFIFDIEERYIRMYVQ

SEQ ID NO: 1701276 - protein, 27 aa, Staphylococcus aureus
YSMIEDFKVTIWYTAPTALRMLMSAGD

SEQ ID NO: 1701277 - protein, 37 aa, Staphylococcus aureus
YSPRIRYKNVILKPAYWKINEMLLPLPKNEEWDQQFL

SEQ ID NO: 1701278 - protein, 32 aa, Staphylococcus aureus
YSPRIRYKNVILKPAYWKINEMVLPLPKNEEW

SEQ ID NO: 1701279 - protein, 34 aa, Staphylococcus aureus
YSPRIRYKNVILKPAYWKINEMVLPLPKNEEWDQ

SEQ ID NO: 1701280 - protein, 30 aa, Staphylococcus aureus
YSPRIRYKNVILKPAYWKINEMVLTLPKNE

SEQ ID NO: 1701281 - protein, 17 aa, Staphylococcus aureus
YSSSLPIYNLYFIKRNI

SEQ ID NO: 1701282 - protein, 32 aa, Staphylococcus aureus
YSTRIMDLVTPIGLGQRGLIVAPPKAGKTSLL

SEQ ID NO: 1701283 - protein, 18 aa, Staphylococcus aureus
YSYLNLMFFMQENKKEFK

SEQ ID NO: 1701284 - protein, 31 aa, Staphylococcus aureus
YTAKKLNLNAVIFMPVTTPLQKVNQVKFFGS

SEQ ID NO: 1701285 - protein, 17 aa, Staphylococcus aureus
YTALQYIFDADVKYIAF

SEQ ID NO: 1701286 - protein, 18 aa, Staphylococcus aureus
YTALQYIFDADVKYIAFG

SEQ ID NO: 1701287 - protein, 19 aa, Staphylococcus aureus
YTAQIAVLSILSQIVAKEH

SEQ ID NO: 1701288 - protein, 27 aa, Staphylococcus aureus
YTDIKWCRMIIRQILSNALKYSENYNV

SEQ ID NO: 1701289 - protein, 19 aa, Staphylococcus aureus
YTDIVAPGGSFAYLNQFGV

SEQ ID NO: 1701290 - protein, 24 aa, Staphylococcus aureus
YTEHQLLVTAIPRHKINNDPRGLF

SEQ ID NO: 1701291 - protein, 20 aa, Staphylococcus aureus
YTFLNWDKIFSRIYKEQKVL

SEQ ID NO: 1701292 - protein, 17 aa, Staphylococcus aureus
YTGILKDREVVITQSGI

SEQ ID NO: 1701293 - protein, 27 aa, Staphylococcus aureus
YTHIQRLLMNVLLNIKLTDVTRNIHAV

SEQ ID NO: 1701294 - protein, 26 aa, Staphylococcus aureus
YTHIQRLLMNVLLNIKPTDVTRNIRA

SEQ ID NO: 1701295 - protein, 19 aa, Staphylococcus aureus
YTLITIVNYDFYQSEQGRN

SEQ ID NO: 1701296 - protein, 22 aa, Staphylococcus aureus
YTLNQFKAAPLIVTAEALQKSK

SEQ ID NO: 1701297 - protein, 30 aa, Staphylococcus aureus
YTNAVMQSFWIDPRTKIIYMTQARPGNHYM

SEQ ID NO: 1701298 - protein, 19 aa, Staphylococcus aureus
YTNAVSHAEGILSKANGSN

SEQ ID NO: 1701299 - protein, 24 aa, Staphylococcus aureus
YTNAVSRAEAILNKTQGANTSKQD

SEQ ID NO: 1701300 - protein, 25 aa, Staphylococcus aureus
YTNQSLVAFFFKALTSYLKKQNCLY

SEQ ID NO: 1701301 - protein, 26 aa, Staphylococcus aureus
YTQRHLTFSNKWLWQKDNGTIHATLL

SEQ ID NO: 1701302 - protein, 20 aa, Staphylococcus aureus
YTTNKIYYIEVRGGSFNSID

SEQ ID NO: 1701303 - protein, 18 aa, Staphylococcus aureus
YTYVIKNGNGYYYVTPNS

SEQ ID NO: 1701304 - protein, 20 aa, Staphylococcus aureus
YVEIIFTMRSVESNSWENEK

SEQ ID NO: 1701305 - protein, 21 aa, Staphylococcus aureus
YVEIIFTMRSVESNSWENEKN

SEQ ID NO: 1701306 - protein, 28 aa, Staphylococcus aureus
YVEIKTKYKLLPIFKINFHKNNLPHLLG

SEQ ID NO: 1701307 - protein, 17 aa, Staphylococcus aureus
YVFHHYLENSDLRPKTK

SEQ ID NO: 1701308 - protein, 28 aa, Staphylococcus aureus
YVFKPKSLFVLYDILSNNSVYLHFFKNG

SEQ ID NO: 1701309 - protein, 18 aa, Staphylococcus aureus
YVFPRKDCSPLKQDTFRV

SEQ ID NO: 1701310 - protein, 18 aa, Staphylococcus aureus
YVFSVEPSNLYTTKVRHN

SEQ ID NO: 1701311 - protein, 24 aa, Staphylococcus aureus
YVGDYPKHIPMMPDKVFMEDIREA

SEQ ID NO: 1701312 - protein, 23 aa, Staphylococcus aureus
YVIKYEGYYDSNASNLEFQTHLF

SEQ ID NO: 1701313 - protein, 33 aa, Staphylococcus aureus
YVKGSVVGFFTPELFHGIGSAGFHVHFANDDRN

SEQ ID NO: 1701314 - protein, 17 aa, Staphylococcus aureus
YVKVDGEWLYKLISYIE

SEQ ID NO: 1701315 - protein, 27 aa, Staphylococcus aureus
YVLYVNPKDYNKLVKSLFKVGGNVQDR

SEQ ID NO: 1701316 - protein, 18 aa, Staphylococcus aureus
YVMTYKELATFLKVLSDP

SEQ ID NO: 1701317 - protein, 17 aa, Staphylococcus aureus
YVNAEPNKKQAYDEAVR

SEQ ID NO: 1701318 - protein, 17 aa, Staphylococcus aureus
YVPLSEMFGYATSLRSN

SEQ ID NO: 1701319 - protein, 18 aa, Staphylococcus aureus
YVSDRFLPDKAIDLIDEA

SEQ ID NO: 1701320 - protein, 28 aa, Staphylococcus aureus
YVSNFEIKDIRIIKSILLKGKKSFNNTH

SEQ ID NO: 1701321 - protein, 18 aa, Staphylococcus aureus
YYDAFIKHQENVTYISTD

SEQ ID NO: 1701322 - protein, 25 aa, Staphylococcus aureus
YYDDPMYFIRLNFPDKVSVGNRAKS

SEQ ID NO: 1701323 - protein, 24 aa, Staphylococcus aureus
YYDNPMYFIRLNFPDSISVKDKAK

SEQ ID NO: 1701324 - protein, 18 aa, Staphylococcus aureus
YYEPLIHKNDKEFKEGMQ

SEQ ID NO: 1701325 - protein, 20 aa, Staphylococcus aureus
YYEWFMFVEETRRIFRGTEI

SEQ ID NO: 1701326 - protein, 18 aa, Staphylococcus aureus
YYFHGHIVPGWQGVKKTF

SEQ ID NO: 1701327 - protein, 17 aa, Staphylococcus aureus
YYFVKKFYEKDKLPDRK

SEQ ID NO: 1701328 - protein, 25 aa, Staphylococcus aureus
YYIAGHVFRIVSCLNQVLFACNNAY

SEQ ID NO: 1701329 - protein, 20 aa, Staphylococcus aureus
YYIDDFLDVMLELYREHLNV

SEQ ID NO: 1701330 - protein, 18 aa, Staphylococcus aureus
YYKLFTDKHDINGNVPIF

SEQ ID NO: 1701331 - protein, 21 aa, Staphylococcus aureus
YYKSYSRGTVVYVKLGSNIGS

SEQ ID NO: 1701332 - protein, 18 aa, Staphylococcus aureus
YYKYRKFGILPETEYEIN

SEQ ID NO: 1701333 - protein, 18 aa, Staphylococcus aureus
YYLFHTKQHYFLCHDILE

SEQ ID NO: 1701334 - protein, 18 aa, Staphylococcus aureus
YYLHGHIVPSWQGVKKTY

SEQ ID NO: 1701335 - protein, 17 aa, Staphylococcus aureus
YYMYKKFGVIPEMKYEM

SEQ ID NO: 1701336 - protein, 17 aa, Staphylococcus aureus
YYMYKKFGVLPEMEYEM

SEQ ID NO: 1701337 - protein, 23 aa, Staphylococcus aureus
YYQLLLIKMWQLSQIYKPSSKQS

SEQ ID NO: 1701338 - protein, 17 aa, Staphylococcus aureus
YYSYLEINKVFYVLDRE

SEQ ID NO: 1701339 - protein, 19 aa, Staphylococcus aureus
EPYVRLFRDLFPNAAIIFD

SEQ ID NO: 1701340 - protein, 27 aa, Staphylococcus aureus
ASEFRNYILGLIFYRFLSEKAEQEYAD

SEQ ID NO: 1701341 - protein, 26 aa, Staphylococcus aureus
DIIKRHRLLELFLIEILKYNWEEVHQ

SEQ ID NO: 1701342 - protein, 19 aa, Staphylococcus aureus
DILYYRFVALNYHAILDCI

SEQ ID NO: 1701343 - protein, 22 aa, Staphylococcus aureus
DSARFRLLLSEAFDVAPRSVDA

SEQ ID NO: 1701344 - protein, 29 aa, Staphylococcus aureus
ELAAPVSHIWYFKGIPSRMGLLLDMSPRA

SEQ ID NO: 1701345 - protein, 26 aa, Staphylococcus aureus
ENFKEAVQWLYLAYLAAIKEQNGAAM

SEQ ID NO: 1701346 - protein, 30 aa, Staphylococcus aureus
EPGKLADIVLWDPIFFGVKPELVVKGGLIN

SEQ ID NO: 1701347 - protein, 24 aa, Staphylococcus aureus
FINRDLFKYIPFDGSIITISELQE

SEQ ID NO: 1701348 - protein, 18 aa, Staphylococcus aureus
FSNYRPQFYFRTTDVTGV

SEQ ID NO: 1701349 - protein, 18 aa, Staphylococcus aureus
HNRLSLLMAVLEKKENYL

SEQ ID NO: 1701350 - protein, 23 aa, Staphylococcus aureus
IAGPGFINFYLDNQYLTAIIPEA

SEQ ID NO: 1701351 - protein, 23 aa, Staphylococcus aureus
KNDGTYTYFLPDIAYHFDKVKRG

SEQ ID NO: 1701352 - protein, 24 aa, Staphylococcus aureus
LDATLYMRIAIELHLKRLIVGGLE

SEQ ID NO: 1701353 - protein, 20 aa, Staphylococcus aureus
NFFLLERIRKAFPDKLILSG

SEQ ID NO: 1701354 - protein, 17 aa, Staphylococcus aureus
PSHLWWQGIDPIAAIRI

SEQ ID NO: 1701355 - protein, 21 aa, Staphylococcus aureus
RQRVWIAMALAQRTDIIFLDE

SEQ ID NO: 1701356 - protein, 24 aa, Staphylococcus aureus
SHQYKLLIILSPSGAYYGGETLKP

SEQ ID NO: 1701357 - protein, 23 aa, Staphylococcus aureus
YEDRSFTFITKTPPAPVLLKKAA

SEQ ID NO: 1701358 - protein, 25 aa, Staphylococcus aureus
ADQFRQLFILPQGEFKRFLISNSRE

SEQ ID NO: 1701359 - protein, 17 aa, Staphylococcus aureus
AGSYFVTALQTVVSRRL

SEQ ID NO: 1701360 - protein, 23 aa, Staphylococcus aureus
AHHIMTYFWMLQRDQQRFEDSLK

SEQ ID NO: 1701361 - protein, 19 aa, Staphylococcus aureus
DNLIWYFSELFKSELKIAI

SEQ ID NO: 1701362 - protein, 25 aa, Staphylococcus aureus
DYGCHLLDLSLWLLGKDMVPHEVLG

SEQ ID NO: 1701363 - protein, 17 aa, Staphylococcus aureus
FAGIPLGHEFNSLVLAI

SEQ ID NO: 1701364 - protein, 22 aa, Staphylococcus aureus
GDAPLLVKYLWDNLTDAPHGIV

SEQ ID NO: 1701365 - protein, 23 aa, Staphylococcus aureus
GNTEAMIKYLLPKATVVTPNLFE

SEQ ID NO: 1701366 - protein, 27 aa, Staphylococcus aureus
HLDIPIDLLPYLFFQFAKDGKRLYSDN

SEQ ID NO: 1701367 - protein, 18 aa, Staphylococcus aureus
IELGIPEHLVWRQPFPGP

SEQ ID NO: 1701368 - protein, 20 aa, Staphylococcus aureus
ILAYATWKFSGLPKERVIGS

SEQ ID NO: 1701369 - protein, 24 aa, Staphylococcus aureus
KFGLSFLTRSIALARFPWLSANIE

SEQ ID NO: 1701370 - protein, 24 aa, Staphylococcus aureus
KLTFLPYVVKALVSALKKYPALNT

SEQ ID NO: 1701371 - protein, 26 aa, Staphylococcus aureus
LMNDLNALYQHKLLLPLKLQYKDYSE

SEQ ID NO: 1701372 - protein, 20 aa, Staphylococcus aureus
PVEHQVLIIYALTKGYLDDI

SEQ ID NO: 1701373 - protein, 25 aa, Staphylococcus aureus
QGDQQLMLRLIKPKYFLPIHGEYRM

SEQ ID NO: 1701374 - protein, 24 aa, Staphylococcus aureus
QGKKGLFIVPLNGLKKWLTPVEMW

SEQ ID NO: 1701375 - protein, 18 aa, Staphylococcus aureus
RKAIPNVLFQMLLRASNA

SEQ ID NO: 1701376 - protein, 26 aa, Staphylococcus aureus
SDKYEWLLEFFPFLDPQHFVFCGRKN

SEQ ID NO: 1701377 - protein, 29 aa, Staphylococcus aureus
TSVFLETFLFFSGFYYPLYLAGQGKMTTS

SEQ ID NO: 1701378 - protein, 20 aa, Staphylococcus aureus
TTDLLIRLYEKVINHLDYHD

SEQ ID NO: 1701379 - protein, 21 aa, Staphylococcus aureus
VDAFNFVCTFLAKAIARDGEG

SEQ ID NO: 1701380 - protein, 24 aa, Staphylococcus aureus
VGNNTPVFFFRDPKLFVSLNRAVK

SEQ ID NO: 1701381 - protein, 27 aa, Staphylococcus aureus
VRDFLHDAFFFINIAEIILFIEKQYGI

SEQ ID NO: 1701382 - protein, 26 aa, Staphylococcus aureus
VVAWNFPMLLAAWKIAPAIAAGNTIV

SEQ ID NO: 1701383 - protein, 25 aa, Staphylococcus aureus
YIFRKLNIEWIYRALIDWKRIGRLK

SEQ ID NO: 1701384 - protein, 20 aa, Staphylococcus aureus
YPHMTVFENMAFGLKLRKVN

SEQ ID NO: 1701385 - protein, 22 aa, Staphylococcus aureus
AILGLVHTLWKPMPGRFKDYIA

SEQ ID NO: 1701386 - protein, 19 aa, Staphylococcus aureus
DANIPIWLDRDCPFNIEGG

SEQ ID NO: 1701387 - protein, 26 aa, Staphylococcus aureus
DDLSTDLVWYLWTGKYSSLFGKRAMT

SEQ ID NO: 1701388 - protein, 23 aa, Staphylococcus aureus
DEQWEAMLLGWKVVPSVKSNAII

SEQ ID NO: 1701389 - protein, 19 aa, Staphylococcus aureus
DLTVHRLIRKYLIEKSMDN

SEQ ID NO: 1701390 - protein, 21 aa, Staphylococcus aureus
DRTQLILEIFALRARSKEGKL

SEQ ID NO: 1701391 - protein, 19 aa, Staphylococcus aureus
DVEFKLYLGLKHISPFIED

SEQ ID NO: 1701392 - protein, 19 aa, Staphylococcus aureus
DVLDTWFSSALWPFSTLGW

SEQ ID NO: 1701393 - protein, 25 aa, Staphylococcus aureus
EFRTMPMVWYCPPLSPIMSYFEGKN

SEQ ID NO: 1701394 - protein, 24 aa, Staphylococcus aureus
ELKGNRLFYLAMAPQFFGVISDYL

SEQ ID NO: 1701395 - protein, 20 aa, Staphylococcus aureus
EMNPFLGYRAIRLCLAQQDI

SEQ ID NO: 1701396 - protein, 22 aa, Staphylococcus aureus
ENIKLFVVIGQLNQLIKGGRIS

SEQ ID NO: 1701397 - protein, 20 aa, Staphylococcus aureus
ENRLPFILFSASGGARMQEG

SEQ ID NO: 1701398 - protein, 26 aa, Staphylococcus aureus
EYYKWTQWIFIQLYNKGLAYVDEVAV

SEQ ID NO: 1701399 - protein, 25 aa, Staphylococcus aureus
FIAEKDFFIFFRNFFTKKFQREIDI

SEQ ID NO: 1701400 - protein, 17 aa, Staphylococcus aureus
FLDKLISVSLPRVRDFQ

SEQ ID NO: 1701401 - protein, 23 aa, Staphylococcus aureus
FPARIKCATLAWKALEKGTVAKE

SEQ ID NO: 1701402 - protein, 25 aa, Staphylococcus aureus
FRDEDIWMLFGTLPVFPCLKDDEDQ

SEQ ID NO: 1701403 - protein, 20 aa, Staphylococcus aureus
GQLPLFRRLPKRGFTNINRK

SEQ ID NO: 1701404 - protein, 24 aa, Staphylococcus aureus
GSTYYGIALALMRISKAILNNENN

SEQ ID NO: 1701405 - protein, 17 aa, Staphylococcus aureus
GYVVYFFELACAMSGYQ

SEQ ID NO: 1701406 - protein, 18 aa, Staphylococcus aureus
HKVKYWLFTTLDKLRKKL

SEQ ID NO: 1701407 - protein, 18 aa, Staphylococcus aureus
IAIVKLLYAYGVRNMVMC

SEQ ID NO: 1701408 - protein, 18 aa, Staphylococcus aureus
IPIFVFLNDQFEQETVWG

SEQ ID NO: 1701409 - protein, 22 aa, Staphylococcus aureus
KCKRAIILPNNKNILMASEQAA

SEQ ID NO: 1701410 - protein, 20 aa, Staphylococcus aureus
KIEWLLPFLQQSGPTIIYVS

SEQ ID NO: 1701411 - protein, 17 aa, Staphylococcus aureus
KKPILLKRGLSATIEEF

SEQ ID NO: 1701412 - protein, 31 aa, Staphylococcus aureus
KNLTLENFVLIYYLDQIIAQANLRLATMSDN

SEQ ID NO: 1701413 - protein, 20 aa, Staphylococcus aureus
KNVFKNLWLIAWEMTYESQL

SEQ ID NO: 1701414 - protein, 24 aa, Staphylococcus aureus
KQTWPFKQILLPLLYQRDSGGGSM

SEQ ID NO: 1701415 - protein, 24 aa, Staphylococcus aureus
LIDETKLNFLWVTDWPLLEYDEDA

SEQ ID NO: 1701416 - protein, 20 aa, Staphylococcus aureus
LKFELFYFDIFTYGTSFVTL

SEQ ID NO: 1701417 - protein, 17 aa, Staphylococcus aureus
LLWFLRPEMKSLNHIEN

SEQ ID NO: 1701418 - protein, 17 aa, Staphylococcus aureus
LMFHFLPIAVRYDGQKA

SEQ ID NO: 1701419 - protein, 25 aa, Staphylococcus aureus
LPNKEFQLLFMLAARPKQIFTREQI

SEQ ID NO: 1701420 - protein, 21 aa, Staphylococcus aureus
LVATELLWFIKGDTNIQYLLK

SEQ ID NO: 1701421 - protein, 24 aa, Staphylococcus aureus
MDDKYPFYLDPMPNLYFTRDPQAS

SEQ ID NO: 1701422 - protein, 25 aa, Staphylococcus aureus
MSRQHHRFLFFINKLPGITIKSLLE

SEQ ID NO: 1701423 - protein, 25 aa, Staphylococcus aureus
NGRHELLDSVFLWQSGQKYRIPVHD

SEQ ID NO: 1701424 - protein, 24 aa, Staphylococcus aureus
NRKGYYLYGYRHFSSRIKGGHTNN

SEQ ID NO: 1701425 - protein, 19 aa, Staphylococcus aureus
PERFWPADLVLLSIGFEGT

SEQ ID NO: 1701426 - protein, 17 aa, Staphylococcus aureus
PGFGDRRKAMLEDLAIL

SEQ ID NO: 1701427 - protein, 21 aa, Staphylococcus aureus
PGLRYILFTQGCLLRCLYCHN

SEQ ID NO: 1701428 - protein, 17 aa, Staphylococcus aureus
PILLKRGLSATIEEFVY

SEQ ID NO: 1701429 - protein, 21 aa, Staphylococcus aureus
PQLFKQLLMISGFDKYYQIVK

SEQ ID NO: 1701430 - protein, 20 aa, Staphylococcus aureus
PTLDYVISKIPRFPFDKFEK

SEQ ID NO: 1701431 - protein, 19 aa, Staphylococcus aureus
QDVLLFIDNIFRFTQAGSE

SEQ ID NO: 1701432 - protein, 22 aa, Staphylococcus aureus
QGAWLYVYPYVKVLVADKYDLS

SEQ ID NO: 1701433 - protein, 22 aa, Staphylococcus aureus
REKRVVISLTYIYGIGTSTAQK

SEQ ID NO: 1701434 - protein, 17 aa, Staphylococcus aureus
RSLLFGPFAGFSPKFLK

SEQ ID NO: 1701435 - protein, 24 aa, Staphylococcus aureus
SMVDTWLFHQFLSAVPLDAQLIFV

SEQ ID NO: 1701436 - protein, 24 aa, Staphylococcus aureus
STAQLDFLLPERFDLTYIGQDGEH

SEQ ID NO: 1701437 - protein, 18 aa, Staphylococcus aureus
TFDYVFPYMMQFIADLPV

SEQ ID NO: 1701438 - protein, 22 aa, Staphylococcus aureus
TNSAFLIYLFAKDLPNHDELMT

SEQ ID NO: 1701439 - protein, 24 aa, Staphylococcus aureus
VGTNYPYVDYLPKKNIKAIQIDTN

SEQ ID NO: 1701440 - protein, 18 aa, Staphylococcus aureus
VHGGLRYLKQFQIGVVAE

SEQ ID NO: 1701441 - protein, 17 aa, Staphylococcus aureus
WHNLFAKNMFIRPESKE

SEQ ID NO: 1701442 - protein, 18 aa, Staphylococcus aureus
YEEMKHYFILNFPQRPGA

SEQ ID NO: 1701443 - protein, 24 aa, Staphylococcus aureus
YTKLHNFHWYVKGPNFFSLHVKFE

SEQ ID NO: 1701444 - protein, 17 aa, Staphylococcus aureus
YVYAHYKGLKSLYYTRN

SEQ ID NO: 1701445 - protein, 17 aa, Staphylococcus aureus
ADNPIIFAMANPNPEII

SEQ ID NO: 1701446 - protein, 18 aa, Staphylococcus aureus
AVMNMKILINILGAFHQQ

SEQ ID NO: 1701447 - protein, 26 aa, Staphylococcus aureus
DLTEEQMIDFLFTSALFGRVVANNAS

SEQ ID NO: 1701448 - protein, 18 aa, Staphylococcus aureus
DRRKAMLEDLAILTGAQV

SEQ ID NO: 1701449 - protein, 20 aa, Staphylococcus aureus
EIIDHFIMKLRIVKFARTPD

SEQ ID NO: 1701450 - protein, 18 aa, Staphylococcus aureus
FGIKENVDFIAASFVRRP

SEQ ID NO: 1701451 - protein, 17 aa, Staphylococcus aureus
FIMKLRIVKFARTPDYN

SEQ ID NO: 1701452 - protein, 18 aa, Staphylococcus aureus
FMHHYNFPNFSVGETGPV

SEQ ID NO: 1701453 - protein, 19 aa, Staphylococcus aureus
FVYKRRLPFHAKRFNDWLE

SEQ ID NO: 1701454 - protein, 23 aa, Staphylococcus aureus
KEVKSLLQMLLLHAIPTPVISDK

SEQ ID NO: 1701455 - protein, 17 aa, Staphylococcus aureus
KVYPWIAKTRGSTPGIG

SEQ ID NO: 1701456 - protein, 19 aa, Staphylococcus aureus
LFTCLRPVRWFKGVPSPVK

SEQ ID NO: 1701457 - protein, 19 aa, Staphylococcus aureus
LHEAPAHVLNYFDPKDKTL

SEQ ID NO: 1701458 - protein, 18 aa, Staphylococcus aureus
LPQTRLRKLLKRMDFYIK

SEQ ID NO: 1701459 - protein, 26 aa, Staphylococcus aureus
MPIVKQYFRMLQRPILYTGLTRAKTS

SEQ ID NO: 1701460 - protein, 18 aa, Staphylococcus aureus
MWAAQFYPFKNHGQWVTS

SEQ ID NO: 1701461 - protein, 18 aa, Staphylococcus aureus
NYTIPPYYDSMVAKLIIH

SEQ ID NO: 1701462 - protein, 25 aa, Staphylococcus aureus
PAEESYFLFYINRPSIIVGKNQNTI

SEQ ID NO: 1701463 - protein, 21 aa, Staphylococcus aureus
QNKLFPLEYGLKGLPSIKIKD

SEQ ID NO: 1701464 - protein, 24 aa, Staphylococcus aureus
RTYAFTELFLFELRMQWLNRLEKS

SEQ ID NO: 1701465 - protein, 20 aa, Staphylococcus aureus
SDLILYVSYFNHSFTDNDKA

SEQ ID NO: 1701466 - protein, 24 aa, Staphylococcus aureus
SDRLRQFFDFITNFGIMIKGTGED

SEQ ID NO: 1701467 - protein, 31 aa, Staphylococcus aureus
SGGERALTAIALLFAILKVRSAPFVILDEVE

SEQ ID NO: 1701468 - protein, 26 aa, Staphylococcus aureus
TSKPYLIYMLGFMPGFPYLGGLDEQL

SEQ ID NO: 1701469 - protein, 23 aa, Staphylococcus aureus
TTAGKLALLMRKKYNKKPMLVAA

SEQ ID NO: 1701470 - protein, 22 aa, Staphylococcus aureus
TTAKLMILAFEKFEKLPLDTLK

SEQ ID NO: 1701471 - protein, 19 aa, Staphylococcus aureus
TWDFAHCLPYFKKLEKTYG

SEQ ID NO: 1701472 - protein, 21 aa, Staphylococcus aureus
VLIIAPFNYPFQLVFEPLIGA

SEQ ID NO: 1701473 - protein, 23 aa, Staphylococcus aureus
VNYKLRDWLFSRQRYWGEPIPVI

SEQ ID NO: 1701474 - protein, 25 aa, Staphylococcus aureus
VQAGRVFIALPPLYKLEKGKGKTKR

SEQ ID NO: 1701475 - protein, 24 aa, Staphylococcus aureus
VTTPEWMLLPMHKGGTFGKFSTSI

SEQ ID NO: 1701476 - protein, 29 aa, Staphylococcus aureus
VVTQITPWNYPLLQASWKIAPALATGCSL

SEQ ID NO: 1701477 - protein, 17 aa, Staphylococcus aureus
YIPVIMYSPKFKGGHAL

SEQ ID NO: 1701478 - protein, 19 aa, Staphylococcus aureus
YVYTFLGFLPRKEKEKSAV

SEQ ID NO: 1701479 - protein, 24 aa, Staphylococcus aureus
EEMQPLYEWLGLTASLGFVDIVDY

SEQ ID NO: 1701480 - protein, 22 aa, Staphylococcus aureus
EQFKTVYGVNVAGVLWGIQAAH

SEQ ID NO: 1701481 - protein, 22 aa, Staphylococcus aureus
GTKLGFMSFFTKASVAALKKYP

SEQ ID NO: 1701482 - protein, 24 aa, Staphylococcus aureus
HNFSTIEYLIIKGLIKYAKSVTII

SEQ ID NO: 1701483 - protein, 17 aa, Staphylococcus aureus
HYLKVRPGAFFLTGCGN

SEQ ID NO: 1701484 - protein, 19 aa, Staphylococcus aureus
INNVLAFPGIFRGALEVEA

SEQ ID NO: 1701485 - protein, 23 aa, Staphylococcus aureus
KLDPYWLYHLYDKDIVPFEGREK

SEQ ID NO: 1701486 - protein, 24 aa, Staphylococcus aureus
KSISGYPFVWWFATNPEYEGKGYG

SEQ ID NO: 1701487 - protein, 18 aa, Staphylococcus aureus
LMLLQQRYNLKALLSSVN

SEQ ID NO: 1701488 - protein, 23 aa, Staphylococcus aureus
LNEGYQFFGVLYIGAILTKDGPK

SEQ ID NO: 1701489 - protein, 17 aa, Staphylococcus aureus
MAKIIRQKLKKLGIRKG

SEQ ID NO: 1701490 - protein, 23 aa, Staphylococcus aureus
NSLENLLFGLGIRHLGVKASQVL

SEQ ID NO: 1701491 - protein, 21 aa, Staphylococcus aureus
SPIDSYLLLRGLKTLHLRIER

SEQ ID NO: 1701492 - protein, 24 aa, Staphylococcus aureus
STLLKLILGLLPLQSGEIFVEGID

SEQ ID NO: 1701493 - protein, 19 aa, Staphylococcus aureus
TALRKAYLESFRKGFKQQI

SEQ ID NO: 1701494 - protein, 22 aa, Staphylococcus aureus
TESTLLIGFLKDTPQRIGSMGK

SEQ ID NO: 1701495 - protein, 23 aa, Staphylococcus aureus
TGRYYIQRFLARAFGFEVDDIKA

SEQ ID NO: 1701496 - protein, 25 aa, Staphylococcus aureus
TTLGNSLRRILLSSLPGAAVKYIEI

SEQ ID NO: 1701497 - protein, 21 aa, Staphylococcus aureus
YLDLFLIHWPCEADGLFLETY

SEQ ID NO: 1701498 - protein, 18 aa, Staphylococcus aureus
AVFDLYFRKMPFNSGYAV

SEQ ID NO: 1701499 - protein, 24 aa, Staphylococcus aureus
EQKRLYLLRLLVHQPNVLLLDEPT

SEQ ID NO: 1701500 - protein, 23 aa, Staphylococcus aureus
IDRALVWGFNWKLGPFQLWDAMG

SEQ ID NO: 1701501 - protein, 26 aa, Staphylococcus aureus
IEDKKALFIVYANPLALGLLTPPGSF

SEQ ID NO: 1701502 - protein, 24 aa, Staphylococcus aureus
KESLGFIFQDYSILPTLTVKENIM

SEQ ID NO: 1701503 - protein, 23 aa, Staphylococcus aureus
REEILILLTLWQKGSMTLKEMDR

SEQ ID NO: 1701504 - protein, 17 aa, Staphylococcus aureus
RVGYKFVDGKKVRIAKK

SEQ ID NO: 1701505 - protein, 18 aa, Staphylococcus aureus
TNQSLVAFFFKALTSYLK

SEQ ID NO: 1701506 - protein, 24 aa, Staphylococcus aureus
VSPDLFIKRLNFYDYLLLNSDGLT

SEQ ID NO: 1701507 - protein, 17 aa, Staphylococcus aureus
YDYLLKRYLLNIEREND

SEQ ID NO: 1701508 - protein, 17 aa, Staphylococcus aureus
AMMFLYFGEIHPVDFVI

SEQ ID NO: 1701509 - protein, 17 aa, Staphylococcus aureus
EKQWDLLHLLEKELQQL

SEQ ID NO: 1701510 - protein, 18 aa, Staphylococcus aureus
GKSRAIPIFVFLNDQFEQ

SEQ ID NO: 1701511 - protein, 17 aa, Staphylococcus aureus
IRQKLKKLGIRKGIPVV

SEQ ID NO: 1701512 - protein, 19 aa, Staphylococcus aureus
LALGLLTPPGSFGADIVVG

SEQ ID NO: 1701513 - protein, 23 aa, Staphylococcus aureus
QTKSYEWFLREGLIEMFRDISPI

SEQ ID NO: 1701514 - protein, 17 aa, Staphylococcus aureus
RRHLIEFWMIEGEMAFT

SEQ ID NO: 1701515 - protein, 22 aa, Staphylococcus aureus
RTSGIFFMIKGDEQYIFGDCAI

SEQ ID NO: 1701516 - protein, 21 aa, Staphylococcus aureus
VIDALSYYQFFILKFVVGEQR

SEQ ID NO: 1701517 - protein, 24 aa, Staphylococcus aureus
ALQPSPFHWRLLDKITLSTLYEVV

SEQ ID NO: 1701518 - protein, 20 aa, Staphylococcus aureus
DNAQVRVLPYASITTRQLGK

SEQ ID NO: 1701519 - protein, 26 aa, Staphylococcus aureus
EKPKPWDVYAFPYYYVYNDFSDHYPI

SEQ ID NO: 1701520 - protein, 17 aa, Staphylococcus aureus
EVRKEFQFLDYAQIAFV

SEQ ID NO: 1701521 - protein, 23 aa, Staphylococcus aureus
HDFEKHMYAIHILTSLYASTSNT

SEQ ID NO: 1701522 - protein, 17 aa, Staphylococcus aureus
IERQYFNQLYRFNNQDL

SEQ ID NO: 1701523 - protein, 22 aa, Staphylococcus aureus
LSFRAFYALPLLSNKAGIHTNA

SEQ ID NO: 1701524 - protein, 21 aa, Staphylococcus aureus
MDMLFTHFGISGPAALRCSQF

SEQ ID NO: 1701525 - protein, 22 aa, Staphylococcus aureus
PGWQKWVWSPFLSVLGSGATAF

SEQ ID NO: 1701526 - protein, 18 aa, Staphylococcus aureus
PILPLIPDVLHRLLKKKY

SEQ ID NO: 1701527 - protein, 17 aa, Staphylococcus aureus
RVLPYASITTRQLGKEL

SEQ ID NO: 1701528 - protein, 20 aa, Staphylococcus aureus
RYQDVPTKLWPIQPLRDFWG

SEQ ID NO: 1701529 - protein, 20 aa, Staphylococcus aureus
AHASLRQSLLPHLIEAASYN

SEQ ID NO: 1701530 - protein, 24 aa, Staphylococcus aureus
ENGLRLFIIPKPGFQKTFVTYTTQ

SEQ ID NO: 1701531 - protein, 21 aa, Staphylococcus aureus
FGIVRMMNTFVPLLEKSEQPV

SEQ ID NO: 1701532 - protein, 20 aa, Staphylococcus aureus
FQGEALLFFLGLTNSMAGFE

SEQ ID NO: 1701533 - protein, 18 aa, Staphylococcus aureus
FVVQILFQYLFSQGRLKD

SEQ ID NO: 1701534 - protein, 22 aa, Staphylococcus aureus
KHPKVLILMGVPGSYLVATDKS

SEQ ID NO: 1701535 - protein, 23 aa, Staphylococcus aureus
MHDLAFLLLVYPLSEYEGALDSA

SEQ ID NO: 1701536 - protein, 22 aa, Staphylococcus aureus
NLTYPQFLVLTILWDESPVNVK

SEQ ID NO: 1701537 - protein, 19 aa, Staphylococcus aureus
PTKLWPIQPLRDFWGINRR

SEQ ID NO: 1701538 - protein, 19 aa, Staphylococcus aureus
QLHMLPLFEEHYHLYAPSD

SEQ ID NO: 1701539 - protein, 24 aa, Staphylococcus aureus
RFHSIIWPILLMALDLPLPKKVFA

SEQ ID NO: 1701540 - protein, 18 aa, Staphylococcus aureus
TTEYYWHWDLKNSKLDVF

SEQ ID NO: 1701541 - protein, 20 aa, Staphylococcus aureus
VKRRIFLGTFALSSGYYDAY

SEQ ID NO: 1701542 - protein, 17 aa, Staphylococcus aureus
YYWHWDLKNSKLDVFDY

SEQ ID NO: 1701543 - protein, 22 aa, Staphylococcus aureus
DKVEWIILAGYMRLIGPDLLAS

SEQ ID NO: 1701544 - protein, 22 aa, Staphylococcus aureus
DQFRMIIKQLYFFSVANPNPTN

SEQ ID NO: 1701545 - protein, 23 aa, Staphylococcus aureus
ERLPLIHKWINGRMPLIGIGSIF

SEQ ID NO: 1701546 - protein, 18 aa, Staphylococcus aureus
IDVFLEPTKLYVKPVLAL

SEQ ID NO: 1701547 - protein, 18 aa, Staphylococcus aureus
IIFAMANPNPEIIPDDAK

SEQ ID NO: 1701548 - protein, 20 aa, Staphylococcus aureus
KQRALYKEELAWMRAGAKAR

SEQ ID NO: 1701549 - protein, 21 aa, Staphylococcus aureus
LTIDNFRWAGVPFYIRTGKRM

SEQ ID NO: 1701550 - protein, 18 aa, Staphylococcus aureus
YIAYKLMEILEEAGLPKG

SEQ ID NO: 1701551 - protein, 23 aa, Staphylococcus aureus
EIYDQMMWIGFKPFKITNIKQES

SEQ ID NO: 1701552 - protein, 17 aa, Staphylococcus aureus
IVDKLVEIFWPGPLNII

SEQ ID NO: 1701553 - protein, 19 aa, Staphylococcus aureus
LMAFLKQRHIPMAIATSSV

SEQ ID NO: 1701554 - protein, 23 aa, Staphylococcus aureus
PDLDTWVIFPWTAGQGKVARLIC

SEQ ID NO: 1701555 - protein, 19 aa, Staphylococcus aureus
QRVMIAMALILKPQILIAD

SEQ ID NO: 1701556 - protein, 22 aa, Staphylococcus aureus
RLSIFIFIINILNQLRGIVIYQ

SEQ ID NO: 1701557 - protein, 21 aa, Staphylococcus aureus
TNCLPVYKILLEKQTAHFRVY

SEQ ID NO: 1701558 - protein, 18 aa, Staphylococcus aureus
NPVDILAYATWKFSGLPK

SEQ ID NO: 1701559 - protein, 22 aa, Staphylococcus aureus
SFIANKLRLLKLAPKVLLRLRE

SEQ ID NO: 1701560 - protein, 21 aa, Staphylococcus aureus
GYITAILLRKLYPESKIYVFG

SEQ ID NO: 1701561 - protein, 29 aa, Staphylococcus aureus
MPSQLFQFFMSYLLARFDISLATLLGVHQ

SEQ ID NO: 1701562 - protein, 17 aa, Staphylococcus aureus
QQKQRALYKEELAWMRA

SEQ ID NO: 1701563 - protein, 18 aa, Staphylococcus aureus
YYMYKKFGIWPEKEYAIN

SEQ ID NO: 1701564 - protein, 30 aa, Staphylococcus aureus
DGAHIQVLLLTFFFKYMKPLVQAGRVFIAL

SEQ ID NO: 1701565 - protein, 24 aa, Staphylococcus aureus
FIQQQYWFLFYHDENYFAVKYSDD

SEQ ID NO: 1701566 - protein, 18 aa, Staphylococcus aureus
IIAWFDAIGKKRGLIRRG

SEQ ID NO: 1701567 - protein, 21 aa, Staphylococcus aureus
NYFLSLGIKTVLITLGKQGTY

SEQ ID NO: 1701568 - protein, 19 aa, Staphylococcus aureus
SMAIYQFYLGDTLTILDRN

SEQ ID NO: 1701569 - protein, 24 aa, Staphylococcus aureus
ANTEQYYFHLFSKKQPDLNWGNPE

SEQ ID NO: 1701570 - protein, 23 aa, Staphylococcus aureus
AVLHLLYARFWHKVLYDLGIVPT

SEQ ID NO: 1701571 - protein, 19 aa, Staphylococcus aureus
ELHLRFQLAFYLFTNRGVI

SEQ ID NO: 1701572 - protein, 18 aa, Staphylococcus aureus
FFDLIKYFELPLQTKIKT

SEQ ID NO: 1701573 - protein, 21 aa, Staphylococcus aureus
FFRPEFLNRFNGIVEFLHLDK

SEQ ID NO: 1701574 - protein, 17 aa, Staphylococcus aureus
RNLFPEIIFLDAISLRT

SEQ ID NO: 1701575 - protein, 23 aa, Staphylococcus aureus
TREHILLSRNVGVPALVVFLNKV

SEQ ID NO: 1701576 - protein, 17 aa, Staphylococcus aureus
YYPRTFIQQLFVDGYFG

SEQ ID NO: 1701577 - protein, 20 aa, Staphylococcus aureus
KGLYLYGPFGTGKSFILGAI

SEQ ID NO: 1701578 - protein, 22 aa, Staphylococcus aureus
SAKKYLWRVLVTQLKKLELNYD

SEQ ID NO: 1701579 - protein, 24 aa, Staphylococcus aureus
YGATFFVFSDYLKPALRLSSIMGL

SEQ ID NO: 1701580 - protein, 23 aa, Staphylococcus aureus
AETFYPMPFLSPQTMWYYKSAFN

SEQ ID NO: 1701581 - protein, 17 aa, Staphylococcus aureus
CLVIYDWRVIESETIMS

SEQ ID NO: 1701582 - protein, 21 aa, Staphylococcus aureus
DIKSPMVGTFFLQDSKELTEP

SEQ ID NO: 1701583 - protein, 22 aa, Staphylococcus aureus
EDKSFDFILTNPPIRAGKETVH

SEQ ID NO: 1701584 - protein, 24 aa, Staphylococcus aureus
EYQYFKKNQIIWGFLHLASSKEIV

SEQ ID NO: 1701585 - protein, 21 aa, Staphylococcus aureus
IRYAAVLLRPFLTHAPKEIFE

SEQ ID NO: 1701586 - protein, 21 aa, Staphylococcus aureus
PQDSYLLVRGIKTLGLRMEQI

SEQ ID NO: 1701587 - protein, 23 aa, Staphylococcus aureus
SCDISLVMRALDSILPFLEKGNT

SEQ ID NO: 1701588 - protein, 17 aa, Staphylococcus aureus
VGTFFLQDSKELTEPIV

SEQ ID NO: 1701589 - protein, 19 aa, Staphylococcus aureus
AARTYNLHFFTPSSIGAFG

SEQ ID NO: 1701590 - protein, 18 aa, Staphylococcus aureus
DHTKVVAPFIRLAGTMEG

SEQ ID NO: 1701591 - protein, 20 aa, Staphylococcus aureus
ELLRFRYWDCPIGCYEWEDI

SEQ ID NO: 1701592 - protein, 17 aa, Staphylococcus aureus
IVNERIQFVLTSRLESF

SEQ ID NO: 1701593 - protein, 24 aa, Staphylococcus aureus
KICGLYAFRNWPIAALSYGQKKRV

SEQ ID NO: 1701594 - protein, 20 aa, Staphylococcus aureus
PEGLIPLLKIQGLGSKKIAK

SEQ ID NO: 1701595 - protein, 29 aa, Staphylococcus aureus
QSSILTSIPLWKNQMAIALTLMRQRNAVA

SEQ ID NO: 1701596 - protein, 18 aa, Staphylococcus aureus
YTKQLFFEIQSRGYIPII

SEQ ID NO: 1701597 - protein, 19 aa, Staphylococcus aureus
DILMYNYLKHFDIPTLVIC

SEQ ID NO: 1701598 - protein, 18 aa, Staphylococcus aureus
ELEDKIYILFHKPTQVIT

SEQ ID NO: 1701599 - protein, 23 aa, Staphylococcus aureus
RASILVMGPLLARLGHAIVALPG

SEQ ID NO: 1701600 - protein, 23 aa, Staphylococcus aureus
SITQLLERFLFPSATHGKKVYKL

SEQ ID NO: 1701601 - protein, 18 aa, Staphylococcus aureus
TKIKAWVRQLLWMSIYQY

SEQ ID NO: 1701602 - protein, 20 aa, Staphylococcus aureus
VDMLRMCRYPWKTKQRILGD

SEQ ID NO: 1701603 - protein, 18 aa, Staphylococcus aureus
AWVILAKPNLGISSPDIF

SEQ ID NO: 1701604 - protein, 20 aa, Staphylococcus aureus
LSIQYIPQRLLPDKAIDVLD

SEQ ID NO: 1701605 - protein, 17 aa, Staphylococcus aureus
MILLASRLDAVVYSLGL

SEQ ID NO: 1701606 - protein, 17 aa, Staphylococcus aureus
MLKVFLDLKFVTQEDGL

SEQ ID NO: 1701607 - protein, 20 aa, Staphylococcus aureus
EPMVLPSRFPNLLVNGSTGI

SEQ ID NO: 1701608 - protein, 21 aa, Staphylococcus aureus
FRSRFRMLVEAQLDLLKNEDW

SEQ ID NO: 1701609 - protein, 19 aa, Staphylococcus aureus
HFDLRPAGIIKMLDLKQPI

SEQ ID NO: 1701610 - protein, 21 aa, Staphylococcus aureus
VNLVNFYYPKLTFRSSILELI

SEQ ID NO: 1701611 - protein, 17 aa, Staphylococcus aureus
FILEPLIQGATGLFVHP

SEQ ID NO: 1701612 - protein, 19 aa, Staphylococcus aureus
GLDILRKKGFYSQIGIFKD

SEQ ID NO: 1701613 - protein, 17 aa, Staphylococcus aureus
HQVGQGPVLIFIPGANG

SEQ ID NO: 1701614 - protein, 22 aa, Staphylococcus aureus
IQQAIWYKLLVNLGINSITALG

SEQ ID NO: 1701615 - protein, 18 aa, Staphylococcus aureus
WEQFFIDKGYYPVSVDAK

SEQ ID NO: 1701616 - protein, 22 aa, Staphylococcus aureus
AESVLPYHPLFIKPNKDELEVM

SEQ ID NO: 1701617 - protein, 17 aa, Staphylococcus aureus
DHFKIVPLLIFSAMHYL

SEQ ID NO: 1701618 - protein, 18 aa, Staphylococcus aureus
DVITLASSKYMVFEAQGA

SEQ ID NO: 1701619 - protein, 17 aa, Staphylococcus aureus
IEKYDVITLASSKYMVF

SEQ ID NO: 1701620 - protein, 17 aa, Staphylococcus aureus
LWLGIPDDAIIGALHIK

SEQ ID NO: 1701621 - protein, 25 aa, Staphylococcus aureus
VDHQITFIPYFPLASGILAGKYDEN

SEQ ID NO: 1701622 - protein, 25 aa, Staphylococcus aureus
VRKKFPDALFIFLAPPSLDHLRERL

SEQ ID NO: 1701623 - protein, 21 aa, Staphylococcus aureus
YNLKCLLLKLTYRYLDNQPLN

SEQ ID NO: 1701624 - protein, 20 aa, Staphylococcus aureus
DVIKFLKYFTFLGKEEIDRL

SEQ ID NO: 1701625 - protein, 18 aa, Staphylococcus aureus
EPNLTVLWSVRLPDNFKT

SEQ ID NO: 1701626 - protein, 23 aa, Staphylococcus aureus
EPSPIWMQARLIKAGIRPINNVV

SEQ ID NO: 1701627 - protein, 24 aa, Staphylococcus aureus
GFGYDPIFYVPKLDKTMAQLSKEQ

SEQ ID NO: 1701628 - protein, 17 aa, Staphylococcus aureus
KLLVTYRTKLQGGYGQF

SEQ ID NO: 1701629 - protein, 17 aa, Staphylococcus aureus
NSQKFFDLIKYFELPLQ

SEQ ID NO: 1701630 - protein, 18 aa, Staphylococcus aureus
RLFYMFDKETMIASMGIG

SEQ ID NO: 1701631 - protein, 17 aa, Staphylococcus aureus
RRYYLMLMLFSKENAMS

SEQ ID NO: 1701632 - protein, 21 aa, Staphylococcus aureus
SLHIGHLLPFLTLRRFQEHGH

SEQ ID NO: 1701633 - protein, 17 aa, Staphylococcus aureus
SSYNLKCLLLKLTYRYL

SEQ ID NO: 1701634 - protein, 23 aa, Staphylococcus aureus
SVKAKKFTLLTKSLRPLPDKFHG

SEQ ID NO: 1701635 - protein, 20 aa, Staphylococcus aureus
CKVYLKREDLQWVRSFKLRG

SEQ ID NO: 1701636 - protein, 18 aa, Staphylococcus aureus
FGAFVEIAPGVQGLVHIS

SEQ ID NO: 1701637 - protein, 27 aa, Staphylococcus aureus
IKFIEKWYFPTLPFQRFIIANIFLIDK

SEQ ID NO: 1701638 - protein, 17 aa, Staphylococcus aureus
KLKHWLPVDLYIGGVEH

SEQ ID NO: 1701639 - protein, 25 aa, Staphylococcus aureus
LQSNYIDEFILYYAPKLIGGSGNYQ

SEQ ID NO: 1701640 - protein, 20 aa, Staphylococcus aureus
NAGLYLLKFLASLNLDNNAQ

SEQ ID NO: 1701641 - protein, 20 aa, Staphylococcus aureus
NLEEELKILLIPKDPNDDKD

SEQ ID NO: 1701642 - protein, 26 aa, Staphylococcus aureus
RIMEGLSLIPLPGMGFLKGAGKSLMK

SEQ ID NO: 1701643 - protein, 24 aa, Staphylococcus aureus
SNWDMLFIVFSIHLIDILKKLSHD

SEQ ID NO: 1701644 - protein, 18 aa, Staphylococcus aureus
ACGTWRLVYQRLKALEVL

SEQ ID NO: 1701645 - protein, 24 aa, Staphylococcus aureus
HITLNQIFPYLKYQIIAMTTDSLK

SEQ ID NO: 1701646 - protein, 25 aa, Staphylococcus aureus
ITNPQAFNLLDWKKRRSLLFEIAKP

SEQ ID NO: 1701647 - protein, 18 aa, Staphylococcus aureus
KKRRSLLFEIAKPINDED

SEQ ID NO: 1701648 - protein, 23 aa, Staphylococcus aureus
KNQFPWVVAAFPSKAWAKRVYPE

SEQ ID NO: 1701649 - protein, 17 aa, Staphylococcus aureus
RQVMRLLKSLQTDENKA

SEQ ID NO: 1701650 - protein, 24 aa, Staphylococcus aureus
SYHFNKIYFLRISTLPLSLGQESC

SEQ ID NO: 1701651 - protein, 17 aa, Staphylococcus aureus
VMRLLKSLQTDENKAII

SEQ ID NO: 1701652 - protein, 30 aa, Staphylococcus aureus; identical to SEQ ID NO: 1599481

SEQ ID NO: 1701653 - protein, 19 aa, Staphylococcus aureus
DAKFIIWTTTPWTIPSNVA

SEQ ID NO: 1701654 - protein, 17 aa, Staphylococcus aureus
EQRQFLQPLIYIPEIQS

SEQ ID NO: 1701655 - protein, 25 aa, Staphylococcus aureus
FFPSKLAFVLFFIKQLEITEHHFVI

SEQ ID NO: 1701656 - protein, 19 aa, Staphylococcus aureus
GVDFPKLFKAFKDMGMTYN

SEQ ID NO: 1701657 - protein, 18 aa, Staphylococcus aureus
IRRLWISSVTKKAIQQGF

SEQ ID NO: 1701658 - protein, 19 aa, Staphylococcus aureus
KNFINQIGWYLDFEKDIDL

SEQ ID NO: 1701659 - protein, 23 aa, Staphylococcus aureus
NNFCTFCIIPWARGLMRSRDPEK

SEQ ID NO: 1701660 - protein, 17 aa, Staphylococcus aureus
PRRVGWFDSVVLRHSRR

SEQ ID NO: 1701661 - protein, 23 aa, Staphylococcus aureus
SVKSLPPFFYPLNELISIGQMIK

SEQ ID NO: 1701662 - protein, 24 aa, Staphylococcus aureus
TEARIFKFYKYFYSHRGPLLDYFD

SEQ ID NO: 1701663 - protein, 26 aa, Staphylococcus aureus
TTTATALQWLLFDKGLDGSTKSFNPV

SEQ ID NO: 1701664 - protein, 17 aa, Staphylococcus aureus
VAFFFKALTSYLKKHNC

SEQ ID NO: 1701665 - protein, 17 aa, Staphylococcus aureus
YIRPLFCEGKGPFRFAA

SEQ ID NO: 1701666 - protein, 22 aa, Staphylococcus aureus
YRLEFYRLYLLMVHLLKFGEMY

SEQ ID NO: 1701667 - protein, 21 aa, Staphylococcus aureus
EIIKKLFLLGIVANINQSLNQ

SEQ ID NO: 1701668 - protein, 25 aa, Staphylococcus aureus
GKDVTIFFTFWGLNALKKVQTVNVK

SEQ ID NO: 1701669 - protein, 17 aa, Staphylococcus aureus
HLLIQWYSKGIYKFKYA

SEQ ID NO: 1701670 - protein, 24 aa, Staphylococcus aureus
HPEELRLLLIDPKMVELAPYNGLP

SEQ ID NO: 1701671 - protein, 20 aa, Staphylococcus aureus
IKVYKLFFIEAYKTVFQMTS

SEQ ID NO: 1701672 - protein, 21 aa, Staphylococcus aureus
KGRYLFIPVHKLADIRWKELG

SEQ ID NO: 1701673 - protein, 19 aa, Staphylococcus aureus
NIRDWTISRQLWWGHQIPA

SEQ ID NO: 1701674 - protein, 17 aa, Staphylococcus aureus
PLGIFSHQLQRFIHLVW

SEQ ID NO: 1701675 - protein, 18 aa, Staphylococcus aureus
PSILTMPYIFEKLFEYSK

SEQ ID NO: 1701676 - protein, 17 aa, Staphylococcus aureus
RFEAYGWNYLLVKDGND

SEQ ID NO: 1701677 - protein, 21 aa, Staphylococcus aureus
RYVGRGMLFLDLIQEGNMGLI

SEQ ID NO: 1701678 - protein, 25 aa, Staphylococcus aureus
SIDVQLIFCTLPLELRGFQIVSLDD

SEQ ID NO: 1701679 - protein, 23 aa, Staphylococcus aureus
SPLFKVKLFQFADAAYILLDFHV

SEQ ID NO: 1701680 - protein, 17 aa, Staphylococcus aureus
ETSGWTNIFIYPGFDFK

SEQ ID NO: 1701681 - protein, 29 aa, Staphylococcus aureus
GAHIRTLLLTFFYRFMRPLIEAGYVYIAQ

SEQ ID NO: 1701682 - protein, 21 aa, Staphylococcus aureus
HIVNLYFPFVEVETMLTLLDM

SEQ ID NO: 1701683 - protein, 24 aa, Staphylococcus aureus
IYEFLTLRIPMLLVPLGLDQSRGD

SEQ ID NO: 1701684 - protein, 17 aa, Staphylococcus aureus
LLFLYLEHAFLSQDFFD

SEQ ID NO: 1701685 - protein, 18 aa, Staphylococcus aureus
RGYVLRRLLRRAVRFSQT

SEQ ID NO: 1701686 - protein, 24 aa, Staphylococcus aureus
RRVSPFFVPMLIPDMATGQVSIDL

SEQ ID NO: 1701687 - protein, 18 aa, Staphylococcus aureus
TLPMLFSDILIYCTERNV

SEQ ID NO: 1701688 - protein, 20 aa, Staphylococcus aureus
YLTEDIAYGLVLWSSLGRVI

SEQ ID NO: 1701689 - protein, 22 aa, Staphylococcus aureus
ESYAYLFDSILPLYNIPYNIDT

SEQ ID NO: 1701690 - protein, 17 aa, Staphylococcus aureus
KFMLKVFLDLKFVTQED

SEQ ID NO: 1701691 - protein, 17 aa, Staphylococcus aureus
KGKYYVSHQWFPLGAVH

SEQ ID NO: 1701692 - protein, 17 aa, Staphylococcus aureus
LNRFNGIVEFLHLDKDA

SEQ ID NO: 1701693 - protein, 21 aa, Staphylococcus aureus
PRPIDNILPIWRAVGGPPASA

SEQ ID NO: 1701694 - protein, 17 aa, Staphylococcus aureus
TERMEEEMFLGLRLNEG

SEQ ID NO: 1701695 - protein, 22 aa, Staphylococcus aureus
VKPFYGNFGIYLRAYTYIRTMG

SEQ ID NO: 1701696 - protein, 20 aa, Staphylococcus aureus
YLRRSGLNYTILHPGALTNA

SEQ ID NO: 1701697 - protein, 18 aa, Staphylococcus aureus
ANIVLAFYLTRPAIDVII

SEQ ID NO: 1701698 - protein, 23 aa, Staphylococcus aureus
ENKPYPLYLLLDKEYQLIEPVMK

SEQ ID NO: 1701699 - protein, 17 aa, Staphylococcus aureus
FIGIMPIASYKNALFLH

SEQ ID NO: 1701700 - protein, 21 aa, Staphylococcus aureus
GKRIRPVLLLLTLDSLNTEYE

SEQ ID NO: 1701701 - protein, 23 aa, Staphylococcus aureus
GTHALDLTLWMMDNYEPESVMGS

SEQ ID NO: 1701702 - protein, 19 aa, Staphylococcus aureus
HKRWLFISSTLIKQTVRSS

SEQ ID NO: 1701703 - protein, 19 aa, Staphylococcus aureus
ILLTPLFPTYFFPTHSDRQ

SEQ ID NO: 1701704 - protein, 19 aa, Staphylococcus aureus
ISAGFFFINPFEVVYYAGG

SEQ ID NO: 1701705 - protein, 18 aa, Staphylococcus aureus
KMRIYPEKIIWDIGGIAP

SEQ ID NO: 1701706 - protein, 26 aa, Staphylococcus aureus
LNESLDQFILLIFYGTFPGGDFTEFG

SEQ ID NO: 1701707 - protein, 24 aa, Staphylococcus aureus
LTRIGLDLPFPIKINQMLGHQTSF

SEQ ID NO: 1701708 - protein, 19 aa, Staphylococcus aureus
MIAWLVKIPHRIMPILGTS

SEQ ID NO: 1701709 - protein, 17 aa, Staphylococcus aureus
NSILMSLLYKNHPEELR

SEQ ID NO: 1701710 - protein, 17 aa, Staphylococcus aureus
PEKSLLKPLPKKAGRNN

SEQ ID NO: 1701711 - protein, 22 aa, Staphylococcus aureus
RQLVLQPWQHFIIGSLFGWVHK

SEQ ID NO: 1701712 - protein, 26 aa, Staphylococcus aureus
VKKGEYLFVLTAWYDQQRTLDSAFRI

SEQ ID NO: 1701713 - protein, 17 aa, Staphylococcus aureus
VTRLFYMFDKETMIASM

SEQ ID NO: 1701714 - protein, 24 aa, Staphylococcus aureus
INNEPLLMDIAKTPHALIAGATGS

SEQ ID NO: 1701715 - protein, 26 aa, Staphylococcus aureus
LDDALNYYLFYLKNWNYAYAYSLKLI

SEQ ID NO: 1701716 - protein, 20 aa, Staphylococcus aureus
QSEYFLPSQTNFIFVKTKRV

SEQ ID NO: 1701717 - protein, 20 aa, Staphylococcus aureus
RSDYFWDLFIQMPAALMFPS

SEQ ID NO: 1701718 - protein, 17 aa, Staphylococcus aureus
RVGWFDSVVLRHSRRVS

SEQ ID NO: 1701719 - protein, 21 aa, Staphylococcus aureus
SDLNWIYLVKNLRNAGVSIES

SEQ ID NO: 1701720 - protein, 17 aa, Staphylococcus aureus
SKPPILLTPLFPTYFFP

SEQ ID NO: 1701721 - protein, 22 aa, Staphylococcus aureus
TAMKLRQRVWRRLAKDLKPENL

SEQ ID NO: 1701722 - protein, 20 aa, Staphylococcus aureus
VLQLIRLCRYFVDVLRQSAN

SEQ ID NO: 1701723 - protein, 25 aa, Staphylococcus aureus
YKNTEKWWNGLKSWWSNFREDQKKK

SEQ ID NO: 1701724 - protein, 17 aa, Staphylococcus aureus
EYMIPRKFEWMEQLPLT

SEQ ID NO: 1701725 - protein, 25 aa, Staphylococcus aureus
KIDKHGFISFTPVGGWWNQVMLSQK

SEQ ID NO: 1701726 - protein, 20 aa, Staphylococcus aureus
RTELKYFYFYHLNNGIWNAK

SEQ ID NO: 1701727 - protein, 24 aa, Staphylococcus aureus
SAKLAILPFKLLKNGLGLAAKSLF

SEQ ID NO: 1701728 - protein, 17 aa, Staphylococcus aureus
TFETNVYPLFWTVQKAL

SEQ ID NO: 1701729 - protein, 17 aa, Staphylococcus aureus
VPLIIKYASELKLYGKT

SEQ ID NO: 1701730 - protein, 19 aa, Staphylococcus aureus
YDHFLYLKHKMNYSEDAMI

SEQ ID NO: 1701731 - protein, 17 aa, Staphylococcus aureus
CEQMYDHFLYLKHKMNY

SEQ ID NO: 1701732 - protein, 23 aa, Staphylococcus aureus
EAIHLLPYNVFFVPARGGLGENV

SEQ ID NO: 1701733 - protein, 24 aa, Staphylococcus aureus
EAIHLLPYNVFFVPARGGLGENVV

SEQ ID NO: 1701734 - protein, 20 aa, Staphylococcus aureus
EALIKIIPSYHALIVRSQTT

SEQ ID NO: 1701735 - protein, 20 aa, Staphylococcus aureus
GYITAILLRKLYPEAKIYVF

SEQ ID NO: 1701736 - protein, 18 aa, Staphylococcus aureus
HAFLLPLMQLIDSEIKEP

SEQ ID NO: 1701737 - protein, 25 aa, Staphylococcus aureus
INNEPLLMDIAKTPHALIAGATGSG

SEQ ID NO: 1701738 - protein, 22 aa, Staphylococcus aureus
PNGWILHIPSCYLGIAQAARNY

SEQ ID NO: 1701739 - protein, 20 aa, Staphylococcus aureus
QLINDFAYKHRIPWIYGGVV

SEQ ID NO: 1701740 - protein, 21 aa, Staphylococcus aureus
RSDYFWDLFIQMPAALMFPSG

SEQ ID NO: 1701741 - protein, 17 aa, Staphylococcus aureus
SEEALIKIIPSYHALIV

SEQ ID NO: 1701742 - protein, 24 aa, Staphylococcus aureus
SEYQDCLLFFRLGDFYEMFYEDAK

SEQ ID NO: 1701743 - protein, 18 aa, Staphylococcus aureus
DLLHLLEKELQQLGLPTD

SEQ ID NO: 1701744 - protein, 28 aa, Staphylococcus aureus
GAHIRTLLLTFFYRFMRPLIEAGYVYIA

SEQ ID NO: 1701745 - protein, 19 aa, Staphylococcus aureus
GKMRIYPEKIIWDIGGIAP

SEQ ID NO: 1701746 - protein, 34 aa, Staphylococcus aureus
KEGYNLTFFAFFVKAVADALKAYPLLNSSWQGNE

SEQ ID NO: 1701747 - protein, 23 aa, Staphylococcus aureus
KIDERLWLLNRAGKIPFVVSGQG

SEQ ID NO: 1701748 - protein, 21 aa, Staphylococcus aureus
NGWILHIPSCYLGIAQAARNY

SEQ ID NO: 1701749 - protein, 20 aa, Staphylococcus aureus
NLILLFLESWYLKASFSQKF

SEQ ID NO: 1701750 - protein, 20 aa, Staphylococcus aureus
PILLTPLFPTYFFPTHSDRQ

SEQ ID NO: 1701751 - protein, 20 aa, Staphylococcus aureus
QWDLLHLLEKELQQLGLPTD

SEQ ID NO: 1701752 - protein, 22 aa, Staphylococcus aureus
SEEALIKIIPSYHALIVRSQTT

SEQ ID NO: 1701753 - protein, 23 aa, Staphylococcus aureus
YPYFKEGLVLFTYLHLANEEKLT

SEQ ID NO: 1701754 - protein, 20 aa, Staphylococcus aureus
DKLVEIFWPGPLNIILKNKT

SEQ ID NO: 1701755 - protein, 19 aa, Staphylococcus aureus
EDVFKLITNPQAFNLLDWK

SEQ ID NO: 1701756 - protein, 19 aa, Staphylococcus aureus
HFYRDILLGKLLLTGKKTA

SEQ ID NO: 1701757 - protein, 17 aa, Staphylococcus aureus
IIILSDYNRRYLSGFTG

SEQ ID NO: 1701758 - protein, 18 aa, Staphylococcus aureus
KRWLFISSTLIKQTVRSS

SEQ ID NO: 1701759 - protein, 19 aa, Staphylococcus aureus
LEPKTQFYNMYRKGLLKLP

SEQ ID NO: 1701760 - protein, 18 aa, Staphylococcus aureus
LQLIRLCRYFVDVLRQSD

SEQ ID NO: 1701761 - protein, 22 aa, Staphylococcus aureus
PYFKEGLVLFTYLHLANEEKLT

SEQ ID NO: 1701762 - protein, 17 aa, Staphylococcus aureus
QWDLLHLLEKELQQLGL

SEQ ID NO: 1701763 - protein, 23 aa, Staphylococcus aureus
RVSPFFVPMLIPDMATGQVSIDL

SEQ ID NO: 1701764 - protein, 18 aa, Staphylococcus aureus
YGNFGIYLRAYTYIRTMG

SEQ ID NO: 1701765 - protein, 27 aa, Staphylococcus aureus
EGIAYDRLWIHLIPVIKEQQLRIKKLE

SEQ ID NO: 1701766 - protein, 33 aa, Staphylococcus aureus
EGYNLTFFAFFVKAVADALKAYPLLNSSWQGNE

SEQ ID NO: 1701767 - protein, 23 aa, Staphylococcus aureus
ELERPYILVTDKKISSFQDILPL

SEQ ID NO: 1701768 - protein, 27 aa, Staphylococcus aureus
FNDSPLFKFKLFQFADAAYILLDFHVS

SEQ ID NO: 1701769 - protein, 20 aa, Staphylococcus aureus
GVTIPPWNFPFAIMAGTTLA

SEQ ID NO: 1701770 - protein, 17 aa, Staphylococcus aureus
GYVLRRLLRRAVRFSQT

SEQ ID NO: 1701771 - protein, 24 aa, Staphylococcus aureus
IGQRRLFEWLRQNGFLIKRKGVDY

SEQ ID NO: 1701772 - protein, 17 aa, Staphylococcus aureus
IGYWLETEINRILTEMN

SEQ ID NO: 1701773 - protein, 22 aa, Staphylococcus aureus
KAILNLPIRTWFDKAESEILAR

SEQ ID NO: 1701774 - protein, 23 aa, Staphylococcus aureus
KNMKVIYMPHWLEFYSIAIHSDV

SEQ ID NO: 1701775 - protein, 17 aa, Staphylococcus aureus
LFPEIIFLDAISLRTFE

SEQ ID NO: 1701776 - protein, 19 aa, Staphylococcus aureus
LTEDIAYGLVLWSSLGRVI

SEQ ID NO: 1701777 - protein, 20 aa, Staphylococcus aureus
QKRFTLNILYPYIETIHITK

SEQ ID NO: 1701778 - protein, 18 aa, Staphylococcus aureus
TPEKSLLKPLPKKAGRNN

SEQ ID NO: 1701779 - protein, 18 aa, Staphylococcus aureus
YNVKVVVLKPFRLGGIDK

SEQ ID NO: 1701780 - protein, 22 aa, Staphylococcus aureus
AERLVIHGFLDPVVRELPIEDV

SEQ ID NO: 1701781 - protein, 20 aa, Staphylococcus aureus
EIIKKLFLLGIVANINQSLN

SEQ ID NO: 1701782 - protein, 22 aa, Staphylococcus aureus
GGKRIRPVLLLLTLDSLNTEYE

SEQ ID NO: 1701783 - protein, 17 aa, Staphylococcus aureus
GYYLVYLFHPEGEGIYL

SEQ ID NO: 1701784 - protein, 17 aa, Staphylococcus aureus
HYICLFIDLFNREIVGY

SEQ ID NO: 1701785 - protein, 21 aa, Staphylococcus aureus
IAQRFLIYVYARGTGKWINMI

SEQ ID NO: 1701786 - protein, 18 aa, Staphylococcus aureus
IRDWTISRQLWWGHQIPA

SEQ ID NO: 1701787 - protein, 24 aa, Staphylococcus aureus
KEIYQFPLLLFYKGNIKLINNMHH

SEQ ID NO: 1701788 - protein, 19 aa, Staphylococcus aureus
KLVEIFWPGPLNIILKNKT

SEQ ID NO: 1701789 - protein, 17 aa, Staphylococcus aureus
LGFLPRKEKEKSAVLEQ

SEQ ID NO: 1701790 - protein, 17 aa, Staphylococcus aureus
LSVLPIYHISGLSVLLR

SEQ ID NO: 1701791 - protein, 18 aa, Staphylococcus aureus
MLQRLMIALALALKPKLI

SEQ ID NO: 1701792 - protein, 19 aa, Staphylococcus aureus
PEAWLECYLDRTLLPILKL

SEQ ID NO: 1701793 - protein, 17 aa, Staphylococcus aureus
PEYQHLNIFPVGRLDKD

SEQ ID NO: 1701794 - protein, 22 aa, Staphylococcus aureus
SEKVFYDLWTDLYRLFKKLRNA

SEQ ID NO: 1701795 - protein, 20 aa, Staphylococcus aureus
TQFYNMYRKGLLKLPNEDLG

SEQ ID NO: 1701796 - protein, 24 aa, Staphylococcus aureus
DFEKRLFLMAIFNRNRTLFYKLTS

SEQ ID NO: 1701797 - protein, 17 aa, Staphylococcus aureus
DRFLVIAHSYQLNARVL

SEQ ID NO: 1701798 - protein, 17 aa, Staphylococcus aureus
FDYVNWYNNFRPHSSLQ

SEQ ID NO: 1701799 - protein, 24 aa, Staphylococcus aureus
HITLNQIFPYLKYQIIAMTTESLK

SEQ ID NO: 1701800 - protein, 25 aa, Staphylococcus aureus
HPEELRLLLIDPKMVELAPYNGLPH

SEQ ID NO: 1701801 - protein, 19 aa, Staphylococcus aureus
KVFYDLWTDLYRLFKKLRN

SEQ ID NO: 1701802 - protein, 18 aa, Staphylococcus aureus
LLFLYLEHAFLSQDFFDI

SEQ ID NO: 1701803 - protein, 19 aa, Staphylococcus aureus
LRRSGLNYTILHPGALTNA

SEQ ID NO: 1701804 - protein, 17 aa, Staphylococcus aureus
NDDFTHWRKIMGAAPIS

SEQ ID NO: 1701805 - protein, 22 aa, Staphylococcus aureus
NNFCTFCIIPWARGLMRSRDPE

SEQ ID NO: 1701806 - protein, 18 aa, Staphylococcus aureus
NPAKNQCYFIPYGNKMQL

SEQ ID NO: 1701807 - protein, 20 aa, Staphylococcus aureus
RYVGRGMLFLDLIQEGNMGL

SEQ ID NO: 1701808 - protein, 19 aa, Staphylococcus aureus
TERMEEEMFLGLRLNEGVS

SEQ ID NO: 1701809 - protein, 19 aa, Staphylococcus aureus
YDLRFPELLRYPARSGAKI

SEQ ID NO: 1701810 - protein, 18 aa, Staphylococcus aureus
AKFIIWTTTPWTIPSNVA

SEQ ID NO: 1701811 - protein, 25 aa, Staphylococcus aureus
ECYLDRTLLPILKLFSNTGISLEAH

SEQ ID NO: 1701812 - protein, 23 aa, Staphylococcus aureus
FSNPNLLFPLLDEEFHLPLVVAT

SEQ ID NO: 1701813 - protein, 21 aa, Staphylococcus aureus
KAKKFTLLTKSLRPLPDKFHG

SEQ ID NO: 1701814 - protein, 23 aa, Staphylococcus aureus
KFDKKLLIELKSPNLYPGIECKL

SEQ ID NO: 1701815 - protein, 17 aa, Staphylococcus aureus
LSIRMYYALFLNKPIIT

SEQ ID NO: 1701816 - protein, 18 aa, Staphylococcus aureus
QYFPATHWKAINGIPYAG

SEQ ID NO: 1701817 - protein, 23 aa, Staphylococcus aureus
RDDKFYYNRLKYYKDRVLVPLAY

SEQ ID NO: 1701818 - protein, 17 aa, Staphylococcus aureus
RDYLFFKLAIHSGMKIT

SEQ ID NO: 1701819 - protein, 21 aa, Staphylococcus aureus
SDLEIYLYDRGPRILRNFPEK

SEQ ID NO: 1701820 - protein, 19 aa, Staphylococcus aureus
SEKWPIFLERSLVDGIFTI

SEQ ID NO: 1701821 - protein, 17 aa, Staphylococcus aureus
SVKAKKFTLLTKSLRPL

SEQ ID NO: 1701822 - protein, 23 aa, Staphylococcus aureus
ALTNYYLYFLVDSNIEIGIKSII

SEQ ID NO: 1701823 - protein, 21 aa, Staphylococcus aureus
CKVYLKREDLQWVRSFKLRGA

SEQ ID NO: 1701824 - protein, 24 aa, Staphylococcus aureus
DIKTYIFYHLFDRYIIDYSMASAT

SEQ ID NO: 1701825 - protein, 22 aa, Staphylococcus aureus
FLAKLLWIYTSFFKGQMLYWDP

SEQ ID NO: 1701826 - protein, 17 aa, Staphylococcus aureus
FLSLIKVTGIGPKSALA

SEQ ID NO: 1701827 - protein, 19 aa, Staphylococcus aureus
FTHLPGWVRKASVGLALFG

SEQ ID NO: 1701828 - protein, 19 aa, Staphylococcus aureus
FVYGLFIYNQWRGMGTLNS

SEQ ID NO: 1701829 - protein, 17 aa, Staphylococcus aureus
ITYILANPFYIGKIQFA

SEQ ID NO: 1701830 - protein, 24 aa, Staphylococcus aureus
KDTVYNIPFLWRLSSELNVAQLRQ

SEQ ID NO: 1701831 - protein, 17 aa, Staphylococcus aureus
LNKDKVEWIILAGYMRL

SEQ ID NO: 1701832 - protein, 24 aa, Staphylococcus aureus
LTTIGLDLPFPIKINQMLGHQTSF

SEQ ID NO: 1701833 - protein, 20 aa, Staphylococcus aureus
NLLQCLIFVNDMYLLSNPKS

SEQ ID NO: 1701834 - protein, 17 aa, Staphylococcus aureus
SFNKVFGYFIEITRANL

SEQ ID NO: 1701835 - protein, 21 aa, Staphylococcus aureus
TVYNVPFLWRLSSGLNVAQLQ

SEQ ID NO: 1701836 - protein, 17 aa, Staphylococcus aureus
VAFFFKALTSYLKKQNC

SEQ ID NO: 1701837 - protein, 19 aa, Staphylococcus aureus
VKPFYGNFGIYLRAYTYIR

SEQ ID NO: 1701838 - protein, 22 aa, Staphylococcus aureus
VKSLPPFFYPLNELISIGQMIK

SEQ ID NO: 1701839 - protein, 24 aa, Staphylococcus aureus
CWDLPNYLLDKYWGFRTWGNADAM

SEQ ID NO: 1701840 - protein, 17 aa, Staphylococcus aureus
DDTYLFDLLLRKIEDMI

SEQ ID NO: 1701841 - protein, 23 aa, Staphylococcus aureus
EAERLVIHGFLDPVVRELPIEDV

SEQ ID NO: 1701842 - protein, 17 aa, Staphylococcus aureus
EYLLFQYRFKSRIAVWV

SEQ ID NO: 1701843 - protein, 24 aa, Staphylococcus aureus
FLRRCPNLKWIAWFATGVNTLPLD

SEQ ID NO: 1701844 - protein, 24 aa, Staphylococcus aureus
FSNPNLLFPLLDEAFHLPLVVATT

SEQ ID NO: 1701845 - protein, 17 aa, Staphylococcus aureus
HNSFVFDLLICENFIIY

SEQ ID NO: 1701846 - protein, 19 aa, Staphylococcus aureus
IEYLLFQYRFKSRIAVWVL

SEQ ID NO: 1701847 - protein, 17 aa, Staphylococcus aureus
ISEKLVVLLPLKFGDYL

SEQ ID NO: 1701848 - protein, 19 aa, Staphylococcus aureus
KRPLVCFFSNDLNIHRTKT

SEQ ID NO: 1701849 - protein, 27 aa, Staphylococcus aureus
LDDALNYYLFYLKNWNYAYAYSLKLID

SEQ ID NO: 1701850 - protein, 21 aa, Staphylococcus aureus
LVTRLFYMFDKESMIASMGIG

SEQ ID NO: 1701851 - protein, 19 aa, Staphylococcus aureus
MTLPMLFSDILIYCTERNV

SEQ ID NO: 1701852 - protein, 25 aa, Staphylococcus aureus
NGFGYDPIFYVPKLDRTMAQLSKEQ

SEQ ID NO: 1701853 - protein, 17 aa, Staphylococcus aureus
NLMIYQLGALQGFCRIH

SEQ ID NO: 1701854 - protein, 25 aa, Staphylococcus aureus
PSGGYFVWLVFKIDIDIKYLFYELL

SEQ ID NO: 1701855 - protein, 17 aa, Staphylococcus aureus
PSILTMPYIFEKLFEYS

SEQ ID NO: 1701856 - protein, 25 aa, Staphylococcus aureus
VDHLITFIPYFPLASGILAGKYDEN

SEQ ID NO: 1701857 - protein, 19 aa, Staphylococcus aureus
VIKFLKYFTFLGKEEIDRL

SEQ ID NO: 1701858 - protein, 23 aa, Staphylococcus aureus
DEQRQFLQPLIYIPEIQSLIWEN

SEQ ID NO: 1701859 - protein, 17 aa, Staphylococcus aureus
DIEMLLGSKVYLELWVK

SEQ ID NO: 1701860 - protein, 17 aa, Staphylococcus aureus
DVITLASSKYMVFEAQG

SEQ ID NO: 1701861 - protein, 19 aa, Staphylococcus aureus
EKGLELGCLFAFYGHTHVA

SEQ ID NO: 1701862 - protein, 22 aa, Staphylococcus aureus
ELERPYILVTDKKISSFQDILP

SEQ ID NO: 1701863 - protein, 24 aa, Staphylococcus aureus
EQPLKLFHPVYTYKMKFIKSFEAI

SEQ ID NO: 1701864 - protein, 22 aa, Staphylococcus aureus
ERDYLFFKLAIHSGLKVSELLT

SEQ ID NO: 1701865 - protein, 17 aa, Staphylococcus aureus
FGAFVEIAPGVQGLVHI

SEQ ID NO: 1701866 - protein, 18 aa, Staphylococcus aureus
FINERIIPIIPQQGSLGA

SEQ ID NO: 1701867 - protein, 26 aa, Staphylococcus aureus
GKDVTIFFTFWGLNALKKAQSTRVKK

SEQ ID NO: 1701868 - protein, 23 aa, Staphylococcus aureus
GKRPLICFFSNDLNIHRTKTEKA

SEQ ID NO: 1701869 - protein, 25 aa, Staphylococcus aureus
GLFSGSHLYVKNRDLAPKATNNKEY

SEQ ID NO: 1701870 - protein, 21 aa, Staphylococcus aureus
GYITAILLRKLYPEAKIYVFG

SEQ ID NO: 1701871 - protein, 17 aa, Staphylococcus aureus
IAKYDVITLASSKYMVF

SEQ ID NO: 1701872 - protein, 24 aa, Staphylococcus aureus
IDKHGFISFTPVGGWWNQVMLSQK

SEQ ID NO: 1701873 - protein, 21 aa, Staphylococcus aureus
IKTYIFYHLFDTYIIDYSMAS

SEQ ID NO: 1701874 - protein, 25 aa, Staphylococcus aureus
KETDILFILSLFRKINWKVYDESTG

SEQ ID NO: 1701875 - protein, 23 aa, Staphylococcus aureus
LAESVLPFHPLFIKPNKDELEVM

SEQ ID NO: 1701876 - protein, 20 aa, Staphylococcus aureus
LFVYGLFIYNKWRGMGTLNS

SEQ ID NO: 1701877 - protein, 20 aa, Staphylococcus aureus
LHIGHLLPFLTLRRFQEHGH

SEQ ID NO: 1701878 - protein, 20 aa, Staphylococcus aureus
NAGLYLLKFLASLNLDNNAK

SEQ ID NO: 1701879 - protein, 17 aa, Staphylococcus aureus
NHVLYHLGYLQDKHYPH

SEQ ID NO: 1701880 - protein, 17 aa, Staphylococcus aureus
PDQLKVIGIIKLYQSFY

SEQ ID NO: 1701881 - protein, 24 aa, Staphylococcus aureus
QSNYIDKFILYYAPKLIGGSGNYQ

SEQ ID NO: 1701882 - protein, 19 aa, Staphylococcus aureus
RYQKLIVVPLFLYDGRLVN

SEQ ID NO: 1701883 - protein, 23 aa, Staphylococcus aureus
SSYNLKCLLLKLTYRYLDNQPLN

SEQ ID NO: 1701884 - protein, 19 aa, Staphylococcus aureus
STIIPMCHPLPLTGIDVHF

SEQ ID NO: 1701885 - protein, 17 aa, Staphylococcus aureus
TLKFMLKVFLDLKFVTQ

SEQ ID NO: 1701886 - protein, 30 aa, Staphylococcus aureus
TNKDGYKYYSFIDNVGLFSGSHLYVKNRDL

SEQ ID NO: 1701887 - protein, 19 aa, Staphylococcus aureus
TQFYNMYRKGLLKLPNEDL

SEQ ID NO: 1701888 - protein, 22 aa, Staphylococcus aureus
TVGFLVLHIPYISSIDFGKFEK

SEQ ID NO: 1701889 - protein, 22 aa, Staphylococcus aureus
VKQLKIVPLLLFSAMHYLKDIP

SEQ ID NO: 1701890 - protein, 18 aa, Staphylococcus aureus
AQSKKFFEIYTPLLKHQG

SEQ ID NO: 1701891 - protein, 23 aa, Staphylococcus aureus
EARIFKFYKYFYSHRGPLLDYFD

SEQ ID NO: 1701892 - protein, 22 aa, Staphylococcus aureus
EILKLPIRTWFDKYESEIMAKE

SEQ ID NO: 1701893 - protein, 22 aa, Staphylococcus aureus
EPSPIWMQVRLIKAGIRPINNV

SEQ ID NO: 1701894 - protein, 17 aa, Staphylococcus aureus
EPYTNYSILLVSGTYPG

SEQ ID NO: 1701895 - protein, 23 aa, Staphylococcus aureus
ESYAYLFDSILPLYNIPYNIDTK

SEQ ID NO: 1701896 - protein, 20 aa, Staphylococcus aureus
FPWVVAAFPSKAWAKRVYPE

SEQ ID NO: 1701897 - protein, 24 aa, Staphylococcus aureus
GGIPDTGFYRFWIQGIFARWTDNP

SEQ ID NO: 1701898 - protein, 17 aa, Staphylococcus aureus
GGKALKPLGFITAITDN

SEQ ID NO: 1701899 - protein, 20 aa, Staphylococcus aureus
GMLQRLMIALALALKPKLII

SEQ ID NO: 1701900 - protein, 25 aa, Staphylococcus aureus
IYEFLTLRIPMLLVPLGLDQSRGDQ

SEQ ID NO: 1701901 - protein, 22 aa, Staphylococcus aureus
KEIYQFPLLLFYRGNIKLINNM

SEQ ID NO: 1701902 - protein, 18 aa, Staphylococcus aureus
KNQFPWVVAAFPSKAWAK

SEQ ID NO: 1701903 - protein, 27 aa, Staphylococcus aureus
NEPQGSFYIWFKLSVPVNIKLLFNEAI

SEQ ID NO: 1701904 - protein, 24 aa, Staphylococcus aureus
NWLYSTKFMLPKWLYKIAKQRADN

SEQ ID NO: 1701905 - protein, 19 aa, Staphylococcus aureus
QFLQPLIYIPEIQSLIWEN

SEQ ID NO: 1701906 - protein, 20 aa, Staphylococcus aureus
QQAIWYKLLVNLGINSITAL

SEQ ID NO: 1701907 - protein, 19 aa, Staphylococcus aureus
QVETWWRWYRNGESYRFSQ

SEQ ID NO: 1701908 - protein, 17 aa, Staphylococcus aureus
RFRTIIKLYSYYVSLKE

SEQ ID NO: 1701909 - protein, 19 aa, Staphylococcus aureus
RLDLEFIPDNTAVADASRI

SEQ ID NO: 1701910 - protein, 18 aa, Staphylococcus aureus
RPLVCFFSNDLNIHRTKT

SEQ ID NO: 1701911 - protein, 18 aa, Staphylococcus aureus
SEFVYNMPLLSEKPLFVY

SEQ ID NO: 1701912 - protein, 23 aa, Staphylococcus aureus
SKNLKVIYMPHWLEFYSIAIHSD

SEQ ID NO: 1701913 - protein, 21 aa, Staphylococcus aureus
TDLGRYFDRFADKLDKTQTNT

SEQ ID NO: 1701914 - protein, 23 aa, Staphylococcus aureus
YQNEYFYITYLSRNLKEYRKYYE

SEQ ID NO: 1701915 - protein, 17 aa, Staphylococcus aureus
DYRELFTLMFYTGLRIG

SEQ ID NO: 1701916 - protein, 18 aa, Staphylococcus aureus
EPKTQFYNMYRKGLLKLP

SEQ ID NO: 1701917 - protein, 20 aa, Staphylococcus aureus
ERDYLFFKLAIHSGLKVSEL

SEQ ID NO: 1701918 - protein, 17 aa, Staphylococcus aureus
FFKLAIHSGLKVSELLT

SEQ ID NO: 1701919 - protein, 21 aa, Staphylococcus aureus
FPLPKAFRDAGWFFDVLPGHY

SEQ ID NO: 1701920 - protein, 18 aa, Staphylococcus aureus
HFDLRPAGIIKMLDLKQP

SEQ ID NO: 1701921 - protein, 18 aa, Staphylococcus aureus
HLLIQWYSKGIYKFKYAI

SEQ ID NO: 1701922 - protein, 24 aa, Staphylococcus aureus
IIDEKLIPKDYWLSQAPKLNSKQL

SEQ ID NO: 1701923 - protein, 17 aa, Staphylococcus aureus
ITEFAVLELLYNKGPQP

SEQ ID NO: 1701924 - protein, 23 aa, Staphylococcus aureus
KRDKLILMLMYEGGLRIGEVLSL

SEQ ID NO: 1701925 - protein, 18 aa, Staphylococcus aureus
LFTLMFYTGLRIGEAMAL

SEQ ID NO: 1701926 - protein, 20 aa, Staphylococcus aureus
LFVYGLFIYNQWRGMGTLNS

SEQ ID NO: 1701927 - protein, 21 aa, Staphylococcus aureus
NENIKALYFYQKNKYRITDVI

SEQ ID NO: 1701928 - protein, 23 aa, Staphylococcus aureus
NGITLMLLIGKFLEKFGSRRDVQ

SEQ ID NO: 1701929 - protein, 24 aa, Staphylococcus aureus
NNNFKRYVFFTNSFRKEMITKSSM

SEQ ID NO: 1701930 - protein, 23 aa, Staphylococcus aureus
NRHSLGHKLYLKNKIYALQNDER

SEQ ID NO: 1701931 - protein, 19 aa, Staphylococcus aureus
PMVLPSRFPNLLVNGSTGI

SEQ ID NO: 1701932 - protein, 17 aa, Staphylococcus aureus
SLVAFFFKALTSYLKKQ

SEQ ID NO: 1701933 - protein, 19 aa, Staphylococcus aureus
TIIPMCHPLPLTGIDVHFS

SEQ ID NO: 1701934 - protein, 21 aa, Staphylococcus aureus
VDMLRMCRYPWKTKQRILGDM

SEQ ID NO: 1701935 - protein, 24 aa, Staphylococcus aureus
VGNKKPLRRLWISSVTKKAIQQGF

SEQ ID NO: 1701936 - protein, 23 aa, Staphylococcus aureus
VVNLINFYYPKLTFRSSILELIK

SEQ ID NO: 1701937 - protein, 22 aa, Staphylococcus aureus
WLYSTKFMLPKWLYKIAKQRAD

SEQ ID NO: 1701938 - protein, 26 aa, Staphylococcus aureus
ASEFRNYILGLIFYRFLSEKAEQEYA

SEQ ID NO: 1701939 - protein, 19 aa, Staphylococcus aureus
AWVILAKPNLGISSPDIFK

SEQ ID NO: 1701940 - protein, 22 aa, Staphylococcus aureus
DDKFYYNRLKYYKDRVLVPLAY

SEQ ID NO: 1701941 - protein, 17 aa, Staphylococcus aureus
DNTLFDGFIYSAGLGYF

SEQ ID NO: 1701942 - protein, 17 aa, Staphylococcus aureus
EPNLTVLWSVRLPDNFK

SEQ ID NO: 1701943 - protein, 23 aa, Staphylococcus aureus
FHAIQGHFTAMFKQLFGGGDAEL

SEQ ID NO: 1701944 - protein, 20 aa, Staphylococcus aureus
GQKADLLLWFLRPEMKSLNH

SEQ ID NO: 1701945 - protein, 18 aa, Staphylococcus aureus
HFYRDILLGKLLLTGKKT

SEQ ID NO: 1701946 - protein, 22 aa, Staphylococcus aureus
KFYYKLILWQYLKDKHGLTCAY

SEQ ID NO: 1701947 - protein, 21 aa, Staphylococcus aureus
LDTKYMQIFINKLSDIYSQNQ

SEQ ID NO: 1701948 - protein, 17 aa, Staphylococcus aureus
LPQSEYFLPSQTNFIFV

SEQ ID NO: 1701949 - protein, 21 aa, Staphylococcus aureus
LSIQYIPQRLLPDKAIDVLDI

SEQ ID NO: 1701950 - protein, 18 aa, Staphylococcus aureus
NSILMSLLYKNHPEELRL

SEQ ID NO: 1701951 - protein, 21 aa, Staphylococcus aureus
QLLDRFLVIAHSYQLNARILV

SEQ ID NO: 1701952 - protein, 18 aa, Staphylococcus aureus
RNYILGLIFYCFLSEKAE

SEQ ID NO: 1701953 - protein, 20 aa, Staphylococcus aureus
RQFLQPLIYIPEIQSLIWEN

SEQ ID NO: 1701954 - protein, 24 aa, Staphylococcus aureus
RTHGYDFPMWFIRPFYAKETTANK

SEQ ID NO: 1701955 - protein, 20 aa, Staphylococcus aureus
SNEVAYLLKGGKVTKVDGNQ

SEQ ID NO: 1701956 - protein, 23 aa, Staphylococcus aureus
SNWDMLFIVFSIHLIDILKKLSH

SEQ ID NO: 1701957 - protein, 17 aa, Staphylococcus aureus
VDFPKLFKAFKDMGMTY

SEQ ID NO: 1701958 - protein, 17 aa, Staphylococcus aureus
VFDLLICENFIIYHGEK

SEQ ID NO: 1701959 - protein, 23 aa, Staphylococcus aureus
VFRSRFRMLVEAQLDLLKNEDWD

SEQ ID NO: 1701960 - protein, 18 aa, Staphylococcus aureus
AARTYNLHFFTPSSIGAF

SEQ ID NO: 1701961 - protein, 31 aa, Staphylococcus aureus
APEAWLECYLNRTLLPILKLFSNTGISLEAH

SEQ ID NO: 1701962 - protein, 24 aa, Staphylococcus aureus
DGSYLFEYPIWQRFGRYTGGLNFN

SEQ ID NO: 1701963 - protein, 19 aa, Staphylococcus aureus
DHTKVVAPFIRLAGTMEGL

SEQ ID NO: 1701964 - protein, 23 aa, Staphylococcus aureus
DIKTYIFYHLFDTYIIDYSMASA

SEQ ID NO: 1701965 - protein, 24 aa, Staphylococcus aureus
ELAVKPFFQLAYDINTHRGYFRIS

SEQ ID NO: 1701966 - protein, 21 aa, Staphylococcus aureus
ERKLYRVWFCKSRLCPMCNWR

SEQ ID NO: 1701967 - protein, 19 aa, Staphylococcus aureus
FDDLWMNLYYLFMNLRDLF

SEQ ID NO: 1701968 - protein, 22 aa, Staphylococcus aureus
GLKYRCKLPNTTFARDLYENMR

SEQ ID NO: 1701969 - protein, 18 aa, Staphylococcus aureus
IEYLLFQYRFKSRIAVWV

SEQ ID NO: 1701970 - protein, 23 aa, Staphylococcus aureus
IFDDLWMELYRSFKKLRNIFKEE

SEQ ID NO: 1701971 - protein, 22 aa, Staphylococcus aureus
IRYAAVLLRPFLTHAPKEIFEQ

SEQ ID NO: 1701972 - protein, 18 aa, Staphylococcus aureus
ISAGFFFINPFEVVYYAG

SEQ ID NO: 1701973 - protein, 20 aa, Staphylococcus aureus
KSFDFILTNPPIRAGKETVH

SEQ ID NO: 1701974 - protein, 19 aa, Staphylococcus aureus
KWEQFFIDKGYYPVSVDAK

SEQ ID NO: 1701975 - protein, 19 aa, Staphylococcus aureus
LDLTLWMMDNYEPESVMGS

SEQ ID NO: 1701976 - protein, 17 aa, Staphylococcus aureus
LIQEFYYYALTKTVEGE

SEQ ID NO: 1701977 - protein, 23 aa, Staphylococcus aureus
LRKAMLYAIDREKWIKAFFNGYA

SEQ ID NO: 1701978 - protein, 18 aa, Staphylococcus aureus
NFSIVWILPISSIDNMPI

SEQ ID NO: 1701979 - protein, 25 aa, Staphylococcus aureus
NIGQRRLFEWLRQNGFLIKRKGVDY

SEQ ID NO: 1701980 - protein, 21 aa, Staphylococcus aureus
NLEEELKILLIPKDPNDDKDV

SEQ ID NO: 1701981 - protein, 17 aa, Staphylococcus aureus
QHFIIGSLFGWVHKETK

SEQ ID NO: 1701982 - protein, 18 aa, Staphylococcus aureus
QKADLLLWFLRPEMKSLN

SEQ ID NO: 1701983 - protein, 22 aa, Staphylococcus aureus
RSDLEIYLYDRGPRILRNFPEK

SEQ ID NO: 1701984 - protein, 22 aa, Staphylococcus aureus
SITQLLERFLFPSATHGKKVYK

SEQ ID NO: 1701985 - protein, 25 aa, Staphylococcus aureus
SVVDNTFMTLYYQNPLDLGIDIVLH

SEQ ID NO: 1701986 - protein, 21 aa, Staphylococcus aureus
TGVTIPPWNFPFAIMAGTTLA

SEQ ID NO: 1701987 - protein, 19 aa, Staphylococcus aureus
TIITIWVKLLTLSGKYNEQ

SEQ ID NO: 1701988 - protein, 18 aa, Staphylococcus aureus
VIPTYKYLLHLDTQRLNK

SEQ ID NO: 1701989 - protein, 17 aa, Staphylococcus aureus
VPEARLLVISPYDKTSV

SEQ ID NO: 1701990 - protein, 18 aa, Staphylococcus aureus
YHQVGQGPVLIFIPGANG

SEQ ID NO: 1701991 - protein, 22 aa, Staphylococcus aureus
YQNEYFYITYLSRNLKEYRKYY

SEQ ID NO: 1701992 - protein, 17 aa, Staphylococcus aureus
AERLVIHGFLDPVVREL

SEQ ID NO: 1701993 - protein, 24 aa, Staphylococcus aureus
ALDFPLPKAFRDAGWFFDVLPGHY

SEQ ID NO: 1701994 - protein, 18 aa, Staphylococcus aureus
ARFEAYGWNYLLVKDGND

SEQ ID NO: 1701995 - protein, 23 aa, Staphylococcus aureus
CNHTLYHLGYLQDKHYPHLRFGF

SEQ ID NO: 1701996 - protein, 20 aa, Staphylococcus aureus
DILMYNYLKHFDIPTLVICT

SEQ ID NO: 1701997 - protein, 26 aa, Staphylococcus aureus
GIAYDRLWVHLIPIIKNQQSKIEKLE

SEQ ID NO: 1701998 - protein, 21 aa, Staphylococcus aureus
GQKADLLLWFLRPEMKSLNHI

SEQ ID NO: 1701999 - protein, 17 aa, Staphylococcus aureus
IAKMFDLMLPKKNIRMP

SEQ ID NO: 1702000 - protein, 24 aa, Staphylococcus aureus
IDVQLIFCTLPLELRGFQIVSLDD

SEQ ID NO: 1702001 - protein, 18 aa, Staphylococcus aureus
IIEDDIFRDIFFSDPTPA

SEQ ID NO: 1702002 - protein, 17 aa, Staphylococcus aureus
IWGFLHLASSKEIVEKM

SEQ ID NO: 1702003 - protein, 24 aa, Staphylococcus aureus
KADQFKYEVTLPQGVTYVNDSLTT

SEQ ID NO: 1702004 - protein, 18 aa, Staphylococcus aureus
KGLELGCLFAFYGHTHVA

SEQ ID NO: 1702005 - protein, 22 aa, Staphylococcus aureus
KPTVRWLFLTLTVKNVYDGEEL

SEQ ID NO: 1702006 - protein, 17 aa, Staphylococcus aureus
KRKGLEPLAIWMKARKH

SEQ ID NO: 1702007 - protein, 19 aa, Staphylococcus aureus
LTHGQFFSILPIYDSGGYL

SEQ ID NO: 1702008 - protein, 19 aa, Staphylococcus aureus
NLILLFLESWYLKASFSQK

SEQ ID NO: 1702009 - protein, 21 aa, Staphylococcus aureus
QLINDFAYKHRIPWIYGGVVQ

SEQ ID NO: 1702010 - protein, 20 aa, Staphylococcus aureus
RLVIHGFLDPVVRELPIEDV

SEQ ID NO: 1702011 - protein, 24 aa, Staphylococcus aureus
SYRLEFYRLYLLMVHLLKFGEMYR

SEQ ID NO: 1702012 - protein, 18 aa, Staphylococcus aureus
YDLRFPELLRYPARSGAK

SEQ ID NO: 1702013 - protein, 18 aa, Staphylococcus aureus
YQKLIVVPLFLYDGRLVN

SEQ ID NO: 1702014 - protein, 24 aa, Staphylococcus aureus
AELERPYILVTDKKISSFQDILPL

SEQ ID NO: 1702015 - protein, 19 aa, Staphylococcus aureus
CNHVLYHLGYLQDKHYPHL

SEQ ID NO: 1702016 - protein, 22 aa, Staphylococcus aureus
EANRFYVLELIKKVLKSKFNQI

SEQ ID NO: 1702017 - protein, 26 aa, Staphylococcus aureus
EGEKNLIAFLFFYFELFEDEKQETIK

SEQ ID NO: 1702018 - protein, 24 aa, Staphylococcus aureus
FERLRNYFFIKKPKRMKYINKFNE

SEQ ID NO: 1702019 - protein, 18 aa, Staphylococcus aureus
FVFDLLICENFIIYHGEK

SEQ ID NO: 1702020 - protein, 17 aa, Staphylococcus aureus
ILDMVFWFGNLQILAAH

SEQ ID NO: 1702021 - protein, 20 aa, Staphylococcus aureus
IRRVFEEFLSFKLKNSDLAQ

SEQ ID NO: 1702022 - protein, 19 aa, Staphylococcus aureus
KFCENIISVPLPRLIYRYY

SEQ ID NO: 1702023 - protein, 26 aa, Staphylococcus aureus
NNNKLYMIELLEPLPFLEKISKLTTV

SEQ ID NO: 1702024 - protein, 17 aa, Staphylococcus aureus
NVVVFKKQAENVKNYLS

SEQ ID NO: 1702025 - protein, 20 aa, Staphylococcus aureus
QYQKLIVVPLFLYDGRLVNK

SEQ ID NO: 1702026 - protein, 22 aa, Staphylococcus aureus
TGVTIPPWNFPFAIMAGTTLAP

SEQ ID NO: 1702027 - protein, 24 aa, Staphylococcus aureus
TKRDKLILMLMYEGGLRIGEVLSL

SEQ ID NO: 1702028 - protein, 21 aa, Staphylococcus aureus
TLKFMLKVFLDLKFVTQEDGL

SEQ ID NO: 1702029 - protein, 26 aa, Staphylococcus aureus
VRKKFPDALFIFLAPPSLEHLRERLV

SEQ ID NO: 1702030 - protein, 23 aa, Staphylococcus aureus
AKGILLYFLSRPDNWQIYTSEVV

SEQ ID NO: 1702031 - protein, 19 aa, Staphylococcus aureus
DLEIYLYDRGPRILRNFPE

SEQ ID NO: 1702032 - protein, 17 aa, Staphylococcus aureus
EDKSFDFILTNPPIRAG

SEQ ID NO: 1702033 - protein, 17 aa, Staphylococcus aureus
ELEDKIYILFHKPTQVI

SEQ ID NO: 1702034 - protein, 25 aa, Staphylococcus aureus
EYQYFKKNQIIWGFLHLASSKEIVE

SEQ ID NO: 1702035 - protein, 24 aa, Staphylococcus aureus
FRNEYYYLTAIPYTLDEYKKYFQP

SEQ ID NO: 1702036 - protein, 22 aa, Staphylococcus aureus
IAQRFLIYVYARGTGKWINMIN

SEQ ID NO: 1702037 - protein, 17 aa, Staphylococcus aureus
KHNLLQCLIFVNDMYLL

SEQ ID NO: 1702038 - protein, 22 aa, Staphylococcus aureus
KIDYEFLYLLSMDKLFGNKRNR

SEQ ID NO: 1702039 - protein, 17 aa, Staphylococcus aureus
KKEWKLFYLYKELIQTF

SEQ ID NO: 1702040 - protein, 21 aa, Staphylococcus aureus
KNRKRWPLYRPWALFIKDTEK

SEQ ID NO: 1702041 - protein, 18 aa, Staphylococcus aureus
KPSPDGIIYILQKYDLHN

SEQ ID NO: 1702042 - protein, 22 aa, Staphylococcus aureus
KYMIFLTWIFSATNNKLRDLGT

SEQ ID NO: 1702043 - protein, 18 aa, Staphylococcus aureus
LTNYLLKYDYRDLEIIKA

SEQ ID NO: 1702044 - protein, 20 aa, Staphylococcus aureus
QDSYLLVRGIKTLGLRMEQI

SEQ ID NO: 1702045 - protein, 21 aa, Staphylococcus aureus
QRCPNLKWIAWFATGVNTLPL

SEQ ID NO: 1702046 - protein, 17 aa, Staphylococcus aureus
QSKKFFEIYTPLLKHQG

SEQ ID NO: 1702047 - protein, 23 aa, Staphylococcus aureus
SAKKYLWRVLVTQLKKLELNYDV

SEQ ID NO: 1702048 - protein, 28 aa, Staphylococcus aureus
SSILTSIPLWKNQMAIALTLMRQRNAVA

SEQ ID NO: 1702049 - protein, 23 aa, Staphylococcus aureus
SWLYSTKFMLPKWLYKIAKQRAD

SEQ ID NO: 1702050 - protein, 18 aa, Staphylococcus aureus
TIVRRLLVISYEDIGLAS

SEQ ID NO: 1702051 - protein, 17 aa, Staphylococcus aureus
TMIFNQFNQMSLSHYPI

SEQ ID NO: 1702052 - protein, 24 aa, Staphylococcus aureus
TREHILLSRNVGVPALVVFLNKVD

SEQ ID NO: 1702053 - protein, 18 aa, Staphylococcus aureus
TYYPRTFIQQLFVDGYFG

SEQ ID NO: 1702054 - protein, 18 aa, Staphylococcus aureus
VIISFKHKVILIGGTEYA

SEQ ID NO: 1702055 - protein, 21 aa, Staphylococcus aureus
VKGLYLYGPFGTGKSFILGAI

SEQ ID NO: 1702056 - protein, 26 aa, Staphylococcus aureus
VPSGGYFVWLVFKIDIDIKYLFYELL

SEQ ID NO: 1702057 - protein, 26 aa, Staphylococcus aureus
YFFPSKLAFVLFFIKQLEITEHHFVI

SEQ ID NO: 1702058 - protein, 17 aa, Staphylococcus aureus
YTKQLFFEIQSRGYIPI

SEQ ID NO: 1702059 - protein, 22 aa, Staphylococcus aureus
AKGILLYLLSRPDNWQIYETEL

SEQ ID NO: 1702060 - protein, 24 aa, Staphylococcus aureus
ATARNEITTILNNKLQAIQATPDA

SEQ ID NO: 1702061 - protein, 21 aa, Staphylococcus aureus
CYDLRFPELLRYPARSGAKIA

SEQ ID NO: 1702062 - protein, 20 aa, Staphylococcus aureus
DTKYMQIFINKLSDIYSQNQ

SEQ ID NO: 1702063 - protein, 17 aa, Staphylococcus aureus
FINERIIPIIPQQGSLG

SEQ ID NO: 1702064 - protein, 17 aa, Staphylococcus aureus
FMTPYYQNPLDLGIDIV

SEQ ID NO: 1702065 - protein, 25 aa, Staphylococcus aureus
GIAYDRLWVHLIPIIKNQQSKIEKL

SEQ ID NO: 1702066 - protein, 19 aa, Staphylococcus aureus
GMLQRLMIALALALKPKLI

SEQ ID NO: 1702067 - protein, 19 aa, Staphylococcus aureus
GYITAILLRKLYPEAKTYV

SEQ ID NO: 1702068 - protein, 24 aa, Staphylococcus aureus
HIVNLYFPFVEVEMMLTLLDMAQI

SEQ ID NO: 1702069 - protein, 19 aa, Staphylococcus aureus
IHKRFYLFVALMTEFQALN

SEQ ID NO: 1702070 - protein, 18 aa, Staphylococcus aureus
IIYILQKYDLHNKDTIYV

SEQ ID NO: 1702071 - protein, 18 aa, Staphylococcus aureus
LILLFLESWYLKASFSQK

SEQ ID NO: 1702072 - protein, 18 aa, Staphylococcus aureus
LWLGIPDDAIIGALHIKT

SEQ ID NO: 1702073 - protein, 22 aa, Staphylococcus aureus
MQAFWPGPISFILPLKLGYLCR

SEQ ID NO: 1702074 - protein, 30 aa, Staphylococcus aureus
PEAWLECYLDRTLLPILKLFSNTGISLEAH

SEQ ID NO: 1702075 - protein, 19 aa, Staphylococcus aureus
QKADLLLWFLRPEMKSLNH

SEQ ID NO: 1702076 - protein, 22 aa, Staphylococcus aureus
QRCPNLKWIAWFATGVNTLPLD

SEQ ID NO: 1702077 - protein, 25 aa, Staphylococcus aureus
RKYSNIYLYFGLRDFLKKLMSNYSY

SEQ ID NO: 1702078 - protein, 17 aa, Staphylococcus aureus
RLLVISPYDKTSVADIE

SEQ ID NO: 1702079 - protein, 17 aa, Staphylococcus aureus
RVWLDKDSYDFSFSGLK

SEQ ID NO: 1702080 - protein, 17 aa, Staphylococcus aureus
SAGFFFINPFEVVYYAG

SEQ ID NO: 1702081 - protein, 18 aa, Staphylococcus aureus
TAMKLRQRVWRRLAKDLK

SEQ ID NO: 1702082 - protein, 18 aa, Staphylococcus aureus
WHYICLFIDLFNREIVGY

SEQ ID NO: 1702083 - protein, 25 aa, Staphylococcus aureus
YGATFFVFSDYLKPALRLSSIMGLN

SEQ ID NO: 1702084 - protein, 25 aa, Staphylococcus aureus
ANTEQYYFHLFSKKQPDLNWGNPEV

SEQ ID NO: 1702085 - protein, 23 aa, Staphylococcus aureus
AVLHLLYARFWHKVLYDLAIVPT

SEQ ID NO: 1702086 - protein, 19 aa, Staphylococcus aureus
CDISLVMRALDSILSFLEK

SEQ ID NO: 1702087 - protein, 24 aa, Staphylococcus aureus
DFSNPNLLFPLLDEDFHLPLVVAT

SEQ ID NO: 1702088 - protein, 20 aa, Staphylococcus aureus
DLRLLFLDKGMIYGLKFHEF

SEQ ID NO: 1702089 - protein, 18 aa, Staphylococcus aureus
FLSIGIKTVLITLGKQGT

SEQ ID NO: 1702090 - protein, 21 aa, Staphylococcus aureus
GTFLMTKMMLPLMMNQGGSIV

SEQ ID NO: 1702091 - protein, 21 aa, Staphylococcus aureus
IDYEFLYLLSMDKLFGNKRNR

SEQ ID NO: 1702092 - protein, 17 aa, Staphylococcus aureus
IRWRGPFERFRIVHLIE

SEQ ID NO: 1702093 - protein, 18 aa, Staphylococcus aureus
KLKHWLPVDLYIGGVEHA

SEQ ID NO: 1702094 - protein, 23 aa, Staphylococcus aureus
KSDVQALFAGRFYLRELATPDNS

SEQ ID NO: 1702095 - protein, 20 aa, Staphylococcus aureus
LEQPVLYPGWNRFKSNKVMK

SEQ ID NO: 1702096 - protein, 22 aa, Staphylococcus aureus
LGYITAILLRKLYPESKIYVFG

SEQ ID NO: 1702097 - protein, 17 aa, Staphylococcus aureus
LIELVTRLGIKLNLPSL

SEQ ID NO: 1702098 - protein, 19 aa, Staphylococcus aureus
LNLFSFVRQLSDIPLGGII

SEQ ID NO: 1702099 - protein, 21 aa, Staphylococcus aureus
NAKSVFNGFRKWLSKTYDWIR

SEQ ID NO: 1702100 - protein, 23 aa, Staphylococcus aureus
QDWKYPRRILWLRKVQSTIKDSL

SEQ ID NO: 1702101 - protein, 29 aa, Staphylococcus aureus
RGTHTKEVLFPDKSLKLSYKVNVANIDTP

SEQ ID NO: 1702102 - protein, 18 aa, Staphylococcus aureus
WQHFIIGSLFGWVHKETK

SEQ ID NO: 1702103 - protein, 21 aa, Staphylococcus aureus
YLIVCTDLRLLFLDKGMIYGL

SEQ ID NO: 1702104 - protein, 17 aa, Staphylococcus aureus
YLRLYAEFENYKRRIQK

SEQ ID NO: 1702105 - protein, 25 aa, Staphylococcus aureus
YSYLFNKIYFLRISTLPLSLGQESC

SEQ ID NO: 1702106 - protein, 19 aa, Staphylococcus aureus
AMGNLKHALAEKDNTKRSV

SEQ ID NO: 1702107 - protein, 31 aa, Staphylococcus aureus
APEAWLECYLDRTLLPILKLFSNTGISLEAH

SEQ ID NO: 1702108 - protein, 19 aa, Staphylococcus aureus
ARFEAYGWNYLLVKDGNDL

SEQ ID NO: 1702109 - protein, 18 aa, Staphylococcus aureus
CNHVLYHLGYLQDKHYPH

SEQ ID NO: 1702110 - protein, 24 aa, Staphylococcus aureus
DIKSPMIGTFFLQDSKELTEPIVN

SEQ ID NO: 1702111 - protein, 17 aa, Staphylococcus aureus
DLVNVYWNHLYGHGLKG

SEQ ID NO: 1702112 - protein, 23 aa, Staphylococcus aureus
DLWMNLYYLFKNLRNLFKTEGHE

SEQ ID NO: 1702113 - protein, 17 aa, Staphylococcus aureus
DYVLSWGPLILGHRDPQ

SEQ ID NO: 1702114 - protein, 20 aa, Staphylococcus aureus
ELHLRFQLAFYLFTNRGVIC

SEQ ID NO: 1702115 - protein, 24 aa, Staphylococcus aureus
ELVEKLIFMLGWDPQSPVPINDHG

SEQ ID NO: 1702116 - protein, 25 aa, Staphylococcus aureus
FDDLWMNLYYLFKNLRNLFKTEEHE

SEQ ID NO: 1702117 - protein, 24 aa, Staphylococcus aureus
FIQQQYWFLFYHDENYFAVKYSDN

SEQ ID NO: 1702118 - protein, 19 aa, Staphylococcus aureus
GRYLFIPVHKLADIRWKEL

SEQ ID NO: 1702119 - protein, 17 aa, Staphylococcus aureus
ILIYLDNAATTKAFEEV

SEQ ID NO: 1702120 - protein, 22 aa, Staphylococcus aureus
IVYYIYAILHHKYYVNKYSSDL

SEQ ID NO: 1702121 - protein, 23 aa, Staphylococcus aureus
KAIQSINQALANKLKEIEASNAT

SEQ ID NO: 1702122 - protein, 22 aa, Staphylococcus aureus
KIDERLWLLNRAGKIPFVVSGQ

SEQ ID NO: 1702123 - protein, 19 aa, Staphylococcus aureus
KLIQFLYNQFDFYEIPVNR

SEQ ID NO: 1702124 - protein, 17 aa, Staphylococcus aureus
LRFGFIHVPYIPEQVIG

SEQ ID NO: 1702125 - protein, 22 aa, Staphylococcus aureus
NAKSVFNGFRKWLSKTYDWIRD

SEQ ID NO: 1702126 - protein, 21 aa, Staphylococcus aureus
NDLNWIYLVKNLRNAGVSIES

SEQ ID NO: 1702127 - protein, 17 aa, Staphylococcus aureus
NTKLIQFLYNQFDFYEI

SEQ ID NO: 1702128 - protein, 17 aa, Staphylococcus aureus
NVKVVVLKPFRLGGIDK

SEQ ID NO: 1702129 - protein, 17 aa, Staphylococcus aureus
PVDILAYATWKFSGLPK

SEQ ID NO: 1702130 - protein, 18 aa, Staphylococcus aureus
SEFDLLWQKSTPLTEQWI

SEQ ID NO: 1702131 - protein, 20 aa, Staphylococcus aureus
STLIPMCHPLPLTGIDVHFS

SEQ ID NO: 1702132 - protein, 19 aa, Staphylococcus aureus
TLKFMLKVFLDLKFVTQED

SEQ ID NO: 1702133 - protein, 17 aa, Staphylococcus aureus
VYIFGRIEFIPDSYTRK

SEQ ID NO: 1702134 - protein, 24 aa, Staphylococcus aureus
AETFYPMPFLSPQTMWYYKSAFNT

SEQ ID NO: 1702135 - protein, 17 aa, Staphylococcus aureus
ALDFPLPKAFRDAGWFF

SEQ ID NO: 1702136 - protein, 18 aa, Staphylococcus aureus
ALDVWLLGKLQFAEFEDF

SEQ ID NO: 1702137 - protein, 22 aa, Staphylococcus aureus
DDKFYYNRLKYYKERVLVPLAY

SEQ ID NO: 1702138 - protein, 29 aa, Staphylococcus aureus
DGAHIQVLLLTFFFKYMKPLVQAGRVFIA

SEQ ID NO: 1702139 - protein, 20 aa, Staphylococcus aureus
DLEIYLYDRGPRILRNFPEK

SEQ ID NO: 1702140 - protein, 20 aa, Staphylococcus aureus
DLNWIYLVKNLRNAGVSIES

SEQ ID NO: 1702141 - protein, 20 aa, Staphylococcus aureus
DTVYNVPFLWRLSSELNVAQ

SEQ ID NO: 1702142 - protein, 19 aa, Staphylococcus aureus
EVIWLYQYFSDISLAPTTY

SEQ ID NO: 1702143 - protein, 21 aa, Staphylococcus aureus
FIANKLRLLKLAPKVLLRLRE

SEQ ID NO: 1702144 - protein, 26 aa, Staphylococcus aureus
GIAYDRLWIHLIPVIKEQQLRIKKLE

SEQ ID NO: 1702145 - protein, 20 aa, Staphylococcus aureus
IDYEFLYLLSMDKLFGNKRN

SEQ ID NO: 1702146 - protein, 17 aa, Staphylococcus aureus
IFQHFNLLWSRTVLKNI

SEQ ID NO: 1702147 - protein, 17 aa, Staphylococcus aureus
IVRRLLVISYEDIGLAS

SEQ ID NO: 1702148 - protein, 26 aa, Staphylococcus aureus
KFDVEYGFYILFIKPIFEIVFSSNYV

SEQ ID NO: 1702149 - protein, 24 aa, Staphylococcus aureus
LEPKTQFYNMYRKGLLKLPNEDLG

SEQ ID NO: 1702150 - protein, 20 aa, Staphylococcus aureus
LNLFSFVRQLSDIPLGGIIY

SEQ ID NO: 1702151 - protein, 28 aa, Staphylococcus aureus
MPSQLFQFFMSYLLARFDISLATLLGVH

SEQ ID NO: 1702152 - protein, 25 aa, Staphylococcus aureus
MRASILVMGPLLARLGHAIVALPGG

SEQ ID NO: 1702153 - protein, 20 aa, Staphylococcus aureus
NYYEFLLRYKKIDALLTENE

SEQ ID NO: 1702154 - protein, 21 aa, Staphylococcus aureus
PEGLIPLLKIQGLGSKKIAKL

SEQ ID NO: 1702155 - protein, 20 aa, Staphylococcus aureus
QRVMIAMALILKPQILIADE

SEQ ID NO: 1702156 - protein, 17 aa, Staphylococcus aureus
SLVAFFFKALTSYLKKH

SEQ ID NO: 1702157 - protein, 20 aa, Staphylococcus aureus
STIIPMCHPLPLTGIDVHFS

SEQ ID NO: 1702158 - protein, 18 aa, Staphylococcus aureus
SYHKILIKNFNLWQAQRE

SEQ ID NO: 1702159 - protein, 17 aa, Staphylococcus aureus
TKIKAWVRQLLWMSIYQ

SEQ ID NO: 1702160 - protein, 20 aa, Staphylococcus aureus
VSMEWLFRPLLKMLAEGDPV

SEQ ID NO: 1702161 - protein, 18 aa, Staphylococcus aureus
YTLKLFNQVFKIIKSMMK

SEQ ID NO: 1702162 - protein, 18 aa, Staphylococcus aureus
ALDFPLPKAFRDAGWFFD

SEQ ID NO: 1702163 - protein, 20 aa, Staphylococcus aureus
ALNAVTRAKAALNGADNLRN

SEQ ID NO: 1702164 - protein, 17 aa, Staphylococcus aureus
ANIVLAFYLTRPAIDVI

SEQ ID NO: 1702165 - protein, 17 aa, Staphylococcus aureus
DIDKLLFQLNLNVRYIK

SEQ ID NO: 1702166 - protein, 19 aa, Staphylococcus aureus
EFPEQLTNYLLKYDYRDLE

SEQ ID NO: 1702167 - protein, 19 aa, Staphylococcus aureus
EIIAWFDAIGKKRGLIRRG

SEQ ID NO: 1702168 - protein, 23 aa, Staphylococcus aureus
EQGIDYLPFQYLADYIRSLKYDG

SEQ ID NO: 1702169 - protein, 25 aa, Staphylococcus aureus
FIRNDLIDYLDCKVLFIGNLDELNK

SEQ ID NO: 1702170 - protein, 17 aa, Staphylococcus aureus
FKFMAPLEYDTITARSL

SEQ ID NO: 1702171 - protein, 19 aa, Staphylococcus aureus
FKQMYALYFKFVMPIFGKL

SEQ ID NO: 1702172 - protein, 18 aa, Staphylococcus aureus
GKKEWKLFYLYKELIQTF

SEQ ID NO: 1702173 - protein, 17 aa, Staphylococcus aureus
HDLKIVPYGPIEISPAA

SEQ ID NO: 1702174 - protein, 24 aa, Staphylococcus aureus
HPDLDTWVIFPWTAGQGKVARLIC

SEQ ID NO: 1702175 - protein, 17 aa, Staphylococcus aureus
IDVFLEPTKLYVKPVLA

SEQ ID NO: 1702176 - protein, 17 aa, Staphylococcus aureus
IIEDDIFRDIFFSDPTP

SEQ ID NO: 1702177 - protein, 18 aa, Staphylococcus aureus
IIVNERIQFVLTSRLESF

SEQ ID NO: 1702178 - protein, 21 aa, Staphylococcus aureus
IYDQMMWIGFKPFKITNIKQE

SEQ ID NO: 1702179 - protein, 22 aa, Staphylococcus aureus
KGRYLFIPVHKLADIRWKELGQ

SEQ ID NO: 1702180 - protein, 22 aa, Staphylococcus aureus
KNRKRWPLYRPWALFIKDTEKL

SEQ ID NO: 1702181 - protein, 20 aa, Staphylococcus aureus
LLDRFLVIAHSYQLNARILV

SEQ ID NO: 1702182 - protein, 17 aa, Staphylococcus aureus
LLLVYPLSEYEGALDSA

SEQ ID NO: 1702183 - protein, 18 aa, Staphylococcus aureus
LVTRLFYMFDKETMIASM

SEQ ID NO: 1702184 - protein, 21 aa, Staphylococcus aureus
MHDLAFLLLVYPLSEYEGALD

SEQ ID NO: 1702185 - protein, 20 aa, Staphylococcus aureus
NCLPVYKILLEKQTAHFRVY

SEQ ID NO: 1702186 - protein, 17 aa, Staphylococcus aureus
NILYPYIETIHITKDKN

SEQ ID NO: 1702187 - protein, 21 aa, Staphylococcus aureus
NKQIFLMFNPVSKLNWVYKYF

SEQ ID NO: 1702188 - protein, 25 aa, Staphylococcus aureus
NLDIKRYFYLVIHKDKYIDTKLNEV

SEQ ID NO: 1702189 - protein, 17 aa, Staphylococcus aureus
NNDCDVIFFATPAPVSK

SEQ ID NO: 1702190 - protein, 19 aa, Staphylococcus aureus
QRALYKEELAWMRAGAKAR

SEQ ID NO: 1702191 - protein, 17 aa, Staphylococcus aureus
RIILFIDEIHMLVGAGK

SEQ ID NO: 1702192 - protein, 18 aa, Staphylococcus aureus
SMAIYQFYLGDTLTILDR

SEQ ID NO: 1702193 - protein, 19 aa, Staphylococcus aureus
SYHKILIKNFNLWQAQRED

SEQ ID NO: 1702194 - protein, 18 aa, Staphylococcus aureus
TAMKLRQRVWRRLAKDLM

SEQ ID NO: 1702195 - protein, 20 aa, Staphylococcus aureus
TAMTALKRAIADKADTKASG

SEQ ID NO: 1702196 - protein, 23 aa, Staphylococcus aureus
TARNEITTILNNKLQAIQATPDA

SEQ ID NO: 1702197 - protein, 18 aa, Staphylococcus aureus
TWELVFGKFHLYVDKVIY

SEQ ID NO: 1702198 - protein, 18 aa, Staphylococcus aureus
VDFPKLFKAFKDMGMTYN

SEQ ID NO: 1702199 - protein, 18 aa, Staphylococcus aureus
VFNGFRKWLSRTYEWIRD

SEQ ID NO: 1702200 - protein, 25 aa, Staphylococcus aureus
VRFHSIIWPILLMALDLPLPKKVFA

SEQ ID NO: 1702201 - protein, 23 aa, Staphylococcus aureus
YRLEFYRLYLLMVHLLKFGEMYR

SEQ ID NO: 1702202 - protein, 19 aa, Staphylococcus aureus
AYIEKFLMSLYLYEMASQT

SEQ ID NO: 1702203 - protein, 22 aa, Staphylococcus aureus
DSDLNWIYLVKNLRNAGVSIES

SEQ ID NO: 1702204 - protein, 19 aa, Staphylococcus aureus
DTVYNVPFLWRLSSELNVA

SEQ ID NO: 1702205 - protein, 19 aa, Staphylococcus aureus
DYEFLYLLSMDKLFGNKRN

SEQ ID NO: 1702206 - protein, 17 aa, Staphylococcus aureus
DYPIAIVFQASCFNEFV

SEQ ID NO: 1702207 - protein, 18 aa, Staphylococcus aureus
EFPEQLTNYLLKYDYRDL

SEQ ID NO: 1702208 - protein, 18 aa, Staphylococcus aureus
ENVLLLRKYYAFIKLDHN

SEQ ID NO: 1702209 - protein, 18 aa, Staphylococcus aureus
FKLLVTYRTKLQGGYGQF

SEQ ID NO: 1702210 - protein, 17 aa, Staphylococcus aureus
FSIVWILPISSIDNMPI

SEQ ID NO: 1702211 - protein, 21 aa, Staphylococcus aureus
GIHKRFYLFVALMTEFQALNG

SEQ ID NO: 1702212 - protein, 23 aa, Staphylococcus aureus
HDFEKHMYAIHILTSLYAPTSNT

SEQ ID NO: 1702213 - protein, 25 aa, Staphylococcus aureus
HIVNLYFPFVEVEMMLTLLDMAQIY

SEQ ID NO: 1702214 - protein, 20 aa, Staphylococcus aureus
ILMIQGILGKIPFFGICLGH

SEQ ID NO: 1702215 - protein, 17 aa, Staphylococcus aureus
IRQKLTMIFNQFNQMSL

SEQ ID NO: 1702216 - protein, 22 aa, Staphylococcus aureus
KHGFISFTPVGGWWNQVMLSQK

SEQ ID NO: 1702217 - protein, 22 aa, Staphylococcus aureus
KLTIDNFRWAGVPFYIRTGKRM

SEQ ID NO: 1702218 - protein, 26 aa, Staphylococcus aureus
KMNFDLKWEYYLRLFLNLISAQNNSA

SEQ ID NO: 1702219 - protein, 24 aa, Staphylococcus aureus
KNRWGLFGYCRFIPYLKKRLNNKI

SEQ ID NO: 1702220 - protein, 17 aa, Staphylococcus aureus
KVMIICAFIVNPELYII

SEQ ID NO: 1702221 - protein, 18 aa, Staphylococcus aureus
LFDYVNWYNNFRPHSSLQ

SEQ ID NO: 1702222 - protein, 19 aa, Staphylococcus aureus
LFDYVNWYNNFRPHSSLQY

SEQ ID NO: 1702223 - protein, 18 aa, Staphylococcus aureus
LHMLPLFEEHYHLYAPSD

SEQ ID NO: 1702224 - protein, 29 aa, Staphylococcus aureus
LKENIEIALKLLKILLKELERVLGRNTFA

SEQ ID NO: 1702225 - protein, 25 aa, Staphylococcus aureus
LKSDIQTLFYGRFYLRELATPDNTI

SEQ ID NO: 1702226 - protein, 17 aa, Staphylococcus aureus
LLDRFLVIAHSYQLNAR

SEQ ID NO: 1702227 - protein, 17 aa, Staphylococcus aureus
LLEAPFWTVDTLFYCTP

SEQ ID NO: 1702228 - protein, 18 aa, Staphylococcus aureus
LMAFLKQRHIPMAIATSS

SEQ ID NO: 1702229 - protein, 22 aa, Staphylococcus aureus
LRRCPNLKWIAWFATGVNTLPL

SEQ ID NO: 1702230 - protein, 23 aa, Staphylococcus aureus
NDHNLFFMNYYLNFKELRAFVTG

SEQ ID NO: 1702231 - protein, 21 aa, Staphylococcus aureus
NYQHFVYVVNFLPQILQEMRE

SEQ ID NO: 1702232 - protein, 17 aa, Staphylococcus aureus
PFILLNWSNTISDLYTL

SEQ ID NO: 1702233 - protein, 18 aa, Staphylococcus aureus
PLIVQMLFEPSHYDDMFI

SEQ ID NO: 1702234 - protein, 17 aa, Staphylococcus aureus
QKFFDLIKYFELPLQTK

SEQ ID NO: 1702235 - protein, 18 aa, Staphylococcus aureus
RYLFIPVHKLADIRWKEL

SEQ ID NO: 1702236 - protein, 17 aa, Staphylococcus aureus
SLRQSLLPHLIEAASYN

SEQ ID NO: 1702237 - protein, 21 aa, Staphylococcus aureus
SYAYLFDSILPLYNIPYNIDT

SEQ ID NO: 1702238 - protein, 18 aa, Staphylococcus aureus
TEPYTNYSILLVSGTYPG

SEQ ID NO: 1702239 - protein, 17 aa, Staphylococcus aureus
TFSKTWELVFGKFHLYV

SEQ ID NO: 1702240 - protein, 24 aa, Staphylococcus aureus
TGSSLKPFLAYGPAIENMKWATNH

SEQ ID NO: 1702241 - protein, 17 aa, Staphylococcus aureus
TIDKTMRWLKISNINKL

SEQ ID NO: 1702242 - protein, 18 aa, Staphylococcus aureus
WHDLKIVPYGPIEISPAA

SEQ ID NO: 1702243 - protein, 23 aa, Staphylococcus aureus
YEFLTLRIPMLLVPLGLDQSRGD

SEQ ID NO: 1702244 - protein, 19 aa, Staphylococcus aureus
YFEYIDIKSFLRYDCEVKG

SEQ ID NO: 1702245 - protein, 19 aa, Staphylococcus aureus
YIVQLISMLDMIGGKKLKI

SEQ ID NO: 1702246 - protein, 19 aa, Staphylococcus aureus
YLLEAPFWTVDTLFYCTPK

SEQ ID NO: 1702247 - protein, 18 aa, Staphylococcus aureus
YWLYLFNHRLKGVGAADI

SEQ ID NO: 1702248 - protein, 18 aa, Staphylococcus aureus
AHASLRQSLLPHLIEAAS

SEQ ID NO: 1702249 - protein, 20 aa, Staphylococcus aureus
ALDLTLWMMDNYEPESVMGS

SEQ ID NO: 1702250 - protein, 17 aa, Staphylococcus aureus
AYKDWFPRMLKYGFEEN

SEQ ID NO: 1702251 - protein, 24 aa, Staphylococcus aureus
DKVEWIILAGYMRLIGPDLLASFE

SEQ ID NO: 1702252 - protein, 24 aa, Staphylococcus aureus
DSWLYSTKFMLPKWLYKIAKQRAD

SEQ ID NO: 1702253 - protein, 18 aa, Staphylococcus aureus
DVFKLITNPQAFNLLDWK

SEQ ID NO: 1702254 - protein, 32 aa, Staphylococcus aureus
EGYNLTFFAFFVKAVADALKAYPLLNSSWQGN

SEQ ID NO: 1702255 - protein, 23 aa, Staphylococcus aureus
EMTRYFMTIPEASRLVLQAGALA

SEQ ID NO: 1702256 - protein, 20 aa, Staphylococcus aureus
FGIVRMMNTFVPLLEKSEQP

SEQ ID NO: 1702257 - protein, 17 aa, Staphylococcus aureus
FIRYPLKDKVLNVHIGV

SEQ ID NO: 1702258 - protein, 20 aa, Staphylococcus aureus
FKYAYDMKLIRIMPSEGIKR

SEQ ID NO: 1702259 - protein, 19 aa, Staphylococcus aureus
GAVKLILKRDFFLEVARDA

SEQ ID NO: 1702260 - protein, 18 aa, Staphylococcus aureus
GTHALDLTLWMMDNYEPE

SEQ ID NO: 1702261 - protein, 18 aa, Staphylococcus aureus
IEKMNLPGISLLPETERF

SEQ ID NO: 1702262 - protein, 19 aa, Staphylococcus aureus
ILNLPIRTWFDKAESEILA

SEQ ID NO: 1702263 - protein, 27 aa, Staphylococcus aureus
KFKSQNWYWFAYFDGPLKLPKNPRGSV

SEQ ID NO: 1702264 - protein, 22 aa, Staphylococcus aureus
KNMKVIYMPHWLEFYSIAIHSD

SEQ ID NO: 1702265 - protein, 25 aa, Staphylococcus aureus
KNRWGLFGYCRFIPYLKKRLNNKIV

SEQ ID NO: 1702266 - protein, 23 aa, Staphylococcus aureus
KQFKQLRVWIWETKKRDGKHHGV

SEQ ID NO: 1702267 - protein, 22 aa, Staphylococcus aureus
LPQSEYFLPSQTNFIFVKTKRV

SEQ ID NO: 1702268 - protein, 17 aa, Staphylococcus aureus
MKPLIVQMLFEPSHYDD

SEQ ID NO: 1702269 - protein, 20 aa, Staphylococcus aureus
MKPLIVQMLFEPSHYDDMFI

SEQ ID NO: 1702270 - protein, 22 aa, Staphylococcus aureus
NAMGAVQQYIDEQHLGVISSTN

SEQ ID NO: 1702271 - protein, 19 aa, Staphylococcus aureus
NDLLFIRYPLKDKVLNVHI

SEQ ID NO: 1702272 - protein, 19 aa, Staphylococcus aureus
NLEEELKILLIPKDPNDDK

SEQ ID NO: 1702273 - protein, 17 aa, Staphylococcus aureus
PNFIFKRYWGFVTWGNA

SEQ ID NO: 1702274 - protein, 21 aa, Staphylococcus aureus
QCDQLIILTAIDYVYINFNTE

SEQ ID NO: 1702275 - protein, 22 aa, Staphylococcus aureus
QGIDYLPFQYLADYIRSLKYDG

SEQ ID NO: 1702276 - protein, 18 aa, Staphylococcus aureus
QYFPATHWKAINGVPYAG

SEQ ID NO: 1702277 - protein, 24 aa, Staphylococcus aureus
RASILVMGPLLARLGHAIVALPGG

SEQ ID NO: 1702278 - protein, 17 aa, Staphylococcus aureus
RLLLALLMLQRDNVLIL

SEQ ID NO: 1702279 - protein, 17 aa, Staphylococcus aureus
SLIPLTPLDSSLLRKEQ

SEQ ID NO: 1702280 - protein, 21 aa, Staphylococcus aureus
TAMGQLQHAIADKTTTLASSK

SEQ ID NO: 1702281 - protein, 22 aa, Staphylococcus aureus
TKSYEWFLREGLIEMFRDISPI

SEQ ID NO: 1702282 - protein, 19 aa, Staphylococcus aureus
TPIAKYRFPERNRIISGLS

SEQ ID NO: 1702283 - protein, 17 aa, Staphylococcus aureus
TWRRYFHQFPELSDKEF

SEQ ID NO: 1702284 - protein, 21 aa, Staphylococcus aureus
VKRRIFLGTFALSSGYYDAYY

SEQ ID NO: 1702285 - protein, 18 aa, Staphylococcus aureus
VMDVSNIQYLAIASWGRH

SEQ ID NO: 1702286 - protein, 22 aa, Staphylococcus aureus
VQSLLHYLAFYTGKNKQQMERI

SEQ ID NO: 1702287 - protein, 24 aa, Staphylococcus aureus
VSEKVFYDLWTDLYRLFKKLRNAF

SEQ ID NO: 1702288 - protein, 18 aa, Staphylococcus aureus
YEFLLRYKKIDALLTENE

SEQ ID NO: 1702289 - protein, 19 aa, Staphylococcus aureus
YQKLIVVPLFLYDGRLVNK

SEQ ID NO: 1702290 - protein, 17 aa, Staphylococcus aureus
ALDVWLLGKLQFAEFED

SEQ ID NO: 1702291 - protein, 20 aa, Staphylococcus aureus
CYDLRFPELLRYPARSGAKI

SEQ ID NO: 1702292 - protein, 17 aa, Staphylococcus aureus
DIQFDVIFLDPPYNKGL

SEQ ID NO: 1702293 - protein, 22 aa, Staphylococcus aureus
DNAQVRVLPYASITTRQLGKEL

SEQ ID NO: 1702294 - protein, 23 aa, Staphylococcus aureus
DQFRMIIKQLYFFSVANPNPKNW

SEQ ID NO: 1702295 - protein, 23 aa, Staphylococcus aureus
EDAYIEKFLMSLYLYETVSQTSM

SEQ ID NO: 1702296 - protein, 17 aa, Staphylococcus aureus
EMSKWEQFFIDKGYYPV

SEQ ID NO: 1702297 - protein, 22 aa, Staphylococcus aureus
ETFYPMPFLSPQTMWYYKSAFN

SEQ ID NO: 1702298 - protein, 17 aa, Staphylococcus aureus
FDDLWMELYRSFKKLRN

SEQ ID NO: 1702299 - protein, 24 aa, Staphylococcus aureus
FKHYIFEIFLPWYKTQVKLRTYEN

SEQ ID NO: 1702300 - protein, 21 aa, Staphylococcus aureus
FQGEALLFFLGLTNSMAGFEK

SEQ ID NO: 1702301 - protein, 23 aa, Staphylococcus aureus
FRNEYYYLTAIPYTLDEYKKYFQ

SEQ ID NO: 1702302 - protein, 27 aa, Staphylococcus aureus
GTHTKEVLFPDKSLKLSYKVNVANIDT

SEQ ID NO: 1702303 - protein, 20 aa, Staphylococcus aureus
HNLFFMNYYLNFKELRAFVT

SEQ ID NO: 1702304 - protein, 18 aa, Staphylococcus aureus
IAWLVKIPHRIMPILGTS

SEQ ID NO: 1702305 - protein, 17 aa, Staphylococcus aureus
IISFKHKVILIGGTEYA

SEQ ID NO: 1702306 - protein, 17 aa, Staphylococcus aureus
ITPLLFMANGPSFVTDT

SEQ ID NO: 1702307 - protein, 22 aa, Staphylococcus aureus
KFFRPEFLNRFNGIVEFLHLDK

SEQ ID NO: 1702308 - protein, 20 aa, Staphylococcus aureus
KGYYFVRTFYRKDKLPDRKN

SEQ ID NO: 1702309 - protein, 24 aa, Staphylococcus aureus
KICGLYAFRNWPIVALSYGQKKRV

SEQ ID NO: 1702310 - protein, 18 aa, Staphylococcus aureus
KKFFEIYTPLLKHQGLVI

SEQ ID NO: 1702311 - protein, 17 aa, Staphylococcus aureus
KLRQRVWRRLAKDLKPE

SEQ ID NO: 1702312 - protein, 17 aa, Staphylococcus aureus
LAGYMRLIGPDLLASFE

SEQ ID NO: 1702313 - protein, 18 aa, Staphylococcus aureus
LDLTLWMMDNYEPESVMG

SEQ ID NO: 1702314 - protein, 25 aa, Staphylococcus aureus
LKADQFKYEVTLPQGVTYVNDSLTT

SEQ ID NO: 1702315 - protein, 19 aa, Staphylococcus aureus
LLDRFLVIAHSYQLNARIL

SEQ ID NO: 1702316 - protein, 22 aa, Staphylococcus aureus
LRKAMLYAIDREKWIKAFFNGY

SEQ ID NO: 1702317 - protein, 17 aa, Staphylococcus aureus
MDVSNIQYLAIASWGRH

SEQ ID NO: 1702318 - protein, 18 aa, Staphylococcus aureus
MIPMRKLLDQLREKFKHL

SEQ ID NO: 1702319 - protein, 23 aa, Staphylococcus aureus
MTTACLLFFGKYNAISDRFPGFQ

SEQ ID NO: 1702320 - protein, 21 aa, Staphylococcus aureus
NDLLFIRYPLKDKVLNVHIGV

SEQ ID NO: 1702321 - protein, 25 aa, Staphylococcus aureus
NFDNFLTIHFYYYYDFEYDCLILPN

SEQ ID NO: 1702322 - protein, 17 aa, Staphylococcus aureus
PDRFLAYGAVSLPYVDQ

SEQ ID NO: 1702323 - protein, 17 aa, Staphylococcus aureus
PFYGNFGIYLRAYTYIR

SEQ ID NO: 1702324 - protein, 21 aa, Staphylococcus aureus
PGWQKWVWSPFLSVLGSGATA

SEQ ID NO: 1702325 - protein, 20 aa, Staphylococcus aureus
PLTHGQFFSILPIYDSGGYL

SEQ ID NO: 1702326 - protein, 17 aa, Staphylococcus aureus
QEKQLIELVTRLGIKLN

SEQ ID NO: 1702327 - protein, 25 aa, Staphylococcus aureus
QERLPLIHKWINGRMPLIGIGSIFT

SEQ ID NO: 1702328 - protein, 25 aa, Staphylococcus aureus
RAGKTYVFILLFLMHIATYKDKGLN

SEQ ID NO: 1702329 - protein, 18 aa, Staphylococcus aureus
REVVNKQIEIIKNADADA

SEQ ID NO: 1702330 - protein, 18 aa, Staphylococcus aureus
RLLLALLMLQRDNVLILD

SEQ ID NO: 1702331 - protein, 24 aa, Staphylococcus aureus
RYQDVPTKLWPIQPLRDFWGINRR

SEQ ID NO: 1702332 - protein, 20 aa, Staphylococcus aureus
RYQKLIVVPLFLYDGRLVNK

SEQ ID NO: 1702333 - protein, 26 aa, Staphylococcus aureus
SYFFPSKLAFALFFIKQLEITEHHFV

SEQ ID NO: 1702334 - protein, 17 aa, Staphylococcus aureus
TEYYWHWDLKNSKLDVF

SEQ ID NO: 1702335 - protein, 25 aa, Staphylococcus aureus
TQQQKLFFKLLFYSGARKGEIRALT

SEQ ID NO: 1702336 - protein, 23 aa, Staphylococcus aureus
TRLSIFIFIINILNQLRGIVIYQ

SEQ ID NO: 1702337 - protein, 22 aa, Staphylococcus aureus
VIDALSYYQFFILKFVVGEQRI

SEQ ID NO: 1702338 - protein, 17 aa, Staphylococcus aureus
VIPTYKYLLHLDTQRLN

SEQ ID NO: 1702339 - protein, 26 aa, Staphylococcus aureus
VRKKFPDALFIFLAPPSLDHLRERLV

SEQ ID NO: 1702340 - protein, 23 aa, Staphylococcus aureus
VSEKVFYDLWTDLYRLFKKLRNA

SEQ ID NO: 1702341 - protein, 17 aa, Staphylococcus aureus
VVQILFQYLFSQGRLKD

SEQ ID NO: 1702342 - protein, 19 aa, Staphylococcus aureus
WQHFIIGSLFGWVHKETKL

SEQ ID NO: 1702343 - protein, 25 aa, Staphylococcus aureus
YFFPSKLAFALFFIKQLEITEHHFV

SEQ ID NO: 1702344 - protein, 27 aa, Staphylococcus aureus
YKEDYYQHFLFISLWFLFMTGMRIGEA

SEQ ID NO: 1702345 - protein, 17 aa, Staphylococcus aureus
AMKLRQRVWRRLAKDLM

SEQ ID NO: 1702346 - protein, 17 aa, Staphylococcus aureus
CGTWRLVYQRLKALEVL

SEQ ID NO: 1702347 - protein, 24 aa, Staphylococcus aureus
DFSNPNLLFPLLDEEFHLPLVVAT

SEQ ID NO: 1702348 - protein, 22 aa, Staphylococcus aureus
DHLLTFYDFPLAIRKSIYSTNL

SEQ ID NO: 1702349 - protein, 18 aa, Staphylococcus aureus
DNTLFDGFIYSAGLGYFK

SEQ ID NO: 1702350 - protein, 20 aa, Staphylococcus aureus
DYFEYIDIKSFLRYDCEVKG

SEQ ID NO: 1702351 - protein, 17 aa, Staphylococcus aureus
EFYRFRLSELQIESRAN

SEQ ID NO: 1702352 - protein, 25 aa, Staphylococcus aureus
EIKTKYKLLPIFKINFHKNNLPHLL

SEQ ID NO: 1702353 - protein, 20 aa, Staphylococcus aureus
FCLEFIIYPFKMNLSRVSKG

SEQ ID NO: 1702354 - protein, 17 aa, Staphylococcus aureus
FELIRLFGKRGRGLYNK

SEQ ID NO: 1702355 - protein, 17 aa, Staphylococcus aureus
FFKSLYYRHNSIMYEFA

SEQ ID NO: 1702356 - protein, 25 aa, Staphylococcus aureus
FFNSNFWIYWKTMFAFEPWHSAMEM

SEQ ID NO: 1702357 - protein, 20 aa, Staphylococcus aureus
FFRPEFLNRFNGIVEFLHLD

SEQ ID NO: 1702358 - protein, 20 aa, Staphylococcus aureus
FINVVVFKKQAENVKNYLSK

SEQ ID NO: 1702359 - protein, 23 aa, Staphylococcus aureus
FLRRCPNLKWIAWFATGVNTLPL

SEQ ID NO: 1702360 - protein, 25 aa, Staphylococcus aureus
GEQKRLYLLRLLVHQPNVLLLDEPT

SEQ ID NO: 1702361 - protein, 22 aa, Staphylococcus aureus
GSRPYYYSFKRNNNRVCIPFRT

SEQ ID NO: 1702362 - protein, 28 aa, Staphylococcus aureus
GTHTKEVLFPDKSLKLSYKVNVANIDTP

SEQ ID NO: 1702363 - protein, 18 aa, Staphylococcus aureus
GYYLVYLFHPEGEGIYLS

SEQ ID NO: 1702364 - protein, 17 aa, Staphylococcus aureus
HIVVYNPAPLAIKDVSG

SEQ ID NO: 1702365 - protein, 17 aa, Staphylococcus aureus
HLTYQMVGIFDPTKLKL

SEQ ID NO: 1702366 - protein, 17 aa, Staphylococcus aureus
IAYKLMEILEEAGLPKG

SEQ ID NO: 1702367 - protein, 22 aa, Staphylococcus aureus
IDRALVWGFNWKLGPFQLWDAM

SEQ ID NO: 1702368 - protein, 18 aa, Staphylococcus aureus
IDYVLSWGPLILGHRDPQ

SEQ ID NO: 1702369 - protein, 18 aa, Staphylococcus aureus
IFLGLRYNIKNVVAYNPA

SEQ ID NO: 1702370 - protein, 17 aa, Staphylococcus aureus
IIFAMANPNPEIIPDDA

SEQ ID NO: 1702371 - protein, 20 aa, Staphylococcus aureus
ILKLPIRTWFDKYESEIMAK

SEQ ID NO: 1702372 - protein, 18 aa, Staphylococcus aureus
ITYILANPFYIGKIQFAK

SEQ ID NO: 1702373 - protein, 18 aa, Staphylococcus aureus
KFKFKYLDDWLFTKSIIF

SEQ ID NO: 1702374 - protein, 25 aa, Staphylococcus aureus
KICGLYAFRNWPIAALSYGQKKRVT

SEQ ID NO: 1702375 - protein, 26 aa, Staphylococcus aureus
KILIDRLSYWGHIFKLLGKSGLTVTV

SEQ ID NO: 1702376 - protein, 25 aa, Staphylococcus aureus
KMNFDLKWEYYLRLFLNLISAQNNS

SEQ ID NO: 1702377 - protein, 18 aa, Staphylococcus aureus
KRFTLNMLYPYIDEILIT

SEQ ID NO: 1702378 - protein, 17 aa, Staphylococcus aureus
KVHHPLYYYASYFTIRA

SEQ ID NO: 1702379 - protein, 24 aa, Staphylococcus aureus
KYDTAKYYYNTYYKYKGAIDQTVL

SEQ ID NO: 1702380 - protein, 17 aa, Staphylococcus aureus
LADDIHYSVKPKLANIT

SEQ ID NO: 1702381 - protein, 22 aa, Staphylococcus aureus
LSDKLFIPIYLYDTNLKDELYY

SEQ ID NO: 1702382 - protein, 22 aa, Staphylococcus aureus
NENIKALYFYQKNKYRITDVIF

SEQ ID NO: 1702383 - protein, 22 aa, Staphylococcus aureus
NGITLMLLIGKFLEKFGSRRDV

SEQ ID NO: 1702384 - protein, 19 aa, Staphylococcus aureus
NGKSRAIPIFVFLNDQFEQ

SEQ ID NO: 1702385 - protein, 19 aa, Staphylococcus aureus
NMIFQHFNLLWSRTVLKNI

SEQ ID NO: 1702386 - protein, 17 aa, Staphylococcus aureus
PFFIGIMPIASYKNALF

SEQ ID NO: 1702387 - protein, 17 aa, Staphylococcus aureus
PGALFKLEKTHDLTEEQ

SEQ ID NO: 1702388 - protein, 18 aa, Staphylococcus aureus
QFYNMYRKGLLKLPNEDL

SEQ ID NO: 1702389 - protein, 22 aa, Staphylococcus aureus
QIDYEFLYLLSMDKLFGNKRNR

SEQ ID NO: 1702390 - protein, 20 aa, Staphylococcus aureus
QKFFDLIKYFELPLQTKIKT

SEQ ID NO: 1702391 - protein, 22 aa, Staphylococcus aureus
QLINDFAYKHRIPWIYGGVVQS

SEQ ID NO: 1702392 - protein, 22 aa, Staphylococcus aureus
QMDMLFTHFGISGPAALRCSQF

SEQ ID NO: 1702393 - protein, 21 aa, Staphylococcus aureus
QNWYWFAYFDGPLKLPKNPRG

SEQ ID NO: 1702394 - protein, 24 aa, Staphylococcus aureus
RKFPTTRTLFLLLLGFKNSKINDQ

SEQ ID NO: 1702395 - protein, 19 aa, Staphylococcus aureus
RNLFPEIIFLDAISLRTFE

SEQ ID NO: 1702396 - protein, 24 aa, Staphylococcus aureus
RTDLGRYFDRFADKLDKTQTNTEV

SEQ ID NO: 1702397 - protein, 21 aa, Staphylococcus aureus
SIKVYKLFFIEAYKTVFQMTS

SEQ ID NO: 1702398 - protein, 18 aa, Staphylococcus aureus
SLKDSFNYGYKYLTDTYK

SEQ ID NO: 1702399 - protein, 23 aa, Staphylococcus aureus
SLSFRAFYALPLLSNKAGIHTNA

SEQ ID NO: 1702400 - protein, 22 aa, Staphylococcus aureus
SLTDLYLFIFNNSIKTLTIVTN

SEQ ID NO: 1702401 - protein, 17 aa, Staphylococcus aureus
SNDIFMDLWMKVYRMFD

SEQ ID NO: 1702402 - protein, 25 aa, Staphylococcus aureus
SQNLWYFRYFIYYLIKENVISKKEI

SEQ ID NO: 1702403 - protein, 24 aa, Staphylococcus aureus
SVVDNTFMTLYYQNPLDLGIDIVL

SEQ ID NO: 1702404 - protein, 25 aa, Staphylococcus aureus
TEAYTNYAILFISGTYPGGVIEAFS

SEQ ID NO: 1702405 - protein, 18 aa, Staphylococcus aureus
TEENLIDYIYFATKNLNS

SEQ ID NO: 1702406 - protein, 24 aa, Staphylococcus aureus
TETQKLMELYYFKKPRTLNLTGVA

SEQ ID NO: 1702407 - protein, 19 aa, Staphylococcus aureus
TRILFHALRKMGIPTIFFI

SEQ ID NO: 1702408 - protein, 24 aa, Staphylococcus aureus
TTIGLDLPFPIKINQMLGYQTSFL

SEQ ID NO: 1702409 - protein, 17 aa, Staphylococcus aureus
TVRFMNVIPNRFIYKIA

SEQ ID NO: 1702410 - protein, 25 aa, Staphylococcus aureus
VGNKKPLRRLWISSVTKKAIQQGFK

SEQ ID NO: 1702411 - protein, 17 aa, Staphylococcus aureus
VKPFYGNFGIYLRAYTY

SEQ ID NO: 1702412 - protein, 22 aa, Staphylococcus aureus
VNKQIFLMFNPVSKLNWVYKYF

SEQ ID NO: 1702413 - protein, 17 aa, Staphylococcus aureus
WELVFGKFHLYVDKVIY

SEQ ID NO: 1702414 - protein, 19 aa, Staphylococcus aureus
WHYICLFIDLFNREIVGYS

SEQ ID NO: 1702415 - protein, 19 aa, Staphylococcus aureus
YHILDMVFWFGNLQILAAH

SEQ ID NO: 1702416 - protein, 20 aa, Staphylococcus aureus
YVELFFDLLGIKPDWEKIKY

SEQ ID NO: 1702417 - protein, 21 aa, Staphylococcus aureus
AAKDLVLKAKEKAYQDILNAQ

SEQ ID NO: 1702418 - protein, 17 aa, Staphylococcus aureus
AFLLPLMQLIDSEIKEP

SEQ ID NO: 1702419 - protein, 19 aa, Staphylococcus aureus
AIQELLWFVFEHFDIKGEH

SEQ ID NO: 1702420 - protein, 17 aa, Staphylococcus aureus
ALPMLFSDILIYCTERN

SEQ ID NO: 1702421 - protein, 25 aa, Staphylococcus aureus
ARTDLGRYFDRFADKLDKTQTNAEV

SEQ ID NO: 1702422 - protein, 25 aa, Staphylococcus aureus
ATARNEITAILNNKLQEIQATPDAT

SEQ ID NO: 1702423 - protein, 17 aa, Staphylococcus aureus
ATLPYALMLANKGYREA

SEQ ID NO: 1702424 - protein, 20 aa, Staphylococcus aureus
DAYIEKFLMSLYLYEMASQT

SEQ ID NO: 1702425 - protein, 20 aa, Staphylococcus aureus
DEDVFKLITNPQAFNLLDWK

SEQ ID NO: 1702426 - protein, 18 aa, Staphylococcus aureus
DEHITFIRKLTLNITLMF

SEQ ID NO: 1702427 - protein, 17 aa, Staphylococcus aureus
DLRFPELLRYPARSGAK

SEQ ID NO: 1702428 - protein, 22 aa, Staphylococcus aureus
EIIDHFIMKLRIVKFARTPDYN

SEQ ID NO: 1702429 - protein, 18 aa, Staphylococcus aureus
ETLKLLRIVKFAFGSYTS

SEQ ID NO: 1702430 - protein, 17 aa, Staphylococcus aureus
EVLVPLKYLLIGGEVLN

SEQ ID NO: 1702431 - protein, 17 aa, Staphylococcus aureus
FDILFFSAIGVGDGDFI

SEQ ID NO: 1702432 - protein, 18 aa, Staphylococcus aureus
FEEWWKLYNKKKDKKMSF

SEQ ID NO: 1702433 - protein, 17 aa, Staphylococcus aureus
FFDLIKYFELPLQTKIK

SEQ ID NO: 1702434 - protein, 19 aa, Staphylococcus aureus
FGRYEFYRFRLSELQIESR

SEQ ID NO: 1702435 - protein, 24 aa, Staphylococcus aureus
FHAIQGHFTAMFKQLFGGGDAELQ

SEQ ID NO: 1702436 - protein, 19 aa, Staphylococcus aureus
FLNELFYLIELYLKAFKGQ

SEQ ID NO: 1702437 - protein, 18 aa, Staphylococcus aureus
FVYKRRLPFHAKRFNDWL

SEQ ID NO: 1702438 - protein, 17 aa, Staphylococcus aureus
FYRDILLGKLLLTGKKT

SEQ ID NO: 1702439 - protein, 20 aa, Staphylococcus aureus
GDFIPEAMVYKLAFKAGNST

SEQ ID NO: 1702440 - protein, 24 aa, Staphylococcus aureus
GEKNLIAFLFFYFELFEDEKQETI

SEQ ID NO: 1702441 - protein, 20 aa, Staphylococcus aureus
GIHKRFYLFVALMTEFQALN

SEQ ID NO: 1702442 - protein, 17 aa, Staphylococcus aureus
GILLYLLSRPDNWQIYE

SEQ ID NO: 1702443 - protein, 23 aa, Staphylococcus aureus
GKKLTFIISPQWFTNHGLTNQNF

SEQ ID NO: 1702444 - protein, 17 aa, Staphylococcus aureus
GPRPQFNKTPKYVKYRD

SEQ ID NO: 1702445 - protein, 23 aa, Staphylococcus aureus
GTHALDLTLWMMDNYEPESVMSS

SEQ ID NO: 1702446 - protein, 18 aa, Staphylococcus aureus
HLYINDFPAIPIEENDNI

SEQ ID NO: 1702447 - protein, 17 aa, Staphylococcus aureus
HPMSPLVKIFWMKHEWQ

SEQ ID NO: 1702448 - protein, 17 aa, Staphylococcus aureus
HYLLRAQERYQMTIVFI

SEQ ID NO: 1702449 - protein, 19 aa, Staphylococcus aureus
IDYEFLYLLSMDKLFGNKR

SEQ ID NO: 1702450 - protein, 22 aa, Staphylococcus aureus
IFKYAYDMKLIRILPSEGIKRP

SEQ ID NO: 1702451 - protein, 17 aa, Staphylococcus aureus
IFLGLRYNIKNVVAYNP

SEQ ID NO: 1702452 - protein, 22 aa, Staphylococcus aureus
IGYRIHFLNLYPVLYEAKKVDK

SEQ ID NO: 1702453 - protein, 17 aa, Staphylococcus aureus
IHFALAEMLYYDGQYLR

SEQ ID NO: 1702454 - protein, 24 aa, Staphylococcus aureus
IQFADIYLMALPTKAMREVATQIN

SEQ ID NO: 1702455 - protein, 22 aa, Staphylococcus aureus
IVDKLVEIFWPGPLNIILKNKT

SEQ ID NO: 1702456 - protein, 20 aa, Staphylococcus aureus
IVNLYFPFVEVETMLTLLDM

SEQ ID NO: 1702457 - protein, 24 aa, Staphylococcus aureus
KEKPKARWLFLTLSTKNAIDGDTL

SEQ ID NO: 1702458 - protein, 24 aa, Staphylococcus aureus
KEVKSLLQMLLLHAIPTPVISDKK

SEQ ID NO: 1702459 - protein, 22 aa, Staphylococcus aureus
KHNLLQCLIFVNDMYLLSNPKS

SEQ ID NO: 1702460 - protein, 21 aa, Staphylococcus aureus
KIDYEFLYLLSMDKLFGNKRN

SEQ ID NO: 1702461 - protein, 17 aa, Staphylococcus aureus
KKDGYWWIRFKYQREGS

SEQ ID NO: 1702462 - protein, 18 aa, Staphylococcus aureus
KLLRIVKFAFGSYTSQYL

SEQ ID NO: 1702463 - protein, 21 aa, Staphylococcus aureus
KLYVLAKILNVSEAWLLGYDV

SEQ ID NO: 1702464 - protein, 22 aa, Staphylococcus aureus
KRWGLFGYCRYIPYLKKRLNNK

SEQ ID NO: 1702465 - protein, 22 aa, Staphylococcus aureus
KTNYFIDLIHRHNLKRPLILLN

SEQ ID NO: 1702466 - protein, 17 aa, Staphylococcus aureus
KVAIQELLWFVFEHFDI

SEQ ID NO: 1702467 - protein, 21 aa, Staphylococcus aureus
KVAIQELLWFVFEHFDIKGEH

SEQ ID NO: 1702468 - protein, 18 aa, Staphylococcus aureus
LEMRALLLHLRPLGLKDK

SEQ ID NO: 1702469 - protein, 23 aa, Staphylococcus aureus
LKGIYQFALNYVFDIKIIPELLR

SEQ ID NO: 1702470 - protein, 20 aa, Staphylococcus aureus
LLGYYQSLKDSFNYGYKYLT

SEQ ID NO: 1702471 - protein, 23 aa, Staphylococcus aureus
LNEGYQFFGVLYIGAILTKNGPK

SEQ ID NO: 1702472 - protein, 17 aa, Staphylococcus aureus
LQCLIFVNDMYLLSNPK

SEQ ID NO: 1702473 - protein, 18 aa, Staphylococcus aureus
LRRSGLNYTILHPGALTN

SEQ ID NO: 1702474 - protein, 17 aa, Staphylococcus aureus
MIITFIANKFRSFYSSL

SEQ ID NO: 1702475 - protein, 25 aa, Staphylococcus aureus
MINYHSKFDILSWLQDPFATPTLGK

SEQ ID NO: 1702476 - protein, 17 aa, Staphylococcus aureus
MRRLALRSALSFKAQEN

SEQ ID NO: 1702477 - protein, 20 aa, Staphylococcus aureus
NENIKALYFYQKNKYRITDV

SEQ ID NO: 1702478 - protein, 21 aa, Staphylococcus aureus
NGLRLFVIPKPGFQKTFVTYT

SEQ ID NO: 1702479 - protein, 18 aa, Staphylococcus aureus
NGQWYKLEKLWEKAIKSG

SEQ ID NO: 1702480 - protein, 20 aa, Staphylococcus aureus
NGWILHIPSCYLGIAQAARN

SEQ ID NO: 1702481 - protein, 24 aa, Staphylococcus aureus
NIRDKFLIQLLYETGLRIGEVLSL

SEQ ID NO: 1702482 - protein, 17 aa, Staphylococcus aureus
NKKPIRRLWISSVTKKA

SEQ ID NO: 1702483 - protein, 18 aa, Staphylococcus aureus
NLFEFKYKLKPFFNPENV

SEQ ID NO: 1702484 - protein, 20 aa, Staphylococcus aureus
NLTLNKLIYFADAMNYAINN

SEQ ID NO: 1702485 - protein, 22 aa, Staphylococcus aureus
NNKFTMYRVFGSKKTELLWVSK

SEQ ID NO: 1702486 - protein, 25 aa, Staphylococcus aureus
NQSKIGGMPFLKYFKDIPLDENNVP

SEQ ID NO: 1702487 - protein, 21 aa, Staphylococcus aureus
NYTLKLFNQVFKIIKSMMKEE

SEQ ID NO: 1702488 - protein, 19 aa, Staphylococcus aureus
PHIIGLVALPYLNASRDFG

SEQ ID NO: 1702489 - protein, 19 aa, Staphylococcus aureus
PHIMPVWSIKNRALKVRDE

SEQ ID NO: 1702490 - protein, 18 aa, Staphylococcus aureus
PIAKYRFPERNRIISGLS

SEQ ID NO: 1702491 - protein, 17 aa, Staphylococcus aureus
PILPLIPDVLHRLLKKK

SEQ ID NO: 1702492 - protein, 17 aa, Staphylococcus aureus
PLIVQMLFEPSHYDDMF

SEQ ID NO: 1702493 - protein, 17 aa, Staphylococcus aureus
PQRLLPDKAIDVLDITA

SEQ ID NO: 1702494 - protein, 19 aa, Staphylococcus aureus
PRRVGWFDSVVLRHSRRVS

SEQ ID NO: 1702495 - protein, 24 aa, Staphylococcus aureus
QERLPLIHKWINGRMPLIGIGSIF

SEQ ID NO: 1702496 - protein, 19 aa, Staphylococcus aureus
QLTNYLLKYDYRDLEIIKA

SEQ ID NO: 1702497 - protein, 20 aa, Staphylococcus aureus
QVKNWWRWYRNGESYRFSQH

SEQ ID NO: 1702498 - protein, 17 aa, Staphylococcus aureus
RELFTLMFYTGLRIGEA

SEQ ID NO: 1702499 - protein, 17 aa, Staphylococcus aureus
REYLPFESLILDLNQPF

SEQ ID NO: 1702500 - protein, 18 aa, Staphylococcus aureus
RILFHALRKMGIPTIFFI

SEQ ID NO: 1702501 - protein, 25 aa, Staphylococcus aureus
SEAIHLLPYNVFFVPARGGLGENVV

SEQ ID NO: 1702502 - protein, 25 aa, Staphylococcus aureus
SEFRNYILGLIFYRFLSEKAEQEYA

SEQ ID NO: 1702503 - protein, 17 aa, Staphylococcus aureus
SEFVYNMPLLSEKPLFV

SEQ ID NO: 1702504 - protein, 22 aa, Staphylococcus aureus
SISGYPFVWWFATNPEYEGKGY

SEQ ID NO: 1702505 - protein, 20 aa, Staphylococcus aureus
SKWEQFFIDKGYYPVSVDAK

SEQ ID NO: 1702506 - protein, 23 aa, Staphylococcus aureus
SPDLFIKRLNFYDYLLLNSDGLT

SEQ ID NO: 1702507 - protein, 22 aa, Staphylococcus aureus
SQNWYWFAYFDGPLKLPKNPRG

SEQ ID NO: 1702508 - protein, 17 aa, Staphylococcus aureus
TGMSHNDDLPYAELALG

SEQ ID NO: 1702509 - protein, 18 aa, Staphylococcus aureus
TIIPMCHPLPLTGIDVHF

SEQ ID NO: 1702510 - protein, 17 aa, Staphylococcus aureus
TSSDLILYVSYFNHSFT

SEQ ID NO: 1702511 - protein, 23 aa, Staphylococcus aureus
TYFKEGLVLFTYLHLANEEKLTQ

SEQ ID NO: 1702512 - protein, 23 aa, Staphylococcus aureus
VAGTWHYICLFIDLFNREIVGYS

SEQ ID NO: 1702513 - protein, 18 aa, Staphylococcus aureus
VPEARLLVISPYDKTSVA

SEQ ID NO: 1702514 - protein, 23 aa, Staphylococcus aureus
VSEKVFYDLWTDLYRLFKKLRET

SEQ ID NO: 1702515 - protein, 23 aa, Staphylococcus aureus
WLYSTKFMLPKWLYKIAKQRADN

SEQ ID NO: 1702516 - protein, 19 aa, Staphylococcus aureus
YGSLIPLTPLDNSLLRKEQ

SEQ ID NO: 1702517 - protein, 17 aa, Staphylococcus aureus
YHPTFIIMIPTMYYSTL

SEQ ID NO: 1702518 - protein, 22 aa, Staphylococcus aureus
YLDLFLIHWPCEADGLFLETYK

SEQ ID NO: 1702519 - protein, 26 aa, Staphylococcus aureus
YLIVCTDLRLLFLDKGMIYGLKFHEF

SEQ ID NO: 1702520 - protein, 18 aa, Staphylococcus aureus
YLLEAPFWTVDTLFYCTP

SEQ ID NO: 1702521 - protein, 25 aa, Staphylococcus aureus
YMDDRYPFYLDPMPNLYFTRDPQAS

SEQ ID NO: 1702522 - protein, 23 aa, Staphylococcus aureus
YQTQLKFVLIYTIHIKKLTKLSI

SEQ ID NO: 1702523 - protein, 25 aa, Staphylococcus aureus
AFLRRCPNLKWIAWFATGVNTLPLD

SEQ ID NO: 1702524 - protein, 21 aa, Staphylococcus aureus
AKGLELGCLFAFYGHTHVAKY

SEQ ID NO: 1702525 - protein, 23 aa, Staphylococcus aureus
ALDFPLPKAFRDAGWFLDVLPGH

SEQ ID NO: 1702526 - protein, 18 aa, Staphylococcus aureus
ARPIRYLLPVLPSVFHQH

SEQ ID NO: 1702527 - protein, 19 aa, Staphylococcus aureus
AVVYPFLDKEISFSVSIYG

SEQ ID NO: 1702528 - protein, 18 aa, Staphylococcus aureus
AYIRPLFCEGKGPFRFAA

SEQ ID NO: 1702529 - protein, 18 aa, Staphylococcus aureus
CYLSYWYGDNENIVNIFH

SEQ ID NO: 1702530 - protein, 17 aa, Staphylococcus aureus
DHLWLYETNKYYALAME

SEQ ID NO: 1702531 - protein, 20 aa, Staphylococcus aureus
DIFMDLWMKVYRMFDELRET

SEQ ID NO: 1702532 - protein, 22 aa, Staphylococcus aureus
DIKTYIFYHLFDTYIIDYSMAS

SEQ ID NO: 1702533 - protein, 19 aa, Staphylococcus aureus
DLRLLFLDKGMIYGLKFHE

SEQ ID NO: 1702534 - protein, 20 aa, Staphylococcus aureus
DLWMNLYYLFMNLRDLFKEE

SEQ ID NO: 1702535 - protein, 22 aa, Staphylococcus aureus
DQFRMIIKQLYFFSVANPDPTN

SEQ ID NO: 1702536 - protein, 25 aa, Staphylococcus aureus
DSKNLKVIYMPHWLEFYSIAIHSDV

SEQ ID NO: 1702537 - protein, 24 aa, Staphylococcus aureus
DTNDFPITWFYPLGEKKVERKSPK

SEQ ID NO: 1702538 - protein, 23 aa, Staphylococcus aureus
DVEYGFYILFIKPIFEIVFSSNY

SEQ ID NO: 1702539 - protein, 18 aa, Staphylococcus aureus
DYEFLYLLSMDKLFGNKR

SEQ ID NO: 1702540 - protein, 18 aa, Staphylococcus aureus
EAKFENGVITRKADEKTT

SEQ ID NO: 1702541 - protein, 23 aa, Staphylococcus aureus
EDKLLNLFLYYFIQTKRYSDVAS

SEQ ID NO: 1702542 - protein, 19 aa, Staphylococcus aureus
EEMQPLYEWLGLTASLGFV

SEQ ID NO: 1702543 - protein, 23 aa, Staphylococcus aureus
EEQFKTVYGVNVAGVLWGIQAAH

SEQ ID NO: 1702544 - protein, 23 aa, Staphylococcus aureus
EFPEQLTNYLLKYDYRDLEIIKA

SEQ ID NO: 1702545 - protein, 19 aa, Staphylococcus aureus
EILAWFDAIGKKRGLIRRG

SEQ ID NO: 1702546 - protein, 21 aa, Staphylococcus aureus
EILKLPIRTWFDKYESEIMAK

SEQ ID NO: 1702547 - protein, 22 aa, Staphylococcus aureus
EIYDQMMWIGFKPFKITNIKQE

SEQ ID NO: 1702548 - protein, 22 aa, Staphylococcus aureus
EKPKARWLFLTLSTKNAIDGDT

SEQ ID NO: 1702549 - protein, 21 aa, Staphylococcus aureus
EKRYFILNFFRRGTTLVGNEA

SEQ ID NO: 1702550 - protein, 21 aa, Staphylococcus aureus
ELNLFSFVRQLSDIPLGGIIY

SEQ ID NO: 1702551 - protein, 24 aa, Staphylococcus aureus
ENDNKFLWFLMNTDLIRNKIKGMM

SEQ ID NO: 1702552 - protein, 19 aa, Staphylococcus aureus
EQFKTVYGVNVAGVLWGIQ

SEQ ID NO: 1702553 - protein, 22 aa, Staphylococcus aureus
EQRQFLQPLIYIPEIQSLIWEN

SEQ ID NO: 1702554 - protein, 22 aa, Staphylococcus aureus
ESLGFIFQDYSILPTLTVKENI

SEQ ID NO: 1702555 - protein, 19 aa, Staphylococcus aureus
EVIPTYKYLLHLDTQRLNK

SEQ ID NO: 1702556 - protein, 17 aa, Staphylococcus aureus
EVQRIYFLKDFQGGGRG

SEQ ID NO: 1702557 - protein, 17 aa, Staphylococcus aureus
EVVNKQIEIIKNADADA

SEQ ID NO: 1702558 - protein, 21 aa, Staphylococcus aureus
FAGAALRFLTGPIGATITAIT

SEQ ID NO: 1702559 - protein, 17 aa, Staphylococcus aureus
FEIYTPLLKHQGLVITD

SEQ ID NO: 1702560 - protein, 19 aa, Staphylococcus aureus
FFINERIIPIIPQQGSLGA

SEQ ID NO: 1702561 - protein, 24 aa, Staphylococcus aureus
FIRNDLIDYLDCKVLFIGNLDELN

SEQ ID NO: 1702562 - protein, 20 aa, Staphylococcus aureus
FLNELFYLIELYLKAFKGQK

SEQ ID NO: 1702563 - protein, 18 aa, Staphylococcus aureus
FMDLWMKVYRMFDELRET

SEQ ID NO: 1702564 - protein, 18 aa, Staphylococcus aureus
FMILLASRLDAVVYSLGL

SEQ ID NO: 1702565 - protein, 17 aa, Staphylococcus aureus
FNFTPYNSKKIYARSIT

SEQ ID NO: 1702566 - protein, 17 aa, Staphylococcus aureus
FNTAYRYYKNDPHAKEM

SEQ ID NO: 1702567 - protein, 19 aa, Staphylococcus aureus
FTRLQIMSFFSSLWISSYS

SEQ ID NO: 1702568 - protein, 21 aa, Staphylococcus aureus
GELHLRFQLAFYLFTNRGVIC

SEQ ID NO: 1702569 - protein, 17 aa, Staphylococcus aureus
GISLLPETERFYPNGNF

SEQ ID NO: 1702570 - protein, 25 aa, Staphylococcus aureus
GKDVTIFFTFWGLNALKKAQTVNVK

SEQ ID NO: 1702571 - protein, 23 aa, Staphylococcus aureus
GLPVPGWFSLQKLQFGKIPLNGK

SEQ ID NO: 1702572 - protein, 22 aa, Staphylococcus aureus
GPGLRYILFTQGCLLRCLYCHN

SEQ ID NO: 1702573 - protein, 19 aa, Staphylococcus aureus
GPSILTMPYIFEKLFEYSK

SEQ ID NO: 1702574 - protein, 23 aa, Staphylococcus aureus
GQKADLLLWFLRPEMKSLNHIEN

SEQ ID NO: 1702575 - protein, 24 aa, Staphylococcus aureus
GQLPGTKVYPWIAKTRGSTPGIGL

SEQ ID NO: 1702576 - protein, 18 aa, Staphylococcus aureus
GVFDYRRSLLRTDVVLNS

SEQ ID NO: 1702577 - protein, 26 aa, Staphylococcus aureus
HDIERQIIFELYPYKVERKAKSPLLF

SEQ ID NO: 1702578 - protein, 22 aa, Staphylococcus aureus
HYYMDDMLFKKYPYFNRKNIHI

SEQ ID NO: 1702579 - protein, 17 aa, Staphylococcus aureus
IDQYFLMRYIKQGDILK

SEQ ID NO: 1702580 - protein, 18 aa, Staphylococcus aureus
IDQYFLMRYIKQGDILKL

SEQ ID NO: 1702581 - protein, 18 aa, Staphylococcus aureus
IDSYLLLRGLKTLHLRIE

SEQ ID NO: 1702582 - protein, 26 aa, Staphylococcus aureus
IEDKKALFIVYANPLALGLLTAPGSF

SEQ ID NO: 1702583 - protein, 19 aa, Staphylococcus aureus
IEYLLFRYRFKSRIAVWVL

SEQ ID NO: 1702584 - protein, 29 aa, Staphylococcus aureus
IIFETLIRIYWFYKQYFYYGKSLKESIPI

SEQ ID NO: 1702585 - protein, 19 aa, Staphylococcus aureus
IINDLFIPLKPLRQLEIIS

SEQ ID NO: 1702586 - protein, 18 aa, Staphylococcus aureus
IIRQKLKKLGIRKGIPVV

SEQ ID NO: 1702587 - protein, 19 aa, Staphylococcus aureus
IIVNERIQFVLTSRLESFI

SEQ ID NO: 1702588 - protein, 26 aa, Staphylococcus aureus
IKDCYIWLYIFFLKKDKNFFEDHIYI

SEQ ID NO: 1702589 - protein, 20 aa, Staphylococcus aureus
ILVMGPLLARLGHAIVALPG

SEQ ID NO: 1702590 - protein, 22 aa, Staphylococcus aureus
IQCDQLIILTAIDYVYINFNTE

SEQ ID NO: 1702591 - protein, 23 aa, Staphylococcus aureus
IVDKLVEIFWPGPLNIILKNKTS

SEQ ID NO: 1702592 - protein, 18 aa, Staphylococcus aureus
IVHKYIMKLAPYLQKHQY

SEQ ID NO: 1702593 - protein, 24 aa, Staphylococcus aureus
KETDILFILSLFRKINWKVYDEST

SEQ ID NO: 1702594 - protein, 17 aa, Staphylococcus aureus
KFFEIYTPLLKHQGLVI

SEQ ID NO: 1702595 - protein, 27 aa, Staphylococcus aureus
KFKSQNWYWFAYFDVPLKLPKNPRGSV

SEQ ID NO: 1702596 - protein, 18 aa, Staphylococcus aureus
KGILLYLLSRPDNWQIYE

SEQ ID NO: 1702597 - protein, 19 aa, Staphylococcus aureus
KGILLYLLSRPDNWQIYET

SEQ ID NO: 1702598 - protein, 20 aa, Staphylococcus aureus
KGPDLYVYLTKNGDIKNGKE

SEQ ID NO: 1702599 - protein, 18 aa, Staphylococcus aureus
KHIVVYNPAPLAIKDVSG

SEQ ID NO: 1702600 - protein, 23 aa, Staphylococcus aureus
KHPKVLILMGVPGSYLVATDKSY

SEQ ID NO: 1702601 - protein, 17 aa, Staphylococcus aureus
KIKIIRLILYTISNVHE

SEQ ID NO: 1702602 - protein, 17 aa, Staphylococcus aureus
KLFPLDYTHIFPGECIW

SEQ ID NO: 1702603 - protein, 21 aa, Staphylococcus aureus
KLYRIFYYDCPPIDKIVYHPL

SEQ ID NO: 1702604 - protein, 20 aa, Staphylococcus aureus
KLYVLAKILNVSEAWLLGYD

SEQ ID NO: 1702605 - protein, 17 aa, Staphylococcus aureus
KPIRRLWISSVTKKAIQ

SEQ ID NO: 1702606 - protein, 21 aa, Staphylococcus aureus
KPTVRWLFLTLTVKNVYDGEE

SEQ ID NO: 1702607 - protein, 23 aa, Staphylococcus aureus
KRKYTLDFYLRPFVKTKIKAWVR

SEQ ID NO: 1702608 - protein, 17 aa, Staphylococcus aureus
KRYNFISVLGWPTYYAN

SEQ ID NO: 1702609 - protein, 22 aa, Staphylococcus aureus
KSHAFLLPLMQLFDSEIKEPQA

SEQ ID NO: 1702610 - protein, 24 aa, Staphylococcus aureus
KSQNWYWFAYFDGPLKLPKNPRGS

SEQ ID NO: 1702611 - protein, 21 aa, Staphylococcus aureus
KTGFMYMYMYITLNGDSYEKI

SEQ ID NO: 1702612 - protein, 21 aa, Staphylococcus aureus
LAELAMPRPYVFVSPKDFKNG

SEQ ID NO: 1702613 - protein, 17 aa, Staphylococcus aureus
LDQAMERLINGIQDKDQ

SEQ ID NO: 1702614 - protein, 22 aa, Staphylococcus aureus
LDTKYMQIFINKLSDIYSQNQV

SEQ ID NO: 1702615 - protein, 20 aa, Staphylococcus aureus
LEFKYLFLKLIVKEDWSLSN

SEQ ID NO: 1702616 - protein, 17 aa, Staphylococcus aureus
LIGFLKDTPQRIGSMGK

SEQ ID NO: 1702617 - protein, 17 aa, Staphylococcus aureus
LIMPFLYANTYYSIDQL

SEQ ID NO: 1702618 - protein, 25 aa, Staphylococcus aureus
LKEIYQFPLLLFYKGNIKLINNMHH

SEQ ID NO: 1702619 - protein, 24 aa, Staphylococcus aureus
LKGIYQFALNYVFDIKIIPELLRI

SEQ ID NO: 1702620 - protein, 18 aa, Staphylococcus aureus
LLQCLIFVNDMYLLSNPK

SEQ ID NO: 1702621 - protein, 23 aa, Staphylococcus aureus
LNHNSRLFKLYKGYKGNITRIVS

SEQ ID NO: 1702622 - protein, 23 aa, Staphylococcus aureus
LQPSPFHWRLLDKITLSTLYEVV

SEQ ID NO: 1702623 - protein, 24 aa, Staphylococcus aureus
LQSNYIDEFILYYAPKLIGGSGNY

SEQ ID NO: 1702624 - protein, 18 aa, Staphylococcus aureus
LRNNFLYHTMSHSLSKIL

SEQ ID NO: 1702625 - protein, 25 aa, Staphylococcus aureus
LTAKKSYFILNDKIVFLGTGIKSTD

SEQ ID NO: 1702626 - protein, 26 aa, Staphylococcus aureus
LTEAYTNYAILFISGTYPGGVIEAFS

SEQ ID NO: 1702627 - protein, 18 aa, Staphylococcus aureus
LTEDIAYGLVLWSSLGRV

SEQ ID NO: 1702628 - protein, 18 aa, Staphylococcus aureus
LVYIFGRIEFIPDSYTRK

SEQ ID NO: 1702629 - protein, 17 aa, Staphylococcus aureus
MAIYQFYLGDTLTILDR

SEQ ID NO: 1702630 - protein, 17 aa, Staphylococcus aureus
MIPMRKLLDQLREKFKH

SEQ ID NO: 1702631 - protein, 17 aa, Staphylococcus aureus
MKLAPYLQKHQYNHSLF

SEQ ID NO: 1702632 - protein, 17 aa, Staphylococcus aureus
MLLQQRYNLKALLSSVN

SEQ ID NO: 1702633 - protein, 20 aa, Staphylococcus aureus
MPHYDGFITDLPFIGQHTLE

SEQ ID NO: 1702634 - protein, 21 aa, Staphylococcus aureus
MPSQLFQFFMSYLLARFDISL

SEQ ID NO: 1702635 - protein, 21 aa, Staphylococcus aureus
NAPALYPNYWGGNKYKVIEEL

SEQ ID NO: 1702636 - protein, 17 aa, Staphylococcus aureus
NDLLLIRYPLKDKVLNV

SEQ ID NO: 1702637 - protein, 17 aa, Staphylococcus aureus
NEGLPLPDLIIVDGGKG

SEQ ID NO: 1702638 - protein, 23 aa, Staphylococcus aureus
NEQRQFLQPLIYIPEIQSLIWEN

SEQ ID NO: 1702639 - protein, 22 aa, Staphylococcus aureus
NGLRLFVIPKPGFQKTFVTYTT

SEQ ID NO: 1702640 - protein, 19 aa, Staphylococcus aureus
NIEFPWLRLVVLRAFIDNI

SEQ ID NO: 1702641 - protein, 26 aa, Staphylococcus aureus
NIEIALKLLKILLKELERVLGRNTFA

SEQ ID NO: 1702642 - protein, 19 aa, Staphylococcus aureus
NILPFILRGIKLIGIDSVC

SEQ ID NO: 1702643 - protein, 24 aa, Staphylococcus aureus
NKQQSFANCKQLRQVYPNGVTADH

SEQ ID NO: 1702644 - protein, 19 aa, Staphylococcus aureus
NLFEFKYKLKPFFNPENVY

SEQ ID NO: 1702645 - protein, 22 aa, Staphylococcus aureus
NNFKLLLVNYLSKKIYCLENKR

SEQ ID NO: 1702646 - protein, 23 aa, Staphylococcus aureus
NNNFKRYVFFTNSFRKEMITKSS

SEQ ID NO: 1702647 - protein, 22 aa, Staphylococcus aureus
NSQKFFDLIKYFELPLQTKIKT

SEQ ID NO: 1702648 - protein, 23 aa, Staphylococcus aureus
NSQKFFDLIKYFELPRQTKIKTF

SEQ ID NO: 1702649 - protein, 22 aa, Staphylococcus aureus
NTAMGQLQHAIADKTTTLASSK

SEQ ID NO: 1702650 - protein, 21 aa, Staphylococcus aureus
NTAMGTLKHAIADKTNTLASS

SEQ ID NO: 1702651 - protein, 24 aa, Staphylococcus aureus
NVSEKLFYDLWTDLYRLFKNLREV

SEQ ID NO: 1702652 - protein, 19 aa, Staphylococcus aureus
PADISILLIYLEQSKLQRV

SEQ ID NO: 1702653 - protein, 21 aa, Staphylococcus aureus
PELENLLLDPYFKNIVTDYQE

SEQ ID NO: 1702654 - protein, 20 aa, Staphylococcus aureus
PSPFHWRLLDKITLSTLYEV

SEQ ID NO: 1702655 - protein, 25 aa, Staphylococcus aureus
QEFPEQLTNYLLKYDYRDLEIIKAV

SEQ ID NO: 1702656 - protein, 22 aa, Staphylococcus aureus
QFFMSYLLARFDISLATLLGVH

SEQ ID NO: 1702657 - protein, 24 aa, Staphylococcus aureus
QKFYYKLILWQYLKDKHGLTCAYS

SEQ ID NO: 1702658 - protein, 17 aa, Staphylococcus aureus
QMYALYFKFVMPIFGKL

SEQ ID NO: 1702659 - protein, 23 aa, Staphylococcus aureus
QNLWYFRYFIYYLIKENVISKKE

SEQ ID NO: 1702660 - protein, 20 aa, Staphylococcus aureus
QSSPFIWFKDALDGYDYLVE

SEQ ID NO: 1702661 - protein, 20 aa, Staphylococcus aureus
QYFPATHWKAINGIPYAGSS

SEQ ID NO: 1702662 - protein, 18 aa, Staphylococcus aureus
RASILVMGPLLARLGHAI

SEQ ID NO: 1702663 - protein, 22 aa, Staphylococcus aureus
RHGFISFTPVGGWWNQVMLSQK

SEQ ID NO: 1702664 - protein, 21 aa, Staphylococcus aureus
RKYSNIYLYLALKGFLEKLMN

SEQ ID NO: 1702665 - protein, 21 aa, Staphylococcus aureus
RLSIFIFIINILNQLRGIVIY

SEQ ID NO: 1702666 - protein, 17 aa, Staphylococcus aureus
RMEEEMFLGLRLNEGVS

SEQ ID NO: 1702667 - protein, 22 aa, Staphylococcus aureus
RNEYYYLTAIPYTLDEYKKYFQ

SEQ ID NO: 1702668 - protein, 17 aa, Staphylococcus aureus
RYEFYRFRLSELQIESR

SEQ ID NO: 1702669 - protein, 20 aa, Staphylococcus aureus
SAWVILAKPNLGISSPDIFK

SEQ ID NO: 1702670 - protein, 23 aa, Staphylococcus aureus
SCDISLVMRALDSILPFLKKGNT

SEQ ID NO: 1702671 - protein, 24 aa, Staphylococcus aureus
SCDISLVMRALDSILPFLKKGNTI

SEQ ID NO: 1702672 - protein, 23 aa, Staphylococcus aureus
SKHNLLQCLIFVNDMYLLSNPKS

SEQ ID NO: 1702673 - protein, 24 aa, Staphylococcus aureus
SKNLKVIYMPHWLEFYSIAIHSDV

SEQ ID NO: 1702674 - protein, 20 aa, Staphylococcus aureus
SLMAFLKQRHIPMAIATSSV

SEQ ID NO: 1702675 - protein, 22 aa, Staphylococcus aureus
SNGWILHIPSCYLGIAQAARNY

SEQ ID NO: 1702676 - protein, 23 aa, Staphylococcus aureus
SPLDTEILWKMHFGLYPTPIKRL

SEQ ID NO: 1702677 - protein, 19 aa, Staphylococcus aureus
STLIPMCHPLPLTGIDVHF

SEQ ID NO: 1702678 - protein, 20 aa, Staphylococcus aureus
TALRKAYLESFRKGFKQQIE

SEQ ID NO: 1702679 - protein, 20 aa, Staphylococcus aureus
TAMKLRQRVWRRLAKDLKPE

SEQ ID NO: 1702680 - protein, 19 aa, Staphylococcus aureus
TAMTALKRAIADKAETKAS

SEQ ID NO: 1702681 - protein, 18 aa, Staphylococcus aureus
TESTLLIGFLKDTPQRIG

SEQ ID NO: 1702682 - protein, 18 aa, Staphylococcus aureus
TIPPWNFPFAIMAGTTLA

SEQ ID NO: 1702683 - protein, 18 aa, Staphylococcus aureus
TIRWRGPFERFRIVHLIE

SEQ ID NO: 1702684 - protein, 17 aa, Staphylococcus aureus
TLLIGFLKDTPQRIGSM

SEQ ID NO: 1702685 - protein, 17 aa, Staphylococcus aureus
TLQLVIYYLMGKASQKP

SEQ ID NO: 1702686 - protein, 24 aa, Staphylococcus aureus
TNLNDEYVVSPGWTKDEQAKAFEE

SEQ ID NO: 1702687 - protein, 25 aa, Staphylococcus aureus
TNRQQSFANCKQLRQVYPNGVTADH

SEQ ID NO: 1702688 - protein, 22 aa, Staphylococcus aureus
TVGFLVLHIPFISSVDFGKFEK

SEQ ID NO: 1702689 - protein, 18 aa, Staphylococcus aureus
TVYGVNVAGVLWGIQAAH

SEQ ID NO: 1702690 - protein, 19 aa, Staphylococcus aureus
VATELLWFIKGDTNIQYLL

SEQ ID NO: 1702691 - protein, 24 aa, Staphylococcus aureus
VEDDPLYYAIFRTLAFTGFRRGEL

SEQ ID NO: 1702692 - protein, 23 aa, Staphylococcus aureus
VFDDLWMELYRSFKKLRNIFKEE

SEQ ID NO: 1702693 - protein, 18 aa, Staphylococcus aureus
VIPTYKYLLHLGTQRLNK

SEQ ID NO: 1702694 - protein, 23 aa, Staphylococcus aureus
VLIPLQMLVLFDKTIFKDEKQFT

SEQ ID NO: 1702695 - protein, 24 aa, Staphylococcus aureus
VLQPSPFHWRLLDKITLSTLYEVV

SEQ ID NO: 1702696 - protein, 21 aa, Staphylococcus aureus
VNAGLYLLKFLASLNLDNNAQ

SEQ ID NO: 1702697 - protein, 18 aa, Staphylococcus aureus
VNLYFPFVEVETMLTLLD

SEQ ID NO: 1702698 - protein, 18 aa, Staphylococcus aureus
VQSLLHYLAFYTSKDKEQ

SEQ ID NO: 1702699 - protein, 19 aa, Staphylococcus aureus
VSMEWLFRPLLKMLAEGDP

SEQ ID NO: 1702700 - protein, 18 aa, Staphylococcus aureus
VYTFLGFLPRKEKEKSAV

SEQ ID NO: 1702701 - protein, 17 aa, Staphylococcus aureus
WKIPIIFHLLQDKVLRL

SEQ ID NO: 1702702 - protein, 17 aa, Staphylococcus aureus
YEFLLRYKKIDALLTEN

SEQ ID NO: 1702703 - protein, 22 aa, Staphylococcus aureus
YGNMVYIYRWPNLFGKWCKPNY

SEQ ID NO: 1702704 - protein, 24 aa, Staphylococcus aureus
YIFRKLNIEWIYRALMDWKRIGRL

SEQ ID NO: 1702705 - protein, 19 aa, Staphylococcus aureus
YILKKYIFEVLFDLEEKFL

SEQ ID NO: 1702706 - protein, 17 aa, Staphylococcus aureus
YLIELYLKAFKGQKKTD

SEQ ID NO: 1702707 - protein, 20 aa, Staphylococcus aureus
YLIVCTDLRLLFLDKGMIYG

SEQ ID NO: 1702708 - protein, 19 aa, Staphylococcus aureus
YLKNILKYYYGTLIIVSHD

SEQ ID NO: 1702709 - protein, 20 aa, Staphylococcus aureus
YLKNILKYYYGTLIIVSHDR

SEQ ID NO: 1702710 - protein, 20 aa, Staphylococcus aureus
YLRLYAEFENYKRRIQKENE

SEQ ID NO: 1702711 - protein, 24 aa, Staphylococcus aureus
YPYFKEGLVLFTYLHLANEEKLTQ

SEQ ID NO: 1702712 - protein, 21 aa, Staphylococcus aureus
YQFNIFLYVLHYSKMKYITLT

SEQ ID NO: 1702713 - protein, 22 aa, Staphylococcus aureus
YQFNIFLYVLHYSKMKYITLTW

SEQ ID NO: 1702714 - protein, 22 aa, Staphylococcus aureus
AAKLLRPKILVKSLLKEEIEKL

SEQ ID NO: 1702715 - protein, 17 aa, Staphylococcus aureus
ADFINVVVFKKQAENVK

SEQ ID NO: 1702716 - protein, 19 aa, Staphylococcus aureus
ADISILLIYLEQGKLQRVS

SEQ ID NO: 1702717 - protein, 18 aa, Staphylococcus aureus
ADWHIALPEIVQLQYDFE

SEQ ID NO: 1702718 - protein, 24 aa, Staphylococcus aureus
AEDLILFRTIPSYYRSLPGKLARE

SEQ ID NO: 1702719 - protein, 18 aa, Staphylococcus aureus
AFKQMYALYFKFVMPIFG

SEQ ID NO: 1702720 - protein, 18 aa, Staphylococcus aureus
AFLIYLFAKDLSNHDELM

SEQ ID NO: 1702721 - protein, 20 aa, Staphylococcus aureus
AFPLLYTYFVKNGDWTLQQL

SEQ ID NO: 1702722 - protein, 18 aa, Staphylococcus aureus
AFWPGPISFILPLKPGYL

SEQ ID NO: 1702723 - protein, 24 aa, Staphylococcus aureus
AGQSVTYYFTDVKAPTVTVGNQTI

SEQ ID NO: 1702724 - protein, 17 aa, Staphylococcus aureus
AIKLRQRVWRRLAKDLK

SEQ ID NO: 1702725 - protein, 22 aa, Staphylococcus aureus
AKVAIQELLWFVFEHFDIKGEH

SEQ ID NO: 1702726 - protein, 21 aa, Staphylococcus aureus
ALANLDTLRDLNQPQRDALRN

SEQ ID NO: 1702727 - protein, 18 aa, Staphylococcus aureus
ALGLLTPPGSFGADIVVG

SEQ ID NO: 1702728 - protein, 21 aa, Staphylococcus aureus
ALNAVTRAKAALNGAENLRNA

SEQ ID NO: 1702729 - protein, 22 aa, Staphylococcus aureus
ALSIRMYYALFLNKPIITTDDT

SEQ ID NO: 1702730 - protein, 19 aa, Staphylococcus aureus
AMEKARLFALKHELKNEIQ

SEQ ID NO: 1702731 - protein, 18 aa, Staphylococcus aureus
AMGNLKHALAEKDNTKRS

SEQ ID NO: 1702732 - protein, 19 aa, Staphylococcus aureus
AMIKYLLPKATVVAPNLFE

SEQ ID NO: 1702733 - protein, 24 aa, Staphylococcus aureus
ANEKTRVRLYKSGKNWVKSGIKEI

SEQ ID NO: 1702734 - protein, 25 aa, Staphylococcus aureus
ANTEQYYFHLFSKKQPDLNWDNPEV

SEQ ID NO: 1702735 - protein, 18 aa, Staphylococcus aureus
AQVLYPKILIDKIIYLLG

SEQ ID NO: 1702736 - protein, 23 aa, Staphylococcus aureus
ARRDIEMLLGSKIYLELWVKVQR

SEQ ID NO: 1702737 - protein, 27 aa, Staphylococcus aureus
ASEFRNYILGLIFYRFLSEKAEQEYSD

SEQ ID NO: 1702738 - protein, 17 aa, Staphylococcus aureus
ATLSPIDSYLLLRGLKT

SEQ ID NO: 1702739 - protein, 21 aa, Staphylococcus aureus
AVQIVPLIIKYASELKLYGKT

SEQ ID NO: 1702740 - protein, 23 aa, Staphylococcus aureus
AVYKAQLYLTPYGPKQYVEHLNQ

SEQ ID NO: 1702741 - protein, 20 aa, Staphylococcus aureus
CDISLVMRALDSILSFLEKG

SEQ ID NO: 1702742 - protein, 21 aa, Staphylococcus aureus
CDMLFIVFSIHLIDILKKLSH

SEQ ID NO: 1702743 - protein, 17 aa, Staphylococcus aureus
CLSLFLAKAFKKGFITF

SEQ ID NO: 1702744 - protein, 17 aa, Staphylococcus aureus
CQLTIMCKLGWAPTKRI

SEQ ID NO: 1702745 - protein, 17 aa, Staphylococcus aureus
CYFIPYGNKMQLQRSYH

SEQ ID NO: 1702746 - protein, 19 aa, Staphylococcus aureus
DAFNFDCTFLAKAIARDGE

SEQ ID NO: 1702747 - protein, 17 aa, Staphylococcus aureus
DARNYLSYLYSNHLKRT

SEQ ID NO: 1702748 - protein, 27 aa, Staphylococcus aureus
DDIITEQDILAHINLIDQLSAEVIDTP

SEQ ID NO: 1702749 - protein, 24 aa, Staphylococcus aureus
DDLWMNLYYLFKNLRNLFKEEGLE

SEQ ID NO: 1702750 - protein, 17 aa, Staphylococcus aureus
DDLWMNLYYLFMNLRDL

SEQ ID NO: 1702751 - protein, 18 aa, Staphylococcus aureus
DDNREIEPPKKGFWSRFF

SEQ ID NO: 1702752 - protein, 17 aa, Staphylococcus aureus
DEFSLNVFNLYGALSMA

SEQ ID NO: 1702753 - protein, 22 aa, Staphylococcus aureus
DEQWEAMLLGWKVVPSVKSNAI

SEQ ID NO: 1702754 - protein, 17 aa, Staphylococcus aureus
DFPMWFIRPNFKSETAP

SEQ ID NO: 1702755 - protein, 23 aa, Staphylococcus aureus
DGNNNIKVILPKVQVKPAARQSV

SEQ ID NO: 1702756 - protein, 19 aa, Staphylococcus aureus
DHDTIWLSVLPIYHISGLS

SEQ ID NO: 1702757 - protein, 23 aa, Staphylococcus aureus
DHQITFIPYFPLVSGILAGKYDE

SEQ ID NO: 1702758 - protein, 25 aa, Staphylococcus aureus
DIIKRHRLLELFLIEILKYNWEEVH

SEQ ID NO: 1702759 - protein, 21 aa, Staphylococcus aureus
DIKSPMVGTFFLQDSKELNEP

SEQ ID NO: 1702760 - protein, 21 aa, Staphylococcus aureus
DIKSPMVGTFFLQDSKELTES

SEQ ID NO: 1702761 - protein, 23 aa, Staphylococcus aureus
DKHGFISFTPVGGWWNQVMLSQK

SEQ ID NO: 1702762 - protein, 22 aa, Staphylococcus aureus
DKQKIIITLYDKFFKTAFNSTT

SEQ ID NO: 1702763 - protein, 23 aa, Staphylococcus aureus
DLAWLVDIMLPRMKAHGVINDDF

SEQ ID NO: 1702764 - protein, 22 aa, Staphylococcus aureus
DLAWLVDVMLPRMKAHGVINDD

SEQ ID NO: 1702765 - protein, 20 aa, Staphylococcus aureus
DLFFELLRFINEKSPQAIFI

SEQ ID NO: 1702766 - protein, 18 aa, Staphylococcus aureus
DLLIPLTFHFSKDEQLVI

SEQ ID NO: 1702767 - protein, 26 aa, Staphylococcus aureus
DLTEDQMIDFLFTSALFGRVVANNAS

SEQ ID NO: 1702768 - protein, 19 aa, Staphylococcus aureus
DLWMELYRSFKKLRNIFKE

SEQ ID NO: 1702769 - protein, 20 aa, Staphylococcus aureus
DLWMELYRSFKKLRNIFKEE

SEQ ID NO: 1702770 - protein, 22 aa, Staphylococcus aureus
DLWMNLYYLFKNLRNLFKEEGL

SEQ ID NO: 1702771 - protein, 22 aa, Staphylococcus aureus
DLWMNLYYLFKNLRNLFKTEEH

SEQ ID NO: 1702772 - protein, 23 aa, Staphylococcus aureus
DNAMGAVQQYIDEQHLGVISSTN

SEQ ID NO: 1702773 - protein, 20 aa, Staphylococcus aureus
DNPMYFIRLNFPNSLSVGDK

SEQ ID NO: 1702774 - protein, 18 aa, Staphylococcus aureus
DNTSFDGFIYSAGLGYFK

SEQ ID NO: 1702775 - protein, 26 aa, Staphylococcus aureus
DNYDGHLLIQWYLKGIYKFKYAILEA

SEQ ID NO: 1702776 - protein, 17 aa, Staphylococcus aureus
DPQFVYSWKLVPTDRIP

SEQ ID NO: 1702777 - protein, 19 aa, Staphylococcus aureus
DQLNRGLNLGLDDIRNTHV

SEQ ID NO: 1702778 - protein, 23 aa, Staphylococcus aureus
DQLQLYYQILHGNPLFINKYWVQ

SEQ ID NO: 1702779 - protein, 22 aa, Staphylococcus aureus
DRLRQFFDFITNFGIMIKGTGE

SEQ ID NO: 1702780 - protein, 18 aa, Staphylococcus aureus
DRRKAMLEDLAILSGAQV

SEQ ID NO: 1702781 - protein, 24 aa, Staphylococcus aureus
DSGKKIYNILYLVPSIQLLTQTLF

SEQ ID NO: 1702782 - protein, 22 aa, Staphylococcus aureus
DSLHIGHLLPFLTLRRFQEHGH

SEQ ID NO: 1702783 - protein, 23 aa, Staphylococcus aureus
DSTVLCEPLILIEVESLILSDVD

SEQ ID NO: 1702784 - protein, 19 aa, Staphylococcus aureus
DSYNLWWYGGIEGKAISVN

SEQ ID NO: 1702785 - protein, 20 aa, Staphylococcus aureus
DTEILWKMHFGLYPTPIKRL

SEQ ID NO: 1702786 - protein, 17 aa, Staphylococcus aureus
DTELNLFSFVRQLSDIP

SEQ ID NO: 1702787 - protein, 26 aa, Staphylococcus aureus
DTKVMTVKYAGQTWTRNISDWIAKSG

SEQ ID NO: 1702788 - protein, 25 aa, Staphylococcus aureus
DTNDFPITWFYPLGEKKVERKAPKL

SEQ ID NO: 1702789 - protein, 17 aa, Staphylococcus aureus
DVFISTILIPGAKPPKL

SEQ ID NO: 1702790 - protein, 18 aa, Staphylococcus aureus
DVLFKYIENILNKDKDQL

SEQ ID NO: 1702791 - protein, 25 aa, Staphylococcus aureus
DYGCHLLDLSLWLLGKNMVPHEVLG

SEQ ID NO: 1702792 - protein, 24 aa, Staphylococcus aureus
EAFTNALEYILSKATEDISDQTTN

SEQ ID NO: 1702793 - protein, 17 aa, Staphylococcus aureus
EAGLFHIAFLLPTTEDL

SEQ ID NO: 1702794 - protein, 17 aa, Staphylococcus aureus
EAKFENGVITRKADEKT

SEQ ID NO: 1702795 - protein, 23 aa, Staphylococcus aureus
EARIFKFYKYFYSHRGPLFDYFD

SEQ ID NO: 1702796 - protein, 23 aa, Staphylococcus aureus
EAYNNYFEPVLNYILEVIHSVET

SEQ ID NO: 1702797 - protein, 24 aa, Staphylococcus aureus
ECYLDRTLLPILKLYSNTGISLEA

SEQ ID NO: 1702798 - protein, 24 aa, Staphylococcus aureus
EDAYIEKFLMSLYLYETASQTSMQ

SEQ ID NO: 1702799 - protein, 23 aa, Staphylococcus aureus
EDKVEWIILAGYMRLIGPDLLDS

SEQ ID NO: 1702800 - protein, 17 aa, Staphylococcus aureus
EEDLKVIYKWMDLGRKT

SEQ ID NO: 1702801 - protein, 18 aa, Staphylococcus aureus
EEHVIILPIWHKVSVEDV

SEQ ID NO: 1702802 - protein, 17 aa, Staphylococcus aureus
EFDLLWQKSTPLTEQWI

SEQ ID NO: 1702803 - protein, 21 aa, Staphylococcus aureus
EFRNYILGLIFYCFLSEKAEQ

SEQ ID NO: 1702804 - protein, 25 aa, Staphylococcus aureus
EFRTMPVVWYCPPLSPIMSYFEGKN

SEQ ID NO: 1702805 - protein, 26 aa, Staphylococcus aureus
EGDTFTFKYGQYFRPGSVRLPSQTQN

SEQ ID NO: 1702806 - protein, 18 aa, Staphylococcus aureus
EGIYFKGLRYFSTTLIAY

SEQ ID NO: 1702807 - protein, 17 aa, Staphylococcus aureus
EGNIYFIYTVADLEVIL

SEQ ID NO: 1702808 - protein, 24 aa, Staphylococcus aureus
EIKTKYKLLPIFKINFHKNNLPHL

SEQ ID NO: 1702809 - protein, 23 aa, Staphylococcus aureus
EKDFNYIYVINLKGSLSGLSSEA

SEQ ID NO: 1702810 - protein, 25 aa, Staphylococcus aureus
EKLMKAFWPGPISFILPLKPGYLCR

SEQ ID NO: 1702811 - protein, 25 aa, Staphylococcus aureus
ELAVKPFYQLVYDIKTHRGYFRISR

SEQ ID NO: 1702812 - protein, 28 aa, Staphylococcus aureus
ELDDALNYYLFYLKNWNYAYAYSLKLID

SEQ ID NO: 1702813 - protein, 17 aa, Staphylococcus aureus
ELGIPEHLVWRQPFPGP

SEQ ID NO: 1702814 - protein, 18 aa, Staphylococcus aureus
ELHLRFQLAFYLFTNRGV

SEQ ID NO: 1702815 - protein, 17 aa, Staphylococcus aureus
ELIIAFMFHHQIPMSVE

SEQ ID NO: 1702816 - protein, 18 aa, Staphylococcus aureus
ELIQEFYYYALTKTVEGE

SEQ ID NO: 1702817 - protein, 25 aa, Staphylococcus aureus
EMDLPLKELALITGAALLARRRSKK

SEQ ID NO: 1702818 - protein, 17 aa, Staphylococcus aureus
EMRALLLHLRPLGLKDK

SEQ ID NO: 1702819 - protein, 25 aa, Staphylococcus aureus
ENDNKFLWFLMNTDLIRNKIKGMMQ

SEQ ID NO: 1702820 - protein, 23 aa, Staphylococcus aureus
ENGKYRFDNLDSGKYKVIFEKPA

SEQ ID NO: 1702821 - protein, 23 aa, Staphylococcus aureus
ENGLRLFIIPKPGFQKTFVTYTT

SEQ ID NO: 1702822 - protein, 27 aa, Staphylococcus aureus
ENIEIALKLLKILLKELERVLGRNTFA

SEQ ID NO: 1702823 - protein, 19 aa, Staphylococcus aureus
ENIKALYFYQKNKYRITDV

SEQ ID NO: 1702824 - protein, 22 aa, Staphylococcus aureus
EPEWMLGFRLKSLKLFYKMPMP

SEQ ID NO: 1702825 - protein, 17 aa, Staphylococcus aureus
EPKTQFYNMYRKGLLKL

SEQ ID NO: 1702826 - protein, 23 aa, Staphylococcus aureus
EPKTQFYNMYRKGLLKLPNKDLG

SEQ ID NO: 1702827 - protein, 26 aa, Staphylococcus aureus
EPQGSFYIWFKLSVPVNIKLLFNEAI

SEQ ID NO: 1702828 - protein, 23 aa, Staphylococcus aureus
EPSPIWMQVRLIKAGIRPINNVV

SEQ ID NO: 1702829 - protein, 18 aa, Staphylococcus aureus
EPYVRLFRDLFPNAAIIF

SEQ ID NO: 1702830 - protein, 17 aa, Staphylococcus aureus
ERFWPADLVLLSIGFEG

SEQ ID NO: 1702831 - protein, 19 aa, Staphylococcus aureus
ESESLSESLSESESLSDSE

SEQ ID NO: 1702832 - protein, 23 aa, Staphylococcus aureus
ESKFTIMMLLSYEKDMILSPSDL

SEQ ID NO: 1702833 - protein, 24 aa, Staphylococcus aureus
ETRRYYLMLMLFSKENPMSLNHFS

SEQ ID NO: 1702834 - protein, 19 aa, Staphylococcus aureus
EVIPTYKYLLHLGTQRLNK

SEQ ID NO: 1702835 - protein, 17 aa, Staphylococcus aureus
EVYLISHALLETGNGTS

SEQ ID NO: 1702836 - protein, 23 aa, Staphylococcus aureus
EYEKFGRWFFNKFKVNRSADAKK

SEQ ID NO: 1702837 - protein, 24 aa, Staphylococcus aureus
EYEKFGRWFFNKFNVNRSADAKKI

SEQ ID NO: 1702838 - protein, 18 aa, Staphylococcus aureus
EYKYNIIWVWHYSDDYLG

SEQ ID NO: 1702839 - protein, 18 aa, Staphylococcus aureus
EYPQFLYENVMSKISSRD

SEQ ID NO: 1702840 - protein, 24 aa, Staphylococcus aureus
FANFFKMLWLRLKAMKHYKALNKE

SEQ ID NO: 1702841 - protein, 18 aa, Staphylococcus aureus
FDDLWMNLYYLFMNLRDL

SEQ ID NO: 1702842 - protein, 20 aa, Staphylococcus aureus
FDDLWMNLYYLFMNLRDLFK

SEQ ID NO: 1702843 - protein, 23 aa, Staphylococcus aureus
FERDYLFFKLAIHSGLKVSELLT

SEQ ID NO: 1702844 - protein, 18 aa, Staphylococcus aureus
FFEYARSFDFIIVSDIGL

SEQ ID NO: 1702845 - protein, 24 aa, Staphylococcus aureus
FFPSKLAFVLFFIKQLEITEHHFV

SEQ ID NO: 1702846 - protein, 24 aa, Staphylococcus aureus
FFRPEFLNRFNGIVEFLHLDKESL

SEQ ID NO: 1702847 - protein, 17 aa, Staphylococcus aureus
FGDRRKAMLEDLAILSG

SEQ ID NO: 1702848 - protein, 17 aa, Staphylococcus aureus
FGIKENVDFIAASFVRR

SEQ ID NO: 1702849 - protein, 17 aa, Staphylococcus aureus
FHALRKMGIPTIFFINK

SEQ ID NO: 1702850 - protein, 17 aa, Staphylococcus aureus
FILFFNHERITLKMADS

SEQ ID NO: 1702851 - protein, 17 aa, Staphylococcus aureus
FKGRDLVYFMPREFIEG

SEQ ID NO: 1702852 - protein, 17 aa, Staphylococcus aureus
FKKPMIFYAFDLEYYIT

SEQ ID NO: 1702853 - protein, 17 aa, Staphylococcus aureus
FKQMYALYFKFVMPIFG

SEQ ID NO: 1702854 - protein, 19 aa, Staphylococcus aureus
FKRWVIGSILFRTYYHNMV

SEQ ID NO: 1702855 - protein, 19 aa, Staphylococcus aureus
FKYAYDMKLIRIMPSEGIK

SEQ ID NO: 1702856 - protein, 21 aa, Staphylococcus aureus
FLAKLLWIYTSFFKGQMIYWD

SEQ ID NO: 1702857 - protein, 25 aa, Staphylococcus aureus
FLKRSIFICLFIISLFKTQGERTSF

SEQ ID NO: 1702858 - protein, 24 aa, Staphylococcus aureus
FLRRCPNLKWIAWFATGVNILPLD

SEQ ID NO: 1702859 - protein, 17 aa, Staphylococcus aureus
FLSIGIKTVLITLGKQG

SEQ ID NO: 1702860 - protein, 17 aa, Staphylococcus aureus
FMDLWMKVYRMFDELRE

SEQ ID NO: 1702861 - protein, 17 aa, Staphylococcus aureus
FPEQLTNYLLKYDYRDL

SEQ ID NO: 1702862 - protein, 18 aa, Staphylococcus aureus
FPVNVGILQFWISSEDQM

SEQ ID NO: 1702863 - protein, 17 aa, Staphylococcus aureus
FQIKHLMVSKVKGSFDQ

SEQ ID NO: 1702864 - protein, 20 aa, Staphylococcus aureus
FRNYILGLIFYCFLSEKAEQ

SEQ ID NO: 1702865 - protein, 18 aa, Staphylococcus aureus
FRSRFRMLVEAQLDLLKN

SEQ ID NO: 1702866 - protein, 17 aa, Staphylococcus aureus
FSHQLQRFIHLVWDVRD

SEQ ID NO: 1702867 - protein, 24 aa, Staphylococcus aureus
FSLTDLYLFIFNNSIKTLTIVTNK

SEQ ID NO: 1702868 - protein, 20 aa, Staphylococcus aureus
FSNPNLLFPLLDEEFHLPLV

SEQ ID NO: 1702869 - protein, 18 aa, Staphylococcus aureus
FTCLRPVRWFKGVPSPVK

SEQ ID NO: 1702870 - protein, 18 aa, Staphylococcus aureus
FVNLYFLHFLSTARTFYQ

SEQ ID NO: 1702871 - protein, 17 aa, Staphylococcus aureus
FWPGPISFILPLKPGYL

SEQ ID NO: 1702872 - protein, 18 aa, Staphylococcus aureus
FYNTGISTYIWIITKDKS

SEQ ID NO: 1702873 - protein, 29 aa, Staphylococcus aureus
GAHIQVLLLTFFFKYMKPLVQADRVFIAL

SEQ ID NO: 1702874 - protein, 28 aa, Staphylococcus aureus
GAHIQVLLLTFFFKYMKPLVQAGRVFIA

SEQ ID NO: 1702875 - protein, 17 aa, Staphylococcus aureus
GAVQQYIDEQHLGVISS

SEQ ID NO: 1702876 - protein, 24 aa, Staphylococcus aureus
GDKFLYYFLEWFATQNKWIRFSQG

SEQ ID NO: 1702877 - protein, 23 aa, Staphylococcus aureus
GDKPVATMWESKGKITYLKGEAM

SEQ ID NO: 1702878 - protein, 22 aa, Staphylococcus aureus
GDTFKFKYGQYFRPGSVRLPSQ

SEQ ID NO: 1702879 - protein, 17 aa, Staphylococcus aureus
GDWYKLEKLWEKAIKSG

SEQ ID NO: 1702880 - protein, 22 aa, Staphylococcus aureus
GESKFDILLFSSIGVIDGDYLA

SEQ ID NO: 1702881 - protein, 18 aa, Staphylococcus aureus
GFILEPLIQGATGLFVHP

SEQ ID NO: 1702882 - protein, 17 aa, Staphylococcus aureus
GFLLGPQYLIDKLTFMH

SEQ ID NO: 1702883 - protein, 18 aa, Staphylococcus aureus
GFMSFFTKASVAALKKYP

SEQ ID NO: 1702884 - protein, 19 aa, Staphylococcus aureus
GFMYMYMYITLNGDSYEKI

SEQ ID NO: 1702885 - protein, 18 aa, Staphylococcus aureus
GGEQIYNLFFPYVEKMYI

SEQ ID NO: 1702886 - protein, 25 aa, Staphylococcus aureus
GGIPDTGFYRFWIQGIFARWTDNPN

SEQ ID NO: 1702887 - protein, 18 aa, Staphylococcus aureus
GIAKMFDLMLPKKNIRMP

SEQ ID NO: 1702888 - protein, 18 aa, Staphylococcus aureus
GIGILYKNQQWYFVVVNI

SEQ ID NO: 1702889 - protein, 17 aa, Staphylococcus aureus
GIKGVYVILKDSNGKEL

SEQ ID NO: 1702890 - protein, 24 aa, Staphylococcus aureus
GIPDTGFYHFWIQGIFARWTDNPN

SEQ ID NO: 1702891 - protein, 17 aa, Staphylococcus aureus
GIPDTGFYRFWAQGIFA

SEQ ID NO: 1702892 - protein, 22 aa, Staphylococcus aureus
GITLMLLIGKFLQKFGSRRQIQ

SEQ ID NO: 1702893 - protein, 17 aa, Staphylococcus aureus
GKTYFLFYVIRELFRRH

SEQ ID NO: 1702894 - protein, 18 aa, Staphylococcus aureus
GLADDIHYSVKPKLANIT

SEQ ID NO: 1702895 - protein, 18 aa, Staphylococcus aureus
GLIPLLKIQGLGSKKIAK

SEQ ID NO: 1702896 - protein, 20 aa, Staphylococcus aureus
GLPTDGFTYKWNNAATGTND

SEQ ID NO: 1702897 - protein, 22 aa, Staphylococcus aureus
GLRVYWYYDLIDNEIKIVCIDP

SEQ ID NO: 1702898 - protein, 26 aa, Staphylococcus aureus
GMDLPLKEFALITGAALLARRRTKNE

SEQ ID NO: 1702899 - protein, 18 aa, Staphylococcus aureus
GNNIVKFFDYTFASVGVK

SEQ ID NO: 1702900 - protein, 18 aa, Staphylococcus aureus
GNTEAMIKYLLPKATVVA

SEQ ID NO: 1702901 - protein, 24 aa, Staphylococcus aureus
GNTVCYMWLRFNIDLQFDDTTINQ

SEQ ID NO: 1702902 - protein, 20 aa, Staphylococcus aureus
GPSILTMPYIFEKLFEYSKK

SEQ ID NO: 1702903 - protein, 23 aa, Staphylococcus aureus
GQHQMWAALFYPFKNHGQWVTSG

SEQ ID NO: 1702904 - protein, 18 aa, Staphylococcus aureus
GQSVTYYFTDVKAPTVTV

SEQ ID NO: 1702905 - protein, 19 aa, Staphylococcus aureus
GQWLILRDIAKHQPTTLIE

SEQ ID NO: 1702906 - protein, 17 aa, Staphylococcus aureus
GTEIVYRFLKYLFTHTY

SEQ ID NO: 1702907 - protein, 18 aa, Staphylococcus aureus
GTKLGFMSFFTKASVAAL

SEQ ID NO: 1702908 - protein, 19 aa, Staphylococcus aureus
GVAQLLFKKVPKLPYTLCY

SEQ ID NO: 1702909 - protein, 20 aa, Staphylococcus aureus
GVDFPKLFKAFKDMGMTYNI

SEQ ID NO: 1702910 - protein, 18 aa, Staphylococcus aureus
GVFIYIGMKPLTALFKDL

SEQ ID NO: 1702911 - protein, 18 aa, Staphylococcus aureus
GYEIPFTRLFYKYTPPEP

SEQ ID NO: 1702912 - protein, 18 aa, Staphylococcus aureus
GYVVYFFELACAMSGYQL

SEQ ID NO: 1702913 - protein, 17 aa, Staphylococcus aureus
HASLRQSLLPHLIEAAS

SEQ ID NO: 1702914 - protein, 24 aa, Staphylococcus aureus
HAVLHLLYARFWHKVLYDLGIVPT

SEQ ID NO: 1702915 - protein, 19 aa, Staphylococcus aureus
HDKFVFGAIQKKLLSEYDF

SEQ ID NO: 1702916 - protein, 17 aa, Staphylococcus aureus
HEAPAHVLNYFDPKDKS

SEQ ID NO: 1702917 - protein, 22 aa, Staphylococcus aureus
HIQQYNYLLKRYLLNIERENDI

SEQ ID NO: 1702918 - protein, 22 aa, Staphylococcus aureus
HIQRLLMNVLLNIKLTDVTRNI

SEQ ID NO: 1702919 - protein, 19 aa, Staphylococcus aureus
HIVNLYFPFVEVEMMLTLL

SEQ ID NO: 1702920 - protein, 18 aa, Staphylococcus aureus
HKSLIYRYDATLGTQITT

SEQ ID NO: 1702921 - protein, 20 aa, Staphylococcus aureus
HLLTFYDFPLAIRKSIYSTN

SEQ ID NO: 1702922 - protein, 21 aa, Staphylococcus aureus
HNLFFMNYYLNFKELRAFVIG

SEQ ID NO: 1702923 - protein, 17 aa, Staphylococcus aureus
HPNKLIPLTFFVKKFKQ

SEQ ID NO: 1702924 - protein, 24 aa, Staphylococcus aureus
HQDQKLYFYFSSPGKDQIIYKESL

SEQ ID NO: 1702925 - protein, 24 aa, Staphylococcus aureus
HQDQKLYFYFSSPGKNQIIYKESL

SEQ ID NO: 1702926 - protein, 24 aa, Staphylococcus aureus
HTGCYYIQRFLARAFGFEVDDIKA

SEQ ID NO: 1702927 - protein, 22 aa, Staphylococcus aureus
HTQFIIDEILAIKLPAEVIKAS

SEQ ID NO: 1702928 - protein, 30 aa, Staphylococcus aureus
HTVNGQENLYRIAIQYYGSGSPENVEKIRR

SEQ ID NO: 1702929 - protein, 17 aa, Staphylococcus aureus
HWFNWLTANNIPIKRRS

SEQ ID NO: 1702930 - protein, 19 aa, Staphylococcus aureus
HYFIKLLNLLKYEQVTYLI

SEQ ID NO: 1702931 - protein, 19 aa, Staphylococcus aureus
HYYMYKKFGIWPEKEYAIN

SEQ ID NO: 1702932 - protein, 23 aa, Staphylococcus aureus
IAKELLAFYAKYATTAGLTMLEV

SEQ ID NO: 1702933 - protein, 17 aa, Staphylococcus aureus
IANLDTLRDLNQPQRDA

SEQ ID NO: 1702934 - protein, 21 aa, Staphylococcus aureus
IDEDVFKLITNPQAFNLLDWK

SEQ ID NO: 1702935 - protein, 23 aa, Staphylococcus aureus
IDQDQFIKFYRGDKFKIASPITP

SEQ ID NO: 1702936 - protein, 24 aa, Staphylococcus aureus
IDRALVWGFTWKLGPFQLWDAMGY

SEQ ID NO: 1702937 - protein, 17 aa, Staphylococcus aureus
IDVLLLVELLNDVDVLP

SEQ ID NO: 1702938 - protein, 24 aa, Staphylococcus aureus
IDVQLIICTLPLELRGFQIVSLDD

SEQ ID NO: 1702939 - protein, 34 aa, Staphylococcus aureus
IEDKKALFIVYANPLALGLLTPPGLFGADIVVGD

SEQ ID NO: 1702940 - protein, 18 aa, Staphylococcus aureus
IELIIAFMFHHQIPMSVE

SEQ ID NO: 1702941 - protein, 24 aa, Staphylococcus aureus
IEPSPIWMQARLIKAGIRPINNVV

SEQ ID NO: 1702942 - protein, 17 aa, Staphylococcus aureus
IERRLLRHFSKKGYITW

SEQ ID NO: 1702943 - protein, 17 aa, Staphylococcus aureus
IESLFIQFAYFSWISCI

SEQ ID NO: 1702944 - protein, 24 aa, Staphylococcus aureus
IFDDLWINLYYLFMNLRDLFKEEG

SEQ ID NO: 1702945 - protein, 18 aa, Staphylococcus aureus
IFDDLWMELYRSFKKLRN

SEQ ID NO: 1702946 - protein, 20 aa, Staphylococcus aureus
IFDDLWMNLYYLFMNLRDLF

SEQ ID NO: 1702947 - protein, 17 aa, Staphylococcus aureus
IFIINILNQLRGSVIYQ

SEQ ID NO: 1702948 - protein, 17 aa, Staphylococcus aureus
IGATFHIVSLPDSGTRI

SEQ ID NO: 1702949 - protein, 23 aa, Staphylococcus aureus
IGGLSNAFGFKLDTYHNTSKPNS

SEQ ID NO: 1702950 - protein, 24 aa, Staphylococcus aureus
IGQRRLFEWLRQNGFLIKHKGVDY

SEQ ID NO: 1702951 - protein, 17 aa, Staphylococcus aureus
IIGGGMVYTFLKAQGKE

SEQ ID NO: 1702952 - protein, 18 aa, Staphylococcus aureus
IIKILSKVKPDPPRIDGN

SEQ ID NO: 1702953 - protein, 18 aa, Staphylococcus aureus
IISDFLTRYLIYKEKQDS

SEQ ID NO: 1702954 - protein, 17 aa, Staphylococcus aureus
IITIWVKLLTLSGKYNE

SEQ ID NO: 1702955 - protein, 17 aa, Staphylococcus aureus
IIWVWHYSDDYLGKIAS

SEQ ID NO: 1702956 - protein, 17 aa, Staphylococcus aureus
IIYILQKYDLHNKDTIY

SEQ ID NO: 1702957 - protein, 19 aa, Staphylococcus aureus
IKHIVVYNPAPLAIKDVSG

SEQ ID NO: 1702958 - protein, 17 aa, Staphylococcus aureus
IKVILPKVQVKPAARQS

SEQ ID NO: 1702959 - protein, 20 aa, Staphylococcus aureus
ILALFCRIFKYKFGMVNKVV

SEQ ID NO: 1702960 - protein, 18 aa, Staphylococcus aureus
ILDMVFWFVNLQILAAHQ

SEQ ID NO: 1702961 - protein, 18 aa, Staphylococcus aureus
ILDVLLNEKLVPGDMLYV

SEQ ID NO: 1702962 - protein, 18 aa, Staphylococcus aureus
ILGEWILQGVFQLAPREI

SEQ ID NO: 1702963 - protein, 18 aa, Staphylococcus aureus
ILKLPIRTWFDKYESEIM

SEQ ID NO: 1702964 - protein, 19 aa, Staphylococcus aureus
ILKLPIRTWFDKYESEIMA

SEQ ID NO: 1702965 - protein, 18 aa, Staphylococcus aureus
ILNLPIRTWFDKAESEIL

SEQ ID NO: 1702966 - protein, 18 aa, Staphylococcus aureus
ILPFILRGIKLIGIDSVC

SEQ ID NO: 1702967 - protein, 19 aa, Staphylococcus aureus
ILRRYCFDKVFIGMNGLDI

SEQ ID NO: 1702968 - protein, 19 aa, Staphylococcus aureus
ILSVFYFRYLYIDSNTHAK

SEQ ID NO: 1702969 - protein, 26 aa, Staphylococcus aureus
ILTSIPLWKNQMAIALTLMRQRNAVA

SEQ ID NO: 1702970 - protein, 17 aa, Staphylococcus aureus
INKKFMYYNLLSNMFWN

SEQ ID NO: 1702971 - protein, 20 aa, Staphylococcus aureus
INKRLHIIPFNYSFKDDQER

SEQ ID NO: 1702972 - protein, 21 aa, Staphylococcus aureus
INKRLHIIPFNYSFKDDQERL

SEQ ID NO: 1702973 - protein, 24 aa, Staphylococcus aureus
INMLEKYWFSWLTKNNIPIKRKSS

SEQ ID NO: 1702974 - protein, 25 aa, Staphylococcus aureus
INNNFKRYVFFTNSFRKEMITKSSM

SEQ ID NO: 1702975 - protein, 20 aa, Staphylococcus aureus
INNVLAFPGIFRGALEAEAT

SEQ ID NO: 1702976 - protein, 19 aa, Staphylococcus aureus
INVVVFKKQAENVKNYLSK

SEQ ID NO: 1702977 - protein, 17 aa, Staphylococcus aureus
IPLTFHFSKDEQLVIDQ

SEQ ID NO: 1702978 - protein, 18 aa, Staphylococcus aureus
IPLTFHFSKDEQLVIDQY

SEQ ID NO: 1702979 - protein, 24 aa, Staphylococcus aureus
IQFADIYLMALPTKAMREVASQIN

SEQ ID NO: 1702980 - protein, 17 aa, Staphylococcus aureus
IQPFAATIPYYFTGHEG

SEQ ID NO: 1702981 - protein, 29 aa, Staphylococcus aureus
IRAEEFMYPYYLTAFLRYRLGLDQIVMNQ

SEQ ID NO: 1702982 - protein, 17 aa, Staphylococcus aureus
ISTILIPGAKPPKLVTR

SEQ ID NO: 1702983 - protein, 18 aa, Staphylococcus aureus
ITKNGILACLLLEGHLLS

SEQ ID NO: 1702984 - protein, 17 aa, Staphylococcus aureus
IVQVLIMPFLYANTYYT

SEQ ID NO: 1702985 - protein, 18 aa, Staphylococcus aureus
IYEHFNVNFIPPAMREDG

SEQ ID NO: 1702986 - protein, 17 aa, Staphylococcus aureus
IYFIYTVADLEVILNCG

SEQ ID NO: 1702987 - protein, 17 aa, Staphylococcus aureus
KADVFISTILIPGAKPP

SEQ ID NO: 1702988 - protein, 21 aa, Staphylococcus aureus
KAIQSINQALANKLKEIEASN

SEQ ID NO: 1702989 - protein, 18 aa, Staphylococcus aureus
KCNSYWLYKFRNIRESKY

SEQ ID NO: 1702990 - protein, 23 aa, Staphylococcus aureus
KDKVEWIILAGYMRLIGPDLLAS

SEQ ID NO: 1702991 - protein, 24 aa, Staphylococcus aureus
KDTVYNVLFLWRLSSELNVAQLRQ

SEQ ID NO: 1702992 - protein, 23 aa, Staphylococcus aureus
KDWKYPRRILWLRKVQSTIKDSL

SEQ ID NO: 1702993 - protein, 23 aa, Staphylococcus aureus
KEIYQFPLLLFYRGNIKLINNMH

SEQ ID NO: 1702994 - protein, 23 aa, Staphylococcus aureus
KESLGFIFQDYSILPTLTVKENI

SEQ ID NO: 1702995 - protein, 17 aa, Staphylococcus aureus
KEVALVMMILRLNTLLK

SEQ ID NO: 1702996 - protein, 22 aa, Staphylococcus aureus
KFDKKLLIELKSPNLYPGIECK

SEQ ID NO: 1702997 - protein, 25 aa, Staphylococcus aureus
KFFRPEFLNRFNGIVEFLHLDKESL

SEQ ID NO: 1702998 - protein, 17 aa, Staphylococcus aureus
KFIYYYINTGLFSEYIN

SEQ ID NO: 1702999 - protein, 22 aa, Staphylococcus aureus
KFKFYEFALFLYEEYHGCYIDN

SEQ ID NO: 1703000 - protein, 20 aa, Staphylococcus aureus
KFRARFAVLAHLLTQREGLP

SEQ ID NO: 1703001 - protein, 24 aa, Staphylococcus aureus
KGIAKLFDFMLPNSPINMPISKMN

SEQ ID NO: 1703002 - protein, 26 aa, Staphylococcus aureus
KGKSFLAKLLWLYTSFFKGQMIYWDP

SEQ ID NO: 1703003 - protein, 17 aa, Staphylococcus aureus
KGLELGCLFAFYGHTHV

SEQ ID NO: 1703004 - protein, 18 aa, Staphylococcus aureus
KGLELGCLFVFYGHTHVA

SEQ ID NO: 1703005 - protein, 17 aa, Staphylococcus aureus
KGVYVILKDSNGKELDR

SEQ ID NO: 1703006 - protein, 19 aa, Staphylococcus aureus
KGYYFVRTFYRKDKLPDRK

SEQ ID NO: 1703007 - protein, 18 aa, Staphylococcus aureus
KHPKVLILMGVPGSYLVA

SEQ ID NO: 1703008 - protein, 17 aa, Staphylococcus aureus
KIKAWVRQLLWMSIYQY

SEQ ID NO: 1703009 - protein, 22 aa, Staphylococcus aureus
KIQCVILICYYYDNLQNYMKNE

SEQ ID NO: 1703010 - protein, 20 aa, Staphylococcus aureus
KIQEIDRVLASHPDVATIRQ

SEQ ID NO: 1703011 - protein, 26 aa, Staphylococcus aureus
KKETDILFILSLFRKINWKVYDESTG

SEQ ID NO: 1703012 - protein, 20 aa, Staphylococcus aureus
KKFFEIYTPLLKHQGLVITD

SEQ ID NO: 1703013 - protein, 26 aa, Staphylococcus aureus
KKFFRPEFLNRFNGIVEFLHLDKESL

SEQ ID NO: 1703014 - protein, 20 aa, Staphylococcus aureus
KKWKYPRKVLWLRKVQATIT

SEQ ID NO: 1703015 - protein, 17 aa, Staphylococcus aureus
KKYIIFPNPMYGSWEAT

SEQ ID NO: 1703016 - protein, 17 aa, Staphylococcus aureus
KLADWHIALPEIVQLQY

SEQ ID NO: 1703017 - protein, 23 aa, Staphylococcus aureus
KLDPYWLYHLYNKDIVPFEGREK

SEQ ID NO: 1703018 - protein, 34 aa, Staphylococcus aureus
KLIAKLHIILLNKAPFKIFIFSMSTLEGALQYIH

SEQ ID NO: 1703019 - protein, 19 aa, Staphylococcus aureus
KLIPFPLPVKFEQDKISQF

SEQ ID NO: 1703020 - protein, 17 aa, Staphylococcus aureus
KLLWLGIPDDAIIGALH

SEQ ID NO: 1703021 - protein, 20 aa, Staphylococcus aureus
KLYRIFYYDCPPIDKIVYHP

SEQ ID NO: 1703022 - protein, 20 aa, Staphylococcus aureus
KMTGYGLKTTAVIGGAFTVN

SEQ ID NO: 1703023 - protein, 20 aa, Staphylococcus aureus
KNEILSFYLNNIYFGDNQYT

SEQ ID NO: 1703024 - protein, 23 aa, Staphylococcus aureus
KNQFPWVVAAFPSKAWAKSVYPE

SEQ ID NO: 1703025 - protein, 18 aa, Staphylococcus aureus
KNRSQNYALIRLLNWLRT

SEQ ID NO: 1703026 - protein, 21 aa, Staphylococcus aureus
KPTVRWLFLTITVKNVYDGEE

SEQ ID NO: 1703027 - protein, 20 aa, Staphylococcus aureus
KPTVRWLFLTLTVKNVYDGE

SEQ ID NO: 1703028 - protein, 24 aa, Staphylococcus aureus
KQTWPFKQILLPLLYQHDSGGGSM

SEQ ID NO: 1703029 - protein, 26 aa, Staphylococcus aureus
KQTWPFKQILLPLLYQRGSGGGSMPS

SEQ ID NO: 1703030 - protein, 17 aa, Staphylococcus aureus
KRWLFISSTLIKQTVRS

SEQ ID NO: 1703031 - protein, 17 aa, Staphylococcus aureus
KSVFNGFRKWLSKTYEW

SEQ ID NO: 1703032 - protein, 22 aa, Staphylococcus aureus
KTDERLWLLNRAGKIPFVVSGQ

SEQ ID NO: 1703033 - protein, 21 aa, Staphylococcus aureus
KTELKYFYYLHLNNGAWNAKS

SEQ ID NO: 1703034 - protein, 17 aa, Staphylococcus aureus
KTGFMYMYMYITLNGDS

SEQ ID NO: 1703035 - protein, 27 aa, Staphylococcus aureus
KTITATALQWLLFDKGLDGSTKSFNPV

SEQ ID NO: 1703036 - protein, 19 aa, Staphylococcus aureus
KTKIKAWVRQLLWMSIYQY

SEQ ID NO: 1703037 - protein, 18 aa, Staphylococcus aureus
KVHHPLYYYASYFTIRAS

SEQ ID NO: 1703038 - protein, 19 aa, Staphylococcus aureus
KVLILMGVPGSYLVATDKS

SEQ ID NO: 1703039 - protein, 17 aa, Staphylococcus aureus
KVLYLVPSIQLLTQTLR

SEQ ID NO: 1703040 - protein, 23 aa, Staphylococcus aureus
KVQDYNEWLIKQPGYRTNFLNID

SEQ ID NO: 1703041 - protein, 24 aa, Staphylococcus aureus
KVYNLDPKLWYFAAGSTTTTIKQI

SEQ ID NO: 1703042 - protein, 18 aa, Staphylococcus aureus
KWCRMIIRQILSNALKYS

SEQ ID NO: 1703043 - protein, 17 aa, Staphylococcus aureus
KYHYFIKLLNLLKYEQV

SEQ ID NO: 1703044 - protein, 22 aa, Staphylococcus aureus
KYMIFLTWIFSTTNNKLRDLGT

SEQ ID NO: 1703045 - protein, 24 aa, Staphylococcus aureus
LAESVLPFHPLFIKPNKDELEVMF

SEQ ID NO: 1703046 - protein, 17 aa, Staphylococcus aureus
LANLDTLRDLNQPQRDA

SEQ ID NO: 1703047 - protein, 26 aa, Staphylococcus aureus
LANMNFLRWVNFPQDYTVTWTNAKIA

SEQ ID NO: 1703048 - protein, 17 aa, Staphylococcus aureus
LCLYYHIGQCLGPCVYD

SEQ ID NO: 1703049 - protein, 18 aa, Staphylococcus aureus
LDLEFIPDNTAVADASRI

SEQ ID NO: 1703050 - protein, 22 aa, Staphylococcus aureus
LDNLIIYALYDQFRDMITLTDD

SEQ ID NO: 1703051 - protein, 20 aa, Staphylococcus aureus
LDSGFYKTPKYSLGDYVWYD

SEQ ID NO: 1703052 - protein, 26 aa, Staphylococcus aureus
LECYLDRTLLPILKLFSNTGISLEAH

SEQ ID NO: 1703053 - protein, 17 aa, Staphylococcus aureus
LEFIIYPFKMNLSRVSK

SEQ ID NO: 1703054 - protein, 17 aa, Staphylococcus aureus
LEFYFPLLKSWSKKKKN

SEQ ID NO: 1703055 - protein, 17 aa, Staphylococcus aureus
LEKHWFNWLTANNIPIK

SEQ ID NO: 1703056 - protein, 19 aa, Staphylococcus aureus
LEMRALLLHLRPLGLKDKS

SEQ ID NO: 1703057 - protein, 23 aa, Staphylococcus aureus
LEYQRNFIFLELGKVLFSEVGKY

SEQ ID NO: 1703058 - protein, 19 aa, Staphylococcus aureus
LFESLSESESLDESESLPE

SEQ ID NO: 1703059 - protein, 18 aa, Staphylococcus aureus
LFESLSESESLSDPVSLV

SEQ ID NO: 1703060 - protein, 19 aa, Staphylococcus aureus
LFESLSESESLSDPVSLVE

SEQ ID NO: 1703061 - protein, 20 aa, Staphylococcus aureus
LFESLSESESLSDPVSLVES

SEQ ID NO: 1703062 - protein, 18 aa, Staphylococcus aureus
LFGGPLYIFHKIFSIITL

SEQ ID NO: 1703063 - protein, 17 aa, Staphylococcus aureus
LFYVIRELFRRHSEVRL

SEQ ID NO: 1703064 - protein, 17 aa, Staphylococcus aureus
LGLTLTPNKHRLQEYIK

SEQ ID NO: 1703065 - protein, 17 aa, Staphylococcus aureus
LHNKSLVILYYFSPTPS

SEQ ID NO: 1703066 - protein, 18 aa, Staphylococcus aureus
LHYLAFYTSKDKEQMERI

SEQ ID NO: 1703067 - protein, 17 aa, Staphylococcus aureus
LIAKLFTYFVEHPIIFI

SEQ ID NO: 1703068 - protein, 17 aa, Staphylococcus aureus
LIIIMAQSGLLIPTLDG

SEQ ID NO: 1703069 - protein, 24 aa, Staphylococcus aureus
LKEPDALVLVDWLCDIESLNDVDV

SEQ ID NO: 1703070 - protein, 22 aa, Staphylococcus aureus
LKGIYQFALNYVFDIKIIPELL

SEQ ID NO: 1703071 - protein, 17 aa, Staphylococcus aureus
LLAFFNNSYWRSQFNPR

SEQ ID NO: 1703072 - protein, 19 aa, Staphylococcus aureus
LLDRFLVIAHSYQLNARVL

SEQ ID NO: 1703073 - protein, 17 aa, Staphylococcus aureus
LLFPLLDEEFHLPLVVA

SEQ ID NO: 1703074 - protein, 19 aa, Staphylococcus aureus
LLGYYQSLKDSFNYGYKYL

SEQ ID NO: 1703075 - protein, 17 aa, Staphylococcus aureus
LLIPLTFHFSKDEQLVI

SEQ ID NO: 1703076 - protein, 18 aa, Staphylococcus aureus
LLNKDKVEWIILAGYMRL

SEQ ID NO: 1703077 - protein, 19 aa, Staphylococcus aureus
LLQCLIFVNDMYLLSNPKS

SEQ ID NO: 1703078 - protein, 17 aa, Staphylococcus aureus
LLTPLFPTYFFSTHSDR

SEQ ID NO: 1703079 - protein, 17 aa, Staphylococcus aureus
LNEDKVEWIILAGYMRL

SEQ ID NO: 1703080 - protein, 24 aa, Staphylococcus aureus
LNEIVICISFLFLTIFIGGCGTGK

SEQ ID NO: 1703081 - protein, 22 aa, Staphylococcus aureus
LNLEFKYLFLKLIVKEDWSLSN

SEQ ID NO: 1703082 - protein, 20 aa, Staphylococcus aureus
LNSRFVVVFLSPNFIESGWS

SEQ ID NO: 1703083 - protein, 17 aa, Staphylococcus aureus
LPFILRGIKLIGIDSVC

SEQ ID NO: 1703084 - protein, 25 aa, Staphylococcus aureus
LPNKEFQLLFMLATRPKQIFTREQI

SEQ ID NO: 1703085 - protein, 22 aa, Staphylococcus aureus
LQNKLFPLEYGLKGLPSIKIKD

SEQ ID NO: 1703086 - protein, 18 aa, Staphylococcus aureus
LQRIWDGILEILQSIIQF

SEQ ID NO: 1703087 - protein, 19 aa, Staphylococcus aureus
LQRIWDGILEILQSIIQFF

SEQ ID NO: 1703088 - protein, 25 aa, Staphylococcus aureus
LRLQKTLYFLFAYYGASYGQLSKSK

SEQ ID NO: 1703089 - protein, 23 aa, Staphylococcus aureus
LSDKLFIPIFLYDTNLKDELYYQ

SEQ ID NO: 1703090 - protein, 21 aa, Staphylococcus aureus
LSIMLLFVYFKSALKINPKNS

SEQ ID NO: 1703091 - protein, 20 aa, Staphylococcus aureus
LSMAIYQFYLGDTLTILDRN

SEQ ID NO: 1703092 - protein, 20 aa, Staphylococcus aureus
LTDMRLILGELIFTELIIVE

SEQ ID NO: 1703093 - protein, 22 aa, Staphylococcus aureus
LTNYYLYFLVDSNIEIGIKSII

SEQ ID NO: 1703094 - protein, 17 aa, Staphylococcus aureus
LTPRLHLFMEDGSIFKN

SEQ ID NO: 1703095 - protein, 18 aa, Staphylococcus aureus
LTQNAIAILYPYIRSLVS

SEQ ID NO: 1703096 - protein, 23 aa, Staphylococcus aureus
LTSIPLWKNQMAIALTLMRQRNA

SEQ ID NO: 1703097 - protein, 17 aa, Staphylococcus aureus
LVILKYLNTVSIENISH

SEQ ID NO: 1703098 - protein, 17 aa, Staphylococcus aureus
LVITLQLLGAQVGWHIP

SEQ ID NO: 1703099 - protein, 20 aa, Staphylococcus aureus
LVKEYVFVIMIKTLQYWSAH

SEQ ID NO: 1703100 - protein, 18 aa, Staphylococcus aureus
LWMNLYYLFMNLRDLFKE

SEQ ID NO: 1703101 - protein, 20 aa, Staphylococcus aureus
LYFPFVEVEMMLTLLDMAQI

SEQ ID NO: 1703102 - protein, 17 aa, Staphylococcus aureus
LYINDFPAIPIEENDNI

SEQ ID NO: 1703103 - protein, 19 aa, Staphylococcus aureus
LYQIRWNGFYWAGANYKNF

SEQ ID NO: 1703104 - protein, 23 aa, Staphylococcus aureus
MDLPLKEFALITGAALLARRCTK

SEQ ID NO: 1703105 - protein, 19 aa, Staphylococcus aureus
MDQLPFMETLLSTLSGVYA

SEQ ID NO: 1703106 - protein, 17 aa, Staphylococcus aureus
MEKARLFALKHELKSEI

SEQ ID NO: 1703107 - protein, 23 aa, Staphylococcus aureus
MIFKYAYDMKLIRILPSEGIKRP

SEQ ID NO: 1703108 - protein, 18 aa, Staphylococcus aureus
MIFQHFNLLWSRTVLKNI

SEQ ID NO: 1703109 - protein, 17 aa, Staphylococcus aureus
MIFYAFDLEYYITTRDF

SEQ ID NO: 1703110 - protein, 26 aa, Staphylococcus aureus
MINYHSKFDILSWLQDPFATPTLGKR

SEQ ID NO: 1703111 - protein, 18 aa, Staphylococcus aureus
MKLIQAEKWFLLKDFGRS

SEQ ID NO: 1703112 - protein, 23 aa, Staphylococcus aureus
MKRYKLLFHILNLTGVHKYDYST

SEQ ID NO: 1703113 - protein, 20 aa, Staphylococcus aureus
MLKNFYLYRYQKRIETLSID

SEQ ID NO: 1703114 - protein, 17 aa, Staphylococcus aureus
MMVILQAFRLPSVNLLQ

SEQ ID NO: 1703115 - protein, 27 aa, Staphylococcus aureus
MPIVKQYFRMLQRPILYTGLTRAKMSL

SEQ ID NO: 1703116 - protein, 18 aa, Staphylococcus aureus
MYDMLKNFYLYRYQKRIE

SEQ ID NO: 1703117 - protein, 17 aa, Staphylococcus aureus
MYYNLLSNMFWNWYNSN

SEQ ID NO: 1703118 - protein, 17 aa, Staphylococcus aureus
NAKLCYIYKFRARFAVL

SEQ ID NO: 1703119 - protein, 21 aa, Staphylococcus aureus
NALNAVTRAKAALNGAENLRN

SEQ ID NO: 1703120 - protein, 22 aa, Staphylococcus aureus
NALNAVTRAKAALNGAENLRNA

SEQ ID NO: 1703121 - protein, 18 aa, Staphylococcus aureus
NAMGAVQQYIDEQHLGVI

SEQ ID NO: 1703122 - protein, 20 aa, Staphylococcus aureus
NAMGAVQQYIDEQHLGVISS

SEQ ID NO: 1703123 - protein, 21 aa, Staphylococcus aureus
NAMGAVQQYIDEQHLGVISST

SEQ ID NO: 1703124 - protein, 17 aa, Staphylococcus aureus
NCRCKLMYYIDEDDLPS

SEQ ID NO: 1703125 - protein, 17 aa, Staphylococcus aureus
NDFAYKHRIPWIYGGVV

SEQ ID NO: 1703126 - protein, 23 aa, Staphylococcus aureus
NDQKKIIITTLQKFPVIYDEIDN

SEQ ID NO: 1703127 - protein, 21 aa, Staphylococcus aureus
NEAINIYFVPSDLVNPTISVG

SEQ ID NO: 1703128 - protein, 18 aa, Staphylococcus aureus
NEIILLSYYIAAINIETT

SEQ ID NO: 1703129 - protein, 18 aa, Staphylococcus aureus
NEIVLLSYYIAAINIEAT

SEQ ID NO: 1703130 - protein, 21 aa, Staphylococcus aureus
NENIKALYFYQKNKYRITEVI

SEQ ID NO: 1703131 - protein, 25 aa, Staphylococcus aureus
NESLDQFILLIFYGTFPGGDFTEFG

SEQ ID NO: 1703132 - protein, 19 aa, Staphylococcus aureus
NETLYTIRLLPVGGYVRMA

SEQ ID NO: 1703133 - protein, 19 aa, Staphylococcus aureus
NFGAFVEIAPGVQGLVHIS

SEQ ID NO: 1703134 - protein, 23 aa, Staphylococcus aureus
NGITLMLLIGKFLQKFGSRRQIQ

SEQ ID NO: 1703135 - protein, 24 aa, Staphylococcus aureus
NGRHELLDSVFLWQSGQKYRIPVH

SEQ ID NO: 1703136 - protein, 18 aa, Staphylococcus aureus
NHQTQIIKILSKVKPDPP

SEQ ID NO: 1703137 - protein, 20 aa, Staphylococcus aureus
NICREMLLLMLAWDKGHLLD

SEQ ID NO: 1703138 - protein, 19 aa, Staphylococcus aureus
NIEEELKILLIPKDPNDDK

SEQ ID NO: 1703139 - protein, 25 aa, Staphylococcus aureus
NIGQRRLFEWLRQNGFLIKHKGVDY

SEQ ID NO: 1703140 - protein, 18 aa, Staphylococcus aureus
NIYFIYTVADLEVILNCG

SEQ ID NO: 1703141 - protein, 25 aa, Staphylococcus aureus
NKFCENIIFVLLPLSFLFQSRDVKI

SEQ ID NO: 1703142 - protein, 20 aa, Staphylococcus aureus
NLAILPFKLLGKGIGLASKS

SEQ ID NO: 1703143 - protein, 21 aa, Staphylococcus aureus
NLEFKYLFLKLIVKEDWSLSN

SEQ ID NO: 1703144 - protein, 31 aa, Staphylococcus aureus; identical to SEQ ID NO: 1599400

SEQ ID NO: 1703145 - protein, 19 aa, Staphylococcus aureus
NLFFMNYYLNFKELRAFVT

SEQ ID NO: 1703146 - protein, 17 aa, Staphylococcus aureus
NLIIIRLKNPSYAPYVA

SEQ ID NO: 1703147 - protein, 25 aa, Staphylococcus aureus
NLKKYKHFMFFGNDIVLKNGKGHSM

SEQ ID NO: 1703148 - protein, 21 aa, Staphylococcus aureus
NLLNMPFGVCHFAVAAKPETT

SEQ ID NO: 1703149 - protein, 18 aa, Staphylococcus aureus
NLMIYQLGALQGFCRIHQ

SEQ ID NO: 1703150 - protein, 19 aa, Staphylococcus aureus
NLPSFIYYMLSYKGNQKKI

SEQ ID NO: 1703151 - protein, 29 aa, Staphylococcus aureus
NLTLENFVLIYYLDQIIAQANLRLATMSD

SEQ ID NO: 1703152 - protein, 27 aa, Staphylococcus aureus
NMINYHSKFDILSWLQDPFATPTLGKR

SEQ ID NO: 1703153 - protein, 17 aa, Staphylococcus aureus
NMLYPYIDEILITKSKT

SEQ ID NO: 1703154 - protein, 20 aa, Staphylococcus aureus
NNAMKGLRYSIANETTVKAS

SEQ ID NO: 1703155 - protein, 20 aa, Staphylococcus aureus
NNYFEPVLNYILEVIHSVET

SEQ ID NO: 1703156 - protein, 24 aa, Staphylococcus aureus
NPVDILVYATWKFSGLPKERVIGS

SEQ ID NO: 1703157 - protein, 17 aa, Staphylococcus aureus
NQALANKLKEIEASNAT

SEQ ID NO: 1703158 - protein, 22 aa, Staphylococcus aureus
NQFPWVVAAFPSKAWAKRVYPE

SEQ ID NO: 1703159 - protein, 18 aa, Staphylococcus aureus
NRRNLIAIKFFEDKQVEQ

SEQ ID NO: 1703160 - protein, 17 aa, Staphylococcus aureus
NRVLPHHLPFINKIGFG

SEQ ID NO: 1703161 - protein, 19 aa, Staphylococcus aureus
NRWGLFGYCRFIPYLKKRL

SEQ ID NO: 1703162 - protein, 17 aa, Staphylococcus aureus
NSAFLIYLFAKDLSNHD

SEQ ID NO: 1703163 - protein, 17 aa, Staphylococcus aureus
NSDFLLQSIIKPALESD

SEQ ID NO: 1703164 - protein, 24 aa, Staphylococcus aureus
NSITYILVNPFYIGKIQFAKYKDW

SEQ ID NO: 1703165 - protein, 22 aa, Staphylococcus aureus
NSLENLLFGLGIRHLGVKASQV

SEQ ID NO: 1703166 - protein, 22 aa, Staphylococcus aureus
NSLENLLFGLGIRHLGVKVSQV

SEQ ID NO: 1703167 - protein, 22 aa, Staphylococcus aureus
NSNEDFLSYKADFSRLLHIDME

SEQ ID NO: 1703168 - protein, 24 aa, Staphylococcus aureus
NSQKFFDLIKYFELPRQTKIKTFS

SEQ ID NO: 1703169 - protein, 21 aa, Staphylococcus aureus
NTAMTALKRAIADKADTKASG

SEQ ID NO: 1703170 - protein, 20 aa, Staphylococcus aureus
NTVLKRFWKFEGTAVYEKVG

SEQ ID NO: 1703171 - protein, 17 aa, Staphylococcus aureus
NVFKNLWLIAWEMTYES

SEQ ID NO: 1703172 - protein, 17 aa, Staphylococcus aureus
NVFYWAGANYKNFKTRT

SEQ ID NO: 1703173 - protein, 17 aa, Staphylococcus aureus
NVKKEHWGFDDPAGKPW

SEQ ID NO: 1703174 - protein, 17 aa, Staphylococcus aureus
NVLKNLWLIAWEMTYES

SEQ ID NO: 1703175 - protein, 17 aa, Staphylococcus aureus
NWFIVDQYKLFYKKQDL

SEQ ID NO: 1703176 - protein, 21 aa, Staphylococcus aureus
PARIKCATLAWKALEKGTVAK

SEQ ID NO: 1703177 - protein, 23 aa, Staphylococcus aureus
PARLMPDKILDLRYKLRVNNVPT

SEQ ID NO: 1703178 - protein, 19 aa, Staphylococcus aureus
PASITAYNNSIRALQSDLT

SEQ ID NO: 1703179 - protein, 20 aa, Staphylococcus aureus
PDTGFYRFWAQGIFARWTDN

SEQ ID NO: 1703180 - protein, 23 aa, Staphylococcus aureus
PEELRLLLIDPKMVELAPYNGLP

SEQ ID NO: 1703181 - protein, 27 aa, Staphylococcus aureus
PERDTIITIWVKLLILSGKYNEQGYIM

SEQ ID NO: 1703182 - protein, 18 aa, Staphylococcus aureus
PEYQHLNIFPVGRLDKDT

SEQ ID NO: 1703183 - protein, 17 aa, Staphylococcus aureus
PFFVIKMPESNRSKYTF

SEQ ID NO: 1703184 - protein, 18 aa, Staphylococcus aureus
PFHNKSLVILYYFSSAPS

SEQ ID NO: 1703185 - protein, 19 aa, Staphylococcus aureus
PIDSYLLLRGLKTLHLRIE

SEQ ID NO: 1703186 - protein, 20 aa, Staphylococcus aureus
PIDSYLLLRGLKTLHLRIER

SEQ ID NO: 1703187 - protein, 24 aa, Staphylococcus aureus
PIQSYLFIYILIITGGRFGEVQRL

SEQ ID NO: 1703188 - protein, 18 aa, Staphylococcus aureus
PITPLLFMANGPSFVTDT

SEQ ID NO: 1703189 - protein, 19 aa, Staphylococcus aureus
PLLVKYLWDNLTDAPHGIV

SEQ ID NO: 1703190 - protein, 19 aa, Staphylococcus aureus
PLPKAFRDAGWFFDVLPGH

SEQ ID NO: 1703191 - protein, 19 aa, Staphylococcus aureus
PLPKAFRDAGWFFDVLPGR

SEQ ID NO: 1703192 - protein, 17 aa, Staphylococcus aureus
PMFVLTHKKLFITKVAL

SEQ ID NO: 1703193 - protein, 26 aa, Staphylococcus aureus
PMYNGYIFKLVVFVSALLTSHGYIEI

SEQ ID NO: 1703194 - protein, 17 aa, Staphylococcus aureus
PNKLIPLTFFVKKFKQA

SEQ ID NO: 1703195 - protein, 19 aa, Staphylococcus aureus
PQTLKLFKVCKLRGIPIFT

SEQ ID NO: 1703196 - protein, 17 aa, Staphylococcus aureus
PQTRLRKLLKRMDFYIK

SEQ ID NO: 1703197 - protein, 24 aa, Staphylococcus aureus
PREAGLFHIALLLPTTEDLANFLY

SEQ ID NO: 1703198 - protein, 23 aa, Staphylococcus aureus
PRGWHLYFVLDTPFYAKGIEKKA

SEQ ID NO: 1703199 - protein, 17 aa, Staphylococcus aureus
PSILTIPYIFEKLFEYS

SEQ ID NO: 1703200 - protein, 20 aa, Staphylococcus aureus
PSPIWMQAHLIKAGIRPINN

SEQ ID NO: 1703201 - protein, 18 aa, Staphylococcus aureus
PTYKNLYKNVWLLKDVPS

SEQ ID NO: 1703202 - protein, 22 aa, Staphylococcus aureus
PTYKNLYKNVWLLKDVPSEFSI

SEQ ID NO: 1703203 - protein, 20 aa, Staphylococcus aureus
PYLLEAPFWTVDTLFYCTPK

SEQ ID NO: 1703204 - protein, 17 aa, Staphylococcus aureus
PYVRLFRDLFPNAAIIF

SEQ ID NO: 1703205 - protein, 25 aa, Staphylococcus aureus
QAVFFTRQLWNMLVLARVITIGAYN

SEQ ID NO: 1703206 - protein, 19 aa, Staphylococcus aureus
QDSYLLVRGIKTLGLRMEQ

SEQ ID NO: 1703207 - protein, 20 aa, Staphylococcus aureus
QDSYLLVRGIKTLGLRMKQI

SEQ ID NO: 1703208 - protein, 20 aa, Staphylococcus aureus
QDVLLFIDNIFRFTQAGSEV

SEQ ID NO: 1703209 - protein, 23 aa, Staphylococcus aureus
QDYRELFTLMFYTGLRIGEAMAL

SEQ ID NO: 1703210 - protein, 17 aa, Staphylococcus aureus
QEDKIYILFHKPTQVIT

SEQ ID NO: 1703211 - protein, 17 aa, Staphylococcus aureus
QERKFLGLTLTPNKHRL

SEQ ID NO: 1703212 - protein, 17 aa, Staphylococcus aureus
QFKFIKYLVPIKDEQEK

SEQ ID NO: 1703213 - protein, 24 aa, Staphylococcus aureus
QGKKGLFIVPLNGLKKWLTSVEMW

SEQ ID NO: 1703214 - protein, 21 aa, Staphylococcus aureus
QHDKFVFGAIQKKLLNEYDFD

SEQ ID NO: 1703215 - protein, 20 aa, Staphylococcus aureus
QHDKFVFGAIQKKLLSEYDF

SEQ ID NO: 1703216 - protein, 17 aa, Staphylococcus aureus
QIALAKRLKLPIIIHNR

SEQ ID NO: 1703217 - protein, 18 aa, Staphylococcus aureus
QIIEAMFEWIFTNAIPLN

SEQ ID NO: 1703218 - protein, 21 aa, Staphylococcus aureus
QINNVLAFPGIFRGALEVEAT

SEQ ID NO: 1703219 - protein, 17 aa, Staphylococcus aureus
QIYNLFFPYVEKMYITK

SEQ ID NO: 1703220 - protein, 23 aa, Staphylococcus aureus
QKPTVRWLFLTLTVKNVYDGEEL

SEQ ID NO: 1703221 - protein, 20 aa, Staphylococcus aureus
QLIDDFAYKHRIPWIYGGVV

SEQ ID NO: 1703222 - protein, 18 aa, Staphylococcus aureus
QLINDFAYKHRIPWIYGG

SEQ ID NO: 1703223 - protein, 25 aa, Staphylococcus aureus
QLKDGYKYYSFVDSIGLHSGSHVFV

SEQ ID NO: 1703224 - protein, 23 aa, Staphylococcus aureus
QLVTRLFFMFDKETMIASMGIGG

SEQ ID NO: 1703225 - protein, 23 aa, Staphylococcus aureus
QMQKPYVFFLKDGKAREVIKRQS

SEQ ID NO: 1703226 - protein, 22 aa, Staphylococcus aureus
QNINFVFQYFQKLYKFLRSLSN

SEQ ID NO: 1703227 - protein, 21 aa, Staphylococcus aureus
QNLILLFLESWYLKASFSQKF

SEQ ID NO: 1703228 - protein, 22 aa, Staphylococcus aureus
QNQYQYVPPQQQAPTKQRPAKE

SEQ ID NO: 1703229 - protein, 23 aa, Staphylococcus aureus
QTQIAIQIQIATQIRIATQIQMQ

SEQ ID NO: 1703230 - protein, 23 aa, Staphylococcus aureus
QTWPFKQILLPLLYQRDSGGGSM

SEQ ID NO: 1703231 - protein, 19 aa, Staphylococcus aureus
QYFPATHWKAINGIPYAGS

SEQ ID NO: 1703232 - protein, 26 aa, Staphylococcus aureus
RAGKTYVFILLFLMHIATYKDKGLNF

SEQ ID NO: 1703233 - protein, 19 aa, Staphylococcus aureus
RAVLKYKLKFENGLHQGDY

SEQ ID NO: 1703234 - protein, 17 aa, Staphylococcus aureus
RCKLPNTTFARDLYENM

SEQ ID NO: 1703235 - protein, 18 aa, Staphylococcus aureus
RDIEMLLGSKVYLELWVK

SEQ ID NO: 1703236 - protein, 21 aa, Staphylococcus aureus
RDIQFDVIFLDPPYNKGLIDK

SEQ ID NO: 1703237 - protein, 17 aa, Staphylococcus aureus
RDTLHFEMLWDTSKIYK

SEQ ID NO: 1703238 - protein, 23 aa, Staphylococcus aureus
REAGLFHIALLLPTTEDLANFLY

SEQ ID NO: 1703239 - protein, 23 aa, Staphylococcus aureus
REDGKIYKFYLYINGILETSDNE

SEQ ID NO: 1703240 - protein, 24 aa, Staphylococcus aureus
REEILILLTLWQKGSMMLKEMDRF

SEQ ID NO: 1703241 - protein, 19 aa, Staphylococcus aureus
REYFISRVLKLKNNLKKKY

SEQ ID NO: 1703242 - protein, 20 aa, Staphylococcus aureus
RFKGLPYWHRSKSNWLFKEY

SEQ ID NO: 1703243 - protein, 17 aa, Staphylococcus aureus
RFWHKVLYDLAIVPTKE

SEQ ID NO: 1703244 - protein, 18 aa, Staphylococcus aureus
RISNLIKFGYLKIEIIKE

SEQ ID NO: 1703245 - protein, 18 aa, Staphylococcus aureus
RIYKAHVKALLPLKPQTI

SEQ ID NO: 1703246 - protein, 21 aa, Staphylococcus aureus
RKIIDHWIWTDSKRLKWWMDL

SEQ ID NO: 1703247 - protein, 24 aa, Staphylococcus aureus
RKKEDLEFIIDKFFKKIQQERPES

SEQ ID NO: 1703248 - protein, 21 aa, Staphylococcus aureus
RKSVFLMLNIKKGIFKTHPNL

SEQ ID NO: 1703249 - protein, 18 aa, Staphylococcus aureus
RLFALKHELKNEIQSMIS

SEQ ID NO: 1703250 - protein, 17 aa, Staphylococcus aureus
RLFYMFDKETMIASMGI

SEQ ID NO: 1703251 - protein, 17 aa, Staphylococcus aureus
RLLVISPYDKSSVADIE

SEQ ID NO: 1703252 - protein, 18 aa, Staphylococcus aureus
RLSIFIFIINILNQLRGS

SEQ ID NO: 1703253 - protein, 22 aa, Staphylococcus aureus
RLSIFIFIINILNQLRGSVIYQ

SEQ ID NO: 1703254 - protein, 19 aa, Staphylococcus aureus
RNEYYYLTAIPYTLDEYKR

SEQ ID NO: 1703255 - protein, 19 aa, Staphylococcus aureus
RNLFPEIIFLDVISLRTFE

SEQ ID NO: 1703256 - protein, 19 aa, Staphylococcus aureus
RPIDNILPIWRAVGGPPAS

SEQ ID NO: 1703257 - protein, 23 aa, Staphylococcus aureus
RPIDNILPIWRAVGGPSASAIKA

SEQ ID NO: 1703258 - protein, 17 aa, Staphylococcus aureus
RQRVWRRLAKDLKPENL

SEQ ID NO: 1703259 - protein, 19 aa, Staphylococcus aureus
RRDIEMLLGSKVYLELWVK

SEQ ID NO: 1703260 - protein, 17 aa, Staphylococcus aureus
RRLWIRSVTKKAIQQGF

SEQ ID NO: 1703261 - protein, 18 aa, Staphylococcus aureus
RRVMWLPIYTKPAKKEKN

SEQ ID NO: 1703262 - protein, 24 aa, Staphylococcus aureus
RTDLGRYFDRFADKLDKTQTNAEV

SEQ ID NO: 1703263 - protein, 19 aa, Staphylococcus aureus
RTELKYFYFYHLNNGIWNA

SEQ ID NO: 1703264 - protein, 21 aa, Staphylococcus aureus
RTSGIFFMIKGDEQYIFGDCA

SEQ ID NO: 1703265 - protein, 23 aa, Staphylococcus aureus
RTYAFTELFLFELRMQWLNRLEK

SEQ ID NO: 1703266 - protein, 17 aa, Staphylococcus aureus
RVMIAMALILKPQILIA

SEQ ID NO: 1703267 - protein, 17 aa, Staphylococcus aureus
RWNGFYWAGANYKNFKT

SEQ ID NO: 1703268 - protein, 26 aa, Staphylococcus aureus
RYSYLFNKIYFLRISTLPLSLGQESC

SEQ ID NO: 1703269 - protein, 24 aa, Staphylococcus aureus
SAKQFFSTVLIPLSTSMKTLSDLT

SEQ ID NO: 1703270 - protein, 22 aa, Staphylococcus aureus
SAYHILDMVFWFGNLQILAAHQ

SEQ ID NO: 1703271 - protein, 18 aa, Staphylococcus aureus
SCVPILTRSQKSLQGILV

SEQ ID NO: 1703272 - protein, 21 aa, Staphylococcus aureus
SDLILYVSYFNHSFTDNDKAF

SEQ ID NO: 1703273 - protein, 18 aa, Staphylococcus aureus
SDPVSLVESESESLAESE

SEQ ID NO: 1703274 - protein, 22 aa, Staphylococcus aureus
SEKVFYDLWTDLYRLFKKLRSA

SEQ ID NO: 1703275 - protein, 24 aa, Staphylococcus aureus
SERLRQFFDFITNFGIMIKGTGED

SEQ ID NO: 1703276 - protein, 19 aa, Staphylococcus aureus
SERYFLMKFFGLPTDEDDA

SEQ ID NO: 1703277 - protein, 24 aa, Staphylococcus aureus
SESESLSESLSESESLSESESLSE

SEQ ID NO: 1703278 - protein, 25 aa, Staphylococcus aureus
SEYQYFKKDQIIWGFLHLASSKEIV

SEQ ID NO: 1703279 - protein, 17 aa, Staphylococcus aureus
SFMRPCQLAKMISRYMI

SEQ ID NO: 1703280 - protein, 18 aa, Staphylococcus aureus
SFSKFIYYYINTGLFSEY

SEQ ID NO: 1703281 - protein, 25 aa, Staphylococcus aureus
SFSLTDLYLFIFNNSIKTLTIVTNK

SEQ ID NO: 1703282 - protein, 20 aa, Staphylococcus aureus
SFTRLQIMSFFSSLWISSYS

SEQ ID NO: 1703283 - protein, 17 aa, Staphylococcus aureus
SFYDWYADLPLASPQIW

SEQ ID NO: 1703284 - protein, 29 aa, Staphylococcus aureus
SGIKEIEMFKIMGLPFISHSIVSQDNQSI

SEQ ID NO: 1703285 - protein, 30 aa, Staphylococcus aureus
SGIKEIEMFKIMGLPFISHSLVSQDNQSIS

SEQ ID NO: 1703286 - protein, 18 aa, Staphylococcus aureus
SHFHFYEANAALDFEREL

SEQ ID NO: 1703287 - protein, 19 aa, Staphylococcus aureus
SIALVTPEHIVRAGARDAV

SEQ ID NO: 1703288 - protein, 17 aa, Staphylococcus aureus
SITQLIERFLFPSATHG

SEQ ID NO: 1703289 - protein, 23 aa, Staphylococcus aureus
SITSKLIFASWSPRLHFNASLFQ

SEQ ID NO: 1703290 - protein, 19 aa, Staphylococcus aureus
SITYILANPFYIGKIQFAK

SEQ ID NO: 1703291 - protein, 22 aa, Staphylococcus aureus
SITYILANPFYIGKIQFAKYKD

SEQ ID NO: 1703292 - protein, 19 aa, Staphylococcus aureus
SKIFNIQYLGGVRDNWGVT

SEQ ID NO: 1703293 - protein, 26 aa, Staphylococcus aureus
SKNLKVIYMPHWLKFYSIAIHSDVTS

SEQ ID NO: 1703294 - protein, 18 aa, Staphylococcus aureus
SKPPILLTPLFPTYFFPT

SEQ ID NO: 1703295 - protein, 19 aa, Staphylococcus aureus
SLEIKVPLNAIKIPKSVLT

SEQ ID NO: 1703296 - protein, 18 aa, Staphylococcus aureus
SLFSVKKITFDLSDAKKT

SEQ ID NO: 1703297 - protein, 18 aa, Staphylococcus aureus
SLPPFYYPLNELISIGQM

SEQ ID NO: 1703298 - protein, 19 aa, Staphylococcus aureus
SLVAFFFKALTSYLKKHNC

SEQ ID NO: 1703299 - protein, 24 aa, Staphylococcus aureus
SNWDMLFIVFSIHLIDILKKLSHE

SEQ ID NO: 1703300 - protein, 25 aa, Staphylococcus aureus
SREEILILLTLWQKGFMTLKEMDRF

SEQ ID NO: 1703301 - protein, 17 aa, Staphylococcus aureus
SSALINVAWFWHTSYSH

SEQ ID NO: 1703302 - protein, 24 aa, Staphylococcus aureus
SSAQKRMYLLWKSNLKDTVYNIPF

SEQ ID NO: 1703303 - protein, 25 aa, Staphylococcus aureus
SSGGYFVWLVFKIDIDIKYLFYELL

SEQ ID NO: 1703304 - protein, 23 aa, Staphylococcus aureus
SSYNLKCLLLKLTYRYLDNQPIN

SEQ ID NO: 1703305 - protein, 24 aa, Staphylococcus aureus
STLLKLVLGLLPLQSGEIFVEGID

SEQ ID NO: 1703306 - protein, 24 aa, Staphylococcus aureus
SVKSLPPFFYPLNELISIGQMIKN

SEQ ID NO: 1703307 - protein, 19 aa, Staphylococcus aureus
SWQIFYFIKEFIQSLDLLE

SEQ ID NO: 1703308 - protein, 19 aa, Staphylococcus aureus
SYIFLYILGITGARYSDVI

SEQ ID NO: 1703309 - protein, 17 aa, Staphylococcus aureus
SYLFSNINWKEKKYMAR

SEQ ID NO: 1703310 - protein, 24 aa, Staphylococcus aureus
SYVYTFLGFLPRKEKEKSDVLEQR

SEQ ID NO: 1703311 - protein, 20 aa, Staphylococcus aureus
TAMGNLKHALAEKDNTKRSV

SEQ ID NO: 1703312 - protein, 20 aa, Staphylococcus aureus
TAMGQLQHAIADKTNTLASS

SEQ ID NO: 1703313 - protein, 24 aa, Staphylococcus aureus
TEAYTNYAILFISGTYPGGVIEVF

SEQ ID NO: 1703314 - protein, 22 aa, Staphylococcus aureus
TEGNIYFIYTVADLEVILNCGN

SEQ ID NO: 1703315 - protein, 20 aa, Staphylococcus aureus
TEPYTNYSVLLISGTYPGGI

SEQ ID NO: 1703316 - protein, 20 aa, Staphylococcus aureus
TFLMTKMMLPLMMNQGGSIV

SEQ ID NO: 1703317 - protein, 23 aa, Staphylococcus aureus
TGHIVNLYFPFVEVETLLTLLDM

SEQ ID NO: 1703318 - protein, 21 aa, Staphylococcus aureus
TGRYYVQRFLARAFGFEVDDI

SEQ ID NO: 1703319 - protein, 17 aa, Staphylococcus aureus
THWKAINGIPYAGSSDI

SEQ ID NO: 1703320 - protein, 19 aa, Staphylococcus aureus
TIFCTFWGLNALKKIQSQR

SEQ ID NO: 1703321 - protein, 17 aa, Staphylococcus aureus
TKFMLPKWLYKIAKQRA

SEQ ID NO: 1703322 - protein, 18 aa, Staphylococcus aureus
TKLWPIQPLRDFWGINRR

SEQ ID NO: 1703323 - protein, 25 aa, Staphylococcus aureus
TKRDKLLIMLMYEGGLRIGEALSLR

SEQ ID NO: 1703324 - protein, 18 aa, Staphylococcus aureus
TKVYPWIAKTRGSTPGIG

SEQ ID NO: 1703325 - protein, 22 aa, Staphylococcus aureus
TLGNSLRRILLSSLSGAAVKYI

SEQ ID NO: 1703326 - protein, 25 aa, Staphylococcus aureus
TLPCSTGLEGFLGSSFAGGTGLPGS

SEQ ID NO: 1703327 - protein, 23 aa, Staphylococcus aureus
TNDFPITWFYPLGEKKVERTTPK

SEQ ID NO: 1703328 - protein, 26 aa, Staphylococcus aureus
TNKPYLIYMLGFMPGFPYLGGLDEQL

SEQ ID NO: 1703329 - protein, 25 aa, Staphylococcus aureus
TNKQQSFANCKQLRQVYPNGVTADH

SEQ ID NO: 1703330 - protein, 21 aa, Staphylococcus aureus
TNSAFLIYLFAKDLPNHDELM

SEQ ID NO: 1703331 - protein, 20 aa, Staphylococcus aureus
TQFYNMYRKGLLKLPNEDLC

SEQ ID NO: 1703332 - protein, 22 aa, Staphylococcus aureus
TQLLDRFLVIAHSYQLNARILV

SEQ ID NO: 1703333 - protein, 25 aa, Staphylococcus aureus
TREHILLSRNVGVPALVVFLNKVDM

SEQ ID NO: 1703334 - protein, 23 aa, Staphylococcus aureus
TRLSIFIFIINILKQLRGIVIYQ

SEQ ID NO: 1703335 - protein, 26 aa, Staphylococcus aureus
TSAKQFFSTVLIPLSTSMKTLSDLTK

SEQ ID NO: 1703336 - protein, 28 aa, Staphylococcus aureus
TSTAPIKLRTFSRLAMSTFASAATTSAV

SEQ ID NO: 1703337 - protein, 29 aa, Staphylococcus aureus
TSTAPVKLRTFSRLAMSTFASAATTTAVT

SEQ ID NO: 1703338 - protein, 22 aa, Staphylococcus aureus
TTAGKLALLMRKKYNKKPMLVA

SEQ ID NO: 1703339 - protein, 23 aa, Staphylococcus aureus
TTAKLMILAFEKFEKLPLDTLKQ

SEQ ID NO: 1703340 - protein, 22 aa, Staphylococcus aureus
TTEYYWHWDLKNSKLDVFDYKK

SEQ ID NO: 1703341 - protein, 22 aa, Staphylococcus aureus
TTIGLDLPFPIKINQMLGHQTS

SEQ ID NO: 1703342 - protein, 23 aa, Staphylococcus aureus
TTIGLDLPFPIKINQMLGHQTSF

SEQ ID NO: 1703343 - protein, 24 aa, Staphylococcus aureus
TTLGNSLRRILLSSLPGAAVKYIE

SEQ ID NO: 1703344 - protein, 25 aa, Staphylococcus aureus
TVETQKLMELYYFKKPRTLNLTGVA

SEQ ID NO: 1703345 - protein, 20 aa, Staphylococcus aureus
TWDFAHCLPYFKKLEKTYGA

SEQ ID NO: 1703346 - protein, 18 aa, Staphylococcus aureus
TYFLSWTTTPWTLPANVA

SEQ ID NO: 1703347 - protein, 19 aa, Staphylococcus aureus
TYIEKFLMSLYLYEMASQT

SEQ ID NO: 1703348 - protein, 17 aa, Staphylococcus aureus
TYNNYFEPVLNYILEVI

SEQ ID NO: 1703349 - protein, 22 aa, Staphylococcus aureus
TYNNYFEPVLNYILEVIHSVET

SEQ ID NO: 1703350 - protein, 19 aa, Staphylococcus aureus
VACGTWRLVYQRLKALEVL

SEQ ID NO: 1703351 - protein, 18 aa, Staphylococcus aureus
VCDYLFCKAFGKLASNIE

SEQ ID NO: 1703352 - protein, 25 aa, Staphylococcus aureus
VEGGPTLRLFKVPDNVRNLKIQFVP

SEQ ID NO: 1703353 - protein, 23 aa, Staphylococcus aureus
VEKIRRANGLSGNNIRNGQQIVI

SEQ ID NO: 1703354 - protein, 21 aa, Staphylococcus aureus
VEPDWLVLLDILVESLSDVDV

SEQ ID NO: 1703355 - protein, 17 aa, Staphylococcus aureus
VETLRGMQISELTPRKP

SEQ ID NO: 1703356 - protein, 17 aa, Staphylococcus aureus
VFNGFRKWLSRTYEWIR

SEQ ID NO: 1703357 - protein, 33 aa, Staphylococcus aureus
VGHPEQLYKYYYDRGYTLTWDNGLVLYSNKANG

SEQ ID NO: 1703358 - protein, 19 aa, Staphylococcus aureus
VGNKKPLRRLWIRSVTKKA

SEQ ID NO: 1703359 - protein, 17 aa, Staphylococcus aureus
VGTFFLQDSKELTESIV

SEQ ID NO: 1703360 - protein, 17 aa, Staphylococcus aureus
VIGIHWGGVPNEFNGAV

SEQ ID NO: 1703361 - protein, 18 aa, Staphylococcus aureus
VIWLYQYFSDISLAPTTY

SEQ ID NO: 1703362 - protein, 17 aa, Staphylococcus aureus
VKEGDTFTFKYGQYFRP

SEQ ID NO: 1703363 - protein, 19 aa, Staphylococcus aureus
VKELKLIPFPLPVKFEQDK

SEQ ID NO: 1703364 - protein, 23 aa, Staphylococcus aureus
VKELKLIPFPLPVKFEQDKISQF

SEQ ID NO: 1703365 - protein, 24 aa, Staphylococcus aureus
VKLDPYWLYHLYDKDIVPFEGREK

SEQ ID NO: 1703366 - protein, 24 aa, Staphylococcus aureus
VKQFKQLRVWIWETKKRDGKHHGV

SEQ ID NO: 1703367 - protein, 33 aa, Staphylococcus aureus; identical to SEQ ID NO: 1598822

SEQ ID NO: 1703368 - protein, 17 aa, Staphylococcus aureus
VKVSQFKFIKYLVPIKD

SEQ ID NO: 1703369 - protein, 17 aa, Staphylococcus aureus
VLDTLLLKNYRILQLQK

SEQ ID NO: 1703370 - protein, 26 aa, Staphylococcus aureus
VLKICRLYAFRNWPIAALSYGQKKRV

SEQ ID NO: 1703371 - protein, 18 aa, Staphylococcus aureus
VLRKAYLESFRKGFKQQI

SEQ ID NO: 1703372 - protein, 20 aa, Staphylococcus aureus
VMIAWLVKIPHRIMPILGTS

SEQ ID NO: 1703373 - protein, 17 aa, Staphylococcus aureus
VMRLLKSLQTDENKTII

SEQ ID NO: 1703374 - protein, 25 aa, Staphylococcus aureus
VQADRVFIALPPLYKLEKGKGKTKR

SEQ ID NO: 1703375 - protein, 27 aa, Staphylococcus aureus
VRDFLHDAFFFINIAEIILFIEKQYDI

SEQ ID NO: 1703376 - protein, 26 aa, Staphylococcus aureus
VRDFLHDAFFFINIAEIILFIEKQYG

SEQ ID NO: 1703377 - protein, 19 aa, Staphylococcus aureus
VSTGYFRLPTKDNVQLFTN

SEQ ID NO: 1703378 - protein, 17 aa, Staphylococcus aureus
VTALQTVVSRRLNPFET

SEQ ID NO: 1703379 - protein, 17 aa, Staphylococcus aureus
VTALQTVVSRRLSPFET

SEQ ID NO: 1703380 - protein, 19 aa, Staphylococcus aureus
VTIPPWNFPFAIMAGTTLA

SEQ ID NO: 1703381 - protein, 29 aa, Staphylococcus aureus
VVTQITPWNYPLLQASWKIAPALATGCSI

SEQ ID NO: 1703382 - protein, 32 aa, Staphylococcus aureus
VYARPLFYFGNIMKPLIWLMNGSARVIIRMFG

SEQ ID NO: 1703383 - protein, 18 aa, Staphylococcus aureus
VYDFWRPTGHKYPLVDGA

SEQ ID NO: 1703384 - protein, 19 aa, Staphylococcus aureus
VYKAQLYLSSYGPKQYVEH

SEQ ID NO: 1703385 - protein, 17 aa, Staphylococcus aureus
VYVILKDSNGKELDRTT

SEQ ID NO: 1703386 - protein, 21 aa, Staphylococcus aureus
VYYIYAILHHKYYVNKYSSDL

SEQ ID NO: 1703387 - protein, 21 aa, Staphylococcus aureus
WDMLFIVFSIHLIDILKKLSH

SEQ ID NO: 1703388 - protein, 20 aa, Staphylococcus aureus
WEALFLCHQLFRAVSGEVAE

SEQ ID NO: 1703389 - protein, 18 aa, Staphylococcus aureus
WGAPFPVIEIVKLGINKA

SEQ ID NO: 1703390 - protein, 18 aa, Staphylococcus aureus
WKEMMVILQAFRLPSVNL

SEQ ID NO: 1703391 - protein, 19 aa, Staphylococcus aureus
WLSVLPIYHISGLSVLLRA

SEQ ID NO: 1703392 - protein, 17 aa, Staphylococcus aureus
WMELYRSFKKLRNIFKE

SEQ ID NO: 1703393 - protein, 19 aa, Staphylococcus aureus
WMRQPHYYMRLYSYTYSAG

SEQ ID NO: 1703394 - protein, 18 aa, Staphylococcus aureus
WYSLHLFYAVDWASLRLA

SEQ ID NO: 1703395 - protein, 20 aa, Staphylococcus aureus
YAYDLFLLTHIFIIFTDESL

SEQ ID NO: 1703396 - protein, 17 aa, Staphylococcus aureus
YDIDLCLDFLLDNNFSL

SEQ ID NO: 1703397 - protein, 20 aa, Staphylococcus aureus
YDLRFPELLRYPARSGAKIA

SEQ ID NO: 1703398 - protein, 22 aa, Staphylococcus aureus
YDTVYQLLAKDYYRWLRSQKAD

SEQ ID NO: 1703399 - protein, 18 aa, Staphylococcus aureus
YDYLLKRYLLNIERENDI

SEQ ID NO: 1703400 - protein, 17 aa, Staphylococcus aureus
YEHFNVNFIPPAMREDG

SEQ ID NO: 1703401 - protein, 22 aa, Staphylococcus aureus
YEKFGRWFFNKFKVNRSADAKK

SEQ ID NO: 1703402 - protein, 17 aa, Staphylococcus aureus
YFDHQILRRLVAFMYEI

SEQ ID NO: 1703403 - protein, 20 aa, Staphylococcus aureus
YFLSLGIKTVLITLGKQGTY

SEQ ID NO: 1703404 - protein, 20 aa, Staphylococcus aureus
YGATFFVFSDNLKPALRLSS

SEQ ID NO: 1703405 - protein, 19 aa, Staphylococcus aureus
YGINEVYLISHALLETGNG

SEQ ID NO: 1703406 - protein, 17 aa, Staphylococcus aureus
YGQYFRPGSVRLPSQTQ

SEQ ID NO: 1703407 - protein, 21 aa, Staphylococcus aureus
YIYGSLIEGFLYWIKDEKIDW

SEQ ID NO: 1703408 - protein, 19 aa, Staphylococcus aureus
YKCNSYWLYKFRNIRESKY

SEQ ID NO: 1703409 - protein, 18 aa, Staphylococcus aureus
YKIGGTWYPFYKKNDGDL

SEQ ID NO: 1703410 - protein, 21 aa, Staphylococcus aureus
YKNRWGLFGYCRFIPYLKKKV

SEQ ID NO: 1703411 - protein, 18 aa, Staphylococcus aureus
YLCILGQTVYDKLGHEMQ

SEQ ID NO: 1703412 - protein, 17 aa, Staphylococcus aureus
YLEGFNFDNGKAKLFPL

SEQ ID NO: 1703413 - protein, 17 aa, Staphylococcus aureus
YLFDLLLRKIEDMILPK

SEQ ID NO: 1703414 - protein, 26 aa, Staphylococcus aureus
YLQDKHYPLLRFGFIHVPYIPEQIDG

SEQ ID NO: 1703415 - protein, 19 aa, Staphylococcus aureus
YLYQPYNPSILRLVKKVIE

SEQ ID NO: 1703416 - protein, 17 aa, Staphylococcus aureus
YMFVAYLGTDPITGKQK

SEQ ID NO: 1703417 - protein, 18 aa, Staphylococcus aureus
YNDHKQLMLFKKDIDNIT

SEQ ID NO: 1703418 - protein, 17 aa, Staphylococcus aureus
YNIIWVWHYSDDYLGKI

SEQ ID NO: 1703419 - protein, 18 aa, Staphylococcus aureus
YNLFFPYVEKMYITKIHH

SEQ ID NO: 1703420 - protein, 19 aa, Staphylococcus aureus
YPHMTVFENMAFGLKLRKV

SEQ ID NO: 1703421 - protein, 20 aa, Staphylococcus aureus
YPIILFYKRNINHLSYSHTL

SEQ ID NO: 1703422 - protein, 24 aa, Staphylococcus aureus
YRLEFYRLYLLMVHLLKFGEMYRD

SEQ ID NO: 1703423 - protein, 17 aa, Staphylococcus aureus
YRRMVIIPMLRKFGKGG

SEQ ID NO: 1703424 - protein, 17 aa, Staphylococcus aureus
YSYIFDTLKKNKQEFLK

SEQ ID NO: 1703425 - protein, 19 aa, Staphylococcus aureus
YTKYKISGTWYPFYKKMTA

SEQ ID NO: 1703426 - protein, 19 aa, Staphylococcus aureus
YVGRGMLFLDLIQEGNMGL

SEQ ID NO: 1703427 - protein, 17 aa, Staphylococcus aureus
YVLYPGLSKDVFKSKAS

SEQ ID NO: 1703428 - protein, 19 aa, Staphylococcus aureus
YVVVEYPYFTPIPDSQLNK

SEQ ID NO: 1703429 - protein, 17 aa, Staphylococcus aureus
YYMYKKFGIWPEKEYAI

SEQ ID NO: 1703430 - protein, 17 aa, Staphylococcus aureus
YYYNIFVQKVFLKAIDS

SEQ ID NO: 1703431 - protein, 6 aa, Staphylococcus aureus
KKYNKD

SEQ ID NO: 1703432 - protein, 6 aa, Staphylococcus aureus
KYGTTY

SEQ ID NO: 1703433 - protein, 4 aa, Staphylococcus aureus
GVGT

SEQ ID NO: 1703434 - protein, 6 aa, Staphylococcus aureus
VQAGDS

SEQ ID NO: 1703435 - protein, 11 aa, Staphylococcus aureus
HEKGSSDTSEF

SEQ ID NO: 1703436 - protein, 10 aa, Staphylococcus aureus
YDIPTNKAPK

SEQ ID NO: 1703437 - protein, 7 aa, Staphylococcus aureus
RVDYGAA

SEQ ID NO: 1703438 - protein, 11 aa, Staphylococcus aureus
YAPKNQNEEFQ

SEQ ID NO: 1703439 - protein, 7 aa, Staphylococcus aureus
NGKSGWV

SEQ ID NO: 1703440 - protein, 7 aa, Staphylococcus aureus
AQKEKYD

SEQ ID NO: 1703441 - protein, 6 aa, Staphylococcus aureus
NGGKYT

SEQ ID NO: 1703442 - protein, 9 aa, Staphylococcus aureus
NQDKTLTAK

SEQ ID NO: 1703443 - protein, 17 aa, Staphylococcus aureus
DKEGYRDDQFDKNDKGT

SEQ ID NO: 1703444 - protein, 13 aa, Staphylococcus aureus
VGQGFQPPAEKDA

SEQ ID NO: 1703445 - protein, 7 aa, Staphylococcus aureus
DYPGKED

SEQ ID NO: 1703446 - protein, 4 aa, Staphylococcus aureus
GSYI

SEQ ID NO: 1703447 - protein, 10 aa, Staphylococcus aureus
HKDKIAKRGE

SEQ ID NO: 1703448 - protein, 20 aa, Staphylococcus aureus
LSKYKDGDISYNPEVPSYSA

SEQ ID NO: 1703449 - protein, 16 aa, Staphylococcus aureus
EIKAHPNGFYNNGGGL

SEQ ID NO: 1703450 - protein, 11 aa, Staphylococcus aureus
KYQLTNDDYNV

SEQ ID NO: 1703451 - protein, 4 aa, Staphylococcus aureus
YEST

SEQ ID NO: 1703452 - protein, 8 aa, Staphylococcus aureus
YPNPNGNK

SEQ ID NO: 1703453 - protein, 13 aa, Staphylococcus aureus
EEKSTQPKGRKFK

SEQ ID NO: 1703454 - protein, 4 aa, Staphylococcus aureus
KKEI

SEQ ID NO: 1703455 - protein, 10 aa, Staphylococcus aureus
ASEAKENEPI

SEQ ID NO: 1703456 - protein, 6 aa, Staphylococcus aureus
NGTSQN

SEQ ID NO: 1703457 - protein, 7 aa, Staphylococcus aureus
NTRTTKG

SEQ ID NO: 1703458 - protein, 5 aa, Staphylococcus aureus
KGENI

SEQ ID NO: 1703459 - protein, 8 aa, Staphylococcus aureus
ESWTQKPK

SEQ ID NO: 1703460 - protein, 6 aa, Staphylococcus aureus
GGYKSS

SEQ ID NO: 1703461 - protein, 8 aa, Staphylococcus aureus
IAPTVSTD

SEQ ID NO: 1703462 - protein, 5 aa, Staphylococcus aureus
KESIP

SEQ ID NO: 1703463 - protein, 17 aa, Staphylococcus aureus
LKDTKIVGQEPAPNLEE

SEQ ID NO: 1703464 - protein, 8 aa, Staphylococcus aureus
RNTRTAKG

SEQ ID NO: 1703465 - protein, 10 aa, Staphylococcus aureus
SDPNAKDAAL

SEQ ID NO: 1703466 - protein, 4 aa, Staphylococcus aureus
TTKL

SEQ ID NO: 1703467 - protein, 10 aa, Staphylococcus aureus
VKNNQVSDDL

SEQ ID NO: 1703468 - protein, 29 aa, Staphylococcus aureus
ASDQSDNEDHHTSTGIHAPKSAKKLETKD

SEQ ID NO: 1703469 - protein, 6 aa, Staphylococcus aureus
ASLTDV

SEQ ID NO: 1703470 - protein, 6 aa, Staphylococcus aureus
ASYEND

SEQ ID NO: 1703471 - protein, 15 aa, Staphylococcus aureus
DAQASTQHTVQSGES

SEQ ID NO: 1703472 - protein, 9 aa, Staphylococcus aureus
DKDLDNKTY

SEQ ID NO: 1703473 - protein, 10 aa, Staphylococcus aureus
DKNSVGLPNS

SEQ ID NO: 1703474 - protein, 7 aa, Staphylococcus aureus
DKQSETG

SEQ ID NO: 1703475 - protein, 7 aa, Staphylococcus aureus
DLDPKID

SEQ ID NO: 1703476 - protein, 8 aa, Staphylococcus aureus
DNSPYQGY

SEQ ID NO: 1703477 - protein, 13 aa, Staphylococcus aureus
DSIGKEGTKGDSY

SEQ ID NO: 1703478 - protein, 14 aa, Staphylococcus aureus
DSNGDYHHTPDGNW

SEQ ID NO: 1703479 - protein, 11 aa, Staphylococcus aureus
ENNIPKEYKKP

SEQ ID NO: 1703480 - protein, 10 aa, Staphylococcus aureus
EQAGKSLKDK

SEQ ID NO: 1703481 - protein, 12 aa, Staphylococcus aureus
GEEGNKDKQDPH

SEQ ID NO: 1703482 - protein, 25 aa, Staphylococcus aureus
GNDTPKDETKSTESNTNQDTNTTKD

SEQ ID NO: 1703483 - protein, 5 aa, Staphylococcus aureus
GNHDL

SEQ ID NO: 1703484 - protein, 18 aa, Staphylococcus aureus
GQDPHEYEVKPKDIKKLT

SEQ ID NO: 1703485 - protein, 15 aa, Staphylococcus aureus
GTGGKQSSDKSNGKL

SEQ ID NO: 1703486 - protein, 23 aa, Staphylococcus aureus
GVPTKSEVAQKSSKVEVKGERPT

SEQ ID NO: 1703487 - protein, 7 aa, Staphylococcus aureus
IDNETDK

SEQ ID NO: 1703488 - protein, 12 aa, Staphylococcus aureus
IPASEVSSYAFI

SEQ ID NO: 1703489 - protein, 17 aa, Staphylococcus aureus
KASTQNEADVKQTYKQI

SEQ ID NO: 1703490 - protein, 12 aa, Staphylococcus aureus
KKAHKGTKISAL

SEQ ID NO: 1703491 - protein, 24 aa, Staphylococcus aureus
KKGNKKQEVTVDAKNGKVLKSEQD

SEQ ID NO: 1703492 - protein, 7 aa, Staphylococcus aureus
KRFEGAK

SEQ ID NO: 1703493 - protein, 13 aa, Staphylococcus aureus
LASEFKKEHKNAD

SEQ ID NO: 1703494 - protein, 7 aa, Staphylococcus aureus
LEKDDGK

SEQ ID NO: 1703495 - protein, 5 aa, Staphylococcus aureus
LENAG

SEQ ID NO: 1703496 - protein, 6 aa, Staphylococcus aureus
LETGNG

SEQ ID NO: 1703497 - protein, 12 aa, Staphylococcus aureus
MGTTEIKGKPKR

SEQ ID NO: 1703498 - protein, 9 aa, Staphylococcus aureus
MPENSPVYS

SEQ ID NO: 1703499 - protein, 16 aa, Staphylococcus aureus
NDKKHKADYEKQGNKY

SEQ ID NO: 1703500 - protein, 18 aa, Staphylococcus aureus
NHTPSKGAILQSSEGPFG

SEQ ID NO: 1703501 - protein, 6 aa, Staphylococcus aureus
NNDMAQ

SEQ ID NO: 1703502 - protein, 7 aa, Staphylococcus aureus
NVGGDNV

SEQ ID NO: 1703503 - protein, 8 aa, Staphylococcus aureus
QDGEIPTL

SEQ ID NO: 1703504 - protein, 5 aa, Staphylococcus aureus
QESEA

SEQ ID NO: 1703505 - protein, 26 aa, Staphylococcus aureus
QIPNGGSGGTTPTATTGSNGNASSFN

SEQ ID NO: 1703506 - protein, 17 aa, Staphylococcus aureus
QPDYGSYRTQRQAGNYD

SEQ ID NO: 1703507 - protein, 8 aa, Staphylococcus aureus
QSTPGPYG

SEQ ID NO: 1703508 - protein, 11 aa, Staphylococcus aureus
RAQAGSPISTY

SEQ ID NO: 1703509 - protein, 5 aa, Staphylococcus aureus
RDVLT

SEQ ID NO: 1703510 - protein, 14 aa, Staphylococcus aureus
RNKDLQKQVDNGKD

SEQ ID NO: 1703511 - protein, 7 aa, Staphylococcus aureus
RSEPVAE

SEQ ID NO: 1703512 - protein, 9 aa, Staphylococcus aureus
SFENSNGEW

SEQ ID NO: 1703513 - protein, 4 aa, Staphylococcus aureus
SGAA

SEQ ID NO: 1703514 - protein, 8 aa, Staphylococcus aureus
SGRIDGAS

SEQ ID NO: 1703515 - protein, 14 aa, Staphylococcus aureus
SKENNHKYSSFGKP

SEQ ID NO: 1703516 - protein, 9 aa, Staphylococcus aureus
SSTGSNSLL

SEQ ID NO: 1703517 - protein, 9 aa, Staphylococcus aureus
SVNSDGSVT

SEQ ID NO: 1703518 - protein, 7 aa, Staphylococcus aureus
SYQPQNK

SEQ ID NO: 1703519 - protein, 10 aa, Staphylococcus aureus
TEKQGTPEQM

SEQ ID NO: 1703520 - protein, 15 aa, Staphylococcus aureus
TKYAGDVNKKQQDKI

SEQ ID NO: 1703521 - protein, 26 aa, Staphylococcus aureus
TVSAGDKVKAGDQIAYSGSTGNSTAP

SEQ ID NO: 1703522 - protein, 16 aa, Staphylococcus aureus
VDKKAMESLSEETKKD

SEQ ID NO: 1703523 - protein, 16 aa, Staphylococcus aureus
VKKTESEWTSSKEWKN

SEQ ID NO: 1703524 - protein, 21 aa, Staphylococcus aureus
VKTSPEDAVKKAEETYKGQKL

SEQ ID NO: 1703525 - protein, 6 aa, Staphylococcus aureus
VNGDGS

SEQ ID NO: 1703526 - protein, 5 aa, Staphylococcus aureus
VSTNY

SEQ ID NO: 1703527 - protein, 5 aa, Staphylococcus aureus
WGRKG

SEQ ID NO: 1703528 - protein, 9 aa, Staphylococcus aureus
YKQNKKIDT

SEQ ID NO: 1703529 - protein, 25 aa, Staphylococcus aureus
YSGGPFSVSSRTISASEAGNYNYIH

SEQ ID NO: 1703530 - protein, 7 aa, Staphylococcus aureus
AAGPYGH

SEQ ID NO: 1703531 - protein, 14 aa, Staphylococcus aureus
AEADPTDDVEGVDA

SEQ ID NO: 1703532 - protein, 5 aa, Staphylococcus aureus
AEENG

SEQ ID NO: 1703533 - protein, 6 aa, Staphylococcus aureus
AIPNDT

SEQ ID NO: 1703534 - protein, 7 aa, Staphylococcus aureus
AKYETQL

SEQ ID NO: 1703535 - protein, 6 aa, Staphylococcus aureus
AQLGRS

SEQ ID NO: 1703536 - protein, 20 aa, Staphylococcus aureus
AQMAQSNDQTLNQKPIEAGA

SEQ ID NO: 1703537 - protein, 9 aa, Staphylococcus aureus
AQRESGGNI

SEQ ID NO: 1703538 - protein, 5 aa, Staphylococcus aureus
ARENN

SEQ ID NO: 1703539 - protein, 5 aa, Staphylococcus aureus
AWTSY

SEQ ID NO: 1703540 - protein, 9 aa, Staphylococcus aureus
DAPAGKGPD

SEQ ID NO: 1703541 - protein, 14 aa, Staphylococcus aureus
DARNTVKKDQPNVF

SEQ ID NO: 1703542 - protein, 8 aa, Staphylococcus aureus
DDGAETDL

SEQ ID NO: 1703543 - protein, 6 aa, Staphylococcus aureus
DERQTV

SEQ ID NO: 1703544 - protein, 8 aa, Staphylococcus aureus
DKETENKI

SEQ ID NO: 1703545 - protein, 9 aa, Staphylococcus aureus
DKSKKRPLN

SEQ ID NO: 1703546 - protein, 8 aa, Staphylococcus aureus
DPGTMSPY

SEQ ID NO: 1703547 - protein, 15 aa, Staphylococcus aureus
DRARDKKSVPNNNTY

SEQ ID NO: 1703548 - protein, 25 aa, Staphylococcus aureus
DRDKEKDLKATQKNLKQQGIPQAKK

SEQ ID NO: 1703549 - protein, 8 aa, Staphylococcus aureus
DRHPTRGS

SEQ ID NO: 1703550 - protein, 39 aa, Staphylococcus aureus
DSHTPPQTSPSNPLTPAIPNVEDNDDELNNAFSKDNKGL

SEQ ID NO: 1703551 - protein, 16 aa, Staphylococcus aureus
DTLQKYTDEMSEITGR

SEQ ID NO: 1703552 - protein, 8 aa, Staphylococcus aureus
DVTSTAGY

SEQ ID NO: 1703553 - protein, 5 aa, Staphylococcus aureus
EDTDA

SEQ ID NO: 1703554 - protein, 8 aa, Staphylococcus aureus
EEAVDPDD

SEQ ID NO: 1703555 - protein, 8 aa, Staphylococcus aureus
EGHQDDKK

SEQ ID NO: 1703556 - protein, 11 aa, Staphylococcus aureus
EGYTETKDSNF

SEQ ID NO: 1703557 - protein, 5 aa, Staphylococcus aureus
EINIK

SEQ ID NO: 1703558 - protein, 8 aa, Staphylococcus aureus
EKYPNESF

SEQ ID NO: 1703559 - protein, 9 aa, Staphylococcus aureus
ENRQQIQDT

SEQ ID NO: 1703560 - protein, 6 aa, Staphylococcus aureus
EQIGGK

SEQ ID NO: 1703561 - protein, 6 aa, Staphylococcus aureus
EQVHTN

SEQ ID NO: 1703562 - protein, 7 aa, Staphylococcus aureus
ESSPEEL

SEQ ID NO: 1703563 - protein, 6 aa, Staphylococcus aureus
ETSLSG

SEQ ID NO: 1703564 - protein, 11 aa, Staphylococcus aureus
FDKEDGDLTDK

SEQ ID NO: 1703565 - protein, 13 aa, Staphylococcus aureus
GCANDDGIYSDKG

SEQ ID NO: 1703566 - protein, 7 aa, Staphylococcus aureus
GESTNAD

SEQ ID NO: 1703567 - protein, 17 aa, Staphylococcus aureus
GGIGNQYAVDPTSYLQS

SEQ ID NO: 1703568 - protein, 8 aa, Staphylococcus aureus
GKGDKPVL

SEQ ID NO: 1703569 - protein, 15 aa, Staphylococcus aureus
GKKESATTSSKNGKP

SEQ ID NO: 1703570 - protein, 11 aa, Staphylococcus aureus
GNKEKEAQHQF

SEQ ID NO: 1703571 - protein, 31 aa, Staphylococcus aureus
GNQGEKNNKAETKSYKMDDGKTVDIPKDPKR

SEQ ID NO: 1703572 - protein, 15 aa, Staphylococcus aureus
HSYEPTQKDILSASK

SEQ ID NO: 1703573 - protein, 13 aa, Staphylococcus aureus
IEGPGDKPTTQSF

SEQ ID NO: 1703574 - protein, 8 aa, Staphylococcus aureus
IKPSGYQE

SEQ ID NO: 1703575 - protein, 7 aa, Staphylococcus aureus
IPAPGDI

SEQ ID NO: 1703576 - protein, 8 aa, Staphylococcus aureus
IPSTNTSV

SEQ ID NO: 1703577 - protein, 7 aa, Staphylococcus aureus
IYPAGTD

SEQ ID NO: 1703578 - protein, 7 aa, Staphylococcus aureus
KAKPVYG

SEQ ID NO: 1703579 - protein, 8 aa, Staphylococcus aureus
KERRGDYL

SEQ ID NO: 1703580 - protein, 8 aa, Staphylococcus aureus
KGIKNAGQ

SEQ ID NO: 1703581 - protein, 11 aa, Staphylococcus aureus
KKIEENGELAK

SEQ ID NO: 1703582 - protein, 9 aa, Staphylococcus aureus
KKQKPNAKI

SEQ ID NO: 1703583 - protein, 20 aa, Staphylococcus aureus
KLNPKKDSIAVESAKDNPYA

SEQ ID NO: 1703584 - protein, 5 aa, Staphylococcus aureus
KNGRK

SEQ ID NO: 1703585 - protein, 8 aa, Staphylococcus aureus
KNNKQNTE

SEQ ID NO: 1703586 - protein, 16 aa, Staphylococcus aureus
KPITYEAGATSDSKLA

SEQ ID NO: 1703587 - protein, 7 aa, Staphylococcus aureus
KRRGISG

SEQ ID NO: 1703588 - protein, 7 aa, Staphylococcus aureus
KSKEGHK

SEQ ID NO: 1703589 - protein, 12 aa, Staphylococcus aureus
KVGKEKQDVDQF

SEQ ID NO: 1703590 - protein, 11 aa, Staphylococcus aureus
KVSKKDRKAFA

SEQ ID NO: 1703591 - protein, 12 aa, Staphylococcus aureus
LGEPLSKMAVIT

SEQ ID NO: 1703592 - protein, 17 aa, Staphylococcus aureus
LNNDSKDKFNDIPKEQR

SEQ ID NO: 1703593 - protein, 4 aa, Staphylococcus aureus
LNNL

SEQ ID NO: 1703594 - protein, 12 aa, Staphylococcus aureus
LNTEKKDKGYKI

SEQ ID NO: 1703595 - protein, 7 aa, Staphylococcus aureus
LPKDSQL

SEQ ID NO: 1703596 - protein, 4 aa, Staphylococcus aureus
MTQD

SEQ ID NO: 1703597 - protein, 14 aa, Staphylococcus aureus
NASDISTGKKPVEQ

SEQ ID NO: 1703598 - protein, 4 aa, Staphylococcus aureus
NEGN

SEQ ID NO: 1703599 - protein, 7 aa, Staphylococcus aureus
NGLNANN

SEQ ID NO: 1703600 - protein, 6 aa, Staphylococcus aureus
NLDPVA

SEQ ID NO: 1703601 - protein, 6 aa, Staphylococcus aureus
NNLYTA

SEQ ID NO: 1703602 - protein, 7 aa, Staphylococcus aureus
NQISGHS

SEQ ID NO: 1703603 - protein, 6 aa, Staphylococcus aureus
NSAEAK

SEQ ID NO: 1703604 - protein, 6 aa, Staphylococcus aureus
NTGSAY

SEQ ID NO: 1703605 - protein, 21 aa, Staphylococcus aureus
NTKDVDALKDKNKAHDTYKYA

SEQ ID NO: 1703606 - protein, 7 aa, Staphylococcus aureus
NYENTNH

SEQ ID NO: 1703607 - protein, 5 aa, Staphylococcus aureus
PAEMP

SEQ ID NO: 1703608 - protein, 10 aa, Staphylococcus aureus
QARHAEPMPN

SEQ ID NO: 1703609 - protein, 5 aa, Staphylococcus aureus
QETFG

SEQ ID NO: 1703610 - protein, 20 aa, Staphylococcus aureus
QNDATQQGVNEKSKAIEQNY

SEQ ID NO: 1703611 - protein, 8 aa, Staphylococcus aureus
QQVDQSKV

SEQ ID NO: 1703612 - protein, 8 aa, Staphylococcus aureus
RASEGKIS

SEQ ID NO: 1703613 - protein, 14 aa, Staphylococcus aureus
RGVTPEKIRNAKSA

SEQ ID NO: 1703614 - protein, 10 aa, Staphylococcus aureus
RKTNEQFEES

SEQ ID NO: 1703615 - protein, 7 aa, Staphylococcus aureus
RPNRPHP

SEQ ID NO: 1703616 - protein, 8 aa, Staphylococcus aureus
RQSVNADS

SEQ ID NO: 1703617 - protein, 8 aa, Staphylococcus aureus
RSTHYGNS

SEQ ID NO: 1703618 - protein, 12 aa, Staphylococcus aureus
RTEDKTSNKWGV

SEQ ID NO: 1703619 - protein, 4 aa, Staphylococcus aureus
SAGI

SEQ ID NO: 1703620 - protein, 10 aa, Staphylococcus aureus
SAKNLPDDTM

SEQ ID NO: 1703621 - protein, 6 aa, Staphylococcus aureus
SDLGRE

SEQ ID NO: 1703622 - protein, 6 aa, Staphylococcus aureus
SDSESV

SEQ ID NO: 1703623 - protein, 7 aa, Staphylococcus aureus
SFQEAVD

SEQ ID NO: 1703624 - protein, 8 aa, Staphylococcus aureus
SGTSPDGR

SEQ ID NO: 1703625 - protein, 5 aa, Staphylococcus aureus
SGVEA

SEQ ID NO: 1703626 - protein, 34 aa, Staphylococcus aureus
SKEAQKALQEDVKDGEKPVNLSKDEIKAIETSLA

SEQ ID NO: 1703627 - protein, 6 aa, Staphylococcus aureus
SNVTAG

SEQ ID NO: 1703628 - protein, 11 aa, Staphylococcus aureus
SPGASANSLGF

SEQ ID NO: 1703629 - protein, 16 aa, Staphylococcus aureus
SQNAGTLEAKAKPLEK

SEQ ID NO: 1703630 - protein, 14 aa, Staphylococcus aureus
SSRTILNPGKYNYI

SEQ ID NO: 1703631 - protein, 22 aa, Staphylococcus aureus
SVAPAKYKGVSPANAPESVQDA

SEQ ID NO: 1703632 - protein, 9 aa, Staphylococcus aureus
SVNPNGTIT

SEQ ID NO: 1703633 - protein, 13 aa, Staphylococcus aureus
SVRPDMDKDFQEK

SEQ ID NO: 1703634 - protein, 8 aa, Staphylococcus aureus
TDKTREMM

SEQ ID NO: 1703635 - protein, 8 aa, Staphylococcus aureus
TDQSMPRE

SEQ ID NO: 1703636 - protein, 27 aa, Staphylococcus aureus
TNEAMNKADELTQERLGKHTQGLNIPG

SEQ ID NO: 1703637 - protein, 9 aa, Staphylococcus aureus
TNIPKKHKK

SEQ ID NO: 1703638 - protein, 11 aa, Staphylococcus aureus
TQPGETDGYSV

SEQ ID NO: 1703639 - protein, 10 aa, Staphylococcus aureus
TSKITGEEEI

SEQ ID NO: 1703640 - protein, 9 aa, Staphylococcus aureus
TVDPKTGSE

SEQ ID NO: 1703641 - protein, 4 aa, Staphylococcus aureus
TVGS

SEQ ID NO: 1703642 - protein, 6 aa, Staphylococcus aureus
TYAGGL

SEQ ID NO: 1703643 - protein, 19 aa, Staphylococcus aureus
VAATQANAATTHTVKPGES

SEQ ID NO: 1703644 - protein, 7 aa, Staphylococcus aureus
VGPYEDT

SEQ ID NO: 1703645 - protein, 14 aa, Staphylococcus aureus
VKEDGSASKELVDS

SEQ ID NO: 1703646 - protein, 10 aa, Staphylococcus aureus
VNPTSGAAGK

SEQ ID NO: 1703647 - protein, 8 aa, Staphylococcus aureus
VSEKSVKS

SEQ ID NO: 1703648 - protein, 20 aa, Staphylococcus aureus
WSNYGGGNQVTIKEANSNNY

SEQ ID NO: 1703649 - protein, 7 aa, Staphylococcus aureus
YASGKND

SEQ ID NO: 1703650 - protein, 16 aa, Staphylococcus aureus
YGGSGALRKQIESGAP

SEQ ID NO: 1703651 - protein, 5 aa, Staphylococcus aureus
AATKP

SEQ ID NO: 1703652 - protein, 12 aa, Staphylococcus aureus
AENKIEDIGQGA

SEQ ID NO: 1703653 - protein, 4 aa, Staphylococcus aureus
AGGF

SEQ ID NO: 1703654 - protein, 6 aa, Staphylococcus aureus
AIPGDD

SEQ ID NO: 1703655 - protein, 9 aa, Staphylococcus aureus
AKKELGKNE

SEQ ID NO: 1703656 - protein, 8 aa, Staphylococcus aureus
AKQAGWDT

SEQ ID NO: 1703657 - protein, 6 aa, Staphylococcus aureus
ALKDNK

SEQ ID NO: 1703658 - protein, 10 aa, Staphylococcus aureus
ANSYNGGDFE

SEQ ID NO: 1703659 - protein, 7 aa, Staphylococcus aureus
APPYSHP

SEQ ID NO: 1703660 - protein, 6 aa, Staphylococcus aureus
ATANTI

SEQ ID NO: 1703661 - protein, 10 aa, Staphylococcus aureus
AVGDRSDDKH

SEQ ID NO: 1703662 - protein, 14 aa, Staphylococcus aureus
CGQKDTEEKTEMTT

SEQ ID NO: 1703663 - protein, 9 aa, Staphylococcus aureus
DAQQTARAL

SEQ ID NO: 1703664 - protein, 19 aa, Staphylococcus aureus
DASRPIKDEEKQKLQDKNI

SEQ ID NO: 1703665 - protein, 14 aa, Staphylococcus aureus
DDEDKWKVIETFKL

SEQ ID NO: 1703666 - protein, 7 aa, Staphylococcus aureus
DEGKENV

SEQ ID NO: 1703667 - protein, 14 aa, Staphylococcus aureus
DELGTEKIKKNPKR

SEQ ID NO: 1703668 - protein, 7 aa, Staphylococcus aureus
DERMPDL

SEQ ID NO: 1703669 - protein, 13 aa, Staphylococcus aureus
DGHSNITEASLKS

SEQ ID NO: 1703670 - protein, 6 aa, Staphylococcus aureus
DKGEID

SEQ ID NO: 1703671 - protein, 5 aa, Staphylococcus aureus
DKLND

SEQ ID NO: 1703672 - protein, 11 aa, Staphylococcus aureus
DKTGKATNEVQ

SEQ ID NO: 1703673 - protein, 11 aa, Staphylococcus aureus
DKTGKPTKEVQ

SEQ ID NO: 1703674 - protein, 18 aa, Staphylococcus aureus
DLNTSNIVSSKESFGITE

SEQ ID NO: 1703675 - protein, 8 aa, Staphylococcus aureus
DNDPLREG

SEQ ID NO: 1703676 - protein, 7 aa, Staphylococcus aureus
DSAGGQI

SEQ ID NO: 1703677 - protein, 7 aa, Staphylococcus aureus
DSNEAME

SEQ ID NO: 1703678 - protein, 18 aa, Staphylococcus aureus
DTGNEQRQDLEKVEKAIN

SEQ ID NO: 1703679 - protein, 7 aa, Staphylococcus aureus
DVKPTDV

SEQ ID NO: 1703680 - protein, 10 aa, Staphylococcus aureus
DWKQEDKTLL

SEQ ID NO: 1703681 - protein, 31 aa, Staphylococcus aureus
DYKTKDSKSWKAAEKDKKIAKDNHIKTTPTA

SEQ ID NO: 1703682 - protein, 6 aa, Staphylococcus aureus
EDVKHD

SEQ ID NO: 1703683 - protein, 6 aa, Staphylococcus aureus
EEHNGN

SEQ ID NO: 1703684 - protein, 7 aa, Staphylococcus aureus
EENPSEI

SEQ ID NO: 1703685 - protein, 12 aa, Staphylococcus aureus
EETKQQILTELQ

SEQ ID NO: 1703686 - protein, 5 aa, Staphylococcus aureus
EHKTS

SEQ ID NO: 1703687 - protein, 5 aa, Staphylococcus aureus
EKETG

SEQ ID NO: 1703688 - protein, 15 aa, Staphylococcus aureus
EKLGKGKTLKHGDDV

SEQ ID NO: 1703689 - protein, 6 aa, Staphylococcus aureus
EKRSVK

SEQ ID NO: 1703690 - protein, 7 aa, Staphylococcus aureus
ERAHGNE

SEQ ID NO: 1703691 - protein, 9 aa, Staphylococcus aureus
ESARGEGGR

SEQ ID NO: 1703692 - protein, 16 aa, Staphylococcus aureus
ESDSGRSALAKSPNHN

SEQ ID NO: 1703693 - protein, 9 aa, Staphylococcus aureus
ESPGASTSV

SEQ ID NO: 1703694 - protein, 7 aa, Staphylococcus aureus
ESQARGL

SEQ ID NO: 1703695 - protein, 4 aa, Staphylococcus aureus
ESVD

SEQ ID NO: 1703696 - protein, 6 aa, Staphylococcus aureus
ETAKKY

SEQ ID NO: 1703697 - protein, 18 aa, Staphylococcus aureus
ETEDIENYAQQKLRKKNA

SEQ ID NO: 1703698 - protein, 16 aa, Staphylococcus aureus
ETGNGTSQLAKGADVV

SEQ ID NO: 1703699 - protein, 5 aa, Staphylococcus aureus
FHPTY

SEQ ID NO: 1703700 - protein, 6 aa, Staphylococcus aureus
FSPSRT

SEQ ID NO: 1703701 - protein, 8 aa, Staphylococcus aureus
FSSDDNEL

SEQ ID NO: 1703702 - protein, 23 aa, Staphylococcus aureus
GASATDSKENTLISSKAGDVTVA

SEQ ID NO: 1703703 - protein, 9 aa, Staphylococcus aureus
GDDDSARGI

SEQ ID NO: 1703704 - protein, 12 aa, Staphylococcus aureus
GEMKTKPTQHSV

SEQ ID NO: 1703705 - protein, 4 aa, Staphylococcus aureus
GGAI

SEQ ID NO: 1703706 - protein, 6 aa, Staphylococcus aureus
GGATCA

SEQ ID NO: 1703707 - protein, 4 aa, Staphylococcus aureus
GHDQ

SEQ ID NO: 1703708 - protein, 4 aa, Staphylococcus aureus
GING

SEQ ID NO: 1703709 - protein, 13 aa, Staphylococcus aureus
GIYNGGGKAEGPY

SEQ ID NO: 1703710 - protein, 12 aa, Staphylococcus aureus
GKATEKEWREND

SEQ ID NO: 1703711 - protein, 12 aa, Staphylococcus aureus
GKSQEKATLEKD

SEQ ID NO: 1703712 - protein, 8 aa, Staphylococcus aureus
GLESPGHS

SEQ ID NO: 1703713 - protein, 10 aa, Staphylococcus aureus
GMDKDEAKKL

SEQ ID NO: 1703714 - protein, 6 aa, Staphylococcus aureus
GNDKDL

SEQ ID NO: 1703715 - protein, 8 aa, Staphylococcus aureus
GNKNSRVD

SEQ ID NO: 1703716 - protein, 27 aa, Staphylococcus aureus
GNSSSLDNQKNASNDSDSKSGGYKPKE

SEQ ID NO: 1703717 - protein, 5 aa, Staphylococcus aureus
GPNNS

SEQ ID NO: 1703718 - protein, 13 aa, Staphylococcus aureus
GQDSSDTVRTREE

SEQ ID NO: 1703719 - protein, 8 aa, Staphylococcus aureus
GQNAAPVA

SEQ ID NO: 1703720 - protein, 8 aa, Staphylococcus aureus
GQTDKDFE

SEQ ID NO: 1703721 - protein, 27 aa, Staphylococcus aureus
GRDDKSVKNNTIDRTAPTGSKSELQRE

SEQ ID NO: 1703722 - protein, 5 aa, Staphylococcus aureus
GRMEE

SEQ ID NO: 1703723 - protein, 4 aa, Staphylococcus aureus
GSGF

SEQ ID NO: 1703724 - protein, 7 aa, Staphylococcus aureus
GSIENFE

SEQ ID NO: 1703725 - protein, 6 aa, Staphylococcus aureus
GSSTIQ

SEQ ID NO: 1703726 - protein, 6 aa, Staphylococcus aureus
GTANAL

SEQ ID NO: 1703727 - protein, 8 aa, Staphylococcus aureus
GTGDYNAN

SEQ ID NO: 1703728 - protein, 4 aa, Staphylococcus aureus
GTLD

SEQ ID NO: 1703729 - protein, 27 aa, Staphylococcus aureus
GTSKQVAGSVSGSGNQTFKASKQQQID

SEQ ID NO: 1703730 - protein, 21 aa, Staphylococcus aureus
GVTQETANLEYKDQSGALNES

SEQ ID NO: 1703731 - protein, 12 aa, Staphylococcus aureus
GWGPTNTVDQQI

SEQ ID NO: 1703732 - protein, 9 aa, Staphylococcus aureus
GWSADYPDP

SEQ ID NO: 1703733 - protein, 13 aa, Staphylococcus aureus
GYAITEADASTRI

SEQ ID NO: 1703734 - protein, 14 aa, Staphylococcus aureus
HQDQLNAAPIKDGA

SEQ ID NO: 1703735 - protein, 26 aa, Staphylococcus aureus
IAELDEKKKKLTEDVNSKDTAVRGKA

SEQ ID NO: 1703736 - protein, 6 aa, Staphylococcus aureus
IAGNDT

SEQ ID NO: 1703737 - protein, 4 aa, Staphylococcus aureus
IENI

SEQ ID NO: 1703738 - protein, 5 aa, Staphylococcus aureus
IETFG

SEQ ID NO: 1703739 - protein, 8 aa, Staphylococcus aureus
IGGTTGDI

SEQ ID NO: 1703740 - protein, 6 aa, Staphylococcus aureus
IRDSNA

SEQ ID NO: 1703741 - protein, 14 aa, Staphylococcus aureus
ISDSEIKEDSKKAS

SEQ ID NO: 1703742 - protein, 18 aa, Staphylococcus aureus
ISNGLSGGLNGNTAFSET

SEQ ID NO: 1703743 - protein, 5 aa, Staphylococcus aureus
ISSEE

SEQ ID NO: 1703744 - protein, 9 aa, Staphylococcus aureus
ISSEVTAQT

SEQ ID NO: 1703745 - protein, 7 aa, Staphylococcus aureus
KAAKKGS

SEQ ID NO: 1703746 - protein, 6 aa, Staphylococcus aureus
KAGQNT

SEQ ID NO: 1703747 - protein, 26 aa, Staphylococcus aureus
KALDSGVKVKDDKAESKHDKAISDGY

SEQ ID NO: 1703748 - protein, 11 aa, Staphylococcus aureus
KAVKDNKVYDV

SEQ ID NO: 1703749 - protein, 16 aa, Staphylococcus aureus
KDEQVKDRELSDYAGE

SEQ ID NO: 1703750 - protein, 9 aa, Staphylococcus aureus
KDGNQPRAL

SEQ ID NO: 1703751 - protein, 8 aa, Staphylococcus aureus
KEASLGGN

SEQ ID NO: 1703752 - protein, 15 aa, Staphylococcus aureus
KEPVYPGPATPEQLN

SEQ ID NO: 1703753 - protein, 8 aa, Staphylococcus aureus
KGDQSLEN

SEQ ID NO: 1703754 - protein, 13 aa, Staphylococcus aureus
KHRGLKEKDKMDD

SEQ ID NO: 1703755 - protein, 7 aa, Staphylococcus aureus
KIEQSTL

SEQ ID NO: 1703756 - protein, 8 aa, Staphylococcus aureus
KIRNGGTH

SEQ ID NO: 1703757 - protein, 9 aa, Staphylococcus aureus
KKDKKLSDD

SEQ ID NO: 1703758 - protein, 7 aa, Staphylococcus aureus
KKSDGNY

SEQ ID NO: 1703759 - protein, 45 aa, Staphylococcus aureus
KNADDRLKEFEKEEDAIKKSEQDFKKAKSHVDNIDNDVKRKEVKQ

SEQ ID NO: 1703760 - protein, 5 aa, Staphylococcus aureus
KNGSN

SEQ ID NO: 1703761 - protein, 20 aa, Staphylococcus aureus
KNPTDRERGMQALSDFDCYI

SEQ ID NO: 1703762 - protein, 10 aa, Staphylococcus aureus
KPHSKDPRDY

SEQ ID NO: 1703763 - protein, 4 aa, Staphylococcus aureus
KPLN

SEQ ID NO: 1703764 - protein, 17 aa, Staphylococcus aureus
KQIDSQTKVTEKQAETL

SEQ ID NO: 1703765 - protein, 8 aa, Staphylococcus aureus
KQKPNESY

SEQ ID NO: 1703766 - protein, 7 aa, Staphylococcus aureus
KTATLGN

SEQ ID NO: 1703767 - protein, 19 aa, Staphylococcus aureus
KVEDPYDYESYEKLLKDKI

SEQ ID NO: 1703768 - protein, 11 aa, Staphylococcus aureus
KVEIDGDSNKY

SEQ ID NO: 1703769 - protein, 10 aa, Staphylococcus aureus
KVGKGKAAFI

SEQ ID NO: 1703770 - protein, 21 aa, Staphylococcus aureus
KWAQDHSDAKISAGQAGTGAG

SEQ ID NO: 1703771 - protein, 19 aa, Staphylococcus aureus
KYERSIKDYDDSSDEFKPF

SEQ ID NO: 1703772 - protein, 8 aa, Staphylococcus aureus
LAKHSKDL

SEQ ID NO: 1703773 - protein, 4 aa, Staphylococcus aureus
LANI

SEQ ID NO: 1703774 - protein, 11 aa, Staphylococcus aureus
LGGTDHADPHG

SEQ ID NO: 1703775 - protein, 9 aa, Staphylococcus aureus
LKEVSDKYT

SEQ ID NO: 1703776 - protein, 6 aa, Staphylococcus aureus
LNESSY

SEQ ID NO: 1703777 - protein, 13 aa, Staphylococcus aureus
LNKEQQKKDNITY

SEQ ID NO: 1703778 - protein, 11 aa, Staphylococcus aureus
LPNKALNDGDI

SEQ ID NO: 1703779 - protein, 6 aa, Staphylococcus aureus
LQTNRM

SEQ ID NO: 1703780 - protein, 10 aa, Staphylococcus aureus
LSDDVTKGLS

SEQ ID NO: 1703781 - protein, 5 aa, Staphylococcus aureus
LTNPQ

SEQ ID NO: 1703782 - protein, 7 aa, Staphylococcus aureus
LVQEGDK

SEQ ID NO: 1703783 - protein, 19 aa, Staphylococcus aureus
LYDEQTAEQVYEAWNEVGV

SEQ ID NO: 1703784 - protein, 6 aa, Staphylococcus aureus
MGGQTI

SEQ ID NO: 1703785 - protein, 48 aa, Staphylococcus aureus
NADRNLNRIDSSEAMNGYRRGAYEDMSKGMNAEEKSSTAMQGVKSSDW

SEQ ID NO: 1703786 - protein, 7 aa, Staphylococcus aureus
NAKSPVN

SEQ ID NO: 1703787 - protein, 6 aa, Staphylococcus aureus
NETRKY

SEQ ID NO: 1703788 - protein, 10 aa, Staphylococcus aureus
NGDPNNALSE

SEQ ID NO: 1703789 - protein, 4 aa, Staphylococcus aureus
NKLR

SEQ ID NO: 1703790 - protein, 6 aa, Staphylococcus aureus
NKPFPE

SEQ ID NO: 1703791 - protein, 7 aa, Staphylococcus aureus
NKRTQQN

SEQ ID NO: 1703792 - protein, 5 aa, Staphylococcus aureus
NNDGS

SEQ ID NO: 1703793 - protein, 9 aa, Staphylococcus aureus
NNPNGSYDD

SEQ ID NO: 1703794 - protein, 5 aa, Staphylococcus aureus
NQESV

SEQ ID NO: 1703795 - protein, 12 aa, Staphylococcus aureus
NQPPVKAMTEAA

SEQ ID NO: 1703796 - protein, 10 aa, Staphylococcus aureus
NRKGDGYEGF

SEQ ID NO: 1703797 - protein, 4 aa, Staphylococcus aureus
NSPT

SEQ ID NO: 1703798 - protein, 12 aa, Staphylococcus aureus
NTEDTPDAKISA

SEQ ID NO: 1703799 - protein, 10 aa, Staphylococcus aureus
PAHPGTHQYA

SEQ ID NO: 1703800 - protein, 12 aa, Staphylococcus aureus
PEQLPAKSKWSH

SEQ ID NO: 1703801 - protein, 8 aa, Staphylococcus aureus
PFKESEQA

SEQ ID NO: 1703802 - protein, 7 aa, Staphylococcus aureus
PFQNDSS

SEQ ID NO: 1703803 - protein, 5 aa, Staphylococcus aureus
PHQDY

SEQ ID NO: 1703804 - protein, 11 aa, Staphylococcus aureus
PMAGSHKSGVL

SEQ ID NO: 1703805 - protein, 4 aa, Staphylococcus aureus
PMVG

SEQ ID NO: 1703806 - protein, 7 aa, Staphylococcus aureus
PNYHGSY

SEQ ID NO: 1703807 - protein, 4 aa, Staphylococcus aureus
PQTN

SEQ ID NO: 1703808 - protein, 13 aa, Staphylococcus aureus
PSVDGVHAPDKEV

SEQ ID NO: 1703809 - protein, 5 aa, Staphylococcus aureus
PTKHD

SEQ ID NO: 1703810 - protein, 30 aa, Staphylococcus aureus
PTWKSEADSYKDATSHLSKTYATDPNYAKK

SEQ ID NO: 1703811 - protein, 17 aa, Staphylococcus aureus
QGGINGAVNTKGEGDSP

SEQ ID NO: 1703812 - protein, 6 aa, Staphylococcus aureus
QNEDAD

SEQ ID NO: 1703813 - protein, 13 aa, Staphylococcus aureus
QNMNAEDPSQKEL

SEQ ID NO: 1703814 - protein, 8 aa, Staphylococcus aureus
QPDGSIDI

SEQ ID NO: 1703815 - protein, 6 aa, Staphylococcus aureus
QPQNIS

SEQ ID NO: 1703816 - protein, 29 aa, Staphylococcus aureus
QQISDSKSKIKGLEKDKENSKKTASNNTK

SEQ ID NO: 1703817 - protein, 11 aa, Staphylococcus aureus
QSSEDSITPGE

SEQ ID NO: 1703818 - protein, 7 aa, Staphylococcus aureus
REDNPGI

SEQ ID NO: 1703819 - protein, 7 aa, Staphylococcus aureus
RENDDLK

SEQ ID NO: 1703820 - protein, 8 aa, Staphylococcus aureus
RETQGNNG

SEQ ID NO: 1703821 - protein, 14 aa, Staphylococcus aureus
RKQTSKDLELGYYE

SEQ ID NO: 1703822 - protein, 14 aa, Staphylococcus aureus
RKYPSTKESLKDYS

SEQ ID NO: 1703823 - protein, 8 aa, Staphylococcus aureus
RNGVGRPE

SEQ ID NO: 1703824 - protein, 17 aa, Staphylococcus aureus
RPAIESSNERNNAGTGH

SEQ ID NO: 1703825 - protein, 5 aa, Staphylococcus aureus
SAAPG

SEQ ID NO: 1703826 - protein, 19 aa, Staphylococcus aureus
SDITENKKDIKFNNKQSAE

SEQ ID NO: 1703827 - protein, 8 aa, Staphylococcus aureus
SDTGSTKA

SEQ ID NO: 1703828 - protein, 11 aa, Staphylococcus aureus
SEVTDENAAEY

SEQ ID NO: 1703829 - protein, 5 aa, Staphylococcus aureus
SGPVE

SEQ ID NO: 1703830 - protein, 8 aa, Staphylococcus aureus
SGSIENPR

SEQ ID NO: 1703831 - protein, 11 aa, Staphylococcus aureus
SHGQTAGAADW

SEQ ID NO: 1703832 - protein, 9 aa, Staphylococcus aureus
SIEAHPNAT

SEQ ID NO: 1703833 - protein, 10 aa, Staphylococcus aureus
SISSQSNDSV

SEQ ID NO: 1703834 - protein, 8 aa, Staphylococcus aureus
SKLTQSGY

SEQ ID NO: 1703835 - protein, 9 aa, Staphylococcus aureus
SKQKGSNIK

SEQ ID NO: 1703836 - protein, 16 aa, Staphylococcus aureus
SKTDTTDKNSKEFKAL

SEQ ID NO: 1703837 - protein, 11 aa, Staphylococcus aureus
SLGKGITASSL

SEQ ID NO: 1703838 - protein, 8 aa, Staphylococcus aureus
SNNPAEQG

SEQ ID NO: 1703839 - protein, 8 aa, Staphylococcus aureus
SNPMPPRT

SEQ ID NO: 1703840 - protein, 9 aa, Staphylococcus aureus
SNRSSGKMG

SEQ ID NO: 1703841 - protein, 10 aa, Staphylococcus aureus
SSRHKGINKE

SEQ ID NO: 1703842 - protein, 10 aa, Staphylococcus aureus
SVTKNKEGIG

SEQ ID NO: 1703843 - protein, 5 aa, Staphylococcus aureus
SYKST

SEQ ID NO: 1703844 - protein, 12 aa, Staphylococcus aureus
SYRKRYDKQYSR

SEQ ID NO: 1703845 - protein, 11 aa, Staphylococcus aureus
TANDRSTINGE

SEQ ID NO: 1703846 - protein, 13 aa, Staphylococcus aureus
TDPKEATAESREA

SEQ ID NO: 1703847 - protein, 10 aa, Staphylococcus aureus
TDQYTKKTGI

SEQ ID NO: 1703848 - protein, 16 aa, Staphylococcus aureus
TDSDGAIKISTRYIEV

SEQ ID NO: 1703849 - protein, 5 aa, Staphylococcus aureus
TGGPG

SEQ ID NO: 1703850 - protein, 8 aa, Staphylococcus aureus
TGIPESKH

SEQ ID NO: 1703851 - protein, 9 aa, Staphylococcus aureus
TGKISTSEM

SEQ ID NO: 1703852 - protein, 5 aa, Staphylococcus aureus
THQGK

SEQ ID NO: 1703853 - protein, 10 aa, Staphylococcus aureus
TKASSFKPTN

SEQ ID NO: 1703854 - protein, 11 aa, Staphylococcus aureus
TNSMINTGSAA

SEQ ID NO: 1703855 - protein, 10 aa, Staphylococcus aureus
TPNSDTAKYS

SEQ ID NO: 1703856 - protein, 6 aa, Staphylococcus aureus
TQDITS

SEQ ID NO: 1703857 - protein, 7 aa, Staphylococcus aureus
TSFSQTM

SEQ ID NO: 1703858 - protein, 7 aa, Staphylococcus aureus
TSNGTTW

SEQ ID NO: 1703859 - protein, 9 aa, Staphylococcus aureus
TSNSNFKDC

SEQ ID NO: 1703860 - protein, 16 aa, Staphylococcus aureus
TTGSAQNNTDWGNKEY

SEQ ID NO: 1703861 - protein, 8 aa, Staphylococcus aureus
TYNTNKYH

SEQ ID NO: 1703862 - protein, 4 aa, Staphylococcus aureus
VDDK

SEQ ID NO: 1703863 - protein, 9 aa, Staphylococcus aureus
VDYKDKKAI

SEQ ID NO: 1703864 - protein, 5 aa, Staphylococcus aureus
VKIED

SEQ ID NO: 1703865 - protein, 7 aa, Staphylococcus aureus
VKPNELK

SEQ ID NO: 1703866 - protein, 9 aa, Staphylococcus aureus
VNDKQDKHQ

SEQ ID NO: 1703867 - protein, 6 aa, Staphylococcus aureus
VNSDGS

SEQ ID NO: 1703868 - protein, 7 aa, Staphylococcus aureus
VNSHTSA

SEQ ID NO: 1703869 - protein, 6 aa, Staphylococcus aureus
VSDYTP

SEQ ID NO: 1703870 - protein, 24 aa, Staphylococcus aureus
VSGSSNSTSNSSRPSTNSGGGSYY

SEQ ID NO: 1703871 - protein, 7 aa, Staphylococcus aureus
VSTSGAV

SEQ ID NO: 1703872 - protein, 8 aa, Staphylococcus aureus
VTNSNTKY

SEQ ID NO: 1703873 - protein, 13 aa, Staphylococcus aureus
VYGKEPPGTPPMT

SEQ ID NO: 1703874 - protein, 6 aa, Staphylococcus aureus
WKPGQK

SEQ ID NO: 1703875 - protein, 12 aa, Staphylococcus aureus
YEADGKGKEPAV

SEQ ID NO: 1703876 - protein, 14 aa, Staphylococcus aureus
YENGKVNASVEPTL

SEQ ID NO: 1703877 - protein, 13 aa, Staphylococcus aureus
YGGGDTKGKNIKG

SEQ ID NO: 1703878 - protein, 11 aa, Staphylococcus aureus
YKDNNGGYESF

SEQ ID NO: 1703879 - protein, 25 aa, Staphylococcus aureus
YKQEAGAVSGTGNQTFKATKQQQID

SEQ ID NO: 1703880 - protein, 11 aa, Staphylococcus aureus
YNKEKASYTLG

SEQ ID NO: 1703881 - protein, 4 aa, Staphylococcus aureus
YNPG

SEQ ID NO: 1703882 - protein, 6 aa, Staphylococcus aureus
YQGNKP

SEQ ID NO: 1703883 - protein, 11 aa, Staphylococcus aureus
YSGKAKTWKDV

SEQ ID NO: 1703884 - protein, 8 aa, Staphylococcus aureus
YSTDGRIA

SEQ ID NO: 1703885 - protein, 18 aa, Staphylococcus aureus
YTGEATHKALNSDRQKAD

SEQ ID NO: 1703886 - protein, 15 aa, Staphylococcus aureus
AAKYGHERYGKTYEG

SEQ ID NO: 1703887 - protein, 8 aa, Staphylococcus aureus
ADKSTRQA

SEQ ID NO: 1703888 - protein, 12 aa, Staphylococcus aureus
ADNGGSTGKIRD

SEQ ID NO: 1703889 - protein, 8 aa, Staphylococcus aureus
AGDTPLDN

SEQ ID NO: 1703890 - protein, 17 aa, Staphylococcus aureus
AHATTPNMGQGAGQAME

SEQ ID NO: 1703891 - protein, 5 aa, Staphylococcus aureus
AIKED

SEQ ID NO: 1703892 - protein, 12 aa, Staphylococcus aureus
AIKEGQKEFDGD

SEQ ID NO: 1703893 - protein, 9 aa, Staphylococcus aureus
AKVTPEEMD

SEQ ID NO: 1703894 - protein, 8 aa, Staphylococcus aureus
ALSTSESQ

SEQ ID NO: 1703895 - protein, 12 aa, Staphylococcus aureus
ANADSKEQAQSL

SEQ ID NO: 1703896 - protein, 4 aa, Staphylococcus aureus
APGF

SEQ ID NO: 1703897 - protein, 6 aa, Staphylococcus aureus
APTGTF

SEQ ID NO: 1703898 - protein, 4 aa, Staphylococcus aureus
ARAG

SEQ ID NO: 1703899 - protein, 6 aa, Staphylococcus aureus
ASSNAQ

SEQ ID NO: 1703900 - protein, 16 aa, Staphylococcus aureus
CGKEQTKTYEGDVSGK

SEQ ID NO: 1703901 - protein, 10 aa, Staphylococcus aureus
DDAPVKGSEF

SEQ ID NO: 1703902 - protein, 8 aa, Staphylococcus aureus
DDKYTNVG

SEQ ID NO: 1703903 - protein, 11 aa, Staphylococcus aureus
DKDIKKYQKVA

SEQ ID NO: 1703904 - protein, 53 aa, Staphylococcus aureus; identical to SEQ ID NO: 1635422

SEQ ID NO: 1703905 - protein, 6 aa, Staphylococcus aureus
DKNHNK

SEQ ID NO: 1703906 - protein, 16 aa, Staphylococcus aureus
DKPTDFNSEKQSLKEK

SEQ ID NO: 1703907 - protein, 8 aa, Staphylococcus aureus
DKSHNELK

SEQ ID NO: 1703908 - protein, 19 aa, Staphylococcus aureus
DLTAPTAVKPTTSAAKDYN

SEQ ID NO: 1703909 - protein, 13 aa, Staphylococcus aureus
DMKEEKKEKEWSG

SEQ ID NO: 1703910 - protein, 7 aa, Staphylococcus aureus
DNWGRGG

SEQ ID NO: 1703911 - protein, 7 aa, Staphylococcus aureus
DQHQFNQ

SEQ ID NO: 1703912 - protein, 11 aa, Staphylococcus aureus
DTSGSGLNRRG

SEQ ID NO: 1703913 - protein, 8 aa, Staphylococcus aureus
EAGINATK

SEQ ID NO: 1703914 - protein, 17 aa, Staphylococcus aureus
EDKKIDDVTKKDAQQLL

SEQ ID NO: 1703915 - protein, 7 aa, Staphylococcus aureus
EDTQTWS

SEQ ID NO: 1703916 - protein, 7 aa, Staphylococcus aureus
EEETARM

SEQ ID NO: 1703917 - protein, 5 aa, Staphylococcus aureus
EEHDY

SEQ ID NO: 1703918 - protein, 7 aa, Staphylococcus aureus
EKGKSEL

SEQ ID NO: 1703919 - protein, 5 aa, Staphylococcus aureus
EKLSK

SEQ ID NO: 1703920 - protein, 11 aa, Staphylococcus aureus
EKPAQGTAPSN

SEQ ID NO: 1703921 - protein, 9 aa, Staphylococcus aureus
EKVNIKKGK

SEQ ID NO: 1703922 - protein, 9 aa, Staphylococcus aureus
ELAKKDDID

SEQ ID NO: 1703923 - protein, 5 aa, Staphylococcus aureus
ESEVP

SEQ ID NO: 1703924 - protein, 7 aa, Staphylococcus aureus
ESNDSEK

SEQ ID NO: 1703925 - protein, 4 aa, Staphylococcus aureus
ETGH

SEQ ID NO: 1703926 - protein, 9 aa, Staphylococcus aureus
ETKRKSVIN

SEQ ID NO: 1703927 - protein, 27 aa, Staphylococcus aureus
FAPQNEKVAKKYGKNYGTAADRAVYNG

SEQ ID NO: 1703928 - protein, 6 aa, Staphylococcus aureus
FEGNSV

SEQ ID NO: 1703929 - protein, 5 aa, Staphylococcus aureus
FETNV

SEQ ID NO: 1703930 - protein, 12 aa, Staphylococcus aureus
FSQHGGNRLGAN

SEQ ID NO: 1703931 - protein, 16 aa, Staphylococcus aureus
GAFSDYADSIQKQGYD

SEQ ID NO: 1703932 - protein, 5 aa, Staphylococcus aureus
GDTPL

SEQ ID NO: 1703933 - protein, 5 aa, Staphylococcus aureus
GESKV

SEQ ID NO: 1703934 - protein, 8 aa, Staphylococcus aureus
GKSKSEQI

SEQ ID NO: 1703935 - protein, 6 aa, Staphylococcus aureus
GKTNHD

SEQ ID NO: 1703936 - protein, 12 aa, Staphylococcus aureus
GLGPTKDDLTKH

SEQ ID NO: 1703937 - protein, 8 aa, Staphylococcus aureus
GNESGFDA

SEQ ID NO: 1703938 - protein, 17 aa, Staphylococcus aureus
GNFQSAPSIGGSGSFNY

SEQ ID NO: 1703939 - protein, 17 aa, Staphylococcus aureus
GNFQSAPSLGGNGSFNY

SEQ ID NO: 1703940 - protein, 33 aa, Staphylococcus aureus
GNTDNSSKKESSTKDTISVKDENGTVKVPKDAK

SEQ ID NO: 1703941 - protein, 24 aa, Staphylococcus aureus
GPNRSKEDIDKALNKDNSKDKPNQ

SEQ ID NO: 1703942 - protein, 7 aa, Staphylococcus aureus
GPPKEMQ

SEQ ID NO: 1703943 - protein, 10 aa, Staphylococcus aureus
GPTTLEDPKD

SEQ ID NO: 1703944 - protein, 20 aa, Staphylococcus aureus
GSQNLAPLEEKTTDLREDNH

SEQ ID NO: 1703945 - protein, 5 aa, Staphylococcus aureus
GTDSG

SEQ ID NO: 1703946 - protein, 12 aa, Staphylococcus aureus
GTGNLKGSSVGY

SEQ ID NO: 1703947 - protein, 4 aa, Staphylococcus aureus
GTSL

SEQ ID NO: 1703948 - protein, 8 aa, Staphylococcus aureus
GTVAGPNA

SEQ ID NO: 1703949 - protein, 4 aa, Staphylococcus aureus
GTWY

SEQ ID NO: 1703950 - protein, 4 aa, Staphylococcus aureus
IAPT

SEQ ID NO: 1703951 - protein, 6 aa, Staphylococcus aureus
IDTEEP

SEQ ID NO: 1703952 - protein, 22 aa, Staphylococcus aureus
IKDENGKATEPTKKTIQDNSYA

SEQ ID NO: 1703953 - protein, 12 aa, Staphylococcus aureus
INKEELKKGVTI

SEQ ID NO: 1703954 - protein, 6 aa, Staphylococcus aureus
ITNRGK

SEQ ID NO: 1703955 - protein, 15 aa, Staphylococcus aureus
KAKQDGFDVSKYEHV

SEQ ID NO: 1703956 - protein, 13 aa, Staphylococcus aureus
KALPKGEGGKSLP

SEQ ID NO: 1703957 - protein, 7 aa, Staphylococcus aureus
KATKEGH

SEQ ID NO: 1703958 - protein, 16 aa, Staphylococcus aureus
KAVGKEKEGEKRLEKH

SEQ ID NO: 1703959 - protein, 9 aa, Staphylococcus aureus
KDITSNPKH

SEQ ID NO: 1703960 - protein, 7 aa, Staphylococcus aureus
KDKLKEV

SEQ ID NO: 1703961 - protein, 7 aa, Staphylococcus aureus
KEEGHEV

SEQ ID NO: 1703962 - protein, 7 aa, Staphylococcus aureus
KEKQTFD

SEQ ID NO: 1703963 - protein, 9 aa, Staphylococcus aureus
KEQKGLGHA

SEQ ID NO: 1703964 - protein, 12 aa, Staphylococcus aureus
KIKDDEEPIKTV

SEQ ID NO: 1703965 - protein, 8 aa, Staphylococcus aureus
KKAAPKAK

SEQ ID NO: 1703966 - protein, 11 aa, Staphylococcus aureus
KKIGKDQIANA

SEQ ID NO: 1703967 - protein, 8 aa, Staphylococcus aureus
KKQDGDLS

SEQ ID NO: 1703968 - protein, 6 aa, Staphylococcus aureus
KLLETD

SEQ ID NO: 1703969 - protein, 7 aa, Staphylococcus aureus
KNAKREL

SEQ ID NO: 1703970 - protein, 7 aa, Staphylococcus aureus
KNGSEYD

SEQ ID NO: 1703971 - protein, 12 aa, Staphylococcus aureus
KNTTSYQKTCIQ

SEQ ID NO: 1703972 - protein, 12 aa, Staphylococcus aureus
KPAQVQKSVPTV

SEQ ID NO: 1703973 - protein, 12 aa, Staphylococcus aureus
KPDSAEYDGNGT

SEQ ID NO: 1703974 - protein, 8 aa, Staphylococcus aureus
KPLLEKKG

SEQ ID NO: 1703975 - protein, 8 aa, Staphylococcus aureus
KQEEIEKY

SEQ ID NO: 1703976 - protein, 8 aa, Staphylococcus aureus
KQNTENIG

SEQ ID NO: 1703977 - protein, 11 aa, Staphylococcus aureus
KQTNPTIAPLA

SEQ ID NO: 1703978 - protein, 9 aa, Staphylococcus aureus
KRKAEEQER

SEQ ID NO: 1703979 - protein, 7 aa, Staphylococcus aureus
KTKDSNV

SEQ ID NO: 1703980 - protein, 6 aa, Staphylococcus aureus
KYPPHK

SEQ ID NO: 1703981 - protein, 8 aa, Staphylococcus aureus
LAKNGSDI

SEQ ID NO: 1703982 - protein, 14 aa, Staphylococcus aureus
LLSNRKKVQQFTEN

SEQ ID NO: 1703983 - protein, 14 aa, Staphylococcus aureus
LPGLGSKSTKNDVK

SEQ ID NO: 1703984 - protein, 9 aa, Staphylococcus aureus
LTKNGRQYE

SEQ ID NO: 1703985 - protein, 10 aa, Staphylococcus aureus
LTTHDESTRY

SEQ ID NO: 1703986 - protein, 32 aa, Staphylococcus aureus; identical to SEQ ID NO: 1632682

SEQ ID NO: 1703987 - protein, 7 aa, Staphylococcus aureus
MDTSPAF

SEQ ID NO: 1703988 - protein, 13 aa, Staphylococcus aureus
NAAAAEELSYITG

SEQ ID NO: 1703989 - protein, 7 aa, Staphylococcus aureus
NDGNKKV

SEQ ID NO: 1703990 - protein, 9 aa, Staphylococcus aureus
NDVSSSNKV

SEQ ID NO: 1703991 - protein, 9 aa, Staphylococcus aureus
NGDIKNGKE

SEQ ID NO: 1703992 - protein, 35 aa, Staphylococcus aureus
NHKDDQAGKDNQKHNNSSNQVKEIATDKNVQGDNY

SEQ ID NO: 1703993 - protein, 12 aa, Staphylococcus aureus
NKIDSADVSQKL

SEQ ID NO: 1703994 - protein, 9 aa, Staphylococcus aureus
NKSVANRGN

SEQ ID NO: 1703995 - protein, 9 aa, Staphylococcus aureus
NNSRERDTR

SEQ ID NO: 1703996 - protein, 13 aa, Staphylococcus aureus
NPMYSYNEDGTEH

SEQ ID NO: 1703997 - protein, 4 aa, Staphylococcus aureus
NSQD

SEQ ID NO: 1703998 - protein, 5 aa, Staphylococcus aureus
NTNGQ

SEQ ID NO: 1703999 - protein, 8 aa, Staphylococcus aureus
NVPTPRTV

SEQ ID NO: 1704000 - protein, 14 aa, Staphylococcus aureus
PATMSNNAETQVNQ

SEQ ID NO: 1704001 - protein, 6 aa, Staphylococcus aureus
PDDTFS

SEQ ID NO: 1704002 - protein, 15 aa, Staphylococcus aureus
PPRKRDYTSKSKGGK

SEQ ID NO: 1704003 - protein, 10 aa, Staphylococcus aureus
PTASGKTELS

SEQ ID NO: 1704004 - protein, 5 aa, Staphylococcus aureus
QAGQP

SEQ ID NO: 1704005 - protein, 10 aa, Staphylococcus aureus
QKVQKNPKLL

SEQ ID NO: 1704006 - protein, 21 aa, Staphylococcus aureus
QPAQPFERGVSNEKFKAQGGT

SEQ ID NO: 1704007 - protein, 10 aa, Staphylococcus aureus
QVKPNNTGIR

SEQ ID NO: 1704008 - protein, 6 aa, Staphylococcus aureus
RASADN

SEQ ID NO: 1704009 - protein, 6 aa, Staphylococcus aureus
RGTENA

SEQ ID NO: 1704010 - protein, 7 aa, Staphylococcus aureus
RIASQGH

SEQ ID NO: 1704011 - protein, 7 aa, Staphylococcus aureus
RLTGEKF

SEQ ID NO: 1704012 - protein, 7 aa, Staphylococcus aureus
RMNNDNQ

SEQ ID NO: 1704013 - protein, 21 aa, Staphylococcus aureus
RPERSTEPEKEPWSQPPSGYK

SEQ ID NO: 1704014 - protein, 9 aa, Staphylococcus aureus
RQSSAYAGQ

SEQ ID NO: 1704015 - protein, 6 aa, Staphylococcus aureus
RSYTDM

SEQ ID NO: 1704016 - protein, 5 aa, Staphylococcus aureus
RTKDG

SEQ ID NO: 1704017 - protein, 11 aa, Staphylococcus aureus
RYSNSKIDTEV

SEQ ID NO: 1704018 - protein, 7 aa, Staphylococcus aureus
SDINPNI

SEQ ID NO: 1704019 - protein, 13 aa, Staphylococcus aureus
SFATESGQKSAFD

SEQ ID NO: 1704020 - protein, 15 aa, Staphylococcus aureus
SKTKDDKEPQVHIYS

SEQ ID NO: 1704021 - protein, 13 aa, Staphylococcus aureus
SNSIKQIDINVKT

SEQ ID NO: 1704022 - protein, 9 aa, Staphylococcus aureus
SPNEQNKHI

SEQ ID NO: 1704023 - protein, 7 aa, Staphylococcus aureus
SRTTYSD

SEQ ID NO: 1704024 - protein, 14 aa, Staphylococcus aureus
STSEGKPTPGYEST

SEQ ID NO: 1704025 - protein, 4 aa, Staphylococcus aureus
SWGE

SEQ ID NO: 1704026 - protein, 4 aa, Staphylococcus aureus
TDDL

SEQ ID NO: 1704027 - protein, 19 aa, Staphylococcus aureus
TDINQTNISDKHVNNARKN

SEQ ID NO: 1704028 - protein, 7 aa, Staphylococcus aureus
THGKIKP

SEQ ID NO: 1704029 - protein, 7 aa, Staphylococcus aureus
TISYNQK

SEQ ID NO: 1704030 - protein, 5 aa, Staphylococcus aureus
TKAMP

SEQ ID NO: 1704031 - protein, 10 aa, Staphylococcus aureus
TKEQTTFEEA

SEQ ID NO: 1704032 - protein, 8 aa, Staphylococcus aureus
TKYSGEGD

SEQ ID NO: 1704033 - protein, 11 aa, Staphylococcus aureus
TQKEGAGNEIQ

SEQ ID NO: 1704034 - protein, 5 aa, Staphylococcus aureus
TSNRQ

SEQ ID NO: 1704035 - protein, 6 aa, Staphylococcus aureus
VENDNA

SEQ ID NO: 1704036 - protein, 4 aa, Staphylococcus aureus
VETS

SEQ ID NO: 1704037 - protein, 4 aa, Staphylococcus aureus
VFPT

SEQ ID NO: 1704038 - protein, 19 aa, Staphylococcus aureus
VKDAKNGNRTRKPSKVSKI

SEQ ID NO: 1704039 - protein, 8 aa, Staphylococcus aureus
VKSSNPNL

SEQ ID NO: 1704040 - protein, 10 aa, Staphylococcus aureus
VTGYPGDKPV

SEQ ID NO: 1704041 - protein, 10 aa, Staphylococcus aureus
WLNESGAKYP

SEQ ID NO: 1704042 - protein, 29 aa, Staphylococcus aureus
YKMRGEKKDGSDAKKVKETVEVPKNPKNA

SEQ ID NO: 1704043 - protein, 8 aa, Staphylococcus aureus
YKSSKGPD

SEQ ID NO: 1704044 - protein, 5 aa, Staphylococcus aureus
YPDYG

SEQ ID NO: 1704045 - protein, 7 aa, Staphylococcus aureus
YRKPSDF

SEQ ID NO: 1704046 - protein, 11 aa, Staphylococcus aureus
AELTDATPAAY

SEQ ID NO: 1704047 - protein, 18 aa, Staphylococcus aureus
AGNAANDGYQVNNTPSVG

SEQ ID NO: 1704048 - protein, 19 aa, Staphylococcus aureus
AGWKKGKDSDVRQKDGKNL

SEQ ID NO: 1704049 - protein, 21 aa, Staphylococcus aureus
AKNGYESATSGIENKDKIYNS

SEQ ID NO: 1704050 - protein, 8 aa, Staphylococcus aureus
ASTHPGAG

SEQ ID NO: 1704051 - protein, 5 aa, Staphylococcus aureus
AYQPA

SEQ ID NO: 1704052 - protein, 10 aa, Staphylococcus aureus
DEQKGKDKQL

SEQ ID NO: 1704053 - protein, 8 aa, Staphylococcus aureus
DETVTPAQ

SEQ ID NO: 1704054 - protein, 4 aa, Staphylococcus aureus
DGFN

SEQ ID NO: 1704055 - protein, 17 aa, Staphylococcus aureus
DGSKKEVDLKKDSYTAN

SEQ ID NO: 1704056 - protein, 26 aa, Staphylococcus aureus
DKLPKKGIDITHGDKAFEKKLEKLEE

SEQ ID NO: 1704057 - protein, 9 aa, Staphylococcus aureus
DQFNSSRKS

SEQ ID NO: 1704058 - protein, 15 aa, Staphylococcus aureus
DSKIKSLKDLKGKKI

SEQ ID NO: 1704059 - protein, 22 aa, Staphylococcus aureus
DWEETTAKDGKEIKKAIGQDAT

SEQ ID NO: 1704060 - protein, 6 aa, Staphylococcus aureus
EANQTL

SEQ ID NO: 1704061 - protein, 8 aa, Staphylococcus aureus
EKDEKKKY

SEQ ID NO: 1704062 - protein, 11 aa, Staphylococcus aureus
ELSTFGPKGRF

SEQ ID NO: 1704063 - protein, 5 aa, Staphylococcus aureus
EPFGA

SEQ ID NO: 1704064 - protein, 7 aa, Staphylococcus aureus
EPNYDKE

SEQ ID NO: 1704065 - protein, 11 aa, Staphylococcus aureus
EPRNEQAANTL

SEQ ID NO: 1704066 - protein, 10 aa, Staphylococcus aureus
EQKDIEDLGG

SEQ ID NO: 1704067 - protein, 5 aa, Staphylococcus aureus
FDSQK

SEQ ID NO: 1704068 - protein, 9 aa, Staphylococcus aureus
FEKNRYKVE

SEQ ID NO: 1704069 - protein, 16 aa, Staphylococcus aureus
FNSDKKNSDISDAEMK

SEQ ID NO: 1704070 - protein, 10 aa, Staphylococcus aureus
FVTPNGQVSA

SEQ ID NO: 1704071 - protein, 5 aa, Staphylococcus aureus
GDTIV

SEQ ID NO: 1704072 - protein, 25 aa, Staphylococcus aureus
GGGNGGSGNSDLKGEAKGDGSSTVA

SEQ ID NO: 1704073 - protein, 5 aa, Staphylococcus aureus
GNDKY

SEQ ID NO: 1704074 - protein, 7 aa, Staphylococcus aureus
GQNDQLE

SEQ ID NO: 1704075 - protein, 13 aa, Staphylococcus aureus
GSNANPTLKETKG

SEQ ID NO: 1704076 - protein, 5 aa, Staphylococcus aureus
GTIAG

SEQ ID NO: 1704077 - protein, 23 aa, Staphylococcus aureus
HDAQAAEQNNNGYNSNDAQSYSY

SEQ ID NO: 1704078 - protein, 10 aa, Staphylococcus aureus
HKKIKSELSK

SEQ ID NO: 1704079 - protein, 11 aa, Staphylococcus aureus
HPSQLNQDNGY

SEQ ID NO: 1704080 - protein, 7 aa, Staphylococcus aureus
IKQSDQQ

SEQ ID NO: 1704081 - protein, 7 aa, Staphylococcus aureus
INAKNNG

SEQ ID NO: 1704082 - protein, 18 aa, Staphylococcus aureus
INGETSDKIAERRTSGDY

SEQ ID NO: 1704083 - protein, 19 aa, Staphylococcus aureus
IQNQKQEQLAKKGNGDRVD

SEQ ID NO: 1704084 - protein, 25 aa, Staphylococcus aureus
IRRNNPELERSLKDAKETFVNRKNQ

SEQ ID NO: 1704085 - protein, 7 aa, Staphylococcus aureus
KATKRRK

SEQ ID NO: 1704086 - protein, 11 aa, Staphylococcus aureus
KDAHRIGQDND

SEQ ID NO: 1704087 - protein, 12 aa, Staphylococcus aureus
KDYDSDSKVTKT

SEQ ID NO: 1704088 - protein, 7 aa, Staphylococcus aureus
KELHAKA

SEQ ID NO: 1704089 - protein, 8 aa, Staphylococcus aureus
KGELQQFN

SEQ ID NO: 1704090 - protein, 6 aa, Staphylococcus aureus
KGETNF

SEQ ID NO: 1704091 - protein, 6 aa, Staphylococcus aureus
KINGKH

SEQ ID NO: 1704092 - protein, 27 aa, Staphylococcus aureus
KNGYQNKDKKQLTKGQQALSKLNLNAK

SEQ ID NO: 1704093 - protein, 8 aa, Staphylococcus aureus
KVRIEGSK

SEQ ID NO: 1704094 - protein, 6 aa, Staphylococcus aureus
LARPTE

SEQ ID NO: 1704095 - protein, 10 aa, Staphylococcus aureus
LDGQEKPATQ

SEQ ID NO: 1704096 - protein, 23 aa, Staphylococcus aureus
LKKNDDAKNSIDPSTIKQIQIVV

SEQ ID NO: 1704097 - protein, 5 aa, Staphylococcus aureus
LQAEV

SEQ ID NO: 1704098 - protein, 13 aa, Staphylococcus aureus
LQNRGEDIGNEIS

SEQ ID NO: 1704099 - protein, 4 aa, Staphylococcus aureus
LSDG

SEQ ID NO: 1704100 - protein, 20 aa, Staphylococcus aureus
LSLSDDDKKTSKNIDKLNSD

SEQ ID NO: 1704101 - protein, 5 aa, Staphylococcus aureus
LSSQE

SEQ ID NO: 1704102 - protein, 6 aa, Staphylococcus aureus
MGPSFN

SEQ ID NO: 1704103 - protein, 5 aa, Staphylococcus aureus
MPAGE

SEQ ID NO: 1704104 - protein, 13 aa, Staphylococcus aureus
NDATLEEQQAAQQ

SEQ ID NO: 1704105 - protein, 8 aa, Staphylococcus aureus
NDVSNQAR

SEQ ID NO: 1704106 - protein, 4 aa, Staphylococcus aureus
NEKG

SEQ ID NO: 1704107 - protein, 7 aa, Staphylococcus aureus
NEKKDAI

SEQ ID NO: 1704108 - protein, 7 aa, Staphylococcus aureus
NIAPKKA

SEQ ID NO: 1704109 - protein, 12 aa, Staphylococcus aureus
NKALSAENAELR

SEQ ID NO: 1704110 - protein, 4 aa, Staphylococcus aureus
NNPQ

SEQ ID NO: 1704111 - protein, 26 aa, Staphylococcus aureus
NQEYPKGYGDSSTIPANSDGKNALYA

SEQ ID NO: 1704112 - protein, 19 aa, Staphylococcus aureus
NSAKTQLDKEIKKNKGKHK

SEQ ID NO: 1704113 - protein, 8 aa, Staphylococcus aureus
NTKDGIKP

SEQ ID NO: 1704114 - protein, 6 aa, Staphylococcus aureus
NVEGAQ

SEQ ID NO: 1704115 - protein, 5 aa, Staphylococcus aureus
PQSTI

SEQ ID NO: 1704116 - protein, 9 aa, Staphylococcus aureus
QDPTGPAAR

SEQ ID NO: 1704117 - protein, 13 aa, Staphylococcus aureus
QGAHANYYPGNSP

SEQ ID NO: 1704118 - protein, 19 aa, Staphylococcus aureus
QGSEERDKYVDTVSTKSSL

SEQ ID NO: 1704119 - protein, 13 aa, Staphylococcus aureus
QNDELTDEEKQAA

SEQ ID NO: 1704120 - protein, 7 aa, Staphylococcus aureus
QTTQGAY

SEQ ID NO: 1704121 - protein, 12 aa, Staphylococcus aureus
RFYPTKKEQERL

SEQ ID NO: 1704122 - protein, 5 aa, Staphylococcus aureus
RTTYY

SEQ ID NO: 1704123 - protein, 7 aa, Staphylococcus aureus
SKLERNK

SEQ ID NO: 1704124 - protein, 15 aa, Staphylococcus aureus
SLTTDGQKVNNKDGI

SEQ ID NO: 1704125 - protein, 9 aa, Staphylococcus aureus
SVNSNGSVR

SEQ ID NO: 1704126 - protein, 15 aa, Staphylococcus aureus
TAKKDDKDLNPSSIS

SEQ ID NO: 1704127 - protein, 9 aa, Staphylococcus aureus
TKSPDVYPG

SEQ ID NO: 1704128 - protein, 11 aa, Staphylococcus aureus
TQDDKNTVNKL

SEQ ID NO: 1704129 - protein, 6 aa, Staphylococcus aureus
VDGTFN

SEQ ID NO: 1704130 - protein, 29 aa, Staphylococcus aureus
VGGSDAQNTSNTSPQAGSASSHTVQAGES

SEQ ID NO: 1704131 - protein, 6 aa, Staphylococcus aureus
VKPGTK

SEQ ID NO: 1704132 - protein, 9 aa, Staphylococcus aureus
VLKQSTINT

SEQ ID NO: 1704133 - protein, 11 aa, Staphylococcus aureus
VNKDTGAYTYT

SEQ ID NO: 1704134 - protein, 12 aa, Staphylococcus aureus
WNPSQLTQNNTY

SEQ ID NO: 1704135 - protein, 10 aa, Staphylococcus aureus
YGYKTGGDFS

SEQ ID NO: 1704136 - protein, 6 aa, Staphylococcus aureus
YNSGNK

SEQ ID NO: 1704137 - protein, 17 aa, Staphylococcus aureus
YPKYARASYKNAKVPTL

SEQ ID NO: 1704138 - protein, 11 aa, Staphylococcus aureus
YSEDKTVDSKS

SEQ ID NO: 1704139 - protein, 8 aa, Staphylococcus aureus
YSERGEKL

SEQ ID NO: 1704140 - protein, 9 aa, Staphylococcus aureus
ALESSNANG

SEQ ID NO: 1704141 - protein, 16 aa, Staphylococcus aureus
ALLPSSTAADYDENLN

SEQ ID NO: 1704142 - protein, 11 aa, Staphylococcus aureus
AQREVNKAPMD

SEQ ID NO: 1704143 - protein, 17 aa, Staphylococcus aureus
ASAPKDKNIKLYRIDLE

SEQ ID NO: 1704144 - protein, 14 aa, Staphylococcus aureus
CGNDDGKDKDGKVT

SEQ ID NO: 1704145 - protein, 7 aa, Staphylococcus aureus
DAKVDDK

SEQ ID NO: 1704146 - protein, 4 aa, Staphylococcus aureus
DANF

SEQ ID NO: 1704147 - protein, 7 aa, Staphylococcus aureus
DGRPELS

SEQ ID NO: 1704148 - protein, 5 aa, Staphylococcus aureus
DKKGV

SEQ ID NO: 1704149 - protein, 14 aa, Staphylococcus aureus
DKRVSYKQDFDSRR

SEQ ID NO: 1704150 - protein, 11 aa, Staphylococcus aureus
DNLTEQEKNNY

SEQ ID NO: 1704151 - protein, 8 aa, Staphylococcus aureus
DPKRGPSL

SEQ ID NO: 1704152 - protein, 5 aa, Staphylococcus aureus
DSTTV

SEQ ID NO: 1704153 - protein, 6 aa, Staphylococcus aureus
DVQPME

SEQ ID NO: 1704154 - protein, 9 aa, Staphylococcus aureus
DVSEDGKTY

SEQ ID NO: 1704155 - protein, 18 aa, Staphylococcus aureus
EMTNDTSRQLSDNKDDDK

SEQ ID NO: 1704156 - protein, 6 aa, Staphylococcus aureus
ETAPTD

SEQ ID NO: 1704157 - protein, 7 aa, Staphylococcus aureus
FENDQDY

SEQ ID NO: 1704158 - protein, 11 aa, Staphylococcus aureus
FTTSENGQQKL

SEQ ID NO: 1704159 - protein, 27 aa, Staphylococcus aureus
GEHKKDESADFNKNDQYWGEKSKLNKV

SEQ ID NO: 1704160 - protein, 23 aa, Staphylococcus aureus
GNNSDKEQSKSETKGSKDTVKIE

SEQ ID NO: 1704161 - protein, 9 aa, Staphylococcus aureus
GVNSNGSVR

SEQ ID NO: 1704162 - protein, 17 aa, Staphylococcus aureus
IATHDSDFAKNEDGSYY

SEQ ID NO: 1704163 - protein, 7 aa, Staphylococcus aureus
IEPGSTH

SEQ ID NO: 1704164 - protein, 6 aa, Staphylococcus aureus
IPRGDT

SEQ ID NO: 1704165 - protein, 9 aa, Staphylococcus aureus
ITEEQRNQY

SEQ ID NO: 1704166 - protein, 10 aa, Staphylococcus aureus
KEFKSKKNMD

SEQ ID NO: 1704167 - protein, 4 aa, Staphylococcus aureus
KEGS

SEQ ID NO: 1704168 - protein, 5 aa, Staphylococcus aureus
KGDHF

SEQ ID NO: 1704169 - protein, 8 aa, Staphylococcus aureus
KGKTTYQF

SEQ ID NO: 1704170 - protein, 8 aa, Staphylococcus aureus
KIDEGTDV

SEQ ID NO: 1704171 - protein, 11 aa, Staphylococcus aureus
KQAARDKITAE

SEQ ID NO: 1704172 - protein, 7 aa, Staphylococcus aureus
KQYPDFK

SEQ ID NO: 1704173 - protein, 14 aa, Staphylococcus aureus
KRDPKTIPDDESRD

SEQ ID NO: 1704174 - protein, 8 aa, Staphylococcus aureus
KRLAQDPA

SEQ ID NO: 1704175 - protein, 9 aa, Staphylococcus aureus
KSIAPYETD

SEQ ID NO: 1704176 - protein, 12 aa, Staphylococcus aureus
LGVSTKENKDIS

SEQ ID NO: 1704177 - protein, 12 aa, Staphylococcus aureus
LLSNRGSRQENY

SEQ ID NO: 1704178 - protein, 12 aa, Staphylococcus aureus
LSAGQRNKINDN

SEQ ID NO: 1704179 - protein, 11 aa, Staphylococcus aureus
MKDEKNKRLKQ

SEQ ID NO: 1704180 - protein, 4 aa, Staphylococcus aureus
NGQW

SEQ ID NO: 1704181 - protein, 5 aa, Staphylococcus aureus
NKFSS

SEQ ID NO: 1704182 - protein, 9 aa, Staphylococcus aureus
NKKMTKSVR

SEQ ID NO: 1704183 - protein, 22 aa, Staphylococcus aureus
NNRDNISKGDKVVTSGLADQLP

SEQ ID NO: 1704184 - protein, 7 aa, Staphylococcus aureus
NRDIKGD

SEQ ID NO: 1704185 - protein, 21 aa, Staphylococcus aureus
NRNESRGAHYKPEFPERNDEE

SEQ ID NO: 1704186 - protein, 25 aa, Staphylococcus aureus
PAIAQSDKSSKDESFAVGNTKNPKN

SEQ ID NO: 1704187 - protein, 12 aa, Staphylococcus aureus
PHVTKKQTATGV

SEQ ID NO: 1704188 - protein, 5 aa, Staphylococcus aureus
QDPNI

SEQ ID NO: 1704189 - protein, 5 aa, Staphylococcus aureus
QEDAT

SEQ ID NO: 1704190 - protein, 6 aa, Staphylococcus aureus
QGKPKL

SEQ ID NO: 1704191 - protein, 11 aa, Staphylococcus aureus
QLYPGAPKGQF

SEQ ID NO: 1704192 - protein, 10 aa, Staphylococcus aureus
QSDAKKANIE

SEQ ID NO: 1704193 - protein, 8 aa, Staphylococcus aureus
QTQGRSPQ

SEQ ID NO: 1704194 - protein, 10 aa, Staphylococcus aureus
QVNKYKDNKG

SEQ ID NO: 1704195 - protein, 11 aa, Staphylococcus aureus
RGASGYAPEHT

SEQ ID NO: 1704196 - protein, 5 aa, Staphylococcus aureus
RNPDQ

SEQ ID NO: 1704197 - protein, 12 aa, Staphylococcus aureus
RSQSQSPPEQYI

SEQ ID NO: 1704198 - protein, 9 aa, Staphylococcus aureus
RVKTGADLT

SEQ ID NO: 1704199 - protein, 5 aa, Staphylococcus aureus
SDESL

SEQ ID NO: 1704200 - protein, 12 aa, Staphylococcus aureus
SIDKSAHSNDIT

SEQ ID NO: 1704201 - protein, 9 aa, Staphylococcus aureus
SMHSSGKDL

SEQ ID NO: 1704202 - protein, 8 aa, Staphylococcus aureus
SNPTDETM

SEQ ID NO: 1704203 - protein, 14 aa, Staphylococcus aureus
SNRPGGKIQSYRKD

SEQ ID NO: 1704204 - protein, 9 aa, Staphylococcus aureus
STNTRAGKL

SEQ ID NO: 1704205 - protein, 32 aa, Staphylococcus aureus; identical to SEQ ID NO: 1633738

SEQ ID NO: 1704206 - protein, 10 aa, Staphylococcus aureus
TDGKKNNGKV

SEQ ID NO: 1704207 - protein, 5 aa, Staphylococcus aureus
TETPK

SEQ ID NO: 1704208 - protein, 6 aa, Staphylococcus aureus
TSDTDI

SEQ ID NO: 1704209 - protein, 5 aa, Staphylococcus aureus
VGTPL

SEQ ID NO: 1704210 - protein, 40 aa, Staphylococcus aureus
VKKDPKHKDDYEKNYKKLNDDLKKIDNDMKQVTKDKQGNA

SEQ ID NO: 1704211 - protein, 51 aa, Staphylococcus aureus; identical to SEQ ID NO: 1628058

SEQ ID NO: 1704212 - protein, 6 aa, Staphylococcus aureus
VRNEKV

SEQ ID NO: 1704213 - protein, 7 aa, Staphylococcus aureus
YDEKNSE

SEQ ID NO: 1704214 - protein, 6 aa, Staphylococcus aureus
YHNPNT

SEQ ID NO: 1704215 - protein, 9 aa, Staphylococcus aureus
YHQPNDTTL

SEQ ID NO: 1704216 - protein, 18 aa, Staphylococcus aureus
YKQESYRTTLSRNTNYKN

SEQ ID NO: 1704217 - protein, 9 aa, Staphylococcus aureus
YKTTTKDNY

SEQ ID NO: 1704218 - protein, 5 aa, Staphylococcus aureus
YPIPG

SEQ ID NO: 1704219 - protein, 8 aa, Staphylococcus aureus
YPNISTNY

SEQ ID NO: 1704220 - protein, 10 aa, Staphylococcus aureus
AELRTGPNAA

SEQ ID NO: 1704221 - protein, 11 aa, Staphylococcus aureus
ASGGSAFNSTY

SEQ ID NO: 1704222 - protein, 12 aa, Staphylococcus aureus
ATFETKINNGSL

SEQ ID NO: 1704223 - protein, 6 aa, Staphylococcus aureus
DATIQK

SEQ ID NO: 1704224 - protein, 5 aa, Staphylococcus aureus
DDINP

SEQ ID NO: 1704225 - protein, 19 aa, Staphylococcus aureus
DKNQKSDDKKSDDKKSEDK

SEQ ID NO: 1704226 - protein, 9 aa, Staphylococcus aureus
DKSVPTDVR

SEQ ID NO: 1704227 - protein, 10 aa, Staphylococcus aureus
DLKQHSRQYA

SEQ ID NO: 1704228 - protein, 12 aa, Staphylococcus aureus
DNTKEKNPLQGK

SEQ ID NO: 1704229 - protein, 52 aa, Staphylococcus aureus; identical to SEQ ID NO: 1631150

SEQ ID NO: 1704230 - protein, 18 aa, Staphylococcus aureus
DQAQTNSQVNQAATNGVS

SEQ ID NO: 1704231 - protein, 5 aa, Staphylococcus aureus
DTLDI

SEQ ID NO: 1704232 - protein, 9 aa, Staphylococcus aureus
DVEQKQKEL

SEQ ID NO: 1704233 - protein, 9 aa, Staphylococcus aureus
DYKQSRKIS

SEQ ID NO: 1704234 - protein, 9 aa, Staphylococcus aureus
EDTSSNEKG

SEQ ID NO: 1704235 - protein, 5 aa, Staphylococcus aureus
EIGKG

SEQ ID NO: 1704236 - protein, 7 aa, Staphylococcus aureus
EKLGADP

SEQ ID NO: 1704237 - protein, 7 aa, Staphylococcus aureus
GHTSVKG

SEQ ID NO: 1704238 - protein, 18 aa, Staphylococcus aureus
GINPDREKKYKFSKPYTF

SEQ ID NO: 1704239 - protein, 9 aa, Staphylococcus aureus
GQGESMDQA

SEQ ID NO: 1704240 - protein, 22 aa, Staphylococcus aureus
GTSISGDLGDAHNWNNRAQYRD

SEQ ID NO: 1704241 - protein, 6 aa, Staphylococcus aureus
IENGTF

SEQ ID NO: 1704242 - protein, 8 aa, Staphylococcus aureus
KAEIEERH

SEQ ID NO: 1704243 - protein, 10 aa, Staphylococcus aureus
KAKTDSNKDN

SEQ ID NO: 1704244 - protein, 5 aa, Staphylococcus aureus
KDPHE

SEQ ID NO: 1704245 - protein, 9 aa, Staphylococcus aureus
KENPDRSQQ

SEQ ID NO: 1704246 - protein, 25 aa, Staphylococcus aureus
KFQNGQKLTAEKVKSSLENSMKKSD

SEQ ID NO: 1704247 - protein, 9 aa, Staphylococcus aureus
KGSKSGITS

SEQ ID NO: 1704248 - protein, 14 aa, Staphylococcus aureus
KNESAEFGSSIGGE

SEQ ID NO: 1704249 - protein, 4 aa, Staphylococcus aureus
KSMP

SEQ ID NO: 1704250 - protein, 7 aa, Staphylococcus aureus
LSERTKR

SEQ ID NO: 1704251 - protein, 13 aa, Staphylococcus aureus
NSNRLANSSFQDK

SEQ ID NO: 1704252 - protein, 5 aa, Staphylococcus aureus
PAHHK

SEQ ID NO: 1704253 - protein, 4 aa, Staphylococcus aureus
PKDL

SEQ ID NO: 1704254 - protein, 16 aa, Staphylococcus aureus
PKSTRTITPSFTSNGF

SEQ ID NO: 1704255 - protein, 45 aa, Staphylococcus aureus
QAAETTQDQTTNKNVLDSNKVKATTEQAKAEVKNPTQNISGTQVY

SEQ ID NO: 1704256 - protein, 9 aa, Staphylococcus aureus
QDVKNKGVT

SEQ ID NO: 1704257 - protein, 6 aa, Staphylococcus aureus
QGYESC

SEQ ID NO: 1704258 - protein, 14 aa, Staphylococcus aureus
QLQPYGQYHGGGAH

SEQ ID NO: 1704259 - protein, 7 aa, Staphylococcus aureus
QQYSTDN

SEQ ID NO: 1704260 - protein, 11 aa, Staphylococcus aureus
QSDLSTEEERL

SEQ ID NO: 1704261 - protein, 5 aa, Staphylococcus aureus
RALAD

SEQ ID NO: 1704262 - protein, 28 aa, Staphylococcus aureus
RENSHKDRQNQKPPQKTSTDNEPKKGGF

SEQ ID NO: 1704263 - protein, 17 aa, Staphylococcus aureus
RESNGQVNAYNPSGASG

SEQ ID NO: 1704264 - protein, 7 aa, Staphylococcus aureus
RYGPNAN

SEQ ID NO: 1704265 - protein, 6 aa, Staphylococcus aureus
SAVATN

SEQ ID NO: 1704266 - protein, 7 aa, Staphylococcus aureus
SGPSHAE

SEQ ID NO: 1704267 - protein, 5 aa, Staphylococcus aureus
SLEKQ

SEQ ID NO: 1704268 - protein, 14 aa, Staphylococcus aureus
SLKDSKNPDRRVAQ

SEQ ID NO: 1704269 - protein, 9 aa, Staphylococcus aureus
SQKATANKV

SEQ ID NO: 1704270 - protein, 7 aa, Staphylococcus aureus
SRDVPNS

SEQ ID NO: 1704271 - protein, 15 aa, Staphylococcus aureus
STTGLNDPDADPSVR

SEQ ID NO: 1704272 - protein, 6 aa, Staphylococcus aureus
TEGSGI

SEQ ID NO: 1704273 - protein, 12 aa, Staphylococcus aureus
TYSYNNASYNNY

SEQ ID NO: 1704274 - protein, 14 aa, Staphylococcus aureus
VTEVESQNSKGVKW

SEQ ID NO: 1704275 - protein, 7 aa, Staphylococcus aureus
WNPVTKE

SEQ ID NO: 1704276 - protein, 12 aa, Staphylococcus aureus
YKQNRSAPPEEL

SEQ ID NO: 1704277 - protein, 15 aa, Staphylococcus aureus
YNTSVESIKQNNQLD

SEQ ID NO: 1704278 - protein, 19 aa, Staphylococcus aureus
YQEDGNNRVRNLESQKDDL

SEQ ID NO: 1704279 - protein, 42 aa, Staphylococcus aureus
ALKSYNDIEKDVSKNKGDKNVQSKLNQISNDIQSAHTSYKDA

SEQ ID NO: 1704280 - protein, 10 aa, Staphylococcus aureus
AQGEAPIKET

SEQ ID NO: 1704281 - protein, 8 aa, Staphylococcus aureus
AQSIDETY

SEQ ID NO: 1704282 - protein, 16 aa, Staphylococcus aureus
ATGAKSHLNELDQDDQ

SEQ ID NO: 1704283 - protein, 9 aa, Staphylococcus aureus
DFSLNGEKG

SEQ ID NO: 1704284 - protein, 6 aa, Staphylococcus aureus
DKTPEV

SEQ ID NO: 1704285 - protein, 14 aa, Staphylococcus aureus
DTYKSYKEKYDTAK

SEQ ID NO: 1704286 - protein, 8 aa, Staphylococcus aureus
EAKTRSDY

SEQ ID NO: 1704287 - protein, 5 aa, Staphylococcus aureus
ENPED

SEQ ID NO: 1704288 - protein, 6 aa, Staphylococcus aureus
ESMEGS

SEQ ID NO: 1704289 - protein, 9 aa, Staphylococcus aureus
FKKSQKTIA

SEQ ID NO: 1704290 - protein, 13 aa, Staphylococcus aureus
FTGDTHQAKGNND

SEQ ID NO: 1704291 - protein, 16 aa, Staphylococcus aureus
FTGGVTPAATSSDKPY

SEQ ID NO: 1704292 - protein, 24 aa, Staphylococcus aureus
GDEVSRPGPRIDEGLKELRDAIYR

SEQ ID NO: 1704293 - protein, 22 aa, Staphylococcus aureus
GEGLANEETSLDFNSTGDRKVT

SEQ ID NO: 1704294 - protein, 7 aa, Staphylococcus aureus
GERYDVG

SEQ ID NO: 1704295 - protein, 10 aa, Staphylococcus aureus
GISESTEKTV

SEQ ID NO: 1704296 - protein, 9 aa, Staphylococcus aureus
GKEDKVKAW

SEQ ID NO: 1704297 - protein, 8 aa, Staphylococcus aureus
GNGPQVGS

SEQ ID NO: 1704298 - protein, 13 aa, Staphylococcus aureus
GNLGQKSSKTIQD

SEQ ID NO: 1704299 - protein, 9 aa, Staphylococcus aureus
GYGDNAKAA

SEQ ID NO: 1704300 - protein, 5 aa, Staphylococcus aureus
HDQKA

SEQ ID NO: 1704301 - protein, 6 aa, Staphylococcus aureus
IQPNEV

SEQ ID NO: 1704302 - protein, 7 aa, Staphylococcus aureus
ISGPQSK

SEQ ID NO: 1704303 - protein, 5 aa, Staphylococcus aureus
KENDF

SEQ ID NO: 1704304 - protein, 7 aa, Staphylococcus aureus
KGKFPKR

SEQ ID NO: 1704305 - protein, 6 aa, Staphylococcus aureus
KGTIGS

SEQ ID NO: 1704306 - protein, 6 aa, Staphylococcus aureus
KNEIRE

SEQ ID NO: 1704307 - protein, 8 aa, Staphylococcus aureus
KPATTVKA

SEQ ID NO: 1704308 - protein, 6 aa, Staphylococcus aureus
KSLRDD

SEQ ID NO: 1704309 - protein, 10 aa, Staphylococcus aureus
LQPNERYENL

SEQ ID NO: 1704310 - protein, 11 aa, Staphylococcus aureus
LSKDELKGFNK

SEQ ID NO: 1704311 - protein, 16 aa, Staphylococcus aureus
MQPEQQKLTAKAGWAE

SEQ ID NO: 1704312 - protein, 8 aa, Staphylococcus aureus
NDAITDAR

SEQ ID NO: 1704313 - protein, 7 aa, Staphylococcus aureus
NKSEKYL

SEQ ID NO: 1704314 - protein, 15 aa, Staphylococcus aureus
NYKASDKAKDKLRKN

SEQ ID NO: 1704315 - protein, 11 aa, Staphylococcus aureus
PELKTGSGIDW

SEQ ID NO: 1704316 - protein, 5 aa, Staphylococcus aureus
PIEQQ

SEQ ID NO: 1704317 - protein, 7 aa, Staphylococcus aureus
PLSNDDE

SEQ ID NO: 1704318 - protein, 11 aa, Staphylococcus aureus
QATAEKSQTKL

SEQ ID NO: 1704319 - protein, 12 aa, Staphylococcus aureus
QGKVAAEEVIAE

SEQ ID NO: 1704320 - protein, 9 aa, Staphylococcus aureus
QVEKNLPGV

SEQ ID NO: 1704321 - protein, 37 aa, Staphylococcus aureus
SAPQTTNSTAFAKSSAEVQQTQQASIPASQKANLGNQ

SEQ ID NO: 1704322 - protein, 24 aa, Staphylococcus aureus
SGNQAHASEQDNYGYNPNDPTSYS

SEQ ID NO: 1704323 - protein, 31 aa, Staphylococcus aureus
SNGEAKASENTQQTSTKHQTTQNNYVTDQQK

SEQ ID NO: 1704324 - protein, 15 aa, Staphylococcus aureus
SRTISASQAAGYNFI

SEQ ID NO: 1704325 - protein, 10 aa, Staphylococcus aureus
SSNNDVGHHA

SEQ ID NO: 1704326 - protein, 21 aa, Staphylococcus aureus
TDIDREKEKQIAKMEKRARDI

SEQ ID NO: 1704327 - protein, 16 aa, Staphylococcus aureus
TDNSAKAESKKDDTDL

SEQ ID NO: 1704328 - protein, 6 aa, Staphylococcus aureus
TQQGFK

SEQ ID NO: 1704329 - protein, 26 aa, Staphylococcus aureus
WDNAAAADGYTIDNRPTVGSIAQTDV

SEQ ID NO: 1704330 - protein, 14 aa, Staphylococcus aureus
YEIPKEQLKEKDGH

SEQ ID NO: 1704331 - protein, 26 aa, Staphylococcus aureus
ADHSTGGLTIGKDKGYEWNPQPIKSM

SEQ ID NO: 1704332 - protein, 13 aa, Staphylococcus aureus
AFQKDAKAKYKDA

SEQ ID NO: 1704333 - protein, 17 aa, Staphylococcus aureus
ALPSHEASADSNNGYKE

SEQ ID NO: 1704334 - protein, 13 aa, Staphylococcus aureus
ANSKVKNYKVTPE

SEQ ID NO: 1704335 - protein, 26 aa, Staphylococcus aureus
ATAKQNINAADTNQEVAQAKDQGTQN

SEQ ID NO: 1704336 - protein, 6 aa, Staphylococcus aureus
ATLGKQ

SEQ ID NO: 1704337 - protein, 52 aa, Staphylococcus aureus
CGNSNSQDQGNKTEQKTKSEDSNVKTDKTKHLTGTFSSKNGETVEGKAEIKN

SEQ ID NO: 1704338 - protein, 7 aa, Staphylococcus aureus
DKENGMH

SEQ ID NO: 1704339 - protein, 15 aa, Staphylococcus aureus
DKNKKKEETKSFPIT

SEQ ID NO: 1704340 - protein, 4 aa, Staphylococcus aureus
DTID

SEQ ID NO: 1704341 - protein, 14 aa, Staphylococcus aureus
EPGNSGSPVLNSNN

SEQ ID NO: 1704342 - protein, 4 aa, Staphylococcus aureus
EWAP

SEQ ID NO: 1704343 - protein, 7 aa, Staphylococcus aureus
GPNNFTD

SEQ ID NO: 1704344 - protein, 17 aa, Staphylococcus aureus
GRAISRENETSHSASAT

SEQ ID NO: 1704345 - protein, 4 aa, Staphylococcus aureus
IKNP

SEQ ID NO: 1704346 - protein, 12 aa, Staphylococcus aureus
IQNGKERSDAYK

SEQ ID NO: 1704347 - protein, 17 aa, Staphylococcus aureus
KEGFRDQEFKKGDKGTW

SEQ ID NO: 1704348 - protein, 6 aa, Staphylococcus aureus
KPEIYT

SEQ ID NO: 1704349 - protein, 16 aa, Staphylococcus aureus
KSYRDALPAKQLGGLN

SEQ ID NO: 1704350 - protein, 9 aa, Staphylococcus aureus
NNNVGGRMN

SEQ ID NO: 1704351 - protein, 12 aa, Staphylococcus aureus
NWAGQASSNGFK

SEQ ID NO: 1704352 - protein, 6 aa, Staphylococcus aureus
PESYLG

SEQ ID NO: 1704353 - protein, 17 aa, Staphylococcus aureus
PSAINQDNYPNGGFTAE

SEQ ID NO: 1704354 - protein, 6 aa, Staphylococcus aureus
PSPQPI

SEQ ID NO: 1704355 - protein, 13 aa, Staphylococcus aureus
QAGASLYDTESVD

SEQ ID NO: 1704356 - protein, 23 aa, Staphylococcus aureus
QDPTTKGIGDSHQALEYEEPRRK

SEQ ID NO: 1704357 - protein, 9 aa, Staphylococcus aureus
QFESTGTIK

SEQ ID NO: 1704358 - protein, 18 aa, Staphylococcus aureus
QNKKQGTHLYITGRMIKL

SEQ ID NO: 1704359 - protein, 62 aa, Staphylococcus aureus
QYSEDAKKTQKDYASQSKKDKNEKSNTKNPQLPTQDELKHKSKPAQSFNNDVNQKDTRATSL

SEQ ID NO: 1704360 - protein, 4 aa, Staphylococcus aureus
RAQT

SEQ ID NO: 1704361 - protein, 18 aa, Staphylococcus aureus
RDAGTGIREYNDGTFGYE

SEQ ID NO: 1704362 - protein, 12 aa, Staphylococcus aureus
RQDGAKKSKITV

SEQ ID NO: 1704363 - protein, 5 aa, Staphylococcus aureus
SDDTL

SEQ ID NO: 1704364 - protein, 8 aa, Staphylococcus aureus
SISPEYNA

SEQ ID NO: 1704365 - protein, 5 aa, Staphylococcus aureus
TAGPT

SEQ ID NO: 1704366 - protein, 19 aa, Staphylococcus aureus
TNELTSKDYTKNKKAAEEV

SEQ ID NO: 1704367 - protein, 28 aa, Staphylococcus aureus
TNEVSASSSFDKGKYKKGDDASYFEPTG

SEQ ID NO: 1704368 - protein, 10 aa, Staphylococcus aureus
TNLERSNEHE

SEQ ID NO: 1704369 - protein, 9 aa, Staphylococcus aureus
TNSNIDETN

SEQ ID NO: 1704370 - protein, 4 aa, Staphylococcus aureus
TNVY

SEQ ID NO: 1704371 - protein, 27 aa, Staphylococcus aureus
TTTAAPSSNGRSISNGYASGSNLYTSG

SEQ ID NO: 1704372 - protein, 5 aa, Staphylococcus aureus
VPYTG

SEQ ID NO: 1704373 - protein, 7 aa, Staphylococcus aureus
AFGSNYD

SEQ ID NO: 1704374 - protein, 8 aa, Staphylococcus aureus
AQDRHTQA

SEQ ID NO: 1704375 - protein, 13 aa, Staphylococcus aureus
AQVGKPVSNRWGN

SEQ ID NO: 1704376 - protein, 7 aa, Staphylococcus aureus
ATVEERN

SEQ ID NO: 1704377 - protein, 6 aa, Staphylococcus aureus
DDAVNQ

SEQ ID NO: 1704378 - protein, 7 aa, Staphylococcus aureus
DDLQNIS

SEQ ID NO: 1704379 - protein, 8 aa, Staphylococcus aureus
DKSYDKDT

SEQ ID NO: 1704380 - protein, 5 aa, Staphylococcus aureus
DPSAK

SEQ ID NO: 1704381 - protein, 13 aa, Staphylococcus aureus
GPDYTDLTEQNTH

SEQ ID NO: 1704382 - protein, 13 aa, Staphylococcus aureus
HITPVSEKKVDDK

SEQ ID NO: 1704383 - protein, 32 aa, Staphylococcus aureus
IADDGSTKNITKSVRDKIGAYESVGSRPQPNM

SEQ ID NO: 1704384 - protein, 19 aa, Staphylococcus aureus
INQADTNAEVDQAQQLGTK

SEQ ID NO: 1704385 - protein, 10 aa, Staphylococcus aureus
KAVTPNSNDY

SEQ ID NO: 1704386 - protein, 7 aa, Staphylococcus aureus
KDDNTYE

SEQ ID NO: 1704387 - protein, 8 aa, Staphylococcus aureus
KNESVKEI

SEQ ID NO: 1704388 - protein, 9 aa, Staphylococcus aureus
LESPTDKKV

SEQ ID NO: 1704389 - protein, 11 aa, Staphylococcus aureus
MAKGEDPEKVI

SEQ ID NO: 1704390 - protein, 10 aa, Staphylococcus aureus
NADQATKDNL

SEQ ID NO: 1704391 - protein, 14 aa, Staphylococcus aureus
NDRHQITDTTNGHY

SEQ ID NO: 1704392 - protein, 5 aa, Staphylococcus aureus
PDNEV

SEQ ID NO: 1704393 - protein, 6 aa, Staphylococcus aureus
PEARNE

SEQ ID NO: 1704394 - protein, 6 aa, Staphylococcus aureus
REHRRK

SEQ ID NO: 1704395 - protein, 12 aa, Staphylococcus aureus
SEEGANKSGLAW

SEQ ID NO: 1704396 - protein, 4 aa, Staphylococcus aureus
TAGY

SEQ ID NO: 1704397 - protein, 7 aa, Staphylococcus aureus
TKAPETV

SEQ ID NO: 1704398 - protein, 5 aa, Staphylococcus aureus
VNMGQ

SEQ ID NO: 1704399 - protein, 11 aa, Staphylococcus aureus
YPRNSIDTKEY

SEQ ID NO: 1704400 - protein, 11 aa, Staphylococcus aureus
ADTSQLDKAKS

SEQ ID NO: 1704401 - protein, 6 aa, Staphylococcus aureus
AGRGYR

SEQ ID NO: 1704402 - protein, 21 aa, Staphylococcus aureus
DFKNGTTKDGVKKFDGTGPFK

SEQ ID NO: 1704403 - protein, 4 aa, Staphylococcus aureus
DFYG

SEQ ID NO: 1704404 - protein, 8 aa, Staphylococcus aureus
DHPKPVPY

SEQ ID NO: 1704405 - protein, 8 aa, Staphylococcus aureus
DKDKTSAL

SEQ ID NO: 1704406 - protein, 14 aa, Staphylococcus aureus
EYESNYETASDDSL

SEQ ID NO: 1704407 - protein, 18 aa, Staphylococcus aureus
FLDPNKASSLLSSGFSPD

SEQ ID NO: 1704408 - protein, 32 aa, Staphylococcus aureus; identical to SEQ ID NO: 1626945

SEQ ID NO: 1704409 - protein, 6 aa, Staphylococcus aureus
GLKNKR

SEQ ID NO: 1704410 - protein, 12 aa, Staphylococcus aureus
GSGDLKGSSVGY

SEQ ID NO: 1704411 - protein, 12 aa, Staphylococcus aureus
GSGNLKGSSVGY

SEQ ID NO: 1704412 - protein, 10 aa, Staphylococcus aureus
HGSKDTKDEV

SEQ ID NO: 1704413 - protein, 6 aa, Staphylococcus aureus
IASSVP

SEQ ID NO: 1704414 - protein, 14 aa, Staphylococcus aureus
KEIKNYSVSQSQFE

SEQ ID NO: 1704415 - protein, 5 aa, Staphylococcus aureus
KKDKV

SEQ ID NO: 1704416 - protein, 15 aa, Staphylococcus aureus
KKMTVQPDVSQSDID

SEQ ID NO: 1704417 - protein, 12 aa, Staphylococcus aureus
KSFTNSKGIQGW

SEQ ID NO: 1704418 - protein, 12 aa, Staphylococcus aureus
KSGYGADTSGIQ

SEQ ID NO: 1704419 - protein, 5 aa, Staphylococcus aureus
KTNDK

SEQ ID NO: 1704420 - protein, 16 aa, Staphylococcus aureus
LSKNNKSKLMKASEAT

SEQ ID NO: 1704421 - protein, 11 aa, Staphylococcus aureus
NALGKSPQEQL

SEQ ID NO: 1704422 - protein, 9 aa, Staphylococcus aureus
NFKTRTFKS

SEQ ID NO: 1704423 - protein, 4 aa, Staphylococcus aureus
NGNE

SEQ ID NO: 1704424 - protein, 11 aa, Staphylococcus aureus
NSQNVEKDLTK

SEQ ID NO: 1704425 - protein, 5 aa, Staphylococcus aureus
NTAKS

SEQ ID NO: 1704426 - protein, 12 aa, Staphylococcus aureus
PDGKKIGNSNTP

SEQ ID NO: 1704427 - protein, 14 aa, Staphylococcus aureus
PKNYEDKSNPDPKV

SEQ ID NO: 1704428 - protein, 6 aa, Staphylococcus aureus
RKTEID

SEQ ID NO: 1704429 - protein, 7 aa, Staphylococcus aureus
RNGSMKA

SEQ ID NO: 1704430 - protein, 4 aa, Staphylococcus aureus
RRIQ

SEQ ID NO: 1704431 - protein, 6 aa, Staphylococcus aureus
SKDTRQ

SEQ ID NO: 1704432 - protein, 8 aa, Staphylococcus aureus
SPINGDLD

SEQ ID NO: 1704433 - protein, 6 aa, Staphylococcus aureus
SPYTRQ

SEQ ID NO: 1704434 - protein, 5 aa, Staphylococcus aureus
SSDFG

SEQ ID NO: 1704435 - protein, 5 aa, Staphylococcus aureus
SWNPV

SEQ ID NO: 1704436 - protein, 13 aa, Staphylococcus aureus
TENQQPLKTTNVD

SEQ ID NO: 1704437 - protein, 4 aa, Staphylococcus aureus
TSQK

SEQ ID NO: 1704438 - protein, 15 aa, Staphylococcus aureus
VDENDPAFNNPSKPI

SEQ ID NO: 1704439 - protein, 9 aa, Staphylococcus aureus
VGKEGADKR

SEQ ID NO: 1704440 - protein, 11 aa, Staphylococcus aureus
YAKPATSPFND

SEQ ID NO: 1704441 - protein, 19 aa, Staphylococcus aureus
YDKEGYRDGEFKKGDKGTW

SEQ ID NO: 1704442 - protein, 9 aa, Staphylococcus aureus
ADHTSESTV

SEQ ID NO: 1704443 - protein, 10 aa, Staphylococcus aureus
AKVPKGTQQY

SEQ ID NO: 1704444 - protein, 17 aa, Staphylococcus aureus
ANKVTETIRKETDAKPL

SEQ ID NO: 1704445 - protein, 7 aa, Staphylococcus aureus
DHEVEGS

SEQ ID NO: 1704446 - protein, 25 aa, Staphylococcus aureus
DKNEAQASTSLPTSNEYQNEKLANE

SEQ ID NO: 1704447 - protein, 9 aa, Staphylococcus aureus
DLKGSSVGY

SEQ ID NO: 1704448 - protein, 4 aa, Staphylococcus aureus
DTPE

SEQ ID NO: 1704449 - protein, 4 aa, Staphylococcus aureus
EEID

SEQ ID NO: 1704450 - protein, 23 aa, Staphylococcus aureus
ERVKSANDAISKLNEKDSIENRR

SEQ ID NO: 1704451 - protein, 8 aa, Staphylococcus aureus
GREGRNIR

SEQ ID NO: 1704452 - protein, 7 aa, Staphylococcus aureus
HGDVEPT

SEQ ID NO: 1704453 - protein, 6 aa, Staphylococcus aureus
KKHKDT

SEQ ID NO: 1704454 - protein, 14 aa, Staphylococcus aureus
KKSGFKMNDRKQSV

SEQ ID NO: 1704455 - protein, 8 aa, Staphylococcus aureus
KKYGENET

SEQ ID NO: 1704456 - protein, 7 aa, Staphylococcus aureus
KNGSIKV

SEQ ID NO: 1704457 - protein, 7 aa, Staphylococcus aureus
KNQIEDE

SEQ ID NO: 1704458 - protein, 5 aa, Staphylococcus aureus
KPQFT

SEQ ID NO: 1704459 - protein, 10 aa, Staphylococcus aureus
LGEDETLAKR

SEQ ID NO: 1704460 - protein, 16 aa, Staphylococcus aureus
LNDRNSHHLKEAERDL

SEQ ID NO: 1704461 - protein, 10 aa, Staphylococcus aureus
MSEKDKEEFE

SEQ ID NO: 1704462 - protein, 7 aa, Staphylococcus aureus
NGTSQNI

SEQ ID NO: 1704463 - protein, 6 aa, Staphylococcus aureus
RTSYGQ

SEQ ID NO: 1704464 - protein, 18 aa, Staphylococcus aureus
TYYPSKLNKDQIKEEMLA

SEQ ID NO: 1704465 - protein, 10 aa, Staphylococcus aureus
VSKDYKVGDR

SEQ ID NO: 1704466 - protein, 9 aa, Staphylococcus aureus
AEHNQGPAF

SEQ ID NO: 1704467 - protein, 15 aa, Staphylococcus aureus
ALSAARPGARKETLE

SEQ ID NO: 1704468 - protein, 10 aa, Staphylococcus aureus
ASKDEPSLAD

SEQ ID NO: 1704469 - protein, 18 aa, Staphylococcus aureus
DNDGRRKKGQDAEHSRSD

SEQ ID NO: 1704470 - protein, 8 aa, Staphylococcus aureus
EAGEQATF

SEQ ID NO: 1704471 - protein, 5 aa, Staphylococcus aureus
EEELS

SEQ ID NO: 1704472 - protein, 16 aa, Staphylococcus aureus
EKEKEAKEKVDKTAKE

SEQ ID NO: 1704473 - protein, 4 aa, Staphylococcus aureus
EKNL

SEQ ID NO: 1704474 - protein, 10 aa, Staphylococcus aureus
EPKGKDMETR

SEQ ID NO: 1704475 - protein, 11 aa, Staphylococcus aureus
EVTGKSYAENY

SEQ ID NO: 1704476 - protein, 17 aa, Staphylococcus aureus
GGNKGLEEKKENKQLTY

SEQ ID NO: 1704477 - protein, 12 aa, Staphylococcus aureus
GIADDGKKKRII

SEQ ID NO: 1704478 - protein, 7 aa, Staphylococcus aureus
GKKGIKR

SEQ ID NO: 1704479 - protein, 6 aa, Staphylococcus aureus
GRIHPG

SEQ ID NO: 1704480 - protein, 4 aa, Staphylococcus aureus
GSPM

SEQ ID NO: 1704481 - protein, 8 aa, Staphylococcus aureus
HDAFKNRN

SEQ ID NO: 1704482 - protein, 7 aa, Staphylococcus aureus
IKYDDYS

SEQ ID NO: 1704483 - protein, 31 aa, Staphylococcus aureus; identical to SEQ ID NO: 1632206

SEQ ID NO: 1704484 - protein, 8 aa, Staphylococcus aureus
KGIKNTPN

SEQ ID NO: 1704485 - protein, 9 aa, Staphylococcus aureus
KTNDQGKIE

SEQ ID NO: 1704486 - protein, 12 aa, Staphylococcus aureus
LADNKSEATNLT

SEQ ID NO: 1704487 - protein, 10 aa, Staphylococcus aureus
LKTARTNADV

SEQ ID NO: 1704488 - protein, 13 aa, Staphylococcus aureus
LNEPNTDDTGKIK

SEQ ID NO: 1704489 - protein, 8 aa, Staphylococcus aureus
LSESYDGV

SEQ ID NO: 1704490 - protein, 5 aa, Staphylococcus aureus
MQQSA

SEQ ID NO: 1704491 - protein, 11 aa, Staphylococcus aureus
NAKHNLTNSEI

SEQ ID NO: 1704492 - protein, 12 aa, Staphylococcus aureus
QAHKEADNIKKE

SEQ ID NO: 1704493 - protein, 6 aa, Staphylococcus aureus
QEVDSI

SEQ ID NO: 1704494 - protein, 5 aa, Staphylococcus aureus
QKFST

SEQ ID NO: 1704495 - protein, 9 aa, Staphylococcus aureus
RNKRTAKGS

SEQ ID NO: 1704496 - protein, 14 aa, Staphylococcus aureus
RTISASEVSSYNYI

SEQ ID NO: 1704497 - protein, 5 aa, Staphylococcus aureus
SKPIP

SEQ ID NO: 1704498 - protein, 31 aa, Staphylococcus aureus
SQDAFESSQDSKNANRQSNLRDNKVNPEEQP

SEQ ID NO: 1704499 - protein, 10 aa, Staphylococcus aureus
TAQLKGKDDM

SEQ ID NO: 1704500 - protein, 17 aa, Staphylococcus aureus
TDDSNGRPKDDEKRYPV

SEQ ID NO: 1704501 - protein, 7 aa, Staphylococcus aureus
TNTTGQS

SEQ ID NO: 1704502 - protein, 14 aa, Staphylococcus aureus
TRHHDSDLKRGQRQ

SEQ ID NO: 1704503 - protein, 12 aa, Staphylococcus aureus
TVPAGKYAKQYL

SEQ ID NO: 1704504 - protein, 4 aa, Staphylococcus aureus
YGGP

SEQ ID NO: 1704505 - protein, 28 aa, Staphylococcus aureus
YNYNTTQTTTTTTTTTTTSSISHSGNLY

SEQ ID NO: 1704506 - protein, 16 aa, Staphylococcus aureus
AANNGVAQIKPTNSGL

SEQ ID NO: 1704507 - protein, 8 aa, Staphylococcus aureus
DAYSETTK

SEQ ID NO: 1704508 - protein, 26 aa, Staphylococcus aureus
DEILEQKESKIEEKQQQVDAKESSVQ

SEQ ID NO: 1704509 - protein, 14 aa, Staphylococcus aureus
EENLERKSDLLDKK

SEQ ID NO: 1704510 - protein, 17 aa, Staphylococcus aureus
EGNFPVQGRSVKSTLHS

SEQ ID NO: 1704511 - protein, 19 aa, Staphylococcus aureus
EQTEAELRERRSELQRQET

SEQ ID NO: 1704512 - protein, 9 aa, Staphylococcus aureus
GSNNDKKVT

SEQ ID NO: 1704513 - protein, 6 aa, Staphylococcus aureus
IEDGDL

SEQ ID NO: 1704514 - protein, 13 aa, Staphylococcus aureus
IKKPDAEKTINDD

SEQ ID NO: 1704515 - protein, 17 aa, Staphylococcus aureus
INSPKTIADNKYSEIQD

SEQ ID NO: 1704516 - protein, 15 aa, Staphylococcus aureus
LSTTGGNSGSPVFNE

SEQ ID NO: 1704517 - protein, 7 aa, Staphylococcus aureus
LTVNPNS

SEQ ID NO: 1704518 - protein, 11 aa, Staphylococcus aureus
MKGIKDAPSLD

SEQ ID NO: 1704519 - protein, 8 aa, Staphylococcus aureus
NWGPYDRD

SEQ ID NO: 1704520 - protein, 7 aa, Staphylococcus aureus
SDRAREI

SEQ ID NO: 1704521 - protein, 8 aa, Staphylococcus aureus
AEKRGVTK

SEQ ID NO: 1704522 - protein, 13 aa, Staphylococcus aureus
DDMKKVKKENKKL

SEQ ID NO: 1704523 - protein, 9 aa, Staphylococcus aureus
ENNRQGYLD

SEQ ID NO: 1704524 - protein, 8 aa, Staphylococcus aureus
GGSANSEK

SEQ ID NO: 1704525 - protein, 4 aa, Staphylococcus aureus
GYPF

SEQ ID NO: 1704526 - protein, 5 aa, Staphylococcus aureus
HRQNK

SEQ ID NO: 1704527 - protein, 18 aa, Staphylococcus aureus
KDGTHSDGRVSNSSSKSL

SEQ ID NO: 1704528 - protein, 14 aa, Staphylococcus aureus
KEDIKAEKNADTNA

SEQ ID NO: 1704529 - protein, 8 aa, Staphylococcus aureus
KGASDKGR

SEQ ID NO: 1704530 - protein, 4 aa, Staphylococcus aureus
KGKG

SEQ ID NO: 1704531 - protein, 6 aa, Staphylococcus aureus
KGNNEV

SEQ ID NO: 1704532 - protein, 12 aa, Staphylococcus aureus
KKGYQKLNGDEA

SEQ ID NO: 1704533 - protein, 6 aa, Staphylococcus aureus
KKKLQR

SEQ ID NO: 1704534 - protein, 4 aa, Staphylococcus aureus
KQAK

SEQ ID NO: 1704535 - protein, 5 aa, Staphylococcus aureus
LEDEP

SEQ ID NO: 1704536 - protein, 10 aa, Staphylococcus aureus
LGKEKEAEDL

SEQ ID NO: 1704537 - protein, 15 aa, Staphylococcus aureus
NANPDATQEERQAAI

SEQ ID NO: 1704538 - protein, 7 aa, Staphylococcus aureus
NGTSTPI

SEQ ID NO: 1704539 - protein, 10 aa, Staphylococcus aureus
PTKPLPNDKL

SEQ ID NO: 1704540 - protein, 4 aa, Staphylococcus aureus
QQTY

SEQ ID NO: 1704541 - protein, 10 aa, Staphylococcus aureus
TGASTGIGQA

SEQ ID NO: 1704542 - protein, 13 aa, Staphylococcus aureus
VATKAGKDPKNDP

SEQ ID NO: 1704543 - protein, 14 aa, Staphylococcus aureus
YQQHDADYHEENMT

SEQ ID NO: 1704544 - protein, 12 aa, Staphylococcus aureus
AINKTQNSGYEN

SEQ ID NO: 1704545 - protein, 26 aa, Staphylococcus aureus
ANAADSDINIKTGTTDIGSNTTVKTG

SEQ ID NO: 1704546 - protein, 7 aa, Staphylococcus aureus
EAPKTQI

SEQ ID NO: 1704547 - protein, 12 aa, Staphylococcus aureus
EDVRHSSDKPEL

SEQ ID NO: 1704548 - protein, 9 aa, Staphylococcus aureus
EVEQQNSKS

SEQ ID NO: 1704549 - protein, 8 aa, Staphylococcus aureus
FKEKEEAF

SEQ ID NO: 1704550 - protein, 5 aa, Staphylococcus aureus
GDYDG

SEQ ID NO: 1704551 - protein, 5 aa, Staphylococcus aureus
GGGGI

SEQ ID NO: 1704552 - protein, 10 aa, Staphylococcus aureus
GLTQEEAINE

SEQ ID NO: 1704553 - protein, 6 aa, Staphylococcus aureus
GTPRAL

SEQ ID NO: 1704554 - protein, 10 aa, Staphylococcus aureus
GVDGKGNELL

SEQ ID NO: 1704555 - protein, 8 aa, Staphylococcus aureus
GVDNAAGR

SEQ ID NO: 1704556 - protein, 11 aa, Staphylococcus aureus
HNTPTFKAEPG

SEQ ID NO: 1704557 - protein, 25 aa, Staphylococcus aureus
KEKDGPTFSKKLDDSEVKKQGKQMA

SEQ ID NO: 1704558 - protein, 7 aa, Staphylococcus aureus
KKGDTLS

SEQ ID NO: 1704559 - protein, 11 aa, Staphylococcus aureus
KSKYATGRTPR

SEQ ID NO: 1704560 - protein, 12 aa, Staphylococcus aureus
KYKSSKDYKNLD

SEQ ID NO: 1704561 - protein, 9 aa, Staphylococcus aureus
LSPINDKND

SEQ ID NO: 1704562 - protein, 11 aa, Staphylococcus aureus
NAKAGKYQEKY

SEQ ID NO: 1704563 - protein, 9 aa, Staphylococcus aureus
NDKSLPQLN

SEQ ID NO: 1704564 - protein, 18 aa, Staphylococcus aureus
NPEKLKQGGAQGGQSGMS

SEQ ID NO: 1704565 - protein, 10 aa, Staphylococcus aureus
QNWNNGGWRK

SEQ ID NO: 1704566 - protein, 4 aa, Staphylococcus aureus
QRNK

SEQ ID NO: 1704567 - protein, 8 aa, Staphylococcus aureus
TAPPSGVY

SEQ ID NO: 1704568 - protein, 8 aa, Staphylococcus aureus
TNSEQSWQ

SEQ ID NO: 1704569 - protein, 16 aa, Staphylococcus aureus
TSRTISANQAGSYNFI

SEQ ID NO: 1704570 - protein, 13 aa, Staphylococcus aureus
TTLPTDGGKPMKP

SEQ ID NO: 1704571 - protein, 5 aa, Staphylococcus aureus
VTSTT

SEQ ID NO: 1704572 - protein, 19 aa, Staphylococcus aureus
DHLTTKGSLSRDYAVNKDN

SEQ ID NO: 1704573 - protein, 8 aa, Staphylococcus aureus
EGTLAQDV

SEQ ID NO: 1704574 - protein, 4 aa, Staphylococcus aureus
GNAP

SEQ ID NO: 1704575 - protein, 6 aa, Staphylococcus aureus
GTNNKI

SEQ ID NO: 1704576 - protein, 6 aa, Staphylococcus aureus
HKDDFG

SEQ ID NO: 1704577 - protein, 12 aa, Staphylococcus aureus
IQPGSSGSPILN

SEQ ID NO: 1704578 - protein, 7 aa, Staphylococcus aureus
KHSGSYM

SEQ ID NO: 1704579 - protein, 16 aa, Staphylococcus aureus
KKESMDTGSAKKDGEL

SEQ ID NO: 1704580 - protein, 14 aa, Staphylococcus aureus
KMAQEQEKLKEERI

SEQ ID NO: 1704581 - protein, 7 aa, Staphylococcus aureus
KNQQISY

SEQ ID NO: 1704582 - protein, 11 aa, Staphylococcus aureus
KTTATADSDKF

SEQ ID NO: 1704583 - protein, 9 aa, Staphylococcus aureus
MSKGYGYQD

SEQ ID NO: 1704584 - protein, 8 aa, Staphylococcus aureus
NQRAIEAA

SEQ ID NO: 1704585 - protein, 8 aa, Staphylococcus aureus
QGVPTNGI

SEQ ID NO: 1704586 - protein, 8 aa, Staphylococcus aureus
REGLPAKQ

SEQ ID NO: 1704587 - protein, 5 aa, Staphylococcus aureus
RQAQT

SEQ ID NO: 1704588 - protein, 11 aa, Staphylococcus aureus
RTVATHRKAQR

SEQ ID NO: 1704589 - protein, 9 aa, Staphylococcus aureus
SSHLTEREK

SEQ ID NO: 1704590 - protein, 15 aa, Staphylococcus aureus
TMEPTATNNKEFTVT

SEQ ID NO: 1704591 - protein, 14 aa, Staphylococcus aureus
TTVSNIQNTNNIAN

SEQ ID NO: 1704592 - protein, 14 aa, Staphylococcus aureus
YEKTAKNGAKYADR

SEQ ID NO: 1704593 - protein, 10 aa, Staphylococcus aureus
AKDGYTKEHP

SEQ ID NO: 1704594 - protein, 9 aa, Staphylococcus aureus
ANNAKALKD

SEQ ID NO: 1704595 - protein, 8 aa, Staphylococcus aureus
DGNQLDEE

SEQ ID NO: 1704596 - protein, 9 aa, Staphylococcus aureus
DKKKVTAQE

SEQ ID NO: 1704597 - protein, 10 aa, Staphylococcus aureus
DNLTKNNKGI

SEQ ID NO: 1704598 - protein, 4 aa, Staphylococcus aureus
DNRQ

SEQ ID NO: 1704599 - protein, 4 aa, Staphylococcus aureus
EKSF

SEQ ID NO: 1704600 - protein, 12 aa, Staphylococcus aureus
EPKLTKQNIEQA

SEQ ID NO: 1704601 - protein, 9 aa, Staphylococcus aureus
ESNKISTDQ

SEQ ID NO: 1704602 - protein, 6 aa, Staphylococcus aureus
GNNDNM

SEQ ID NO: 1704603 - protein, 14 aa, Staphylococcus aureus
HKTISTDKIATNKK

SEQ ID NO: 1704604 - protein, 7 aa, Staphylococcus aureus
HSEHKES

SEQ ID NO: 1704605 - protein, 10 aa, Staphylococcus aureus
ITNPEKAKGI

SEQ ID NO: 1704606 - protein, 8 aa, Staphylococcus aureus
KAKVTVQE

SEQ ID NO: 1704607 - protein, 10 aa, Staphylococcus aureus
KDIENTYDGT

SEQ ID NO: 1704608 - protein, 7 aa, Staphylococcus aureus
KDTGNIQ

SEQ ID NO: 1704609 - protein, 6 aa, Staphylococcus aureus
KGNKYS

SEQ ID NO: 1704610 - protein, 22 aa, Staphylococcus aureus
KPVNDKSYTGWTSDGHTGEDVN

SEQ ID NO: 1704611 - protein, 9 aa, Staphylococcus aureus
KSEPDINQN

SEQ ID NO: 1704612 - protein, 11 aa, Staphylococcus aureus
MSNKDENVKQL

SEQ ID NO: 1704613 - protein, 17 aa, Staphylococcus aureus
NRTVSSSNYHIDVFLYK

SEQ ID NO: 1704614 - protein, 9 aa, Staphylococcus aureus
NSSENERDK

SEQ ID NO: 1704615 - protein, 12 aa, Staphylococcus aureus
QNKPYNTKGVIV

SEQ ID NO: 1704616 - protein, 16 aa, Staphylococcus aureus
REGATDLNRKTSLNPN

SEQ ID NO: 1704617 - protein, 7 aa, Staphylococcus aureus
SHTPKRH

SEQ ID NO: 1704618 - protein, 6 aa, Staphylococcus aureus
TTTETY

SEQ ID NO: 1704619 - protein, 15 aa, Staphylococcus aureus
TVDKDGKPSRMNQPY

SEQ ID NO: 1704620 - protein, 6 aa, Staphylococcus aureus
YREQLE

SEQ ID NO: 1704621 - protein, 8 aa, Staphylococcus aureus
DGKSHTID

SEQ ID NO: 1704622 - protein, 6 aa, Staphylococcus aureus
DPTYDK

SEQ ID NO: 1704623 - protein, 10 aa, Staphylococcus aureus
DSTISTNGLT

SEQ ID NO: 1704624 - protein, 14 aa, Staphylococcus aureus
DYKARGANENQTLN

SEQ ID NO: 1704625 - protein, 7 aa, Staphylococcus aureus
ENNPKGS

SEQ ID NO: 1704626 - protein, 17 aa, Staphylococcus aureus
FSTGTNDLISESNNWDE

SEQ ID NO: 1704627 - protein, 15 aa, Staphylococcus aureus
FTQSQYELPFNEMQY

SEQ ID NO: 1704628 - protein, 4 aa, Staphylococcus aureus
GSMS

SEQ ID NO: 1704629 - protein, 12 aa, Staphylococcus aureus
HTVSAHRKAQKA

SEQ ID NO: 1704630 - protein, 17 aa, Staphylococcus aureus
INATPGATREEKQEAIN

SEQ ID NO: 1704631 - protein, 14 aa, Staphylococcus aureus
ITAHPNGDKGNGGI

SEQ ID NO: 1704632 - protein, 25 aa, Staphylococcus aureus
KAENDPKKSAKDLKAYYDKGYKTDI

SEQ ID NO: 1704633 - protein, 11 aa, Staphylococcus aureus
KGYGAKDIPYA

SEQ ID NO: 1704634 - protein, 7 aa, Staphylococcus aureus
KSYDKDT

SEQ ID NO: 1704635 - protein, 16 aa, Staphylococcus aureus
KVVDSKSIKMEVFLNT

SEQ ID NO: 1704636 - protein, 16 aa, Staphylococcus aureus
LNADATTNTTPQIKGA

SEQ ID NO: 1704637 - protein, 14 aa, Staphylococcus aureus
NSPAESHTVSTNPY

SEQ ID NO: 1704638 - protein, 6 aa, Staphylococcus aureus
NTRTAK

SEQ ID NO: 1704639 - protein, 5 aa, Staphylococcus aureus
NYEAD

SEQ ID NO: 1704640 - protein, 6 aa, Staphylococcus aureus
TAQEID

SEQ ID NO: 1704641 - protein, 6 aa, Staphylococcus aureus
TEKNNT

SEQ ID NO: 1704642 - protein, 7 aa, Staphylococcus aureus
TGTGQAE

SEQ ID NO: 1704643 - protein, 28 aa, Staphylococcus aureus
TYAYGPRSESFSGNIENTESAKIIFDIF

SEQ ID NO: 1704644 - protein, 17 aa, Staphylococcus aureus
VYSKQDRQFFKGNRDYE

SEQ ID NO: 1704645 - protein, 6 aa, Staphylococcus aureus
YPWPGY

SEQ ID NO: 1704646 - protein, 9 aa, Staphylococcus aureus
CTTDKKEIK

SEQ ID NO: 1704647 - protein, 16 aa, Staphylococcus aureus
DDVEAPSDYVFRAEVS

SEQ ID NO: 1704648 - protein, 9 aa, Staphylococcus aureus
DKDGKLTGY

SEQ ID NO: 1704649 - protein, 12 aa, Staphylococcus aureus
DSGDAKNYQAQG

SEQ ID NO: 1704650 - protein, 11 aa, Staphylococcus aureus
FPEKSKDGKTL

SEQ ID NO: 1704651 - protein, 7 aa, Staphylococcus aureus
GTHPNSK

SEQ ID NO: 1704652 - protein, 5 aa, Staphylococcus aureus
KKPQR

SEQ ID NO: 1704653 - protein, 10 aa, Staphylococcus aureus
KTAQNKEGAY

SEQ ID NO: 1704654 - protein, 6 aa, Staphylococcus aureus
KVPNIK

SEQ ID NO: 1704655 - protein, 18 aa, Staphylococcus aureus
NKAYADEIDKSKDFTRGY

SEQ ID NO: 1704656 - protein, 16 aa, Staphylococcus aureus
NKTIDSSDYHIDVYLF

SEQ ID NO: 1704657 - protein, 6 aa, Staphylococcus aureus
TEKENS

SEQ ID NO: 1704658 - protein, 12 aa, Staphylococcus aureus
VTSRDDKNEIAK

SEQ ID NO: 1704659 - protein, 12 aa, Staphylococcus aureus
AARDAVSHDAQQ

SEQ ID NO: 1704660 - protein, 4 aa, Staphylococcus aureus
AFES

SEQ ID NO: 1704661 - protein, 9 aa, Staphylococcus aureus
AQQDENKEW

SEQ ID NO: 1704662 - protein, 9 aa, Staphylococcus aureus
EKGNAKQGF

SEQ ID NO: 1704663 - protein, 5 aa, Staphylococcus aureus
ETNVE

SEQ ID NO: 1704664 - protein, 10 aa, Staphylococcus aureus
GDNKKRLESS

SEQ ID NO: 1704665 - protein, 5 aa, Staphylococcus aureus
GQDYN

SEQ ID NO: 1704666 - protein, 38 aa, Staphylococcus aureus; identical to SEQ ID NO: 1632144

SEQ ID NO: 1704667 - protein, 22 aa, Staphylococcus aureus
LEKERMGDSIDGRQIQKILVEM

SEQ ID NO: 1704668 - protein, 9 aa, Staphylococcus aureus
LKNSDYNVE

SEQ ID NO: 1704669 - protein, 4 aa, Staphylococcus aureus
NCDR

SEQ ID NO: 1704670 - protein, 6 aa, Staphylococcus aureus
NNFNSE

SEQ ID NO: 1704671 - protein, 7 aa, Staphylococcus aureus
PFTTPEG

SEQ ID NO: 1704672 - protein, 11 aa, Staphylococcus aureus
QAYTNATDKIQ

SEQ ID NO: 1704673 - protein, 5 aa, Staphylococcus aureus
QHPFN

SEQ ID NO: 1704674 - protein, 4 aa, Staphylococcus aureus
SESM

SEQ ID NO: 1704675 - protein, 8 aa, Staphylococcus aureus
SNGLKQGQ

SEQ ID NO: 1704676 - protein, 29 aa, Staphylococcus aureus
TKLEHNNKALRDTAKKNLDDSKENEVKGA

SEQ ID NO: 1704677 - protein, 10 aa, Staphylococcus aureus
TQQKSGEESE

SEQ ID NO: 1704678 - protein, 18 aa, Staphylococcus aureus
YDKEGYRDGEFKKGDKGT

SEQ ID NO: 1704679 - protein, 15 aa, Staphylococcus aureus
YKNKVNDKKIDEQIE

SEQ ID NO: 1704680 - protein, 26 aa, Staphylococcus aureus
ADAAETTNTQQAHTQMSTQSQDVSYG

SEQ ID NO: 1704681 - protein, 14 aa, Staphylococcus aureus
CGMGKEAEIKKSFE

SEQ ID NO: 1704682 - protein, 14 aa, Staphylococcus aureus
CGTGKEAEIKKSFE

SEQ ID NO: 1704683 - protein, 9 aa, Staphylococcus aureus
DENRNNVPL

SEQ ID NO: 1704684 - protein, 13 aa, Staphylococcus aureus
DKAKEILKEYHFA

SEQ ID NO: 1704685 - protein, 4 aa, Staphylococcus aureus
DPIS

SEQ ID NO: 1704686 - protein, 12 aa, Staphylococcus aureus
FNSSDLANQFKG

SEQ ID NO: 1704687 - protein, 4 aa, Staphylococcus aureus
GTRI

SEQ ID NO: 1704688 - protein, 7 aa, Staphylococcus aureus
KARKEVD

SEQ ID NO: 1704689 - protein, 18 aa, Staphylococcus aureus
KIGDYTSVGTRKQPNLEE

SEQ ID NO: 1704690 - protein, 8 aa, Staphylococcus aureus
KRNAEEVG

SEQ ID NO: 1704691 - protein, 17 aa, Staphylococcus aureus
LGTPHNGTHASDLAGNE

SEQ ID NO: 1704692 - protein, 6 aa, Staphylococcus aureus
LPKAAT

SEQ ID NO: 1704693 - protein, 6 aa, Staphylococcus aureus
LSESTK

SEQ ID NO: 1704694 - protein, 8 aa, Staphylococcus aureus
NDKLTSKK

SEQ ID NO: 1704695 - protein, 8 aa, Staphylococcus aureus
NDYTTPNK

SEQ ID NO: 1704696 - protein, 5 aa, Staphylococcus aureus
NGPCK

SEQ ID NO: 1704697 - protein, 6 aa, Staphylococcus aureus
NQQEDV

SEQ ID NO: 1704698 - protein, 29 aa, Staphylococcus aureus
NWKGTNTKDKWTDRSSERYKIDWEKEEMT

SEQ ID NO: 1704699 - protein, 7 aa, Staphylococcus aureus
RAKDGHT

SEQ ID NO: 1704700 - protein, 15 aa, Staphylococcus aureus
SKNVARYESINGENL

SEQ ID NO: 1704701 - protein, 26 aa, Staphylococcus aureus
SPNSAQAYTNDSKTLEEAKKAHPNAQ

SEQ ID NO: 1704702 - protein, 9 aa, Staphylococcus aureus
STIANVDED

SEQ ID NO: 1704703 - protein, 20 aa, Staphylococcus aureus
STISTNRVNYSDNESIRIEV

SEQ ID NO: 1704704 - protein, 12 aa, Staphylococcus aureus
TANAEGKITPVS

SEQ ID NO: 1704705 - protein, 24 aa, Staphylococcus aureus
TTTIASTADASEGYGPREKKPVSI

SEQ ID NO: 1704706 - protein, 17 aa, Staphylococcus aureus
VKQTPNATDEEKQAAVN

SEQ ID NO: 1704707 - protein, 12 aa, Staphylococcus aureus
VQAQTQSPTTYT

SEQ ID NO: 1704708 - protein, 4 aa, Staphylococcus aureus
YNPK

SEQ ID NO: 1704709 - protein, 6 aa, Staphylococcus aureus
AKKHDV

SEQ ID NO: 1704710 - protein, 9 aa, Staphylococcus aureus
ANDKGEFEY

SEQ ID NO: 1704711 - protein, 5 aa, Staphylococcus aureus
AVKNN

SEQ ID NO: 1704712 - protein, 12 aa, Staphylococcus aureus
DEHDTEMSNSNI

SEQ ID NO: 1704713 - protein, 12 aa, Staphylococcus aureus
DKVNNKIEKTEK

SEQ ID NO: 1704714 - protein, 8 aa, Staphylococcus aureus
DPNANGKY

SEQ ID NO: 1704715 - protein, 7 aa, Staphylococcus aureus
DQPDESI

SEQ ID NO: 1704716 - protein, 20 aa, Staphylococcus aureus
EELNEEEKKSSKRKYDDTLP

SEQ ID NO: 1704717 - protein, 19 aa, Staphylococcus aureus
GKEVKTTQKYTVNKSNNGL

SEQ ID NO: 1704718 - protein, 13 aa, Staphylococcus aureus
GQARNTGERVSAE

SEQ ID NO: 1704719 - protein, 15 aa, Staphylococcus aureus
HPLNKEQVDQITAIF

SEQ ID NO: 1704720 - protein, 12 aa, Staphylococcus aureus
IGKEAEVKKSFE

SEQ ID NO: 1704721 - protein, 6 aa, Staphylococcus aureus
KHGKNN

SEQ ID NO: 1704722 - protein, 7 aa, Staphylococcus aureus
LAAEGKP

SEQ ID NO: 1704723 - protein, 37 aa, Staphylococcus aureus
NEKDIKDFDDVKGKKLAQTFTSNYGKLAKDKGADITK

SEQ ID NO: 1704724 - protein, 7 aa, Staphylococcus aureus
NNNGDDY

SEQ ID NO: 1704725 - protein, 5 aa, Staphylococcus aureus
NRTGW

SEQ ID NO: 1704726 - protein, 7 aa, Staphylococcus aureus
NYDNQSY

SEQ ID NO: 1704727 - protein, 5 aa, Staphylococcus aureus
PTKPG

SEQ ID NO: 1704728 - protein, 19 aa, Staphylococcus aureus
QRNPGFNETEKGSYGPAKI

SEQ ID NO: 1704729 - protein, 4 aa, Staphylococcus aureus
RKEI

SEQ ID NO: 1704730 - protein, 13 aa, Staphylococcus aureus
SDAKWSNGDKVTA

SEQ ID NO: 1704731 - protein, 26 aa, Staphylococcus aureus
SKVKNELASQRGVTTEKINNAQTATY

SEQ ID NO: 1704732 - protein, 8 aa, Staphylococcus aureus
SQKNGQEH

SEQ ID NO: 1704733 - protein, 5 aa, Staphylococcus aureus
SRFDE

SEQ ID NO: 1704734 - protein, 5 aa, Staphylococcus aureus
TCHTN

SEQ ID NO: 1704735 - protein, 9 aa, Staphylococcus aureus
TKDEDTVEG

SEQ ID NO: 1704736 - protein, 11 aa, Staphylococcus aureus
TKDSKGSSIKD

SEQ ID NO: 1704737 - protein, 18 aa, Staphylococcus aureus
VASTIKDKDKKLSLEDKL

SEQ ID NO: 1704738 - protein, 11 aa, Staphylococcus aureus
VATNNPASQQV

SEQ ID NO: 1704739 - protein, 17 aa, Staphylococcus aureus
YSPKSKKDTSTPAAFGK

SEQ ID NO: 1704740 - protein, 78 aa, Staphylococcus aureus
AANGQTAGFSNVAGADYTTSYNQGSNVQSVSYNAQSSNSNVEAVSAPTYHNYSTSTTSSSVRLSNGNTAGATGSSAAQ

SEQ ID NO: 1704741 - protein, 7 aa, Staphylococcus aureus
ADNDTVI

SEQ ID NO: 1704742 - protein, 4 aa, Staphylococcus aureus
ADYA

SEQ ID NO: 1704743 - protein, 8 aa, Staphylococcus aureus
AKKNTELA

SEQ ID NO: 1704744 - protein, 7 aa, Staphylococcus aureus
AKLDNGQ

SEQ ID NO: 1704745 - protein, 6 aa, Staphylococcus aureus
AKTGTA

SEQ ID NO: 1704746 - protein, 6 aa, Staphylococcus aureus
AYQATF

SEQ ID NO: 1704747 - protein, 4 aa, Staphylococcus aureus
DAIV

SEQ ID NO: 1704748 - protein, 40 aa, Staphylococcus aureus
DKDKDEKIEQYDKNVKEQASKDNKQQAKPQIPKDKSKVAG

SEQ ID NO: 1704749 - protein, 11 aa, Staphylococcus aureus
DKNKYKEKTHG

SEQ ID NO: 1704750 - protein, 4 aa, Staphylococcus aureus
EENI

SEQ ID NO: 1704751 - protein, 14 aa, Staphylococcus aureus
GDGDLKGSSVGSKN

SEQ ID NO: 1704752 - protein, 15 aa, Staphylococcus aureus
GKPGDTVVDDHTDNE

SEQ ID NO: 1704753 - protein, 5 aa, Staphylococcus aureus
GNKPV

SEQ ID NO: 1704754 - protein, 13 aa, Staphylococcus aureus
GNVTGDDTGKIGG

SEQ ID NO: 1704755 - protein, 12 aa, Staphylococcus aureus
GTDQSLYNLTKE

SEQ ID NO: 1704756 - protein, 13 aa, Staphylococcus aureus
GYGNQADAKVYSQ

SEQ ID NO: 1704757 - protein, 8 aa, Staphylococcus aureus
GYGPGVVT

SEQ ID NO: 1704758 - protein, 19 aa, Staphylococcus aureus
GYKDRDGDGFREDPKGNKF

SEQ ID NO: 1704759 - protein, 12 aa, Staphylococcus aureus
HERGKGDKSEFE

SEQ ID NO: 1704760 - protein, 10 aa, Staphylococcus aureus
HESQPTKQQR

SEQ ID NO: 1704761 - protein, 9 aa, Staphylococcus aureus
HTDRPQNEM

SEQ ID NO: 1704762 - protein, 5 aa, Staphylococcus aureus
IATST

SEQ ID NO: 1704763 - protein, 5 aa, Staphylococcus aureus
IEPAK

SEQ ID NO: 1704764 - protein, 9 aa, Staphylococcus aureus
IKLPKGKKP

SEQ ID NO: 1704765 - protein, 8 aa, Staphylococcus aureus
ISKDGRVK

SEQ ID NO: 1704766 - protein, 8 aa, Staphylococcus aureus
KDTPEHGK

SEQ ID NO: 1704767 - protein, 6 aa, Staphylococcus aureus
KKQENY

SEQ ID NO: 1704768 - protein, 4 aa, Staphylococcus aureus
KLKN

SEQ ID NO: 1704769 - protein, 5 aa, Staphylococcus aureus
KRDKH

SEQ ID NO: 1704770 - protein, 9 aa, Staphylococcus aureus
KSLAPEGKT

SEQ ID NO: 1704771 - protein, 8 aa, Staphylococcus aureus
KSNSDAVK

SEQ ID NO: 1704772 - protein, 6 aa, Staphylococcus aureus
LQEDRM

SEQ ID NO: 1704773 - protein, 13 aa, Staphylococcus aureus
MAPQTAGEYEGTN

SEQ ID NO: 1704774 - protein, 10 aa, Staphylococcus aureus
NEKSNEKTQF

SEQ ID NO: 1704775 - protein, 18 aa, Staphylococcus aureus
NGKNPKQALDEATNDITQ

SEQ ID NO: 1704776 - protein, 12 aa, Staphylococcus aureus
NKIESTNVSQTL

SEQ ID NO: 1704777 - protein, 4 aa, Staphylococcus aureus
NSEK

SEQ ID NO: 1704778 - protein, 18 aa, Staphylococcus aureus
NTAVADASRITTNKDGYK

SEQ ID NO: 1704779 - protein, 25 aa, Staphylococcus aureus
NVDDNNNTNVTDFAPKNQDESREVK

SEQ ID NO: 1704780 - protein, 4 aa, Staphylococcus aureus
NVDM

SEQ ID NO: 1704781 - protein, 4 aa, Staphylococcus aureus
PNEF

SEQ ID NO: 1704782 - protein, 7 aa, Staphylococcus aureus
PSYSPTH

SEQ ID NO: 1704783 - protein, 6 aa, Staphylococcus aureus
PTDADR

SEQ ID NO: 1704784 - protein, 4 aa, Staphylococcus aureus
PYGH

SEQ ID NO: 1704785 - protein, 10 aa, Staphylococcus aureus
QKHSNTDSKY

SEQ ID NO: 1704786 - protein, 4 aa, Staphylococcus aureus
QTGM

SEQ ID NO: 1704787 - protein, 10 aa, Staphylococcus aureus
QTNSKQGATN

SEQ ID NO: 1704788 - protein, 9 aa, Staphylococcus aureus
RKASKQQTN

SEQ ID NO: 1704789 - protein, 10 aa, Staphylococcus aureus
RTANQKNLDE

SEQ ID NO: 1704790 - protein, 15 aa, Staphylococcus aureus
SDYAKAYKKAVNSEK

SEQ ID NO: 1704791 - protein, 9 aa, Staphylococcus aureus
SGTTPSIDE

SEQ ID NO: 1704792 - protein, 12 aa, Staphylococcus aureus
SIGGITSANDKA

SEQ ID NO: 1704793 - protein, 6 aa, Staphylococcus aureus
STHSRN

SEQ ID NO: 1704794 - protein, 6 aa, Staphylococcus aureus
TGNINS

SEQ ID NO: 1704795 - protein, 8 aa, Staphylococcus aureus
TKQYPDEY

SEQ ID NO: 1704796 - protein, 10 aa, Staphylococcus aureus
TNVQTPDYEK

SEQ ID NO: 1704797 - protein, 9 aa, Staphylococcus aureus
TNVVGSGDG

SEQ ID NO: 1704798 - protein, 10 aa, Staphylococcus aureus
TNVVGSGDGV

SEQ ID NO: 1704799 - protein, 16 aa, Staphylococcus aureus
TVNRTTNGHGKVEDYT

SEQ ID NO: 1704800 - protein, 9 aa, Staphylococcus aureus
VKPNPNDYD

SEQ ID NO: 1704801 - protein, 10 aa, Staphylococcus aureus
VLENQGAAFN

SEQ ID NO: 1704802 - protein, 7 aa, Staphylococcus aureus
VNVKPDS

SEQ ID NO: 1704803 - protein, 4 aa, Staphylococcus aureus
VPGE

SEQ ID NO: 1704804 - protein, 9 aa, Staphylococcus aureus
YKEQNQMNK

SEQ ID NO: 1704805 - protein, 12 aa, Staphylococcus aureus
YSGSNPTFEPRT

SEQ ID NO: 1704806 - protein, 7 aa, Staphylococcus aureus
AENRNGT

SEQ ID NO: 1704807 - protein, 4 aa, Staphylococcus aureus
APSL

SEQ ID NO: 1704808 - protein, 21 aa, Staphylococcus aureus
ASPIQESRANTNIENIGDGAE

SEQ ID NO: 1704809 - protein, 20 aa, Staphylococcus aureus
CSGNSNKQSSDNKDKETTSI

SEQ ID NO: 1704810 - protein, 7 aa, Staphylococcus aureus
DDKDGFS

SEQ ID NO: 1704811 - protein, 7 aa, Staphylococcus aureus
DENKYEI

SEQ ID NO: 1704812 - protein, 11 aa, Staphylococcus aureus
DENKYKEKTHG

SEQ ID NO: 1704813 - protein, 4 aa, Staphylococcus aureus
DGNE

SEQ ID NO: 1704814 - protein, 17 aa, Staphylococcus aureus
DPAISTDENRQDPTVTV

SEQ ID NO: 1704815 - protein, 18 aa, Staphylococcus aureus
EDIDQLRKEKDKDDKSIY

SEQ ID NO: 1704816 - protein, 14 aa, Staphylococcus aureus
EEQGQEMTPNNKQQ

SEQ ID NO: 1704817 - protein, 12 aa, Staphylococcus aureus
ENHVDKKEEKLS

SEQ ID NO: 1704818 - protein, 6 aa, Staphylococcus aureus
FPKDSK

SEQ ID NO: 1704819 - protein, 17 aa, Staphylococcus aureus
GDTADGYAGVKGIGEKT

SEQ ID NO: 1704820 - protein, 5 aa, Staphylococcus aureus
GEFRS

SEQ ID NO: 1704821 - protein, 22 aa, Staphylococcus aureus
GGEIGSTWGNANNWAAAAQGAG

SEQ ID NO: 1704822 - protein, 6 aa, Staphylococcus aureus
GITKKN

SEQ ID NO: 1704823 - protein, 26 aa, Staphylococcus aureus
GNNSSKDKEASKDSKTINVGTEGTYA

SEQ ID NO: 1704824 - protein, 17 aa, Staphylococcus aureus
GSTTTTIKQIEELDKVV

SEQ ID NO: 1704825 - protein, 4 aa, Staphylococcus aureus
HGST

SEQ ID NO: 1704826 - protein, 14 aa, Staphylococcus aureus
HKADYEDENVEVEK

SEQ ID NO: 1704827 - protein, 12 aa, Staphylococcus aureus
HPNGENDTGGYY

SEQ ID NO: 1704828 - protein, 15 aa, Staphylococcus aureus
IAQGTFNATKQVSVG

SEQ ID NO: 1704829 - protein, 9 aa, Staphylococcus aureus
IDEKKRKDI

SEQ ID NO: 1704830 - protein, 24 aa, Staphylococcus aureus
ITPATKVKTDAKNAIDKSAETQHN

SEQ ID NO: 1704831 - protein, 10 aa, Staphylococcus aureus
KDGKAEINRE

SEQ ID NO: 1704832 - protein, 18 aa, Staphylococcus aureus
KDSNYTSVKDLKDNDKLA

SEQ ID NO: 1704833 - protein, 23 aa, Staphylococcus aureus
KKVSNSNHGQNVSNEYVNKENPD

SEQ ID NO: 1704834 - protein, 33 aa, Staphylococcus aureus
KNANANGSGQTYVNPATAGDNNDYTASQSQQHI

SEQ ID NO: 1704835 - protein, 5 aa, Staphylococcus aureus
KSNTL

SEQ ID NO: 1704836 - protein, 5 aa, Staphylococcus aureus
KTNHV

SEQ ID NO: 1704837 - protein, 7 aa, Staphylococcus aureus
NAQPEVT

SEQ ID NO: 1704838 - protein, 14 aa, Staphylococcus aureus
PGNDKSKFQQRSYE

SEQ ID NO: 1704839 - protein, 17 aa, Staphylococcus aureus
PTAGAEQTNQIANKPQA

SEQ ID NO: 1704840 - protein, 18 aa, Staphylococcus aureus
QDIENNQNLKVSKESGFR

SEQ ID NO: 1704841 - protein, 9 aa, Staphylococcus aureus
QNNKTSGVV

SEQ ID NO: 1704842 - protein, 17 aa, Staphylococcus aureus
QNNTTATHQNAKVNKAY

SEQ ID NO: 1704843 - protein, 7 aa, Staphylococcus aureus
RTGVSAS

SEQ ID NO: 1704844 - protein, 13 aa, Staphylococcus aureus
SGFHSSSNYNGIN

SEQ ID NO: 1704845 - protein, 9 aa, Staphylococcus aureus
SKEKGEDAF

SEQ ID NO: 1704846 - protein, 18 aa, Staphylococcus aureus
TDAKSDVNQTPVGTGPYQ

SEQ ID NO: 1704847 - protein, 13 aa, Staphylococcus aureus
TTTFPNGNEDSTV

SEQ ID NO: 1704848 - protein, 5 aa, Staphylococcus aureus
TYRTA

SEQ ID NO: 1704849 - protein, 20 aa, Staphylococcus aureus
YDKKANKTGKVRPKYEDKEL

SEQ ID NO: 1704850 - protein, 12 aa, Staphylococcus aureus
YKPQVQRVPGKW

SEQ ID NO: 1704851 - protein, 18 aa, Staphylococcus aureus
YNLKGKKGYIATPYPTYN

SEQ ID NO: 1704852 - protein, 13 aa, Staphylococcus aureus
AAKYGHERYGKTY

SEQ ID NO: 1704853 - protein, 8 aa, Staphylococcus aureus
AHPHPKRK

SEQ ID NO: 1704854 - protein, 6 aa, Staphylococcus aureus
AKVSGV

SEQ ID NO: 1704855 - protein, 18 aa, Staphylococcus aureus
ATPHNGSQAADKFGNTEA

SEQ ID NO: 1704856 - protein, 12 aa, Staphylococcus aureus
AYSNPNTTTTGY

SEQ ID NO: 1704857 - protein, 7 aa, Staphylococcus aureus
DATKNPI

SEQ ID NO: 1704858 - protein, 6 aa, Staphylococcus aureus
DKQQTI

SEQ ID NO: 1704859 - protein, 6 aa, Staphylococcus aureus
DNAPAL

SEQ ID NO: 1704860 - protein, 15 aa, Staphylococcus aureus
DQAPLNPDTTNEEVA

SEQ ID NO: 1704861 - protein, 9 aa, Staphylococcus aureus
DQSTSHKGV

SEQ ID NO: 1704862 - protein, 5 aa, Staphylococcus aureus
DRSAW

SEQ ID NO: 1704863 - protein, 10 aa, Staphylococcus aureus
ESHKEEKNSN

SEQ ID NO: 1704864 - protein, 5 aa, Staphylococcus aureus
ETHDD

SEQ ID NO: 1704865 - protein, 8 aa, Staphylococcus aureus
ETSTEGLN

SEQ ID NO: 1704866 - protein, 7 aa, Staphylococcus aureus
EYPGKED

SEQ ID NO: 1704867 - protein, 11 aa, Staphylococcus aureus
FAYASTSKAIN

SEQ ID NO: 1704868 - protein, 16 aa, Staphylococcus aureus
FTGGVTPAAKPSDKTY

SEQ ID NO: 1704869 - protein, 19 aa, Staphylococcus aureus
GDANISGVRYNGTDLTGAL

SEQ ID NO: 1704870 - protein, 13 aa, Staphylococcus aureus
GKDDKSKESRRQM

SEQ ID NO: 1704871 - protein, 9 aa, Staphylococcus aureus
GKVENYNGS

SEQ ID NO: 1704872 - protein, 21 aa, Staphylococcus aureus
GMKDNDKQGSDDNGSSKSPYH

SEQ ID NO: 1704873 - protein, 12 aa, Staphylococcus aureus
GNSGGIVSSEPL

SEQ ID NO: 1704874 - protein, 17 aa, Staphylococcus aureus
GQAISGKSTAKQALNNP

SEQ ID NO: 1704875 - protein, 12 aa, Staphylococcus aureus
GRQSSSNAGQNF

SEQ ID NO: 1704876 - protein, 10 aa, Staphylococcus aureus
GSGKDESEKN

SEQ ID NO: 1704877 - protein, 25 aa, Staphylococcus aureus
GTLTTEVHSGHAKQNQKSVNKHDKE

SEQ ID NO: 1704878 - protein, 14 aa, Staphylococcus aureus
GVNTTTEKPVHAEK

SEQ ID NO: 1704879 - protein, 10 aa, Staphylococcus aureus
GVTKKNQDAY

SEQ ID NO: 1704880 - protein, 6 aa, Staphylococcus aureus
HAKDSI

SEQ ID NO: 1704881 - protein, 18 aa, Staphylococcus aureus
HHDKQAEQLVEETKDNID

SEQ ID NO: 1704882 - protein, 26 aa, Staphylococcus aureus
HHQDSAKKESTSHKKKENDNEELNEE

SEQ ID NO: 1704883 - protein, 21 aa, Staphylococcus aureus
HIDGQNSPEKPTDKNTDNKQL

SEQ ID NO: 1704884 - protein, 6 aa, Staphylococcus aureus
HPSNQP

SEQ ID NO: 1704885 - protein, 13 aa, Staphylococcus aureus
ISNTPKNSSQGNN

SEQ ID NO: 1704886 - protein, 7 aa, Staphylococcus aureus
KDKDTDQ

SEQ ID NO: 1704887 - protein, 23 aa, Staphylococcus aureus
KDNKSDKPNDKLISETAKSVMKE

SEQ ID NO: 1704888 - protein, 20 aa, Staphylococcus aureus
KGESKSSYVINGPGKTNEYA

SEQ ID NO: 1704889 - protein, 6 aa, Staphylococcus aureus
KGQSEP

SEQ ID NO: 1704890 - protein, 5 aa, Staphylococcus aureus
KISGQ

SEQ ID NO: 1704891 - protein, 7 aa, Staphylococcus aureus
KKAESLL

SEQ ID NO: 1704892 - protein, 18 aa, Staphylococcus aureus
KKEKDEKSADVEKQTKAL

SEQ ID NO: 1704893 - protein, 25 aa, Staphylococcus aureus
KNAPQTLEEVEANAAKLTDSKKKQY

SEQ ID NO: 1704894 - protein, 13 aa, Staphylococcus aureus
KNDPHAKEMTPTA

SEQ ID NO: 1704895 - protein, 12 aa, Staphylococcus aureus
KNPNKITVDVLF

SEQ ID NO: 1704896 - protein, 11 aa, Staphylococcus aureus
KPKVRRKRAAL

SEQ ID NO: 1704897 - protein, 6 aa, Staphylococcus aureus
KQGYNV

SEQ ID NO: 1704898 - protein, 11 aa, Staphylococcus aureus
KQQIASAVTNA

SEQ ID NO: 1704899 - protein, 12 aa, Staphylococcus aureus
KQSQARQTAEDI

SEQ ID NO: 1704900 - protein, 10 aa, Staphylococcus aureus
KRDEGDGIAT

SEQ ID NO: 1704901 - protein, 14 aa, Staphylococcus aureus
KRTEDVSSKKWGVT

SEQ ID NO: 1704902 - protein, 17 aa, Staphylococcus aureus
KSIRKDVSEQSDQSIEN

SEQ ID NO: 1704903 - protein, 11 aa, Staphylococcus aureus
KYGGEVKNRND

SEQ ID NO: 1704904 - protein, 13 aa, Staphylococcus aureus
LNKEKEGEKRLAE

SEQ ID NO: 1704905 - protein, 6 aa, Staphylococcus aureus
LPAQNS

SEQ ID NO: 1704906 - protein, 5 aa, Staphylococcus aureus
LPNES

SEQ ID NO: 1704907 - protein, 6 aa, Staphylococcus aureus
LQPHRM

SEQ ID NO: 1704908 - protein, 4 aa, Staphylococcus aureus
MGGQ

SEQ ID NO: 1704909 - protein, 9 aa, Staphylococcus aureus
NIDTPKNID

SEQ ID NO: 1704910 - protein, 9 aa, Staphylococcus aureus
NKDYEGAYY

SEQ ID NO: 1704911 - protein, 9 aa, Staphylococcus aureus
NMKDLKEKA

SEQ ID NO: 1704912 - protein, 7 aa, Staphylococcus aureus
NTRTTNG

SEQ ID NO: 1704913 - protein, 5 aa, Staphylococcus aureus
NWEPG

SEQ ID NO: 1704914 - protein, 7 aa, Staphylococcus aureus
PKGAQTK

SEQ ID NO: 1704915 - protein, 7 aa, Staphylococcus aureus
PKSDQYL

SEQ ID NO: 1704916 - protein, 47 aa, Staphylococcus aureus
PKYTKREIDKMSEKDKKDKKANENLGLNPSHEGETDPEKIAEKSPAY

SEQ ID NO: 1704917 - protein, 8 aa, Staphylococcus aureus
PLEENRKN

SEQ ID NO: 1704918 - protein, 5 aa, Staphylococcus aureus
PQNQK

SEQ ID NO: 1704919 - protein, 12 aa, Staphylococcus aureus
PSESPRYTHPSQ

SEQ ID NO: 1704920 - protein, 5 aa, Staphylococcus aureus
PTLNR

SEQ ID NO: 1704921 - protein, 10 aa, Staphylococcus aureus
PTVKPQAKQD

SEQ ID NO: 1704922 - protein, 18 aa, Staphylococcus aureus
QETFTGGVTPAATSNDKH

SEQ ID NO: 1704923 - protein, 5 aa, Staphylococcus aureus
QGSIH

SEQ ID NO: 1704924 - protein, 10 aa, Staphylococcus aureus
QKRGIDPKKY

SEQ ID NO: 1704925 - protein, 26 aa, Staphylococcus aureus
RLPSTDANRYVKKPQNAKIEVILEKS

SEQ ID NO: 1704926 - protein, 4 aa, Staphylococcus aureus
RSVQ

SEQ ID NO: 1704927 - protein, 14 aa, Staphylococcus aureus
RTSFSDVKGSGYEL

SEQ ID NO: 1704928 - protein, 26 aa, Staphylococcus aureus
SKQNEKAQNKSVNPNEYAKHKSKMDE

SEQ ID NO: 1704929 - protein, 5 aa, Staphylococcus aureus
SLNPY

SEQ ID NO: 1704930 - protein, 4 aa, Staphylococcus aureus
SSDI

SEQ ID NO: 1704931 - protein, 4 aa, Staphylococcus aureus
STGT

SEQ ID NO: 1704932 - protein, 12 aa, Staphylococcus aureus
TDGKTDKNRTKF

SEQ ID NO: 1704933 - protein, 4 aa, Staphylococcus aureus
THHH

SEQ ID NO: 1704934 - protein, 6 aa, Staphylococcus aureus
TKNYQG

SEQ ID NO: 1704935 - protein, 12 aa, Staphylococcus aureus
TNVSGQSQGYYD

SEQ ID NO: 1704936 - protein, 7 aa, Staphylococcus aureus
TTKDPNV

SEQ ID NO: 1704937 - protein, 8 aa, Staphylococcus aureus
VHADKSGK

SEQ ID NO: 1704938 - protein, 9 aa, Staphylococcus aureus
VLKSERGIS

SEQ ID NO: 1704939 - protein, 4 aa, Staphylococcus aureus
VQPN

SEQ ID NO: 1704940 - protein, 6 aa, Staphylococcus aureus
WGPYGR

SEQ ID NO: 1704941 - protein, 14 aa, Staphylococcus aureus
WGPYGRDSYDPTYG

SEQ ID NO: 1704942 - protein, 7 aa, Staphylococcus aureus
YAKQTYD

SEQ ID NO: 1704943 - protein, 14 aa, Staphylococcus aureus
YEQDARTWKNKGYP

SEQ ID NO: 1704944 - protein, 4 aa, Staphylococcus aureus
YGKY

SEQ ID NO: 1704945 - protein, 19 aa, Staphylococcus aureus
YKQESYRTTIDRKTNHKSI

SEQ ID NO: 1704946 - protein, 11 aa, Staphylococcus aureus
YPGAGKKAAEW

SEQ ID NO: 1704947 - protein, 4 aa, Staphylococcus aureus
YPTK

SEQ ID NO: 1704948 - protein, 21 aa, Staphylococcus aureus
YSGASKELKNVTGYRYSKGGK

SEQ ID NO: 1704949 - protein, 7 aa, Staphylococcus aureus
AAEKGAH

SEQ ID NO: 1704950 - protein, 6 aa, Staphylococcus aureus
AHGGEI

SEQ ID NO: 1704951 - protein, 4 aa, Staphylococcus aureus
AKSN

SEQ ID NO: 1704952 - protein, 4 aa, Staphylococcus aureus
ALTQ

SEQ ID NO: 1704953 - protein, 9 aa, Staphylococcus aureus
APDDEDEAL

SEQ ID NO: 1704954 - protein, 22 aa, Staphylococcus aureus
APYTPTTDPNANNAGQNAPNEV

SEQ ID NO: 1704955 - protein, 42 aa, Staphylococcus aureus; identical to SEQ ID NO: 1626564

SEQ ID NO: 1704956 - protein, 11 aa, Staphylococcus aureus
AYSIGQDETNI

SEQ ID NO: 1704957 - protein, 6 aa, Staphylococcus aureus
DAQTGE

SEQ ID NO: 1704958 - protein, 5 aa, Staphylococcus aureus
DESGM

SEQ ID NO: 1704959 - protein, 10 aa, Staphylococcus aureus
DFKKMSEAKY

SEQ ID NO: 1704960 - protein, 5 aa, Staphylococcus aureus
DLQGD

SEQ ID NO: 1704961 - protein, 6 aa, Staphylococcus aureus
DQETID

SEQ ID NO: 1704962 - protein, 7 aa, Staphylococcus aureus
EDHTGEY

SEQ ID NO: 1704963 - protein, 18 aa, Staphylococcus aureus
EKDNGGVHTNSGIPNKAA

SEQ ID NO: 1704964 - protein, 19 aa, Staphylococcus aureus
EKYDQTFKGVSAKGNEASQ

SEQ ID NO: 1704965 - protein, 20 aa, Staphylococcus aureus
EPKPKTVSSNNKSNSNSSTL

SEQ ID NO: 1704966 - protein, 17 aa, Staphylococcus aureus
FKTNKKINGDTKDVAEV

SEQ ID NO: 1704967 - protein, 9 aa, Staphylococcus aureus
FTGDDPRKV

SEQ ID NO: 1704968 - protein, 10 aa, Staphylococcus aureus
GDIKGSSVGY

SEQ ID NO: 1704969 - protein, 26 aa, Staphylococcus aureus
GDTDAKKVKPTNKVTLSKDDAADKAF

SEQ ID NO: 1704970 - protein, 6 aa, Staphylococcus aureus
GKKQVV

SEQ ID NO: 1704971 - protein, 24 aa, Staphylococcus aureus
GNGNKSGSDDKKITVGASPAPHAE

SEQ ID NO: 1704972 - protein, 16 aa, Staphylococcus aureus
GNINSGYKKPNPKDYN

SEQ ID NO: 1704973 - protein, 5 aa, Staphylococcus aureus
GPESW

SEQ ID NO: 1704974 - protein, 19 aa, Staphylococcus aureus
GVTKIGDGDVEKVAKEKPD

SEQ ID NO: 1704975 - protein, 5 aa, Staphylococcus aureus
HNETI

SEQ ID NO: 1704976 - protein, 16 aa, Staphylococcus aureus
HTESGNSGSPVLNSNN

SEQ ID NO: 1704977 - protein, 24 aa, Staphylococcus aureus
IKSTDSSKNPVTTIENRKANGYTL

SEQ ID NO: 1704978 - protein, 31 aa, Staphylococcus aureus; identical to SEQ ID NO: 1568968

SEQ ID NO: 1704979 - protein, 97 aa, Staphylococcus aureus
ISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSAL

SEQ ID NO: 1704980 - protein, 9 aa, Staphylococcus aureus
ISDYPGDED

SEQ ID NO: 1704981 - protein, 5 aa, Staphylococcus aureus
KDKYT

SEQ ID NO: 1704982 - protein, 7 aa, Staphylococcus aureus
KIGSEYN

SEQ ID NO: 1704983 - protein, 16 aa, Staphylococcus aureus
KKDGAINKGDYNNSNV

SEQ ID NO: 1704984 - protein, 7 aa, Staphylococcus aureus
KKQAIEA

SEQ ID NO: 1704985 - protein, 23 aa, Staphylococcus aureus
KVTGNASTNSGSATTTNRGYNTP

SEQ ID NO: 1704986 - protein, 9 aa, Staphylococcus aureus
NDQTGQATL

SEQ ID NO: 1704987 - protein, 8 aa, Staphylococcus aureus
NGNKEEIA

SEQ ID NO: 1704988 - protein, 7 aa, Staphylococcus aureus
NGTSTNI

SEQ ID NO: 1704989 - protein, 4 aa, Staphylococcus aureus
NIGS

SEQ ID NO: 1704990 - protein, 11 aa, Staphylococcus aureus
NKIETTDVGQT

SEQ ID NO: 1704991 - protein, 21 aa, Staphylococcus aureus
NSKWPDKKINAVSPNSSHGTY

SEQ ID NO: 1704992 - protein, 11 aa, Staphylococcus aureus
NSRSAQIKDTF

SEQ ID NO: 1704993 - protein, 10 aa, Staphylococcus aureus
NTRHSESDKN

SEQ ID NO: 1704994 - protein, 57 aa, Staphylococcus aureus
PKNKISTAKVDSTFSYSSGGKFDSTKGIGRTSSNSYSKTISYNQQNYDTIASGKNNN

SEQ ID NO: 1704995 - protein, 8 aa, Staphylococcus aureus
PLAEDRKN

SEQ ID NO: 1704996 - protein, 10 aa, Staphylococcus aureus
QAVERGPKGF

SEQ ID NO: 1704997 - protein, 18 aa, Staphylococcus aureus
QDTSVTQQLEDYRSNNKY

SEQ ID NO: 1704998 - protein, 17 aa, Staphylococcus aureus
QIDQDRSNAQVDKTASL

SEQ ID NO: 1704999 - protein, 21 aa, Staphylococcus aureus
QKAYGKDLKKENGKTKEADSG

SEQ ID NO: 1705000 - protein, 7 aa, Staphylococcus aureus
QKDNGTI

SEQ ID NO: 1705001 - protein, 8 aa, Staphylococcus aureus
SAFGSNYD

SEQ ID NO: 1705002 - protein, 8 aa, Staphylococcus aureus
SNKPWTNY

SEQ ID NO: 1705003 - protein, 6 aa, Staphylococcus aureus
STGPVM

SEQ ID NO: 1705004 - protein, 11 aa, Staphylococcus aureus
TDVKTDKKGFT

SEQ ID NO: 1705005 - protein, 14 aa, Staphylococcus aureus
TFGRESYDNQGSPI

SEQ ID NO: 1705006 - protein, 14 aa, Staphylococcus aureus
TKAQPSETKAYINV

SEQ ID NO: 1705007 - protein, 13 aa, Staphylococcus aureus
TSAEAASGNSIDT

SEQ ID NO: 1705008 - protein, 18 aa, Staphylococcus aureus
TSLEDIDKAETKYDHTKV

SEQ ID NO: 1705009 - protein, 10 aa, Staphylococcus aureus
TTATSDNDKL

SEQ ID NO: 1705010 - protein, 8 aa, Staphylococcus aureus
TVENPELS

SEQ ID NO: 1705011 - protein, 61 aa, Staphylococcus aureus
VQPKTANNKTGNAQVSQKVDTAQVNGDTRANQSATTNNTQPVAKSTSTTAPKTNTNVTNAG

SEQ ID NO: 1705012 - protein, 10 aa, Staphylococcus aureus
VTQKSDAVKA

SEQ ID NO: 1705013 - protein, 6 aa, Staphylococcus aureus
YAYNST

SEQ ID NO: 1705014 - protein, 29 aa, Staphylococcus aureus
YDKEDKAKELNKDLDNKIASMKDKTKNFN

SEQ ID NO: 1705015 - protein, 10 aa, Staphylococcus aureus
YKDKAETFTG

SEQ ID NO: 1705016 - protein, 12 aa, Staphylococcus aureus
AGQTKFLYKSKE

SEQ ID NO: 1705017 - protein, 15 aa, Staphylococcus aureus
AKAANDTEDIGKGSD

SEQ ID NO: 1705018 - protein, 18 aa, Staphylococcus aureus
AKQDDTVRQSEQKPQVGD

SEQ ID NO: 1705019 - protein, 20 aa, Staphylococcus aureus
ATMGKSPHQNDRMTLKLNKN

SEQ ID NO: 1705020 - protein, 35 aa, Staphylococcus aureus
AVATLPNKGTKELTAKAKDDQTNKVAKQGQYKNQD

SEQ ID NO: 1705021 - protein, 21 aa, Staphylococcus aureus
CSTTNNESNNETKSVPEEMEA

SEQ ID NO: 1705022 - protein, 8 aa, Staphylococcus aureus
DEKKHEID

SEQ ID NO: 1705023 - protein, 10 aa, Staphylococcus aureus
DGSAKLNNMT

SEQ ID NO: 1705024 - protein, 10 aa, Staphylococcus aureus
DGTPFDADAV

SEQ ID NO: 1705025 - protein, 19 aa, Staphylococcus aureus
DITNNRTNQQVDDTTSQAL

SEQ ID NO: 1705026 - protein, 16 aa, Staphylococcus aureus
EDKNHDVQKNEKKYPV

SEQ ID NO: 1705027 - protein, 5 aa, Staphylococcus aureus
EQANK

SEQ ID NO: 1705028 - protein, 13 aa, Staphylococcus aureus
EVYNSKDPKYKKI

SEQ ID NO: 1705029 - protein, 12 aa, Staphylococcus aureus
FVTPDGKKSAHD

SEQ ID NO: 1705030 - protein, 38 aa, Staphylococcus aureus
GNDDSKKDDSKTSKKDDGVKAELKQATKAYDKYTDEQL

SEQ ID NO: 1705031 - protein, 17 aa, Staphylococcus aureus
GNFQSAPSIGGNGSFNY

SEQ ID NO: 1705032 - protein, 7 aa, Staphylococcus aureus
HISGETY

SEQ ID NO: 1705033 - protein, 7 aa, Staphylococcus aureus
IATPEQL

SEQ ID NO: 1705034 - protein, 37 aa, Staphylococcus aureus; identical to SEQ ID NO: 1638711

SEQ ID NO: 1705035 - protein, 10 aa, Staphylococcus aureus
KELPKSENVK

SEQ ID NO: 1705036 - protein, 5 aa, Staphylococcus aureus
KGKYY

SEQ ID NO: 1705037 - protein, 5 aa, Staphylococcus aureus
KGPEV

SEQ ID NO: 1705038 - protein, 11 aa, Staphylococcus aureus
KKNIDAVQENK

SEQ ID NO: 1705039 - protein, 6 aa, Staphylococcus aureus
KNRPGI

SEQ ID NO: 1705040 - protein, 28 aa, Staphylococcus aureus
KVSGTASSSNAASNSSRPSTNSGGGSYY

SEQ ID NO: 1705041 - protein, 4 aa, Staphylococcus aureus
LDKE

SEQ ID NO: 1705042 - protein, 24 aa, Staphylococcus aureus
LKQAQQEIENTNQDAAVTDVRNQT

SEQ ID NO: 1705043 - protein, 30 aa, Staphylococcus aureus; identical to SEQ ID NO: 1564144

SEQ ID NO: 1705044 - protein, 8 aa, Staphylococcus aureus
NKYDDNYS

SEQ ID NO: 1705045 - protein, 18 aa, Staphylococcus aureus
NQATTNADVDNAKGDGLN

SEQ ID NO: 1705046 - protein, 12 aa, Staphylococcus aureus
NYGGQDNRNNAA

SEQ ID NO: 1705047 - protein, 4 aa, Staphylococcus aureus
PHPY

SEQ ID NO: 1705048 - protein, 6 aa, Staphylococcus aureus
PNGSIH

SEQ ID NO: 1705049 - protein, 33 aa, Staphylococcus aureus
PTNEEIESNKKMLEKEKAYKESFKNSGLPTTLG

SEQ ID NO: 1705050 - protein, 6 aa, Staphylococcus aureus
QDAVDE

SEQ ID NO: 1705051 - protein, 8 aa, Staphylococcus aureus
QNETNVNE

SEQ ID NO: 1705052 - protein, 6 aa, Staphylococcus aureus
RNRKTE

SEQ ID NO: 1705053 - protein, 9 aa, Staphylococcus aureus
RVESRNGMH

SEQ ID NO: 1705054 - protein, 43 aa, Staphylococcus aureus
SELNANKNTTKDKIKNEGAVKTSDTSLKLDNKSAISNGNEINQ

SEQ ID NO: 1705055 - protein, 15 aa, Staphylococcus aureus
SGKKDNAVSDKTVRQ

SEQ ID NO: 1705056 - protein, 19 aa, Staphylococcus aureus
SITAKGQKLTIKTNSAYPE

SEQ ID NO: 1705057 - protein, 18 aa, Staphylococcus aureus
SNGLSGGLNGSKSFSETI

SEQ ID NO: 1705058 - protein, 11 aa, Staphylococcus aureus
SNKGEKYQKDI

SEQ ID NO: 1705059 - protein, 6 aa, Staphylococcus aureus
SQGDVK

SEQ ID NO: 1705060 - protein, 21 aa, Staphylococcus aureus
TAKPTPTPTPKPSTPTTNNKL

SEQ ID NO: 1705061 - protein, 11 aa, Staphylococcus aureus
TIKANGKARTG

SEQ ID NO: 1705062 - protein, 25 aa, Staphylococcus aureus
TMAPSSNGRSISSGYTSGRNLYTSG

SEQ ID NO: 1705063 - protein, 11 aa, Staphylococcus aureus
TVTKPQTTQTV

SEQ ID NO: 1705064 - protein, 7 aa, Staphylococcus aureus
VSAHSEQ

SEQ ID NO: 1705065 - protein, 11 aa, Staphylococcus aureus
VSVSSESNDAV

SEQ ID NO: 1705066 - protein, 6 aa, Staphylococcus aureus
VTKKNV

SEQ ID NO: 1705067 - protein, 8 aa, Staphylococcus aureus
YAGATTGQ

SEQ ID NO: 1705068 - protein, 17 aa, Staphylococcus aureus
YGDGDGRTFTSLSGAND

SEQ ID NO: 1705069 - protein, 12 aa, Staphylococcus aureus
YKSLKELPKGAT

SEQ ID NO: 1705070 - protein, 8 aa, Staphylococcus aureus
YSIKPGTK

SEQ ID NO: 1705071 - protein, 23 aa, Staphylococcus aureus
YTPGKEGDALRSMSNPEQFGQPA

SEQ ID NO: 1705072 - protein, 8 aa, Staphylococcus aureus
AGAKAGER

SEQ ID NO: 1705073 - protein, 12 aa, Staphylococcus aureus
AQPGNSGSPVLN

SEQ ID NO: 1705074 - protein, 5 aa, Staphylococcus aureus
DDIEG

SEQ ID NO: 1705075 - protein, 8 aa, Staphylococcus aureus
DYNEKTGV

SEQ ID NO: 1705076 - protein, 8 aa, Staphylococcus aureus
EKNKDGQR

SEQ ID NO: 1705077 - protein, 12 aa, Staphylococcus aureus
ENANDGSGYPVG

SEQ ID NO: 1705078 - protein, 9 aa, Staphylococcus aureus
ETKLSDNEK

SEQ ID NO: 1705079 - protein, 39 aa, Staphylococcus aureus
FGGNHKLSSKKSEESKQETVKKESEEEKDPDLEKYEEIE

SEQ ID NO: 1705080 - protein, 5 aa, Staphylococcus aureus
GGRAL

SEQ ID NO: 1705081 - protein, 17 aa, Staphylococcus aureus
GNQGNASVNLGGSVTSI

SEQ ID NO: 1705082 - protein, 9 aa, Staphylococcus aureus
GSNDPINNK

SEQ ID NO: 1705083 - protein, 13 aa, Staphylococcus aureus
HASDSLSKSPENW

SEQ ID NO: 1705084 - protein, 10 aa, Staphylococcus aureus
IDDEKVKKEI

SEQ ID NO: 1705085 - protein, 5 aa, Staphylococcus aureus
INDPV

SEQ ID NO: 1705086 - protein, 15 aa, Staphylococcus aureus
ITAHPNSDKGNGGIY

SEQ ID NO: 1705087 - protein, 12 aa, Staphylococcus aureus
KKADDETVQKFN

SEQ ID NO: 1705088 - protein, 14 aa, Staphylococcus aureus
KKHIENKAKRNYQV

SEQ ID NO: 1705089 - protein, 7 aa, Staphylococcus aureus
KNGTKKV

SEQ ID NO: 1705090 - protein, 5 aa, Staphylococcus aureus
KQAKY

SEQ ID NO: 1705091 - protein, 6 aa, Staphylococcus aureus
KQAKYT

SEQ ID NO: 1705092 - protein, 7 aa, Staphylococcus aureus
KQTGDGY

SEQ ID NO: 1705093 - protein, 19 aa, Staphylococcus aureus
MNDSTTEEQQAAKDKVDQA

SEQ ID NO: 1705094 - protein, 4 aa, Staphylococcus aureus
NDET

SEQ ID NO: 1705095 - protein, 10 aa, Staphylococcus aureus
NKEKVAPSKL

SEQ ID NO: 1705096 - protein, 30 aa, Staphylococcus aureus
NNYTNNSQTATNNYYTGGSGASYSTTSNNV

SEQ ID NO: 1705097 - protein, 12 aa, Staphylococcus aureus
NQSVNAKGKYEK

SEQ ID NO: 1705098 - protein, 37 aa, Staphylococcus aureus; identical to SEQ ID NO: 1633052

SEQ ID NO: 1705099 - protein, 14 aa, Staphylococcus aureus
QKQYGGKDKFEKAL

SEQ ID NO: 1705100 - protein, 9 aa, Staphylococcus aureus
RENADSGTF

SEQ ID NO: 1705101 - protein, 12 aa, Staphylococcus aureus
SNSEDSGNITIT

SEQ ID NO: 1705102 - protein, 13 aa, Staphylococcus aureus
SNYYRPQNVSRDY

SEQ ID NO: 1705103 - protein, 11 aa, Staphylococcus aureus
SPNGPTGSARE

SEQ ID NO: 1705104 - protein, 46 aa, Staphylococcus aureus
TPRLEDKKLKKTESIPTGNNVTQLKQKASVTMPTSQFKSNNYTYNE

SEQ ID NO: 1705105 - protein, 6 aa, Staphylococcus aureus
TQTNDA

SEQ ID NO: 1705106 - protein, 16 aa, Staphylococcus aureus
VDDYPKDVKKGKKQFD

SEQ ID NO: 1705107 - protein, 4 aa, Staphylococcus aureus
VKLD

SEQ ID NO: 1705108 - protein, 9 aa, Staphylococcus aureus
VLESNRGIT

SEQ ID NO: 1705109 - protein, 7 aa, Staphylococcus aureus
VPEADTH

SEQ ID NO: 1705110 - protein, 9 aa, Staphylococcus aureus
YEGSADKGR

SEQ ID NO: 1705111 - protein, 7 aa, Staphylococcus aureus
YNFPKKP

SEQ ID NO: 1705112 - protein, 17 aa, Staphylococcus aureus
YTGVSSHTGPLGYENPD

SEQ ID NO: 1705113 - protein, 5 aa, Staphylococcus aureus
YYRGD

SEQ ID NO: 1705114 - protein, 9 aa, Staphylococcus aureus
AIERGPKGF

SEQ ID NO: 1705115 - protein, 8 aa, Staphylococcus aureus
AKAALKKN

SEQ ID NO: 1705116 - protein, 36 aa, Staphylococcus aureus; identical to SEQ ID NO: 1630834

SEQ ID NO: 1705117 - protein, 8 aa, Staphylococcus aureus
DDKNGYLA

SEQ ID NO: 1705118 - protein, 5 aa, Staphylococcus aureus
DIENK

SEQ ID NO: 1705119 - protein, 10 aa, Staphylococcus aureus
DNEKKYQYTG

SEQ ID NO: 1705120 - protein, 5 aa, Staphylococcus aureus
ESINT

SEQ ID NO: 1705121 - protein, 10 aa, Staphylococcus aureus
ETTPITKTAT

SEQ ID NO: 1705122 - protein, 13 aa, Staphylococcus aureus
GAHSAELDPATPY

SEQ ID NO: 1705123 - protein, 30 aa, Staphylococcus aureus; identical to SEQ ID NO: 1637397

SEQ ID NO: 1705124 - protein, 26 aa, Staphylococcus aureus
GKSSNKDEGVKDATKTETSKHKGGTL

SEQ ID NO: 1705125 - protein, 4 aa, Staphylococcus aureus
GNRM

SEQ ID NO: 1705126 - protein, 5 aa, Staphylococcus aureus
GYSYG

SEQ ID NO: 1705127 - protein, 15 aa, Staphylococcus aureus
IATIEGNKADASSLD

SEQ ID NO: 1705128 - protein, 12 aa, Staphylococcus aureus
IDSKNKPANSDI

SEQ ID NO: 1705129 - protein, 21 aa, Staphylococcus aureus
IKQANTNAEVDQAATVAENNI

SEQ ID NO: 1705130 - protein, 4 aa, Staphylococcus aureus
ITVP

SEQ ID NO: 1705131 - protein, 6 aa, Staphylococcus aureus
KEKAYQ

SEQ ID NO: 1705132 - protein, 11 aa, Staphylococcus aureus
KGAGSLATGSA

SEQ ID NO: 1705133 - protein, 25 aa, Staphylococcus aureus
KGDIDVANDATGAMAKDAKSSNAGL

SEQ ID NO: 1705134 - protein, 12 aa, Staphylococcus aureus
KIWTSDDNAAYD

SEQ ID NO: 1705135 - protein, 9 aa, Staphylococcus aureus
KQPVQQASK

SEQ ID NO: 1705136 - protein, 10 aa, Staphylococcus aureus
KYQLTNDDYN

SEQ ID NO: 1705137 - protein, 8 aa, Staphylococcus aureus
LKQQADTI

SEQ ID NO: 1705138 - protein, 15 aa, Staphylococcus aureus
NDKAKTADGKPLALG

SEQ ID NO: 1705139 - protein, 18 aa, Staphylococcus aureus
NGNREEIEYQKKHGGEIS

SEQ ID NO: 1705140 - protein, 11 aa, Staphylococcus aureus
NLKAPKIEEDY

SEQ ID NO: 1705141 - protein, 26 aa, Staphylococcus aureus
NRGGLTGNITKESNYSETISYQQPSY

SEQ ID NO: 1705142 - protein, 8 aa, Staphylococcus aureus
NTKKATGY

SEQ ID NO: 1705143 - protein, 8 aa, Staphylococcus aureus
NTKTTNGY

SEQ ID NO: 1705144 - protein, 6 aa, Staphylococcus aureus
PNNEDM

SEQ ID NO: 1705145 - protein, 17 aa, Staphylococcus aureus
QPTTVAASSKDKSVSKL

SEQ ID NO: 1705146 - protein, 4 aa, Staphylococcus aureus
QSEY

SEQ ID NO: 1705147 - protein, 8 aa, Staphylococcus aureus
RNTRSAKG

SEQ ID NO: 1705148 - protein, 6 aa, Staphylococcus aureus
RSRKIG

SEQ ID NO: 1705149 - protein, 6 aa, Staphylococcus aureus
SELPPL

SEQ ID NO: 1705150 - protein, 6 aa, Staphylococcus aureus
SKNYTA

SEQ ID NO: 1705151 - protein, 17 aa, Staphylococcus aureus
TKDEDEGKPHDNEKRYP

SEQ ID NO: 1705152 - protein, 6 aa, Staphylococcus aureus
TKPSLE

SEQ ID NO: 1705153 - protein, 6 aa, Staphylococcus aureus
TKVEVK

SEQ ID NO: 1705154 - protein, 11 aa, Staphylococcus aureus
TLDTTQDERDV

SEQ ID NO: 1705155 - protein, 25 aa, Staphylococcus aureus
TQDAKNNVIPVSNGDHYRWYSSIYG

SEQ ID NO: 1705156 - protein, 16 aa, Staphylococcus aureus
TSLEGIKRDTKRWKDE

SEQ ID NO: 1705157 - protein, 13 aa, Staphylococcus aureus
YRVGTSSTAANPV

SEQ ID NO: 1705158 - protein, 14 aa, Staphylococcus aureus
ADADASAKEIARTD

SEQ ID NO: 1705159 - protein, 12 aa, Staphylococcus aureus
AEENESLDDQNI

SEQ ID NO: 1705160 - protein, 10 aa, Staphylococcus aureus
APQPNQATTK

SEQ ID NO: 1705161 - protein, 13 aa, Staphylococcus aureus
AQTTNDVTQIKDQ

SEQ ID NO: 1705162 - protein, 20 aa, Staphylococcus aureus
ATAKKQEINQNTNATTEEKQ

SEQ ID NO: 1705163 - protein, 16 aa, Staphylococcus aureus
ATDNVNNTTNDSQSKH

SEQ ID NO: 1705164 - protein, 13 aa, Staphylococcus aureus
DAENAVNKKVDQM

SEQ ID NO: 1705165 - protein, 11 aa, Staphylococcus aureus
DEYKDYYDKKV

SEQ ID NO: 1705166 - protein, 6 aa, Staphylococcus aureus
DGEVSE

SEQ ID NO: 1705167 - protein, 22 aa, Staphylococcus aureus
DGVPKDYKVADKSGQAITYASR

SEQ ID NO: 1705168 - protein, 13 aa, Staphylococcus aureus
DKGSSSQKEQAEY

SEQ ID NO: 1705169 - protein, 12 aa, Staphylococcus aureus
DKYSDDNKPYKE

SEQ ID NO: 1705170 - protein, 10 aa, Staphylococcus aureus
DRGISEQDLK

SEQ ID NO: 1705171 - protein, 13 aa, Staphylococcus aureus
DSIEENNKNQLDA

SEQ ID NO: 1705172 - protein, 7 aa, Staphylococcus aureus
EADGNQL

SEQ ID NO: 1705173 - protein, 4 aa, Staphylococcus aureus
EGFN

SEQ ID NO: 1705174 - protein, 23 aa, Staphylococcus aureus
ELDTKAQEKVTAAQQSKKVTQDE

SEQ ID NO: 1705175 - protein, 5 aa, Staphylococcus aureus
GHAPH

SEQ ID NO: 1705176 - protein, 16 aa, Staphylococcus aureus
GTFKYQSRPKFNSTPK

SEQ ID NO: 1705177 - protein, 4 aa, Staphylococcus aureus
HPDV

SEQ ID NO: 1705178 - protein, 10 aa, Staphylococcus aureus
INNDKNNAIA

SEQ ID NO: 1705179 - protein, 9 aa, Staphylococcus aureus
ITPNNPSGH

SEQ ID NO: 1705180 - protein, 8 aa, Staphylococcus aureus
KADKRELI

SEQ ID NO: 1705181 - protein, 8 aa, Staphylococcus aureus
KARKNPGL

SEQ ID NO: 1705182 - protein, 8 aa, Staphylococcus aureus
KASAREQL

SEQ ID NO: 1705183 - protein, 5 aa, Staphylococcus aureus
KPAAL

SEQ ID NO: 1705184 - protein, 5 aa, Staphylococcus aureus
KPDYV

SEQ ID NO: 1705185 - protein, 6 aa, Staphylococcus aureus
KQHYHT

SEQ ID NO: 1705186 - protein, 13 aa, Staphylococcus aureus
KQNDTKKSKIKVT

SEQ ID NO: 1705187 - protein, 11 aa, Staphylococcus aureus
KTGTKAKADRY

SEQ ID NO: 1705188 - protein, 7 aa, Staphylococcus aureus
KTNTIKK

SEQ ID NO: 1705189 - protein, 7 aa, Staphylococcus aureus
KVGAHYP

SEQ ID NO: 1705190 - protein, 12 aa, Staphylococcus aureus
LADQAKKDDERI

SEQ ID NO: 1705191 - protein, 8 aa, Staphylococcus aureus
LYNGEFNK

SEQ ID NO: 1705192 - protein, 16 aa, Staphylococcus aureus
NAQQQINTAKTEAQQV

SEQ ID NO: 1705193 - protein, 22 aa, Staphylococcus aureus
NDIAQNKTNAEVDRTETDGNDN

SEQ ID NO: 1705194 - protein, 4 aa, Staphylococcus aureus
NETS

SEQ ID NO: 1705195 - protein, 17 aa, Staphylococcus aureus
NPKDLNDYKYDPEKAKK

SEQ ID NO: 1705196 - protein, 6 aa, Staphylococcus aureus
PNDEMK

SEQ ID NO: 1705197 - protein, 10 aa, Staphylococcus aureus
PNGEYNNGGF

SEQ ID NO: 1705198 - protein, 5 aa, Staphylococcus aureus
PSLQV

SEQ ID NO: 1705199 - protein, 5 aa, Staphylococcus aureus
QNGET

SEQ ID NO: 1705200 - protein, 14 aa, Staphylococcus aureus
QRLKELGDKVTNPV

SEQ ID NO: 1705201 - protein, 45 aa, Staphylococcus aureus; identical to SEQ ID NO: 1630040

SEQ ID NO: 1705202 - protein, 8 aa, Staphylococcus aureus
SEAKENER

SEQ ID NO: 1705203 - protein, 8 aa, Staphylococcus aureus
SNENFTDK

SEQ ID NO: 1705204 - protein, 6 aa, Staphylococcus aureus
STHADS

SEQ ID NO: 1705205 - protein, 9 aa, Staphylococcus aureus
TDKKIRPKA

SEQ ID NO: 1705206 - protein, 6 aa, Staphylococcus aureus
TNVAPY

SEQ ID NO: 1705207 - protein, 4 aa, Staphylococcus aureus
TQGY

SEQ ID NO: 1705208 - protein, 7 aa, Staphylococcus aureus
TTTVPGL

SEQ ID NO: 1705209 - protein, 14 aa, Staphylococcus aureus
VDGQIDTSKSGKYQ

SEQ ID NO: 1705210 - protein, 5 aa, Staphylococcus aureus
VEPGS

SEQ ID NO: 1705211 - protein, 7 aa, Staphylococcus aureus
VERQTQQ

SEQ ID NO: 1705212 - protein, 4 aa, Staphylococcus aureus
VKPV

SEQ ID NO: 1705213 - protein, 7 aa, Staphylococcus aureus
VKTPSNK

SEQ ID NO: 1705214 - protein, 19 aa, Staphylococcus aureus
VVSETTDKKGHATYSDDND

SEQ ID NO: 1705215 - protein, 29 aa, Staphylococcus aureus
YEEKHSKPVEVNKAELEKESINVKTSSNL

SEQ ID NO: 1705216 - protein, 59 aa, Staphylococcus aureus
YQSNVGPDASYYSHSNNNQAYNSHDGNGKVNYPNGTSNQNGGSASKATASGHAKDASWL

SEQ ID NO: 1705217 - protein, 8 aa, Staphylococcus aureus
YSGPSYEL

SEQ ID NO: 1705218 - protein, 12 aa, Staphylococcus aureus
AAPEKTYKSQLD

SEQ ID NO: 1705219 - protein, 23 aa, Staphylococcus aureus
AGESHAQTKNVEAAKKYDQYQTN

SEQ ID NO: 1705220 - protein, 5 aa, Staphylococcus aureus
AKRVP

SEQ ID NO: 1705221 - protein, 9 aa, Staphylococcus aureus
ATPNKAARQ

SEQ ID NO: 1705222 - protein, 8 aa, Staphylococcus aureus
DANGPTYQ

SEQ ID NO: 1705223 - protein, 9 aa, Staphylococcus aureus
DATHGDPHA

SEQ ID NO: 1705224 - protein, 12 aa, Staphylococcus aureus
DIDAATTNAQVE

SEQ ID NO: 1705225 - protein, 9 aa, Staphylococcus aureus
DKKDKGKSQ

SEQ ID NO: 1705226 - protein, 13 aa, Staphylococcus aureus
DLEENGYKAYEAS

SEQ ID NO: 1705227 - protein, 24 aa, Staphylococcus aureus
DPNGRLSTVGGVTKKNNKSSETNT

SEQ ID NO: 1705228 - protein, 13 aa, Staphylococcus aureus
DYRDEADKMADYD

SEQ ID NO: 1705229 - protein, 15 aa, Staphylococcus aureus
EDSDGMTHNHTKRYP

SEQ ID NO: 1705230 - protein, 14 aa, Staphylococcus aureus
ENSAPTSKQAQAAI

SEQ ID NO: 1705231 - protein, 12 aa, Staphylococcus aureus
FSNEEKKKFTAP

SEQ ID NO: 1705232 - protein, 5 aa, Staphylococcus aureus
GGNLD

SEQ ID NO: 1705233 - protein, 6 aa, Staphylococcus aureus
GKPALD

SEQ ID NO: 1705234 - protein, 15 aa, Staphylococcus aureus
GNPPYGERIGDREEV

SEQ ID NO: 1705235 - protein, 7 aa, Staphylococcus aureus
GQSVLTP

SEQ ID NO: 1705236 - protein, 4 aa, Staphylococcus aureus
HDGF

SEQ ID NO: 1705237 - protein, 20 aa, Staphylococcus aureus
IANAESNSNIKAKDKKHVQV

SEQ ID NO: 1705238 - protein, 15 aa, Staphylococcus aureus
IANRPTDGGLSWSDD

SEQ ID NO: 1705239 - protein, 13 aa, Staphylococcus aureus
IDSTEKQKAIEEL

SEQ ID NO: 1705240 - protein, 6 aa, Staphylococcus aureus
IVGSRA

SEQ ID NO: 1705241 - protein, 8 aa, Staphylococcus aureus
KDGGPRDY

SEQ ID NO: 1705242 - protein, 13 aa, Staphylococcus aureus
KITKYSSSSSKYT

SEQ ID NO: 1705243 - protein, 49 aa, Staphylococcus aureus; identical to SEQ ID NO: 1632452

SEQ ID NO: 1705244 - protein, 8 aa, Staphylococcus aureus
KVQNDQYG

SEQ ID NO: 1705245 - protein, 7 aa, Staphylococcus aureus
LGTQITT

SEQ ID NO: 1705246 - protein, 17 aa, Staphylococcus aureus
NADDDSPKKLKYKENSA

SEQ ID NO: 1705247 - protein, 16 aa, Staphylococcus aureus
NASSKGAPYNLPTTPW

SEQ ID NO: 1705248 - protein, 9 aa, Staphylococcus aureus
NGIDGNRTI

SEQ ID NO: 1705249 - protein, 9 aa, Staphylococcus aureus
NIPTQKAPK

SEQ ID NO: 1705250 - protein, 6 aa, Staphylococcus aureus
NPPHGA

SEQ ID NO: 1705251 - protein, 6 aa, Staphylococcus aureus
NVAPYS

SEQ ID NO: 1705252 - protein, 4 aa, Staphylococcus aureus
PLDP

SEQ ID NO: 1705253 - protein, 8 aa, Staphylococcus aureus
REHPERAQ

SEQ ID NO: 1705254 - protein, 13 aa, Staphylococcus aureus
RITKEDNKGTISH

SEQ ID NO: 1705255 - protein, 8 aa, Staphylococcus aureus
SISYTQQN

SEQ ID NO: 1705256 - protein, 5 aa, Staphylococcus aureus
STGKI

SEQ ID NO: 1705257 - protein, 7 aa, Staphylococcus aureus
VGTAGGG

SEQ ID NO: 1705258 - protein, 8 aa, Staphylococcus aureus
VKDQETTL

SEQ ID NO: 1705259 - protein, 10 aa, Staphylococcus aureus
YKTEPKDSKI

SEQ ID NO: 1705260 - protein, 10 aa, Staphylococcus aureus
YNIPTNKAPK

SEQ ID NO: 1705261 - protein, 14 aa, Staphylococcus aureus
YTIPTGKKESATTD

SEQ ID NO: 1705262 - protein, 15 aa, Staphylococcus aureus
AHAQQHGTQVKTPVQ

SEQ ID NO: 1705263 - protein, 14 aa, Staphylococcus aureus
AKDELATKANEQKA

SEQ ID NO: 1705264 - protein, 15 aa, Staphylococcus aureus
ASNLNQAQQNNFTQQ

SEQ ID NO: 1705265 - protein, 10 aa, Staphylococcus aureus
ATPNKAARQL

SEQ ID NO: 1705266 - protein, 14 aa, Staphylococcus aureus
DDEDDNSENQINPE

SEQ ID NO: 1705267 - protein, 16 aa, Staphylococcus aureus
DDSMREELTRFIKALG

SEQ ID NO: 1705268 - protein, 6 aa, Staphylococcus aureus
DESKHL

SEQ ID NO: 1705269 - protein, 4 aa, Staphylococcus aureus
DGNI

SEQ ID NO: 1705270 - protein, 11 aa, Staphylococcus aureus
DKQERANYEKL

SEQ ID NO: 1705271 - protein, 8 aa, Staphylococcus aureus
EDEKLKQK

SEQ ID NO: 1705272 - protein, 4 aa, Staphylococcus aureus
GADQ

SEQ ID NO: 1705273 - protein, 11 aa, Staphylococcus aureus
GNKPSGESTRG

SEQ ID NO: 1705274 - protein, 6 aa, Staphylococcus aureus
GTAGGG

SEQ ID NO: 1705275 - protein, 11 aa, Staphylococcus aureus
GVASNDTKAWE

SEQ ID NO: 1705276 - protein, 16 aa, Staphylococcus aureus
HDEDGRPKSKDKEYPV

SEQ ID NO: 1705277 - protein, 15 aa, Staphylococcus aureus
HQKGSMRSNDNGDDM

SEQ ID NO: 1705278 - protein, 6 aa, Staphylococcus aureus
IEKGTA

SEQ ID NO: 1705279 - protein, 11 aa, Staphylococcus aureus
IQQTAKAENSV

SEQ ID NO: 1705280 - protein, 7 aa, Staphylococcus aureus
ISYTQQN

SEQ ID NO: 1705281 - protein, 10 aa, Staphylococcus aureus
ITADTTIKDV

SEQ ID NO: 1705282 - protein, 19 aa, Staphylococcus aureus
ITNKNTSTSNESGVHFELT

SEQ ID NO: 1705283 - protein, 17 aa, Staphylococcus aureus
KATEDISDQTTNAEIAT

SEQ ID NO: 1705284 - protein, 10 aa, Staphylococcus aureus
KDVKKVKDGA

SEQ ID NO: 1705285 - protein, 15 aa, Staphylococcus aureus
KESDKNLTPYKAETV

SEQ ID NO: 1705286 - protein, 10 aa, Staphylococcus aureus
KKGTKNSAQF

SEQ ID NO: 1705287 - protein, 12 aa, Staphylococcus aureus
KKQVNKKVVDAQ

SEQ ID NO: 1705288 - protein, 5 aa, Staphylococcus aureus
LESTN

SEQ ID NO: 1705289 - protein, 5 aa, Staphylococcus aureus
NQFAK

SEQ ID NO: 1705290 - protein, 7 aa, Staphylococcus aureus
NYPGKED

SEQ ID NO: 1705291 - protein, 56 aa, Staphylococcus aureus; identical to SEQ ID NO: 1629865

SEQ ID NO: 1705292 - protein, 9 aa, Staphylococcus aureus
QPKGERMKS

SEQ ID NO: 1705293 - protein, 13 aa, Staphylococcus aureus
RAKEKGKSTGLVS

SEQ ID NO: 1705294 - protein, 12 aa, Staphylococcus aureus
SNHAKASVTESV

SEQ ID NO: 1705295 - protein, 12 aa, Staphylococcus aureus
TDTSGNTATTSF

SEQ ID NO: 1705296 - protein, 6 aa, Staphylococcus aureus
THTEYS

SEQ ID NO: 1705297 - protein, 7 aa, Staphylococcus aureus
THTEYSK

SEQ ID NO: 1705298 - protein, 8 aa, Staphylococcus aureus
TKGYNGLE

SEQ ID NO: 1705299 - protein, 8 aa, Staphylococcus aureus
TKGYNGLK

SEQ ID NO: 1705300 - protein, 18 aa, Staphylococcus aureus
VPAAPKKAVAQPKTAVKA

SEQ ID NO: 1705301 - protein, 5 aa, Staphylococcus aureus
YEEGL

SEQ ID NO: 1705302 - protein, 10 aa, Staphylococcus aureus
YGSNVTAAEI

SEQ ID NO: 1705303 - protein, 9 aa, Staphylococcus aureus
YSNSTQTFD

SEQ ID NO: 1705304 - protein, 26 aa, Staphylococcus aureus
ADQKKNNISADTNATQDEKQQAIKQV

SEQ ID NO: 1705305 - protein, 12 aa, Staphylococcus aureus
AGGTDPDPSDLY

SEQ ID NO: 1705306 - protein, 7 aa, Staphylococcus aureus
AGVGSDH

SEQ ID NO: 1705307 - protein, 9 aa, Staphylococcus aureus
AKKDSAEFK

SEQ ID NO: 1705308 - protein, 7 aa, Staphylococcus aureus
ANGPTYQ

SEQ ID NO: 1705309 - protein, 62 aa, Staphylococcus aureus; identical to SEQ ID NO: 1626550

SEQ ID NO: 1705310 - protein, 5 aa, Staphylococcus aureus
ASEHN

SEQ ID NO: 1705311 - protein, 11 aa, Staphylococcus aureus
AVHPKNRNFKD

SEQ ID NO: 1705312 - protein, 19 aa, Staphylococcus aureus
DALQQQVNSQVDNSHYTTA

SEQ ID NO: 1705313 - protein, 16 aa, Staphylococcus aureus
DDSMREELTRFIKELG

SEQ ID NO: 1705314 - protein, 13 aa, Staphylococcus aureus
DGQIDTSKSGKYQ

SEQ ID NO: 1705315 - protein, 10 aa, Staphylococcus aureus
DKQERANYEK

SEQ ID NO: 1705316 - protein, 4 aa, Staphylococcus aureus
DKVN

SEQ ID NO: 1705317 - protein, 5 aa, Staphylococcus aureus
DLTSL

SEQ ID NO: 1705318 - protein, 11 aa, Staphylococcus aureus
DNFTPKDKMPV

SEQ ID NO: 1705319 - protein, 11 aa, Staphylococcus aureus
DNFTPKNKMPV

SEQ ID NO: 1705320 - protein, 7 aa, Staphylococcus aureus
DRDIKSV

SEQ ID NO: 1705321 - protein, 14 aa, Staphylococcus aureus
DSVYPKNKKFSENT

SEQ ID NO: 1705322 - protein, 49 aa, Staphylococcus aureus; identical to SEQ ID NO: 1626729

SEQ ID NO: 1705323 - protein, 8 aa, Staphylococcus aureus
EEAEQIQK

SEQ ID NO: 1705324 - protein, 11 aa, Staphylococcus aureus
EEGHRQSVEGE

SEQ ID NO: 1705325 - protein, 5 aa, Staphylococcus aureus
EHVRP

SEQ ID NO: 1705326 - protein, 51 aa, Staphylococcus aureus; identical to SEQ ID NO: 1628589

SEQ ID NO: 1705327 - protein, 5 aa, Staphylococcus aureus
ELPPL

SEQ ID NO: 1705328 - protein, 5 aa, Staphylococcus aureus
ERHNI

SEQ ID NO: 1705329 - protein, 16 aa, Staphylococcus aureus
ETDPSISNNDDSGQFN

SEQ ID NO: 1705330 - protein, 5 aa, Staphylococcus aureus
FGADQ

SEQ ID NO: 1705331 - protein, 30 aa, Staphylococcus aureus; identical to SEQ ID NO: 1564563

SEQ ID NO: 1705332 - protein, 14 aa, Staphylococcus aureus
GKDEKKYKDGPYDN

SEQ ID NO: 1705333 - protein, 52 aa, Staphylococcus aureus
GQAQAAEKQVNMGNSQEDTVTAQSIGDQQTRENANYQRENGVDEQQHTENLT

SEQ ID NO: 1705334 - protein, 6 aa, Staphylococcus aureus
IEKAPN

SEQ ID NO: 1705335 - protein, 11 aa, Staphylococcus aureus
IGVDSNKQKVK

SEQ ID NO: 1705336 - protein, 30 aa, Staphylococcus aureus; identical to SEQ ID NO: 1566612

SEQ ID NO: 1705337 - protein, 11 aa, Staphylococcus aureus
IKQNATNLNSA

SEQ ID NO: 1705338 - protein, 28 aa, Staphylococcus aureus
INATPDATNDEKNAAINTLNQDRQQAIE

SEQ ID NO: 1705339 - protein, 14 aa, Staphylococcus aureus
IPTKGIKDENIKKE

SEQ ID NO: 1705340 - protein, 13 aa, Staphylococcus aureus
IQASTDVKTNARA

SEQ ID NO: 1705341 - protein, 5 aa, Staphylococcus aureus
IQHGS

SEQ ID NO: 1705342 - protein, 9 aa, Staphylococcus aureus
KIPTNKAPK

SEQ ID NO: 1705343 - protein, 14 aa, Staphylococcus aureus
KTNGRNAQIKDTFN

SEQ ID NO: 1705344 - protein, 8 aa, Staphylococcus aureus
LATGSLNT

SEQ ID NO: 1705345 - protein, 17 aa, Staphylococcus aureus
LNKSNGQNKTKDQVTEA

SEQ ID NO: 1705346 - protein, 7 aa, Staphylococcus aureus
LTPETDN

SEQ ID NO: 1705347 - protein, 19 aa, Staphylococcus aureus
NAATTTGDVTTAKDTAVQK

SEQ ID NO: 1705348 - protein, 8 aa, Staphylococcus aureus
NGEDLDKH

SEQ ID NO: 1705349 - protein, 8 aa, Staphylococcus aureus
NGIDGNRT

SEQ ID NO: 1705350 - protein, 8 aa, Staphylococcus aureus
NGSAIPDA

SEQ ID NO: 1705351 - protein, 5 aa, Staphylococcus aureus
NGTKK

SEQ ID NO: 1705352 - protein, 23 aa, Staphylococcus aureus
NKVKQTKAVKSPVRKASQAKKVV

SEQ ID NO: 1705353 - protein, 21 aa, Staphylococcus aureus
NNAQKADVKSKINAASNIAGV

SEQ ID NO: 1705354 - protein, 16 aa, Staphylococcus aureus
NNETTNEEKGNDIGPV

SEQ ID NO: 1705355 - protein, 8 aa, Staphylococcus aureus
NNSWSTNA

SEQ ID NO: 1705356 - protein, 60 aa, Staphylococcus aureus
NNYNNYNNGYSYNNYSRYNNYSNNNQSYNYNNYNSYNTNSYRTGGLGASYSTSSNNVQVT

SEQ ID NO: 1705357 - protein, 6 aa, Staphylococcus aureus
NSALEQ

SEQ ID NO: 1705358 - protein, 10 aa, Staphylococcus aureus
PQPAPADHPW

SEQ ID NO: 1705359 - protein, 21 aa, Staphylococcus aureus
QSDNYVNADTNKKNDYNNAYN

SEQ ID NO: 1705360 - protein, 12 aa, Staphylococcus aureus
QYTPSEDTRYES

SEQ ID NO: 1705361 - protein, 6 aa, Staphylococcus aureus
RRTGNH

SEQ ID NO: 1705362 - protein, 12 aa, Staphylococcus aureus
SDLTSAKNSANA

SEQ ID NO: 1705363 - protein, 7 aa, Staphylococcus aureus
SIVGSRA

SEQ ID NO: 1705364 - protein, 7 aa, Staphylococcus aureus
SSPYETG

SEQ ID NO: 1705365 - protein, 10 aa, Staphylococcus aureus
TNTITANDNF

SEQ ID NO: 1705366 - protein, 10 aa, Staphylococcus aureus
TNVVGKDDGV

SEQ ID NO: 1705367 - protein, 31 aa, Staphylococcus aureus; identical to SEQ ID NO: 1622032

SEQ ID NO: 1705368 - protein, 29 aa, Staphylococcus aureus
TTSTQLPKTPISFSSEAKAYNISENETNI

SEQ ID NO: 1705369 - protein, 12 aa, Staphylococcus aureus
TVKQQGTDLNTA

SEQ ID NO: 1705370 - protein, 9 aa, Staphylococcus aureus
YSDNTANNK

SEQ ID NO: 1705371 - protein, 12 aa, Staphylococcus aureus
AHSAELDPATPY

SEQ ID NO: 1705372 - protein, 9 aa, Staphylococcus aureus
AIAPGTIET

SEQ ID NO: 1705373 - protein, 5 aa, Staphylococcus aureus
AKEEG

SEQ ID NO: 1705374 - protein, 12 aa, Staphylococcus aureus
AKSNKPGELDDE

SEQ ID NO: 1705375 - protein, 41 aa, Staphylococcus aureus
ANQHKENSSKSNDTNKKTQQTDNTTQSNTEKQMTPQEAEDI

SEQ ID NO: 1705376 - protein, 7 aa, Staphylococcus aureus
AYHKDTE

SEQ ID NO: 1705377 - protein, 14 aa, Staphylococcus aureus
DKAKTADGKPLALG

SEQ ID NO: 1705378 - protein, 12 aa, Staphylococcus aureus
DLEENGYKAYEA

SEQ ID NO: 1705379 - protein, 10 aa, Staphylococcus aureus
DPNTNTNGIT

SEQ ID NO: 1705380 - protein, 12 aa, Staphylococcus aureus
DTDNPHKITNER

SEQ ID NO: 1705381 - protein, 13 aa, Staphylococcus aureus
DTKSGKEVKFNSD

SEQ ID NO: 1705382 - protein, 12 aa, Staphylococcus aureus
EATESKGTQLKA

SEQ ID NO: 1705383 - protein, 6 aa, Staphylococcus aureus
ERHNIS

SEQ ID NO: 1705384 - protein, 5 aa, Staphylococcus aureus
ESSFI

SEQ ID NO: 1705385 - protein, 13 aa, Staphylococcus aureus
FAEENESLDDQNI

SEQ ID NO: 1705386 - protein, 6 aa, Staphylococcus aureus
FGGGYG

SEQ ID NO: 1705387 - protein, 10 aa, Staphylococcus aureus
GAGSLATGSA

SEQ ID NO: 1705388 - protein, 4 aa, Staphylococcus aureus
GAID

SEQ ID NO: 1705389 - protein, 5 aa, Staphylococcus aureus
GDGNI

SEQ ID NO: 1705390 - protein, 8 aa, Staphylococcus aureus
GKLSKENK

SEQ ID NO: 1705391 - protein, 5 aa, Staphylococcus aureus
GNMGS

SEQ ID NO: 1705392 - protein, 51 aa, Staphylococcus aureus
GQAQAAEKQVNMGNSQEDTVTAQSIGDQQTRENANYQRENGVDEQQHTENL

SEQ ID NO: 1705393 - protein, 7 aa, Staphylococcus aureus
GRDGIRA

SEQ ID NO: 1705394 - protein, 9 aa, Staphylococcus aureus
GSGSKSYIQ

SEQ ID NO: 1705395 - protein, 14 aa, Staphylococcus aureus
GSIVNTSSFSGQAA

SEQ ID NO: 1705396 - protein, 15 aa, Staphylococcus aureus
IPTKEIKDKNIKKEI

SEQ ID NO: 1705397 - protein, 17 aa, Staphylococcus aureus
KAELEKESINVKTSSNL

SEQ ID NO: 1705398 - protein, 13 aa, Staphylococcus aureus
KKQVNKKVVDAQK

SEQ ID NO: 1705399 - protein, 10 aa, Staphylococcus aureus
KQAPKQAVAK

SEQ ID NO: 1705400 - protein, 7 aa, Staphylococcus aureus
KRIEDGV

SEQ ID NO: 1705401 - protein, 8 aa, Staphylococcus aureus
LGKPEEVG

SEQ ID NO: 1705402 - protein, 7 aa, Staphylococcus aureus
LKNRSQN

SEQ ID NO: 1705403 - protein, 9 aa, Staphylococcus aureus
NGNKTQALQ

SEQ ID NO: 1705404 - protein, 9 aa, Staphylococcus aureus
NGNPTVQNI

SEQ ID NO: 1705405 - protein, 8 aa, Staphylococcus aureus
NKSGDTLI

SEQ ID NO: 1705406 - protein, 14 aa, Staphylococcus aureus
NPPYGERIGDREEV

SEQ ID NO: 1705407 - protein, 4 aa, Staphylococcus aureus
NRPR

SEQ ID NO: 1705408 - protein, 13 aa, Staphylococcus aureus
NSTNRTNNARERN

SEQ ID NO: 1705409 - protein, 11 aa, Staphylococcus aureus
QAKQTAKQQLN

SEQ ID NO: 1705410 - protein, 4 aa, Staphylococcus aureus
QHGS

SEQ ID NO: 1705411 - protein, 4 aa, Staphylococcus aureus
QYNH

SEQ ID NO: 1705412 - protein, 5 aa, Staphylococcus aureus
RGGFN

SEQ ID NO: 1705413 - protein, 6 aa, Staphylococcus aureus
RKGAEL

SEQ ID NO: 1705414 - protein, 5 aa, Staphylococcus aureus
RTGNH

SEQ ID NO: 1705415 - protein, 6 aa, Staphylococcus aureus
SASAIE

SEQ ID NO: 1705416 - protein, 8 aa, Staphylococcus aureus
SKRENSKL

SEQ ID NO: 1705417 - protein, 26 aa, Staphylococcus aureus
TDQAKQGITDATTTAEVEKAKAQGLE

SEQ ID NO: 1705418 - protein, 19 aa, Staphylococcus aureus
VNVKQKGSLADDKELSSID

SEQ ID NO: 1705419 - protein, 23 aa, Staphylococcus aureus
VTTQSVKAEKIQSTKVDKVPTLK

SEQ ID NO: 1705420 - protein, 12 aa, Staphylococcus aureus
YEEKHSKPVEVN

SEQ ID NO: 1705421 - protein, 16 aa, Staphylococcus aureus
YKDNPTSQEGKWANQK

SEQ ID NO: 1705422 - protein, 10 aa, Staphylococcus aureus
YRSGYNAAKG

SEQ ID NO: 1705423 - protein, 13 aa, Staphylococcus aureus
AAGQTKFLYKSKE

SEQ ID NO: 1705424 - protein, 4 aa, Staphylococcus aureus
DDET

SEQ ID NO: 1705425 - protein, 9 aa, Staphylococcus aureus
DIPTKQAPK

SEQ ID NO: 1705426 - protein, 12 aa, Staphylococcus aureus
DISKNQNEKKYR

SEQ ID NO: 1705427 - protein, 18 aa, Staphylococcus aureus
DKEGYRDDQFDKNDKGTW

SEQ ID NO: 1705428 - protein, 22 aa, Staphylococcus aureus
DLKNNQKSPVEPTKDNDKKNGL

SEQ ID NO: 1705429 - protein, 14 aa, Staphylococcus aureus
DYRDEADKMADYDK

SEQ ID NO: 1705430 - protein, 10 aa, Staphylococcus aureus
ENEKKYQYTG

SEQ ID NO: 1705431 - protein, 9 aa, Staphylococcus aureus
FAPDNQLPP

SEQ ID NO: 1705432 - protein, 16 aa, Staphylococcus aureus
HTRQLTNDSDNRTKSE

SEQ ID NO: 1705433 - protein, 12 aa, Staphylococcus aureus
IGVASNDTKAWE

SEQ ID NO: 1705434 - protein, 9 aa, Staphylococcus aureus
KDDKLKQKI

SEQ ID NO: 1705435 - protein, 35 aa, Staphylococcus aureus; identical to SEQ ID NO: 1639094

SEQ ID NO: 1705436 - protein, 15 aa, Staphylococcus aureus
KKEESSKDKQIKENF

SEQ ID NO: 1705437 - protein, 24 aa, Staphylococcus aureus
KKEETHESRKVEKELPNTGSEGMD

SEQ ID NO: 1705438 - protein, 8 aa, Staphylococcus aureus
KPGTTLTK

SEQ ID NO: 1705439 - protein, 9 aa, Staphylococcus aureus
KPGTTLTKE

SEQ ID NO: 1705440 - protein, 35 aa, Staphylococcus aureus
LAGTTTLENEEPKGTDVKKSSKTFVGGTKFDDQHA

SEQ ID NO: 1705441 - protein, 7 aa, Staphylococcus aureus
LNAYNQK

SEQ ID NO: 1705442 - protein, 9 aa, Staphylococcus aureus
LQAARQKLT

SEQ ID NO: 1705443 - protein, 18 aa, Staphylococcus aureus
NAANNEANKFGSNNKVYN

SEQ ID NO: 1705444 - protein, 8 aa, Staphylococcus aureus
NDEPATRR

SEQ ID NO: 1705445 - protein, 32 aa, Staphylococcus aureus; identical to SEQ ID NO: 1640864

SEQ ID NO: 1705446 - protein, 22 aa, Staphylococcus aureus
NNGVEGLEDYENEVERIRKRFK

SEQ ID NO: 1705447 - protein, 6 aa, Staphylococcus aureus
RGGFNK

SEQ ID NO: 1705448 - protein, 15 aa, Staphylococcus aureus
SKLPDIPHHKFLEMI

SEQ ID NO: 1705449 - protein, 10 aa, Staphylococcus aureus
SQPKGESLKS

SEQ ID NO: 1705450 - protein, 14 aa, Staphylococcus aureus
TDPSISNNDDSGQF

SEQ ID NO: 1705451 - protein, 6 aa, Staphylococcus aureus
TNQTGI

SEQ ID NO: 1705452 - protein, 7 aa, Staphylococcus aureus
YAKKATY

SEQ ID NO: 1705453 - protein, 9 aa, Staphylococcus aureus
YNISTEKSP

SEQ ID NO: 1705454 - protein, 20 aa, Staphylococcus aureus
AINDINQTTPATTAKAAALE

SEQ ID NO: 1705455 - protein, 16 aa, Staphylococcus aureus
ANHVETANRASQADID

SEQ ID NO: 1705456 - protein, 4 aa, Staphylococcus aureus
AQGN

SEQ ID NO: 1705457 - protein, 29 aa, Staphylococcus aureus
ARDAVKQQYEAKKQEIEQAEHATDEEKQV

SEQ ID NO: 1705458 - protein, 6 aa, Staphylococcus aureus
AVPESK

SEQ ID NO: 1705459 - protein, 8 aa, Staphylococcus aureus
DATHGDPH

SEQ ID NO: 1705460 - protein, 16 aa, Staphylococcus aureus
DSDSSLRSEDKGDDMS

SEQ ID NO: 1705461 - protein, 7 aa, Staphylococcus aureus
EDPNLKK

SEQ ID NO: 1705462 - protein, 7 aa, Staphylococcus aureus
EHPERAQ

SEQ ID NO: 1705463 - protein, 16 aa, Staphylococcus aureus
ESDSSLRSEDKGDDMS

SEQ ID NO: 1705464 - protein, 37 aa, Staphylococcus aureus
GNDDSKKDDSKTSKKDDGVKAELKQATKAYDKYTDEQ

SEQ ID NO: 1705465 - protein, 5 aa, Staphylococcus aureus
GPSFE

SEQ ID NO: 1705466 - protein, 13 aa, Staphylococcus aureus
HHADAAENYTNYN

SEQ ID NO: 1705467 - protein, 11 aa, Staphylococcus aureus
KEAPIKDPKKA

SEQ ID NO: 1705468 - protein, 5 aa, Staphylococcus aureus
KEAQS

SEQ ID NO: 1705469 - protein, 16 aa, Staphylococcus aureus
KEGFRDQEFDKRDKGT

SEQ ID NO: 1705470 - protein, 9 aa, Staphylococcus aureus
KGKEEPQSS

SEQ ID NO: 1705471 - protein, 12 aa, Staphylococcus aureus
KGSSSQKEQAEY

SEQ ID NO: 1705472 - protein, 24 aa, Staphylococcus aureus
KLTDTNRYVKNPKNAQIEVILEKS

SEQ ID NO: 1705473 - protein, 12 aa, Staphylococcus aureus
KSKFDSKRLSNA

SEQ ID NO: 1705474 - protein, 6 aa, Staphylococcus aureus
LDETQR

SEQ ID NO: 1705475 - protein, 10 aa, Staphylococcus aureus
LEAKEENQIL

SEQ ID NO: 1705476 - protein, 4 aa, Staphylococcus aureus
NGNA

SEQ ID NO: 1705477 - protein, 12 aa, Staphylococcus aureus
NLKAPKIEEDYT

SEQ ID NO: 1705478 - protein, 14 aa, Staphylococcus aureus
NPESTNTASDIESK

SEQ ID NO: 1705479 - protein, 14 aa, Staphylococcus aureus
NPKPEQLNKASEFT

SEQ ID NO: 1705480 - protein, 4 aa, Staphylococcus aureus
QGNY

SEQ ID NO: 1705481 - protein, 10 aa, Staphylococcus aureus
QLENKNTNDR

SEQ ID NO: 1705482 - protein, 4 aa, Staphylococcus aureus
QNIR

SEQ ID NO: 1705483 - protein, 15 aa, Staphylococcus aureus
QRTSKEPSKNAQNQQ

SEQ ID NO: 1705484 - protein, 12 aa, Staphylococcus aureus
QSNLWKSKDNGF

SEQ ID NO: 1705485 - protein, 23 aa, Staphylococcus aureus
SDLKNNQKSPVEPTKDNDKKNGL

SEQ ID NO: 1705486 - protein, 9 aa, Staphylococcus aureus
SKNYKVGDR

SEQ ID NO: 1705487 - protein, 9 aa, Staphylococcus aureus
SSHFTDRDK

SEQ ID NO: 1705488 - protein, 5 aa, Staphylococcus aureus
TTQGY

SEQ ID NO: 1705489 - protein, 14 aa, Staphylococcus aureus
VGSDKDKYNEEVNP

SEQ ID NO: 1705490 - protein, 20 aa, Staphylococcus aureus
VNVKQKGSLADDKELSSIDL

SEQ ID NO: 1705491 - protein, 6 aa, Staphylococcus aureus
VPYTGA

SEQ ID NO: 1705492 - protein, 16 aa, Staphylococcus aureus
AAHAQQHGTQVKTPVQ

SEQ ID NO: 1705493 - protein, 26 aa, Staphylococcus aureus
AGSPTVDQINTNTSAANQAKSDLDHA

SEQ ID NO: 1705494 - protein, 26 aa, Staphylococcus aureus
ANKRTATIKNGTAMPTNLAGGSTTTI

SEQ ID NO: 1705495 - protein, 13 aa, Staphylococcus aureus
ANRQQPNNQQAGV

SEQ ID NO: 1705496 - protein, 21 aa, Staphylococcus aureus
ATAKKQEINQNTNATTEEKQV

SEQ ID NO: 1705497 - protein, 7 aa, Staphylococcus aureus
ATLSGQY

SEQ ID NO: 1705498 - protein, 9 aa, Staphylococcus aureus
AYAGATTGQ

SEQ ID NO: 1705499 - protein, 20 aa, Staphylococcus aureus
CSGNSNKQSSDSKDKETTSI

SEQ ID NO: 1705500 - protein, 21 aa, Staphylococcus aureus
CSTTNNESNKETKSVPEEMEA

SEQ ID NO: 1705501 - protein, 15 aa, Staphylococcus aureus
DDKQTTASDNQGTNS

SEQ ID NO: 1705502 - protein, 27 aa, Staphylococcus aureus
DQHEHGEEHEHEGHDHEKEEHHHHGGY

SEQ ID NO: 1705503 - protein, 6 aa, Staphylococcus aureus
EITTEE

SEQ ID NO: 1705504 - protein, 9 aa, Staphylococcus aureus
ENIHPNNRQ

SEQ ID NO: 1705505 - protein, 4 aa, Staphylococcus aureus
GAHY

SEQ ID NO: 1705506 - protein, 8 aa, Staphylococcus aureus
GKAYPREV

SEQ ID NO: 1705507 - protein, 13 aa, Staphylococcus aureus
GMGKEAEIKKSFE

SEQ ID NO: 1705508 - protein, 18 aa, Staphylococcus aureus
GNAGHEAHASEADLNKAS

SEQ ID NO: 1705509 - protein, 17 aa, Staphylococcus aureus
GRAISRENETSHTASAT

SEQ ID NO: 1705510 - protein, 44 aa, Staphylococcus aureus
HKQAARDAINQATATKRQQINSNREATQEEKNAALNELTQATNH

SEQ ID NO: 1705511 - protein, 13 aa, Staphylococcus aureus
HNNTGKGKEYGYK

SEQ ID NO: 1705512 - protein, 5 aa, Staphylococcus aureus
HQDQS

SEQ ID NO: 1705513 - protein, 7 aa, Staphylococcus aureus
HRKEFEK

SEQ ID NO: 1705514 - protein, 31 aa, Staphylococcus aureus; identical to SEQ ID NO: 1570834

SEQ ID NO: 1705515 - protein, 20 aa, Staphylococcus aureus
KAQETASSIKNTLSNLLSFW

SEQ ID NO: 1705516 - protein, 9 aa, Staphylococcus aureus
KNKYDDNYS

SEQ ID NO: 1705517 - protein, 14 aa, Staphylococcus aureus
KNQNISYKDLEGKV

SEQ ID NO: 1705518 - protein, 5 aa, Staphylococcus aureus
KQAEY

SEQ ID NO: 1705519 - protein, 11 aa, Staphylococcus aureus
KSKYKYTGYTE

SEQ ID NO: 1705520 - protein, 49 aa, Staphylococcus aureus; identical to SEQ ID NO: 1639836

SEQ ID NO: 1705521 - protein, 8 aa, Staphylococcus aureus
KTHSIDPI

SEQ ID NO: 1705522 - protein, 16 aa, Staphylococcus aureus
LTGTSEDKEGKAFREN

SEQ ID NO: 1705523 - protein, 9 aa, Staphylococcus aureus
MNKPNTAQV

SEQ ID NO: 1705524 - protein, 6 aa, Staphylococcus aureus
QHNHPK

SEQ ID NO: 1705525 - protein, 5 aa, Staphylococcus aureus
RSRKI

SEQ ID NO: 1705526 - protein, 19 aa, Staphylococcus aureus
SKDSDGKSLKASGLTLDTK

SEQ ID NO: 1705527 - protein, 27 aa, Staphylococcus aureus
STGANFNTNEASAAAKPLDKSSSTLHH

SEQ ID NO: 1705528 - protein, 9 aa, Staphylococcus aureus
STNKPKNNI

SEQ ID NO: 1705529 - protein, 29 aa, Staphylococcus aureus
TGATVASNEVSAAEKDKLPATQKAKEMQN

SEQ ID NO: 1705530 - protein, 12 aa, Staphylococcus aureus
TSALPGRKSGSL

SEQ ID NO: 1705531 - protein, 7 aa, Staphylococcus aureus
YAQGDIG

SEQ ID NO: 1705532 - protein, 6 aa, Staphylococcus aureus
YNFPKK

SEQ ID NO: 1705533 - protein, 16 aa, Staphylococcus aureus
AEATKVSPKEIQPAPK

SEQ ID NO: 1705534 - protein, 28 aa, Staphylococcus aureus
AKTNATKKVEKYDQTFKGVTAKGNEANQ

SEQ ID NO: 1705535 - protein, 15 aa, Staphylococcus aureus
ANTSAEAASGNSIDT

SEQ ID NO: 1705536 - protein, 35 aa, Staphylococcus aureus
AVATLPNKGTKELTAKAKGDQTNKVAKQGQYKNQD

SEQ ID NO: 1705537 - protein, 8 aa, Staphylococcus aureus
DADTGAVV

SEQ ID NO: 1705538 - protein, 14 aa, Staphylococcus aureus
DEASAKNIHPNNRQ

SEQ ID NO: 1705539 - protein, 8 aa, Staphylococcus aureus
DKDRPLTT

SEQ ID NO: 1705540 - protein, 11 aa, Staphylococcus aureus
DKNKAKNLQDD

SEQ ID NO: 1705541 - protein, 7 aa, Staphylococcus aureus
DSDNKNI

SEQ ID NO: 1705542 - protein, 10 aa, Staphylococcus aureus
DVKTDKKGFT

SEQ ID NO: 1705543 - protein, 44 aa, Staphylococcus aureus
ERKRTKKKQLEKEKANTLNQNTNDTESSNQEPSLQQAKEQKDNK

SEQ ID NO: 1705544 - protein, 12 aa, Staphylococcus aureus
GDGDLKGSSIGH

SEQ ID NO: 1705545 - protein, 26 aa, Staphylococcus aureus
GDTDAKKVKPTNKVTLSKDEAADKAF

SEQ ID NO: 1705546 - protein, 23 aa, Staphylococcus aureus
GGEIGSTWGNANNWAAAAQGAGF

SEQ ID NO: 1705547 - protein, 8 aa, Staphylococcus aureus
GLKPGDKL

SEQ ID NO: 1705548 - protein, 24 aa, Staphylococcus aureus
GNGSKSGSDDKKITVGASPAPHAE

SEQ ID NO: 1705549 - protein, 17 aa, Staphylococcus aureus
GTASPIHQEAQAATTPY

SEQ ID NO: 1705550 - protein, 14 aa, Staphylococcus aureus
GYAAGTGHQAHAAE

SEQ ID NO: 1705551 - protein, 13 aa, Staphylococcus aureus
IKPGAQKVTGTTL

SEQ ID NO: 1705552 - protein, 17 aa, Staphylococcus aureus
IKQPKSTMNDGDKVEIS

SEQ ID NO: 1705553 - protein, 6 aa, Staphylococcus aureus
ISGETY

SEQ ID NO: 1705554 - protein, 10 aa, Staphylococcus aureus
ITADGNNYTI

SEQ ID NO: 1705555 - protein, 29 aa, Staphylococcus aureus
ITVKKESHTGKWSDINKSQKQDSKTNQYY

SEQ ID NO: 1705556 - protein, 8 aa, Staphylococcus aureus
KAAEKGAH

SEQ ID NO: 1705557 - protein, 7 aa, Staphylococcus aureus
KDGAVTF

SEQ ID NO: 1705558 - protein, 26 aa, Staphylococcus aureus
KNAPQTLEEVEANAAKLTDSKKKQYG

SEQ ID NO: 1705559 - protein, 23 aa, Staphylococcus aureus
KNKKVINKKTEKEDTVNENDNFK

SEQ ID NO: 1705560 - protein, 36 aa, Staphylococcus aureus
KSKKSDKEGLDDKEAKQKAEEIQKEVSKDPSKFGEI

SEQ ID NO: 1705561 - protein, 14 aa, Staphylococcus aureus
KSTGGGSGNSPARL

SEQ ID NO: 1705562 - protein, 9 aa, Staphylococcus aureus
LEAKEENQI

SEQ ID NO: 1705563 - protein, 11 aa, Staphylococcus aureus
LPNGQGTRNVE

SEQ ID NO: 1705564 - protein, 12 aa, Staphylococcus aureus
NAVSPNSSHGTY

SEQ ID NO: 1705565 - protein, 6 aa, Staphylococcus aureus
NGKSGW

SEQ ID NO: 1705566 - protein, 5 aa, Staphylococcus aureus
NPFDN

SEQ ID NO: 1705567 - protein, 9 aa, Staphylococcus aureus
NSKWPDKKI

SEQ ID NO: 1705568 - protein, 37 aa, Staphylococcus aureus; identical to SEQ ID NO: 1566244

SEQ ID NO: 1705569 - protein, 6 aa, Staphylococcus aureus
PDESGM

SEQ ID NO: 1705570 - protein, 56 aa, Staphylococcus aureus; identical to SEQ ID NO: 1641847

SEQ ID NO: 1705571 - protein, 4 aa, Staphylococcus aureus
QYKD

SEQ ID NO: 1705572 - protein, 12 aa, Staphylococcus aureus
RAKEKGKSTGLV

SEQ ID NO: 1705573 - protein, 5 aa, Staphylococcus aureus
RLDKE

SEQ ID NO: 1705574 - protein, 14 aa, Staphylococcus aureus
SKDLDTKSADMTRT

SEQ ID NO: 1705575 - protein, 35 aa, Staphylococcus aureus
SKKSDKEGLDDKEAKQKAEEIQKEVSKDPSKFGEI

SEQ ID NO: 1705576 - protein, 4 aa, Staphylococcus aureus
SNTL

SEQ ID NO: 1705577 - protein, 12 aa, Staphylococcus aureus
SNYYRPQNVSRD

SEQ ID NO: 1705578 - protein, 19 aa, Staphylococcus aureus
TEKDNGGVHTNSGIPNKAA

SEQ ID NO: 1705579 - protein, 6 aa, Staphylococcus aureus
TEQANK

SEQ ID NO: 1705580 - protein, 14 aa, Staphylococcus aureus
TFGRESYDNHGSPI

SEQ ID NO: 1705581 - protein, 8 aa, Staphylococcus aureus
TGDDPRKV

SEQ ID NO: 1705582 - protein, 12 aa, Staphylococcus aureus
TLSDNNKYDDYK

SEQ ID NO: 1705583 - protein, 17 aa, Staphylococcus aureus
TPAALASDTNHKPATSD

SEQ ID NO: 1705584 - protein, 6 aa, Staphylococcus aureus
TSDVQK

SEQ ID NO: 1705585 - protein, 5 aa, Staphylococcus aureus
TTNQD

SEQ ID NO: 1705586 - protein, 14 aa, Staphylococcus aureus
VDADATTEEKEAFT

SEQ ID NO: 1705587 - protein, 16 aa, Staphylococcus aureus
VDTKKQPKDKAKANVQ

SEQ ID NO: 1705588 - protein, 8 aa, Staphylococcus aureus
VEKERQLD

SEQ ID NO: 1705589 - protein, 8 aa, Staphylococcus aureus
VEQTHQSH

SEQ ID NO: 1705590 - protein, 12 aa, Staphylococcus aureus
VGKAEPAKGGNL

SEQ ID NO: 1705591 - protein, 14 aa, Staphylococcus aureus
VGQGFQPPAEKDAI

SEQ ID NO: 1705592 - protein, 16 aa, Staphylococcus aureus
VPAAPKKAVAQPKTAV

SEQ ID NO: 1705593 - protein, 6 aa, Staphylococcus aureus
VQGNPS

SEQ ID NO: 1705594 - protein, 10 aa, Staphylococcus aureus
VTKPQTTQTV

SEQ ID NO: 1705595 - protein, 27 aa, Staphylococcus aureus
VTTHANGQVSYGARPTQNKPSETNAYN

SEQ ID NO: 1705596 - protein, 17 aa, Staphylococcus aureus
YGDGDGRTFTNLSGAND

SEQ ID NO: 1705597 - protein, 11 aa, Staphylococcus aureus
YGGQDNRNNAA

SEQ ID NO: 1705598 - protein, 13 aa, Staphylococcus aureus
YGTESKEAYNTYT

SEQ ID NO: 1705599 - protein, 7 aa, Staphylococcus aureus
YNEKTGV

SEQ ID NO: 1705600 - protein, 11 aa, Staphylococcus aureus
YPGAGKKAADW

SEQ ID NO: 1705601 - protein, 4 aa, Staphylococcus aureus
YPIE

SEQ ID NO: 1705602 - protein, 8 aa, Staphylococcus aureus
YYSGTGYN

SEQ ID NO: 1705603 - protein, 6 aa, Staphylococcus aureus
AESKAV

SEQ ID NO: 1705604 - protein, 9 aa, Staphylococcus aureus
ANNEKRALQ

SEQ ID NO: 1705605 - protein, 9 aa, Staphylococcus aureus
APIKDPKKA

SEQ ID NO: 1705606 - protein, 12 aa, Staphylococcus aureus
ATPDATEDEIQD

SEQ ID NO: 1705607 - protein, 11 aa, Staphylococcus aureus
AYANEENPKIE

SEQ ID NO: 1705608 - protein, 26 aa, Staphylococcus aureus
AYGKEPDKKVADLTSNFKNKTSRNTN

SEQ ID NO: 1705609 - protein, 12 aa, Staphylococcus aureus
DENGKFSFDAEK

SEQ ID NO: 1705610 - protein, 15 aa, Staphylococcus aureus
DKKGYSRSKEKEYPV

SEQ ID NO: 1705611 - protein, 6 aa, Staphylococcus aureus
DLENNV

SEQ ID NO: 1705612 - protein, 10 aa, Staphylococcus aureus
DNEEKYQYTG

SEQ ID NO: 1705613 - protein, 9 aa, Staphylococcus aureus
DQPTTNKGV

SEQ ID NO: 1705614 - protein, 7 aa, Staphylococcus aureus
EADGNKL

SEQ ID NO: 1705615 - protein, 10 aa, Staphylococcus aureus
EEAEQIQKEK

SEQ ID NO: 1705616 - protein, 14 aa, Staphylococcus aureus
ENYKEDEVSYNPEV

SEQ ID NO: 1705617 - protein, 10 aa, Staphylococcus aureus
FNDQTGQATL

SEQ ID NO: 1705618 - protein, 10 aa, Staphylococcus aureus
FSSSEISKEY

SEQ ID NO: 1705619 - protein, 13 aa, Staphylococcus aureus
GDEYRKYQQRRHT

SEQ ID NO: 1705620 - protein, 13 aa, Staphylococcus aureus
GKDDKSKESRRQI

SEQ ID NO: 1705621 - protein, 33 aa, Staphylococcus aureus; identical to SEQ ID NO: 1637398

SEQ ID NO: 1705622 - protein, 26 aa, Staphylococcus aureus
GNNSSKDKEANKDSKTINVGTEGTYA

SEQ ID NO: 1705623 - protein, 27 aa, Staphylococcus aureus
GPDFPTMEQNRPSLSDNYTQPTTPNPI

SEQ ID NO: 1705624 - protein, 5 aa, Staphylococcus aureus
GVANH

SEQ ID NO: 1705625 - protein, 14 aa, Staphylococcus aureus
GVTKTNKTSGFVST

SEQ ID NO: 1705626 - protein, 6 aa, Staphylococcus aureus
IATSTV

SEQ ID NO: 1705627 - protein, 48 aa, Staphylococcus aureus
IGDQTTDDGVTRIKDQGIQTLSGDTATPVVKPNAKKAIRDKATKQREI

SEQ ID NO: 1705628 - protein, 8 aa, Staphylococcus aureus
IQPKPGTK

SEQ ID NO: 1705629 - protein, 6 aa, Staphylococcus aureus
KDEDTS

SEQ ID NO: 1705630 - protein, 6 aa, Staphylococcus aureus
KDGAVT

SEQ ID NO: 1705631 - protein, 4 aa, Staphylococcus aureus
KDGG

SEQ ID NO: 1705632 - protein, 10 aa, Staphylococcus aureus
KDNFTKDNTI

SEQ ID NO: 1705633 - protein, 18 aa, Staphylococcus aureus
KDSNYTSVKDLKGNDKLA

SEQ ID NO: 1705634 - protein, 6 aa, Staphylococcus aureus
KEELDN

SEQ ID NO: 1705635 - protein, 7 aa, Staphylococcus aureus
KKNIPHD

SEQ ID NO: 1705636 - protein, 7 aa, Staphylococcus aureus
KNKPGIH

SEQ ID NO: 1705637 - protein, 8 aa, Staphylococcus aureus
KSDSDAVK

SEQ ID NO: 1705638 - protein, 7 aa, Staphylococcus aureus
KSNRGIT

SEQ ID NO: 1705639 - protein, 12 aa, Staphylococcus aureus
KVSDRNKADALK

SEQ ID NO: 1705640 - protein, 12 aa, Staphylococcus aureus
KVSNRNKADALK

SEQ ID NO: 1705641 - protein, 22 aa, Staphylococcus aureus
KVTGNASTNSGSTTTTNRGYNT

SEQ ID NO: 1705642 - protein, 20 aa, Staphylococcus aureus
KYKDWTEHNQDQIKKGKTAQ

SEQ ID NO: 1705643 - protein, 9 aa, Staphylococcus aureus
LKNDDYNVK

SEQ ID NO: 1705644 - protein, 21 aa, Staphylococcus aureus
LPESNNDGELANSKSISASPI

SEQ ID NO: 1705645 - protein, 45 aa, Staphylococcus aureus; identical to SEQ ID NO: 1571381

SEQ ID NO: 1705646 - protein, 8 aa, Staphylococcus aureus
LTEEKTSC

SEQ ID NO: 1705647 - protein, 14 aa, Staphylococcus aureus
NAANNEANKFGNGH

SEQ ID NO: 1705648 - protein, 20 aa, Staphylococcus aureus
NAKAPSRDVKGQNLTNGTDA

SEQ ID NO: 1705649 - protein, 4 aa, Staphylococcus aureus
NGGK

SEQ ID NO: 1705650 - protein, 6 aa, Staphylococcus aureus
NGTKRV

SEQ ID NO: 1705651 - protein, 17 aa, Staphylococcus aureus
NHADKTAQVNQDSIDAQ

SEQ ID NO: 1705652 - protein, 17 aa, Staphylococcus aureus
NKTVESKSINVEVHLTK

SEQ ID NO: 1705653 - protein, 10 aa, Staphylococcus aureus
NMKDLKEKAM

SEQ ID NO: 1705654 - protein, 8 aa, Staphylococcus aureus
NNEPTKEI

SEQ ID NO: 1705655 - protein, 9 aa, Staphylococcus aureus
NNNEPTKEI

SEQ ID NO: 1705656 - protein, 14 aa, Staphylococcus aureus
NSKDIQNIAVTINQ

SEQ ID NO: 1705657 - protein, 37 aa, Staphylococcus aureus
NSPKSYRESKYEGESAQHSQLHENENVANELIDFLWK

SEQ ID NO: 1705658 - protein, 7 aa, Staphylococcus aureus
NTRTAKG

SEQ ID NO: 1705659 - protein, 39 aa, Staphylococcus aureus; identical to SEQ ID NO: 1629825

SEQ ID NO: 1705660 - protein, 13 aa, Staphylococcus aureus
PGSHDSGSFTLTD

SEQ ID NO: 1705661 - protein, 9 aa, Staphylococcus aureus
PKGKSLTSR

SEQ ID NO: 1705662 - protein, 14 aa, Staphylococcus aureus
PKVTKDSSSSSKYT

SEQ ID NO: 1705663 - protein, 8 aa, Staphylococcus aureus
PPVEGRGV

SEQ ID NO: 1705664 - protein, 5 aa, Staphylococcus aureus
QEKQN

SEQ ID NO: 1705665 - protein, 6 aa, Staphylococcus aureus
QGSIHS

SEQ ID NO: 1705666 - protein, 6 aa, Staphylococcus aureus
RDKHDI

SEQ ID NO: 1705667 - protein, 62 aa, Staphylococcus aureus
RKEQNDTTDKDKSSNNTDDSNNSNNNNSVNNQQQPATDQNLNQNQGGTQQTPQASNNQNGVV

SEQ ID NO: 1705668 - protein, 16 aa, Staphylococcus aureus
SENSKKLKAYYTQPSI

SEQ ID NO: 1705669 - protein, 23 aa, Staphylococcus aureus
SNSNDNNESKKDDADNGKKQEIQ

SEQ ID NO: 1705670 - protein, 10 aa, Staphylococcus aureus
SRSANLPSVR

SEQ ID NO: 1705671 - protein, 11 aa, Staphylococcus aureus
SSNFSKDKKLD

SEQ ID NO: 1705672 - protein, 9 aa, Staphylococcus aureus
SVEQTHQSH

SEQ ID NO: 1705673 - protein, 14 aa, Staphylococcus aureus
TPEEAQRAQENSDQ

SEQ ID NO: 1705674 - protein, 14 aa, Staphylococcus aureus
TSLKNNGNFGASFN

SEQ ID NO: 1705675 - protein, 26 aa, Staphylococcus aureus
TTMAPSSNGRSISSGYTSGRNLYTSG

SEQ ID NO: 1705676 - protein, 5 aa, Staphylococcus aureus
VLTKG

SEQ ID NO: 1705677 - protein, 4 aa, Staphylococcus aureus
VREA

SEQ ID NO: 1705678 - protein, 7 aa, Staphylococcus aureus
WGPYGRD

SEQ ID NO: 1705679 - protein, 11 aa, Staphylococcus aureus
YKSLKELPKGA

SEQ ID NO: 1705680 - protein, 31 aa, Staphylococcus aureus
YNNYTNNSQTATNNYYTGGSGASYSTTSNNV

SEQ ID NO: 1705681 - protein, 59 aa, Staphylococcus aureus
YQSNVGPDASYYSHSNNNQAYNSHNGNGKVNYPNGTSNQNGGSASKATASGHAKDASWL

SEQ ID NO: 1705682 - protein, 24 aa, Staphylococcus aureus
YTPGKEGDALRSMSNPEQFGQPSH

SEQ ID NO: 1705683 - protein, 54 aa, Staphylococcus aureus
AAANADVDNAVTQANSNIEAANSQNDVDQAKTTGETSIDQVTPTVNKKATARNE

SEQ ID NO: 1705684 - protein, 9 aa, Staphylococcus aureus
ADGQTVKKG

SEQ ID NO: 1705685 - protein, 8 aa, Staphylococcus aureus
AESQTVNA

SEQ ID NO: 1705686 - protein, 19 aa, Staphylococcus aureus
AGESHAQTKAEKYNEYQTN

SEQ ID NO: 1705687 - protein, 6 aa, Staphylococcus aureus
AGSLNP

SEQ ID NO: 1705688 - protein, 10 aa, Staphylococcus aureus
AKAALKSNNF

SEQ ID NO: 1705689 - protein, 8 aa, Staphylococcus aureus
ATGLPTDG

SEQ ID NO: 1705690 - protein, 11 aa, Staphylococcus aureus
AYANEEDPKIE

SEQ ID NO: 1705691 - protein, 6 aa, Staphylococcus aureus
DGEVSD

SEQ ID NO: 1705692 - protein, 8 aa, Staphylococcus aureus
DNKTVETD

SEQ ID NO: 1705693 - protein, 8 aa, Staphylococcus aureus
DNKTVETE

SEQ ID NO: 1705694 - protein, 27 aa, Staphylococcus aureus
DQHEHGEEHEHEGHDHGKEEHHHHGGY

SEQ ID NO: 1705695 - protein, 24 aa, Staphylococcus aureus
EDDKSFRDGMRNSKKQLKDKSRPY

SEQ ID NO: 1705696 - protein, 18 aa, Staphylococcus aureus
EDIDQLRKEKDKDDNSIY

SEQ ID NO: 1705697 - protein, 5 aa, Staphylococcus aureus
EQQID

SEQ ID NO: 1705698 - protein, 6 aa, Staphylococcus aureus
ESINTG

SEQ ID NO: 1705699 - protein, 10 aa, Staphylococcus aureus
EYKDYYDKKV

SEQ ID NO: 1705700 - protein, 8 aa, Staphylococcus aureus
FDATKNPI

SEQ ID NO: 1705701 - protein, 8 aa, Staphylococcus aureus
FKNGTKKV

SEQ ID NO: 1705702 - protein, 4 aa, Staphylococcus aureus
FKNR

SEQ ID NO: 1705703 - protein, 15 aa, Staphylococcus aureus
FKNSPKVNVSNLTDN

SEQ ID NO: 1705704 - protein, 4 aa, Staphylococcus aureus
GGTG

SEQ ID NO: 1705705 - protein, 17 aa, Staphylococcus aureus
GGVTPHENNKLSEPKNI

SEQ ID NO: 1705706 - protein, 9 aa, Staphylococcus aureus
GKLSKDAVN

SEQ ID NO: 1705707 - protein, 11 aa, Staphylococcus aureus
GMKQARKGVGY

SEQ ID NO: 1705708 - protein, 5 aa, Staphylococcus aureus
GSGTG

SEQ ID NO: 1705709 - protein, 8 aa, Staphylococcus aureus
GSKIDGSK

SEQ ID NO: 1705710 - protein, 5 aa, Staphylococcus aureus
GSSFS

SEQ ID NO: 1705711 - protein, 17 aa, Staphylococcus aureus
GSTTTTIKQIDELEKVV

SEQ ID NO: 1705712 - protein, 13 aa, Staphylococcus aureus
GTNIDRIEVNLKS

SEQ ID NO: 1705713 - protein, 4 aa, Staphylococcus aureus
GTSF

SEQ ID NO: 1705714 - protein, 5 aa, Staphylococcus aureus
GVQQE

SEQ ID NO: 1705715 - protein, 4 aa, Staphylococcus aureus
HGKN

SEQ ID NO: 1705716 - protein, 14 aa, Staphylococcus aureus
HQTISTDKVSTNKK

SEQ ID NO: 1705717 - protein, 15 aa, Staphylococcus aureus
HTRQLTNDSDDRVKS

SEQ ID NO: 1705718 - protein, 5 aa, Staphylococcus aureus
HYGST

SEQ ID NO: 1705719 - protein, 10 aa, Staphylococcus aureus
IAGDKQYKNP

SEQ ID NO: 1705720 - protein, 15 aa, Staphylococcus aureus
IANNDVKRVESNGIA

SEQ ID NO: 1705721 - protein, 18 aa, Staphylococcus aureus
IENYENGDISYNSEAPIY

SEQ ID NO: 1705722 - protein, 11 aa, Staphylococcus aureus
IETNGKNMESR

SEQ ID NO: 1705723 - protein, 7 aa, Staphylococcus aureus
IGSGYGS

SEQ ID NO: 1705724 - protein, 11 aa, Staphylococcus aureus
IKDVKKVKDGA

SEQ ID NO: 1705725 - protein, 9 aa, Staphylococcus aureus
ITDSSKKKA

SEQ ID NO: 1705726 - protein, 11 aa, Staphylococcus aureus
ITSTGKTGAGI

SEQ ID NO: 1705727 - protein, 9 aa, Staphylococcus aureus
ITYSTSSNN

SEQ ID NO: 1705728 - protein, 9 aa, Staphylococcus aureus
KAQETATTF

SEQ ID NO: 1705729 - protein, 23 aa, Staphylococcus aureus
KAVKEKQQQIDNSLDSTDNEKEV

SEQ ID NO: 1705730 - protein, 13 aa, Staphylococcus aureus
KDLDNKSADMTRT

SEQ ID NO: 1705731 - protein, 18 aa, Staphylococcus aureus
KDNDGKSLKASGLTLDTK

SEQ ID NO: 1705732 - protein, 8 aa, Staphylococcus aureus
KDNSTVTA

SEQ ID NO: 1705733 - protein, 4 aa, Staphylococcus aureus
KEAQ

SEQ ID NO: 1705734 - protein, 16 aa, Staphylococcus aureus
KEGFRDEEFEKGDKGT

SEQ ID NO: 1705735 - protein, 13 aa, Staphylococcus aureus
KGNDTNDHGDFNG

SEQ ID NO: 1705736 - protein, 5 aa, Staphylococcus aureus
KGSVG

SEQ ID NO: 1705737 - protein, 7 aa, Staphylococcus aureus
KKGENTF

SEQ ID NO: 1705738 - protein, 7 aa, Staphylococcus aureus
KLDETQR

SEQ ID NO: 1705739 - protein, 11 aa, Staphylococcus aureus
KPQVQRVPGKW

SEQ ID NO: 1705740 - protein, 24 aa, Staphylococcus aureus
KRSPKYNPGMNDQAEMDNESEDIQ

SEQ ID NO: 1705741 - protein, 6 aa, Staphylococcus aureus
KSAEFK

SEQ ID NO: 1705742 - protein, 6 aa, Staphylococcus aureus
KSSVDP

SEQ ID NO: 1705743 - protein, 13 aa, Staphylococcus aureus
KTNGRNAQIKDTF

SEQ ID NO: 1705744 - protein, 8 aa, Staphylococcus aureus
KTQNSGFR

SEQ ID NO: 1705745 - protein, 9 aa, Staphylococcus aureus
KVHADKSGK

SEQ ID NO: 1705746 - protein, 10 aa, Staphylococcus aureus
KYVGGKSGAM

SEQ ID NO: 1705747 - protein, 7 aa, Staphylococcus aureus
LATGSLN

SEQ ID NO: 1705748 - protein, 13 aa, Staphylococcus aureus
LDKEKEGEKRLAE

SEQ ID NO: 1705749 - protein, 11 aa, Staphylococcus aureus
LDKTQTNTEVA

SEQ ID NO: 1705750 - protein, 6 aa, Staphylococcus aureus
LNNREI

SEQ ID NO: 1705751 - protein, 5 aa, Staphylococcus aureus
LQPHR

SEQ ID NO: 1705752 - protein, 8 aa, Staphylococcus aureus
MKTESGRT

SEQ ID NO: 1705753 - protein, 17 aa, Staphylococcus aureus
NADDDPPKKLKYKENSA

SEQ ID NO: 1705754 - protein, 18 aa, Staphylococcus aureus
NAEVDKKDLKKKSDLDSS

SEQ ID NO: 1705755 - protein, 10 aa, Staphylococcus aureus
NAQPDPKLDE

SEQ ID NO: 1705756 - protein, 7 aa, Staphylococcus aureus
NAYQATF

SEQ ID NO: 1705757 - protein, 20 aa, Staphylococcus aureus
NDTNKGRNYGNKSKFSSGFN

SEQ ID NO: 1705758 - protein, 13 aa, Staphylococcus aureus
NDTNKGRNYGTKS

SEQ ID NO: 1705759 - protein, 17 aa, Staphylococcus aureus
NGKNPKQALDEATNDIT

SEQ ID NO: 1705760 - protein, 5 aa, Staphylococcus aureus
NNGDD

SEQ ID NO: 1705761 - protein, 13 aa, Staphylococcus aureus
NNIRPSTNRSVPT

SEQ ID NO: 1705762 - protein, 8 aa, Staphylococcus aureus
NSNKRQQL

SEQ ID NO: 1705763 - protein, 5 aa, Staphylococcus aureus
NTNHI

SEQ ID NO: 1705764 - protein, 8 aa, Staphylococcus aureus
NTRTTKGN

SEQ ID NO: 1705765 - protein, 7 aa, Staphylococcus aureus
NTRTTTG

SEQ ID NO: 1705766 - protein, 46 aa, Staphylococcus aureus; identical to SEQ ID NO: 1633199

SEQ ID NO: 1705767 - protein, 22 aa, Staphylococcus aureus
QQTAKAENTVKQITNTNVAPYS

SEQ ID NO: 1705768 - protein, 6 aa, Staphylococcus aureus
QYKYPT

SEQ ID NO: 1705769 - protein, 13 aa, Staphylococcus aureus
RGNDTNDHGDFNG

SEQ ID NO: 1705770 - protein, 4 aa, Staphylococcus aureus
RYTN

SEQ ID NO: 1705771 - protein, 21 aa, Staphylococcus aureus
SKVQNTIKTDIKQEDSNTHVY

SEQ ID NO: 1705772 - protein, 13 aa, Staphylococcus aureus
SNSEDSGNITITE

SEQ ID NO: 1705773 - protein, 11 aa, Staphylococcus aureus
SQQEVADTKAK

SEQ ID NO: 1705774 - protein, 20 aa, Staphylococcus aureus
SRASKELKNVTGYRYSKGGK

SEQ ID NO: 1705775 - protein, 4 aa, Staphylococcus aureus
SSNA

SEQ ID NO: 1705776 - protein, 18 aa, Staphylococcus aureus
TEHDGNQIDKNNSTDNSH

SEQ ID NO: 1705777 - protein, 29 aa, Staphylococcus aureus
TGATVTSNEVSAAEKDKLPATQKAKEMQN

SEQ ID NO: 1705778 - protein, 5 aa, Staphylococcus aureus
TKGGI

SEQ ID NO: 1705779 - protein, 13 aa, Staphylococcus aureus
TPFNDKTQNNTTL

SEQ ID NO: 1705780 - protein, 5 aa, Staphylococcus aureus
TVQPN

SEQ ID NO: 1705781 - protein, 15 aa, Staphylococcus aureus
VDDYPKDVKEGKKQF

SEQ ID NO: 1705782 - protein, 10 aa, Staphylococcus aureus
VEGETDPIYK

SEQ ID NO: 1705783 - protein, 9 aa, Staphylococcus aureus
VPSNSPTHV

SEQ ID NO: 1705784 - protein, 12 aa, Staphylococcus aureus
VSDYKSNKGTMG

SEQ ID NO: 1705785 - protein, 4 aa, Staphylococcus aureus
VSTT

SEQ ID NO: 1705786 - protein, 7 aa, Staphylococcus aureus
VTDKNLP

SEQ ID NO: 1705787 - protein, 8 aa, Staphylococcus aureus
VTDKNLPI

SEQ ID NO: 1705788 - protein, 43 aa, Staphylococcus aureus; identical to SEQ ID NO: 1645170

SEQ ID NO: 1705789 - protein, 17 aa, Staphylococcus aureus
VVQPGSSGSPILNSKRE

SEQ ID NO: 1705790 - protein, 19 aa, Staphylococcus aureus
VVSETTDSKGHATYSDDND

SEQ ID NO: 1705791 - protein, 10 aa, Staphylococcus aureus
YDIPTKKAPK

SEQ ID NO: 1705792 - protein, 24 aa, Staphylococcus aureus
YDQTANKVTFTSQGVTTARGTHTK

SEQ ID NO: 1705793 - protein, 19 aa, Staphylococcus aureus
YDQTTNENHANKDKINIKN

SEQ ID NO: 1705794 - protein, 27 aa, Staphylococcus aureus
YKDTQSYEDLAKATAKVSTLSQSHQNY

SEQ ID NO: 1705795 - protein, 7 aa, Staphylococcus aureus
YKTPKYS

SEQ ID NO: 1705796 - protein, 20 aa, Staphylococcus aureus
YNEVKTELENTELANNYKDK

SEQ ID NO: 1705797 - protein, 19 aa, Staphylococcus aureus
YNLKGKKGYIATPYPTYNT

SEQ ID NO: 1705798 - protein, 6 aa, Staphylococcus aureus
YPGISA

SEQ ID NO: 1705799 - protein, 10 aa, Staphylococcus aureus
YQDGTTSTVT

SEQ ID NO: 1705800 - protein, 20 aa, Staphylococcus aureus
YSQESYESTNISVKSEDYYG

SEQ ID NO: 1705801 - protein, 12 aa, Staphylococcus aureus
ADAAETTNTQQA

SEQ ID NO: 1705802 - protein, 5 aa, Staphylococcus aureus
ADEPL

SEQ ID NO: 1705803 - protein, 9 aa, Staphylococcus aureus
AENRNGTVY

SEQ ID NO: 1705804 - protein, 5 aa, Staphylococcus aureus
AKAEG

SEQ ID NO: 1705805 - protein, 37 aa, Staphylococcus aureus
AKINSEIKAVSEKNLDGDTKMYTRTATTSDSQKNITQ

SEQ ID NO: 1705806 - protein, 6 aa, Staphylococcus aureus
AKQTYD

SEQ ID NO: 1705807 - protein, 10 aa, Staphylococcus aureus
AKTQDKDYLT

SEQ ID NO: 1705808 - protein, 6 aa, Staphylococcus aureus
ALSNDN

SEQ ID NO: 1705809 - protein, 5 aa, Staphylococcus aureus
ANNEK

SEQ ID NO: 1705810 - protein, 22 aa, Staphylococcus aureus
APYTPTTDPNANNIGQNAPNEV

SEQ ID NO: 1705811 - protein, 71 aa, Staphylococcus aureus
ATGANGANMSAQAPATNNVEPSAVQANQVQSQEVEAPQNAQTQQPQASTSNNSQVTATPTESKASEGSSVN

SEQ ID NO: 1705812 - protein, 20 aa, Staphylococcus aureus
ATQVKTDARNAVNDKAREAI

SEQ ID NO: 1705813 - protein, 62 aa, Staphylococcus aureus
ATTQANSAHKDSQDQNKKEHVDKSQQKDKRNVTNKDKNSTVPDDIGKNGKITKRTETVYDEK

SEQ ID NO: 1705814 - protein, 18 aa, Staphylococcus aureus
AVSETVDKIKSNGDKAKA

SEQ ID NO: 1705815 - protein, 20 aa, Staphylococcus aureus
AVSETVDKIKSNGDNAKAYN

SEQ ID NO: 1705816 - protein, 6 aa, Staphylococcus aureus
AYEGGA

SEQ ID NO: 1705817 - protein, 20 aa, Staphylococcus aureus
CSTTNNESNNETKSVPEEME

SEQ ID NO: 1705818 - protein, 12 aa, Staphylococcus aureus
DAENAVNRKVDD

SEQ ID NO: 1705819 - protein, 10 aa, Staphylococcus aureus
DIPPTINNPV

SEQ ID NO: 1705820 - protein, 13 aa, Staphylococcus aureus
DKAKEILKEYHFT

SEQ ID NO: 1705821 - protein, 9 aa, Staphylococcus aureus
DKNDKGKSR

SEQ ID NO: 1705822 - protein, 8 aa, Staphylococcus aureus
DNDSDNQP

SEQ ID NO: 1705823 - protein, 12 aa, Staphylococcus aureus
DNIDESNNNQLD

SEQ ID NO: 1705824 - protein, 7 aa, Staphylococcus aureus
DPNVNGK

SEQ ID NO: 1705825 - protein, 12 aa, Staphylococcus aureus
DSATDKERNGFY

SEQ ID NO: 1705826 - protein, 9 aa, Staphylococcus aureus
DSDPFESQN

SEQ ID NO: 1705827 - protein, 7 aa, Staphylococcus aureus
DSMPYPH

SEQ ID NO: 1705828 - protein, 16 aa, Staphylococcus aureus
DSRKSLDERETEKKYP

SEQ ID NO: 1705829 - protein, 14 aa, Staphylococcus aureus
DTIDSRNIEKIEVN

SEQ ID NO: 1705830 - protein, 7 aa, Staphylococcus aureus
DTPEHGK

SEQ ID NO: 1705831 - protein, 4 aa, Staphylococcus aureus
DYDH

SEQ ID NO: 1705832 - protein, 17 aa, Staphylococcus aureus
EAAETGKGKGVLGDTKD

SEQ ID NO: 1705833 - protein, 17 aa, Staphylococcus aureus
EAQNSNQKKVNKGTNNY

SEQ ID NO: 1705834 - protein, 9 aa, Staphylococcus aureus
EDLANASKD

SEQ ID NO: 1705835 - protein, 22 aa, Staphylococcus aureus
EGNGRQADNHSIGGVTKTNRGV

SEQ ID NO: 1705836 - protein, 37 aa, Staphylococcus aureus
EKVQPQQNNQANDKITNHNFNNEQEVKPQKDEKTLSV

SEQ ID NO: 1705837 - protein, 12 aa, Staphylococcus aureus
EKYSDQNKPYKE

SEQ ID NO: 1705838 - protein, 11 aa, Staphylococcus aureus
ENHVDQKEEKL

SEQ ID NO: 1705839 - protein, 38 aa, Staphylococcus aureus
EQASNRPKKRSRRAAPADPNATPADPAAAAAGNGGAPV

SEQ ID NO: 1705840 - protein, 7 aa, Staphylococcus aureus
EQNKDGQ

SEQ ID NO: 1705841 - protein, 8 aa, Staphylococcus aureus
ESGEKFYP

SEQ ID NO: 1705842 - protein, 6 aa, Staphylococcus aureus
FPKASK

SEQ ID NO: 1705843 - protein, 5 aa, Staphylococcus aureus
GALKS

SEQ ID NO: 1705844 - protein, 16 aa, Staphylococcus aureus
GDANISGVRYNGTDLT

SEQ ID NO: 1705845 - protein, 21 aa, Staphylococcus aureus
GDSRQATNYSIGGVTKTNSQP

SEQ ID NO: 1705846 - protein, 5 aa, Staphylococcus aureus
GEFRN

SEQ ID NO: 1705847 - protein, 8 aa, Staphylococcus aureus
GENLESRG

SEQ ID NO: 1705848 - protein, 11 aa, Staphylococcus aureus
GISPIPVDDET

SEQ ID NO: 1705849 - protein, 11 aa, Staphylococcus aureus
GKDDKKYGEGV

SEQ ID NO: 1705850 - protein, 14 aa, Staphylococcus aureus
GKDDKKYKDGPYDN

SEQ ID NO: 1705851 - protein, 40 aa, Staphylococcus aureus
GKFDSTKGIGRTSSNSYSKSISYNQQNYDTIASGKNNNRH

SEQ ID NO: 1705852 - protein, 12 aa, Staphylococcus aureus
GKSADSVEGGYG

SEQ ID NO: 1705853 - protein, 16 aa, Staphylococcus aureus
GNINSGYERPNPKDYD

SEQ ID NO: 1705854 - protein, 39 aa, Staphylococcus aureus
GQAEASETNQKVSTNQESKAVSQTEQNSKETKAAESSKN

SEQ ID NO: 1705855 - protein, 17 aa, Staphylococcus aureus
GQAVSGKSTAKQALNNP

SEQ ID NO: 1705856 - protein, 14 aa, Staphylococcus aureus
GSDKDKFKDGDNSN

SEQ ID NO: 1705857 - protein, 12 aa, Staphylococcus aureus
GTGDLKGSSIGH

SEQ ID NO: 1705858 - protein, 11 aa, Staphylococcus aureus
GVLENQGAAFN

SEQ ID NO: 1705859 - protein, 5 aa, Staphylococcus aureus
HDGFK

SEQ ID NO: 1705860 - protein, 12 aa, Staphylococcus aureus
IKGNAEQSKSAF

SEQ ID NO: 1705861 - protein, 12 aa, Staphylococcus aureus
IPTNKKNITAQE

SEQ ID NO: 1705862 - protein, 8 aa, Staphylococcus aureus
IRANTKED

SEQ ID NO: 1705863 - protein, 6 aa, Staphylococcus aureus
ISDEQQ

SEQ ID NO: 1705864 - protein, 17 aa, Staphylococcus aureus
ITSEGQAVHAKEKQERV

SEQ ID NO: 1705865 - protein, 8 aa, Staphylococcus aureus
KDEKKEVI

SEQ ID NO: 1705866 - protein, 8 aa, Staphylococcus aureus
KDKEHYHT

SEQ ID NO: 1705867 - protein, 9 aa, Staphylococcus aureus
KDKKLKNEI

SEQ ID NO: 1705868 - protein, 6 aa, Staphylococcus aureus
KDQRTV

SEQ ID NO: 1705869 - protein, 12 aa, Staphylococcus aureus
KFAEGAKAKDRI

SEQ ID NO: 1705870 - protein, 46 aa, Staphylococcus aureus; identical to SEQ ID NO: 1639095

SEQ ID NO: 1705871 - protein, 7 aa, Staphylococcus aureus
KGTSKYG

SEQ ID NO: 1705872 - protein, 10 aa, Staphylococcus aureus
KHKAKNLKDK

SEQ ID NO: 1705873 - protein, 33 aa, Staphylococcus aureus
KITTVSEKNLDGDTKMYTRTATTSDTEKKISQS

SEQ ID NO: 1705874 - protein, 33 aa, Staphylococcus aureus
KNANANGSGQTYVNQATAGDNNDYTASQSQQHI

SEQ ID NO: 1705875 - protein, 12 aa, Staphylococcus aureus
KNPQKITVEVLI

SEQ ID NO: 1705876 - protein, 18 aa, Staphylococcus aureus
KNYQDGSITTNENVPRYE

SEQ ID NO: 1705877 - protein, 7 aa, Staphylococcus aureus
KPESIDN

SEQ ID NO: 1705878 - protein, 16 aa, Staphylococcus aureus
KPSEAPRYTHPSQSQS

SEQ ID NO: 1705879 - protein, 22 aa, Staphylococcus aureus
KTSVKSDSSYGQNDTLSSYSDI

SEQ ID NO: 1705880 - protein, 8 aa, Staphylococcus aureus
KVDPKDGF

SEQ ID NO: 1705881 - protein, 28 aa, Staphylococcus aureus
KVSGTASSSNSTSNSSRPSTNSSGGSYY

SEQ ID NO: 1705882 - protein, 10 aa, Staphylococcus aureus
KYGNEIKNRN

SEQ ID NO: 1705883 - protein, 7 aa, Staphylococcus aureus
LATEGKP

SEQ ID NO: 1705884 - protein, 12 aa, Staphylococcus aureus
LESNEQQQRSYN

SEQ ID NO: 1705885 - protein, 8 aa, Staphylococcus aureus
LKKAESLL

SEQ ID NO: 1705886 - protein, 18 aa, Staphylococcus aureus
LKSDRGVSERDLKHAKKA

SEQ ID NO: 1705887 - protein, 8 aa, Staphylococcus aureus
LKTSKTPK

SEQ ID NO: 1705888 - protein, 4 aa, Staphylococcus aureus
LSQL

SEQ ID NO: 1705889 - protein, 10 aa, Staphylococcus aureus
LSTVENPELS

SEQ ID NO: 1705890 - protein, 7 aa, Staphylococcus aureus
LTEEKTS

SEQ ID NO: 1705891 - protein, 8 aa, Staphylococcus aureus
MKTESDRK

SEQ ID NO: 1705892 - protein, 7 aa, Staphylococcus aureus
MSNKDEI

SEQ ID NO: 1705893 - protein, 6 aa, Staphylococcus aureus
MSSGTV

SEQ ID NO: 1705894 - protein, 10 aa, Staphylococcus aureus
NGNKSQALQQ

SEQ ID NO: 1705895 - protein, 5 aa, Staphylococcus aureus
NGTKR

SEQ ID NO: 1705896 - protein, 8 aa, Staphylococcus aureus
NGTTTNIQ

SEQ ID NO: 1705897 - protein, 16 aa, Staphylococcus aureus
NIAQGTFNATKQVSVG

SEQ ID NO: 1705898 - protein, 7 aa, Staphylococcus aureus
NKPWTNY

SEQ ID NO: 1705899 - protein, 8 aa, Staphylococcus aureus
NNAPTKED

SEQ ID NO: 1705900 - protein, 25 aa, Staphylococcus aureus
NPIVNSENGSDNNFESGTIERNQNE

SEQ ID NO: 1705901 - protein, 26 aa, Staphylococcus aureus
NRGGLTGNITKEKNYSETISYQQPSY

SEQ ID NO: 1705902 - protein, 4 aa, Staphylococcus aureus
NRNY

SEQ ID NO: 1705903 - protein, 8 aa, Staphylococcus aureus
NTRTTKGE

SEQ ID NO: 1705904 - protein, 27 aa, Staphylococcus aureus
NTSSSGIQTEEKPQIENPSNELPLNPL

SEQ ID NO: 1705905 - protein, 26 aa, Staphylococcus aureus
NVDDNNNSTNVTDFAPKNQDESREVK

SEQ ID NO: 1705906 - protein, 15 aa, Staphylococcus aureus
PKNKISTAKVDSTFS

SEQ ID NO: 1705907 - protein, 4 aa, Staphylococcus aureus
PNGY

SEQ ID NO: 1705908 - protein, 4 aa, Staphylococcus aureus
PSLE

SEQ ID NO: 1705909 - protein, 14 aa, Staphylococcus aureus
PTEEIKDEKLKKEI

SEQ ID NO: 1705910 - protein, 14 aa, Staphylococcus aureus
PTKDIKDEKIKKEI

SEQ ID NO: 1705911 - protein, 14 aa, Staphylococcus aureus
PTKEIKDEKIKKEI

SEQ ID NO: 1705912 - protein, 10 aa, Staphylococcus aureus
PTKPIADDKL

SEQ ID NO: 1705913 - protein, 34 aa, Staphylococcus aureus; identical to SEQ ID NO: 1633126

SEQ ID NO: 1705914 - protein, 8 aa, Staphylococcus aureus
QKKGEALN

SEQ ID NO: 1705915 - protein, 17 aa, Staphylococcus aureus
QPTTVAASSKDKNVSKL

SEQ ID NO: 1705916 - protein, 8 aa, Staphylococcus aureus
QRNPKTEI

SEQ ID NO: 1705917 - protein, 13 aa, Staphylococcus aureus
QSNGYKIGKPSLN

SEQ ID NO: 1705918 - protein, 17 aa, Staphylococcus aureus
RAKGGISKEDTKASSDG

SEQ ID NO: 1705919 - protein, 13 aa, Staphylococcus aureus
RASKEPSNNAQHQ

SEQ ID NO: 1705920 - protein, 4 aa, Staphylococcus aureus
REIP

SEQ ID NO: 1705921 - protein, 14 aa, Staphylococcus aureus
RSDAKWSNGDKVTA

SEQ ID NO: 1705922 - protein, 11 aa, Staphylococcus aureus
RTANQKNLDEF

SEQ ID NO: 1705923 - protein, 8 aa, Staphylococcus aureus
RVSQADID

SEQ ID NO: 1705924 - protein, 12 aa, Staphylococcus aureus
RVSQADIDSLTN

SEQ ID NO: 1705925 - protein, 65 aa, Staphylococcus aureus
SAAKPAALETQYKAAAPKATPVAPKAKTEATPKVTTFSASAQPRSAAAAPKTSLPKYKPQVNSSI

SEQ ID NO: 1705926 - protein, 22 aa, Staphylococcus aureus
SAPSKKPTTPTTYTETTTQVPM

SEQ ID NO: 1705927 - protein, 10 aa, Staphylococcus aureus
SDKPTGESTR

SEQ ID NO: 1705928 - protein, 5 aa, Staphylococcus aureus
SDVQK

SEQ ID NO: 1705929 - protein, 7 aa, Staphylococcus aureus
SFKPSQI

SEQ ID NO: 1705930 - protein, 9 aa, Staphylococcus aureus
SGQSVHTPH

SEQ ID NO: 1705931 - protein, 10 aa, Staphylococcus aureus
SGTTPSIDEI

SEQ ID NO: 1705932 - protein, 6 aa, Staphylococcus aureus
SHIKTS

SEQ ID NO: 1705933 - protein, 8 aa, Staphylococcus aureus
SHRNETNA

SEQ ID NO: 1705934 - protein, 14 aa, Staphylococcus aureus
SIGGITKASDKVVD

SEQ ID NO: 1705935 - protein, 19 aa, Staphylococcus aureus
SITAKGQKLTIKTSSAYPE

SEQ ID NO: 1705936 - protein, 16 aa, Staphylococcus aureus
SKDDFNTKKDKVTVVK

SEQ ID NO: 1705937 - protein, 8 aa, Staphylococcus aureus
SNDTKKNI

SEQ ID NO: 1705938 - protein, 9 aa, Staphylococcus aureus
SNLGNKTGY

SEQ ID NO: 1705939 - protein, 13 aa, Staphylococcus aureus
SNNATVSQADQTA

SEQ ID NO: 1705940 - protein, 23 aa, Staphylococcus aureus
SNSNDNQDNKKDAADNGKKQEIQ

SEQ ID NO: 1705941 - protein, 26 aa, Staphylococcus aureus
SPNSAQAYTNDSKTLEEAKRAHPNAQ

SEQ ID NO: 1705942 - protein, 27 aa, Staphylococcus aureus
STGANFNTNEASAAAKQIDKSSSSLHH

SEQ ID NO: 1705943 - protein, 10 aa, Staphylococcus aureus
STQSQDVSYG

SEQ ID NO: 1705944 - protein, 5 aa, Staphylococcus aureus
SYAEI

SEQ ID NO: 1705945 - protein, 13 aa, Staphylococcus aureus
SYNPNAPNYSAEY

SEQ ID NO: 1705946 - protein, 9 aa, Staphylococcus aureus
TAKSPVNVN

SEQ ID NO: 1705947 - protein, 16 aa, Staphylococcus aureus
TGNEKLTVKDDDEVSN

SEQ ID NO: 1705948 - protein, 7 aa, Staphylococcus aureus
TGSNTVS

SEQ ID NO: 1705949 - protein, 7 aa, Staphylococcus aureus
TGVPAST

SEQ ID NO: 1705950 - protein, 5 aa, Staphylococcus aureus
TIDHP

SEQ ID NO: 1705951 - protein, 11 aa, Staphylococcus aureus
TIKENGKARTG

SEQ ID NO: 1705952 - protein, 20 aa, Staphylococcus aureus
TNITNDRTNQQVNDSTNQAL

SEQ ID NO: 1705953 - protein, 7 aa, Staphylococcus aureus
TSKEVDE

SEQ ID NO: 1705954 - protein, 13 aa, Staphylococcus aureus
TSLKNNGNFGASF

SEQ ID NO: 1705955 - protein, 9 aa, Staphylococcus aureus
TSPPVEGRG

SEQ ID NO: 1705956 - protein, 24 aa, Staphylococcus aureus
TTAQPVKASTLEVRSQATQDLSEY

SEQ ID NO: 1705957 - protein, 17 aa, Staphylococcus aureus
VDTKKQVKDKEAKANVQ

SEQ ID NO: 1705958 - protein, 9 aa, Staphylococcus aureus
VEEAKNAAR

SEQ ID NO: 1705959 - protein, 5 aa, Staphylococcus aureus
VGAGV

SEQ ID NO: 1705960 - protein, 8 aa, Staphylococcus aureus
VKKGDKVN

SEQ ID NO: 1705961 - protein, 12 aa, Staphylococcus aureus
VSDYKNNKGTMG

SEQ ID NO: 1705962 - protein, 15 aa, Staphylococcus aureus
VSKSTGQHTTSVTSE

SEQ ID NO: 1705963 - protein, 44 aa, Staphylococcus aureus
VSSPAANALSSKAMDNHPQQTQSSKQQTPKIKKGGNLKPLEQRE

SEQ ID NO: 1705964 - protein, 45 aa, Staphylococcus aureus; identical to SEQ ID NO: 1572721

SEQ ID NO: 1705965 - protein, 11 aa, Staphylococcus aureus
VYSKDDKGWAK

SEQ ID NO: 1705966 - protein, 28 aa, Staphylococcus aureus
YDISTKRAPELKLRGSGDLKGSSVGSKE

SEQ ID NO: 1705967 - protein, 43 aa, Staphylococcus aureus
YDKNNTPNNNHQNQSRTNDNHQHANQRDFNNNQYHSSLSGQYT

SEQ ID NO: 1705968 - protein, 9 aa, Staphylococcus aureus
YDSQNRDSM

SEQ ID NO: 1705969 - protein, 8 aa, Staphylococcus aureus
YKNNQVGT

SEQ ID NO: 1705970 - protein, 4 aa, Staphylococcus aureus
YSDI

SEQ ID NO: 1705971 - protein, 6 aa, Staphylococcus aureus
ADNMTL

SEQ ID NO: 1705972 - protein, 5 aa, Staphylococcus aureus
ADYAA

SEQ ID NO: 1705973 - protein, 11 aa, Staphylococcus aureus
AGNIKGSSVGY

SEQ ID NO: 1705974 - protein, 14 aa, Staphylococcus aureus
AHYSSKGKGGGNYD

SEQ ID NO: 1705975 - protein, 6 aa, Staphylococcus aureus
AKDPEV

SEQ ID NO: 1705976 - protein, 7 aa, Staphylococcus aureus
AKLNNGQ

SEQ ID NO: 1705977 - protein, 8 aa, Staphylococcus aureus
AKNNGINT

SEQ ID NO: 1705978 - protein, 9 aa, Staphylococcus aureus
AKTQGKDYL

SEQ ID NO: 1705979 - protein, 36 aa, Staphylococcus aureus
AKYFGKSNGNLDKKFKKDGYDLATNSKDLSKSDKDK

SEQ ID NO: 1705980 - protein, 23 aa, Staphylococcus aureus
ALVTESGVNDTKQFTEVTSEEKV

SEQ ID NO: 1705981 - protein, 11 aa, Staphylococcus aureus
ANSQPDPKIDE

SEQ ID NO: 1705982 - protein, 64 aa, Staphylococcus aureus
ANTEANSANKDSQDQTKKEHVDKAQQKEKRNVNDKDKNTPGPDDIGKNGKVTKRTVSEYDKETN

SEQ ID NO: 1705983 - protein, 6 aa, Staphylococcus aureus
APWGTQ

SEQ ID NO: 1705984 - protein, 72 aa, Staphylococcus aureus
ATGANGADMSAQAPATNNVAPSADQSNQVQSQEVEAPQNAQTQQPQASTSNNSQVTATPTESKASEGSSVNV

SEQ ID NO: 1705985 - protein, 20 aa, Staphylococcus aureus
ATMDKSPHQNDRITLKLNKN

SEQ ID NO: 1705986 - protein, 6 aa, Staphylococcus aureus
AVKNNR

SEQ ID NO: 1705987 - protein, 5 aa, Staphylococcus aureus
AVPES

SEQ ID NO: 1705988 - protein, 18 aa, Staphylococcus aureus
AVSTLDGNKADASSKKDY

SEQ ID NO: 1705989 - protein, 73 aa, Staphylococcus aureus
AVTDAKNNITAATDDNGVDTAKDAGKNSIQSTQPATAVKSNAKNEVDQAVTTQNQAIDNTTGATTEEKNAAKD

SEQ ID NO: 1705990 - protein, 14 aa, Staphylococcus aureus
AYGKEPDNKVKELT

SEQ ID NO: 1705991 - protein, 19 aa, Staphylococcus aureus
CGKSDETKEGSKEEQIKKS

SEQ ID NO: 1705992 - protein, 19 aa, Staphylococcus aureus
CGKSDKTKEDSKEEQIKKS

SEQ ID NO: 1705993 - protein, 21 aa, Staphylococcus aureus
DIAQNKTNAEVDQTEADGNNN

SEQ ID NO: 1705994 - protein, 9 aa, Staphylococcus aureus
DISTEKAPK

SEQ ID NO: 1705995 - protein, 12 aa, Staphylococcus aureus
DKDKYKKGLEGQ

SEQ ID NO: 1705996 - protein, 11 aa, Staphylococcus aureus
DKGKAAEEAGY

SEQ ID NO: 1705997 - protein, 24 aa, Staphylococcus aureus
DKNKKVINKKTEKEDTVNENDNFK

SEQ ID NO: 1705998 - protein, 6 aa, Staphylococcus aureus
DKQQTM

SEQ ID NO: 1705999 - protein, 15 aa, Staphylococcus aureus
DLAPKATNNKEYTIN

SEQ ID NO: 1706000 - protein, 34 aa, Staphylococcus aureus; identical to SEQ ID NO: 1568742

SEQ ID NO: 1706001 - protein, 9 aa, Staphylococcus aureus
DSIGYDDKT

SEQ ID NO: 1706002 - protein, 6 aa, Staphylococcus aureus
DSSFIT

SEQ ID NO: 1706003 - protein, 6 aa, Staphylococcus aureus
EALTDQ

SEQ ID NO: 1706004 - protein, 15 aa, Staphylococcus aureus
EAQNSNQKKTNKVTN

SEQ ID NO: 1706005 - protein, 32 aa, Staphylococcus aureus
EAQQAIKATAENQVESIKDTPHATVDELDEAN

SEQ ID NO: 1706006 - protein, 18 aa, Staphylococcus aureus
EESFESTNISVKSEDYYG

SEQ ID NO: 1706007 - protein, 16 aa, Staphylococcus aureus
EETQQIAKAEKHVTQV

SEQ ID NO: 1706008 - protein, 11 aa, Staphylococcus aureus
EGSGKQAENIS

SEQ ID NO: 1706009 - protein, 12 aa, Staphylococcus aureus
EITTSDVNAQET

SEQ ID NO: 1706010 - protein, 13 aa, Staphylococcus aureus
EKDHKNELKPKDI

SEQ ID NO: 1706011 - protein, 12 aa, Staphylococcus aureus
EKKVERTTPKLE

SEQ ID NO: 1706012 - protein, 13 aa, Staphylococcus aureus
ENLETNSSHMTKT

SEQ ID NO: 1706013 - protein, 17 aa, Staphylococcus aureus
ENRNKGKLKITGGGNDF

SEQ ID NO: 1706014 - protein, 44 aa, Staphylococcus aureus
ERKRTKKKQLEKEKANTLNQNTNDTESSNQEPSLQQTKEQKDNK

SEQ ID NO: 1706015 - protein, 14 aa, Staphylococcus aureus
ESPEEKKEREFEEK

SEQ ID NO: 1706016 - protein, 18 aa, Staphylococcus aureus
ETKKQAKDKEAKANNQVP

SEQ ID NO: 1706017 - protein, 20 aa, Staphylococcus aureus
ETTEDKKGYVHNKDKKYPVK

SEQ ID NO: 1706018 - protein, 9 aa, Staphylococcus aureus
FAPKSDEIL

SEQ ID NO: 1706019 - protein, 9 aa, Staphylococcus aureus
FDGDYKQNI

SEQ ID NO: 1706020 - protein, 14 aa, Staphylococcus aureus
FDTPEDSKETQIKK

SEQ ID NO: 1706021 - protein, 4 aa, Staphylococcus aureus
FKGK

SEQ ID NO: 1706022 - protein, 14 aa, Staphylococcus aureus
FNNNSLSDKYKNKN

SEQ ID NO: 1706023 - protein, 15 aa, Staphylococcus aureus
FSGQSGSAIRDSKNN

SEQ ID NO: 1706024 - protein, 13 aa, Staphylococcus aureus
FTDEEKKKYTAPI

SEQ ID NO: 1706025 - protein, 11 aa, Staphylococcus aureus
FTDRDKRAIRR

SEQ ID NO: 1706026 - protein, 22 aa, Staphylococcus aureus
GFPGDKSDNRQYKGKGKLESFD

SEQ ID NO: 1706027 - protein, 10 aa, Staphylococcus aureus
GGDSAGAQLA

SEQ ID NO: 1706028 - protein, 13 aa, Staphylococcus aureus
GGNGPANKSTKGY

SEQ ID NO: 1706029 - protein, 17 aa, Staphylococcus aureus
GGVTPHENNKLSEPKEI

SEQ ID NO: 1706030 - protein, 4 aa, Staphylococcus aureus
GIQQ

SEQ ID NO: 1706031 - protein, 12 aa, Staphylococcus aureus
GITKTNKNDYKD

SEQ ID NO: 1706032 - protein, 19 aa, Staphylococcus aureus
GKEVKTTQKYTVNRSNNGL

SEQ ID NO: 1706033 - protein, 93 aa, Staphylococcus aureus
GQDSDQQKDSNKEKDDKAKTEQQDKKTNDSSKDKKDNKDDSKDVNKDNKDNSANDNQQQSNSNATNNDQNQTNNNQSNSGQTTNNQKSSYVAP

SEQ ID NO: 1706034 - protein, 26 aa, Staphylococcus aureus
GSIVNTSSFSGQAEDLYRSGYNAAKG

SEQ ID NO: 1706035 - protein, 6 aa, Staphylococcus aureus
GTFEYG

SEQ ID NO: 1706036 - protein, 26 aa, Staphylococcus aureus
GTLTTEAHSGHAKQNQKSVNKHDKEA

SEQ ID NO: 1706037 - protein, 19 aa, Staphylococcus aureus
GVTKIGDGDIEKVAKEKPD

SEQ ID NO: 1706038 - protein, 13 aa, Staphylococcus aureus
GYGNEADAKVYSQ

SEQ ID NO: 1706039 - protein, 4 aa, Staphylococcus aureus
HATS

SEQ ID NO: 1706040 - protein, 143 aa, Staphylococcus aureus; identical to SEQ ID NO: 1570692

SEQ ID NO: 1706041 - protein, 12 aa, Staphylococcus aureus
HEKGKGDKSEFE

SEQ ID NO: 1706042 - protein, 10 aa, Staphylococcus aureus
HESQPTKQQQ

SEQ ID NO: 1706043 - protein, 26 aa, Staphylococcus aureus
HHQDSAKKESASHKKKENDNEELNEE

SEQ ID NO: 1706044 - protein, 10 aa, Staphylococcus aureus
HKSENPHSSL

SEQ ID NO: 1706045 - protein, 20 aa, Staphylococcus aureus
HLDKSEYEAEPPLFFFSGRL

SEQ ID NO: 1706046 - protein, 13 aa, Staphylococcus aureus
HNNNGKGKEYGYK

SEQ ID NO: 1706047 - protein, 18 aa, Staphylococcus aureus
IANAESNSNIKAKDKRHV

SEQ ID NO: 1706048 - protein, 98 aa, Staphylococcus aureus
IDNLQKENKELKDKKEKLQQEKEKLADKQKDLEKEVKDLKPSKEDNKDDKKDEDKNKDKDKEASQDKQSKDQTKSSDKDNHKKPTSTDKDQKANDKHQ

SEQ ID NO: 1706049 - protein, 57 aa, Staphylococcus aureus
IEGNSTKLEIKPQGTESTLKGTQGESSDIEVKPQATETTEASHYPARPQFNKTPKYV

SEQ ID NO: 1706050 - protein, 23 aa, Staphylococcus aureus
IEPATKVKTDAKNAIDQSAETQH

SEQ ID NO: 1706051 - protein, 11 aa, Staphylococcus aureus
IKGNAEQSRSA

SEQ ID NO: 1706052 - protein, 30 aa, Staphylococcus aureus; identical to SEQ ID NO: 1570816

SEQ ID NO: 1706053 - protein, 8 aa, Staphylococcus aureus
IKSNKNPK

SEQ ID NO: 1706054 - protein, 22 aa, Staphylococcus aureus
IKSTDSSKNPVTSVENRKANGY

SEQ ID NO: 1706055 - protein, 10 aa, Staphylococcus aureus
INDKGVKKEI

SEQ ID NO: 1706056 - protein, 14 aa, Staphylococcus aureus
IPTEDVKNEDLKRE

SEQ ID NO: 1706057 - protein, 6 aa, Staphylococcus aureus
ISADDA

SEQ ID NO: 1706058 - protein, 9 aa, Staphylococcus aureus
ISDYPGNED

SEQ ID NO: 1706059 - protein, 9 aa, Staphylococcus aureus
ISGNENEEI

SEQ ID NO: 1706060 - protein, 15 aa, Staphylococcus aureus
ISITKEDKKGTISHD

SEQ ID NO: 1706061 - protein, 27 aa, Staphylococcus aureus
ISNQPHSIAKAEKNVKEITDATKAPYN

SEQ ID NO: 1706062 - protein, 13 aa, Staphylococcus aureus
ISNTPKNSNQGNN

SEQ ID NO: 1706063 - protein, 10 aa, Staphylococcus aureus
ITKKGDNKLI

SEQ ID NO: 1706064 - protein, 20 aa, Staphylococcus aureus
ITNEDENFVKDEQRAGVDAN

SEQ ID NO: 1706065 - protein, 20 aa, Staphylococcus aureus
IVTTQSANAEVASALKAGQL

SEQ ID NO: 1706066 - protein, 47 aa, Staphylococcus aureus; identical to SEQ ID NO: 1638623

SEQ ID NO: 1706067 - protein, 6 aa, Staphylococcus aureus
KAQYEA

SEQ ID NO: 1706068 - protein, 16 aa, Staphylococcus aureus
KATAKVSTLSQSHQNY

SEQ ID NO: 1706069 - protein, 7 aa, Staphylococcus aureus
KDKAYTA

SEQ ID NO: 1706070 - protein, 37 aa, Staphylococcus aureus
KDNVPSDDFNTTVSGEDSWKTLTSKLKEKGLVTDGQT

SEQ ID NO: 1706071 - protein, 30 aa, Staphylococcus aureus
KDYKDGDISYNPNVPSYSAKYQLNNDDYNV

SEQ ID NO: 1706072 - protein, 5 aa, Staphylococcus aureus
KEENV

SEQ ID NO: 1706073 - protein, 16 aa, Staphylococcus aureus
KELPKSENVKNHYQDY

SEQ ID NO: 1706074 - protein, 6 aa, Staphylococcus aureus
KEYNEL

SEQ ID NO: 1706075 - protein, 10 aa, Staphylococcus aureus
KGKAAEEAGY

SEQ ID NO: 1706076 - protein, 23 aa, Staphylococcus aureus
KGKAAEEGGYVAAPEKTYKSQLD

SEQ ID NO: 1706077 - protein, 9 aa, Staphylococcus aureus
KGNEEPQNS

SEQ ID NO: 1706078 - protein, 6 aa, Staphylococcus aureus
KGNINK

SEQ ID NO: 1706079 - protein, 6 aa, Staphylococcus aureus
KHYGST

SEQ ID NO: 1706080 - protein, 7 aa, Staphylococcus aureus
KKGENTY

SEQ ID NO: 1706081 - protein, 6 aa, Staphylococcus aureus
KKTPMG

SEQ ID NO: 1706082 - protein, 5 aa, Staphylococcus aureus
KLKNG

SEQ ID NO: 1706083 - protein, 10 aa, Staphylococcus aureus
KLNNSDTNVK

SEQ ID NO: 1706084 - protein, 6 aa, Staphylococcus aureus
KLQEDR

SEQ ID NO: 1706085 - protein, 13 aa, Staphylococcus aureus
KNDSHAKEMTPTA

SEQ ID NO: 1706086 - protein, 23 aa, Staphylococcus aureus
KNIQSKQKDLLPYDEATENRVTN

SEQ ID NO: 1706087 - protein, 6 aa, Staphylococcus aureus
KNKQEF

SEQ ID NO: 1706088 - protein, 113 aa, Staphylococcus aureus
KNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREI

SEQ ID NO: 1706089 - protein, 23 aa, Staphylococcus aureus
KNVSNSNHGQNVSNEYINKENPD

SEQ ID NO: 1706090 - protein, 21 aa, Staphylococcus aureus
KNYKDWTEHNQDQIKKGKTAQ

SEQ ID NO: 1706091 - protein, 17 aa, Staphylococcus aureus
KNYKNGEVSYNSEAPIY

SEQ ID NO: 1706092 - protein, 70 aa, Staphylococcus aureus
KRSPKYNPGMSDHDKTDGESEDIQHHDNDNNKAIQNDTPDQKAVDKNDKNAVNKEEKHDNHAKNSAETKV

SEQ ID NO: 1706093 - protein, 9 aa, Staphylococcus aureus
KSLAPQGQT

SEQ ID NO: 1706094 - protein, 4 aa, Staphylococcus aureus
KSRR

SEQ ID NO: 1706095 - protein, 26 aa, Staphylococcus aureus
KTGYSSSVSAYGNNNDDFSSTPSNFS

SEQ ID NO: 1706096 - protein, 14 aa, Staphylococcus aureus
KTISTDKVSTNKKI

SEQ ID NO: 1706097 - protein, 6 aa, Staphylococcus aureus
KTLQGE

SEQ ID NO: 1706098 - protein, 5 aa, Staphylococcus aureus
KVEVK

SEQ ID NO: 1706099 - protein, 7 aa, Staphylococcus aureus
KVGSEYN

SEQ ID NO: 1706100 - protein, 21 aa, Staphylococcus aureus
LATDETDAIDNVTNATTNADV

SEQ ID NO: 1706101 - protein, 7 aa, Staphylococcus aureus
LENTPAY

SEQ ID NO: 1706102 - protein, 12 aa, Staphylococcus aureus
LESNEQEQRSDN

SEQ ID NO: 1706103 - protein, 7 aa, Staphylococcus aureus
LGKPEEV

SEQ ID NO: 1706104 - protein, 12 aa, Staphylococcus aureus
LKGLGGEHNDYE

SEQ ID NO: 1706105 - protein, 8 aa, Staphylococcus aureus
LKNNDYNV

SEQ ID NO: 1706106 - protein, 6 aa, Staphylococcus aureus
LNTDRI

SEQ ID NO: 1706107 - protein, 7 aa, Staphylococcus aureus
LSKDGRI

SEQ ID NO: 1706108 - protein, 16 aa, Staphylococcus aureus
LTGTSEDDAGKTFREN

SEQ ID NO: 1706109 - protein, 7 aa, Staphylococcus aureus
LYNGEFN

SEQ ID NO: 1706110 - protein, 21 aa, Staphylococcus aureus
LYNNSYNKGQIKITGTDNNYT

SEQ ID NO: 1706111 - protein, 12 aa, Staphylococcus aureus
MAPQTAGEYEGT

SEQ ID NO: 1706112 - protein, 8 aa, Staphylococcus aureus
MKTDTNRT

SEQ ID NO: 1706113 - protein, 23 aa, Staphylococcus aureus
NADIDNATANTDVDNAKTTNEAT

SEQ ID NO: 1706114 - protein, 18 aa, Staphylococcus aureus
NADVDKNDLKKKSDIDSS

SEQ ID NO: 1706115 - protein, 10 aa, Staphylococcus aureus
NAKKDSAEFK

SEQ ID NO: 1706116 - protein, 17 aa, Staphylococcus aureus
NANTNADVEQVKTNAIQ

SEQ ID NO: 1706117 - protein, 12 aa, Staphylococcus aureus
NDSTISKNDLTQ

SEQ ID NO: 1706118 - protein, 9 aa, Staphylococcus aureus
NDYTTPNKL

SEQ ID NO: 1706119 - protein, 32 aa, Staphylococcus aureus
NEITFTKDGTKHTGKYEYNGKKTLKYPKGNRG

SEQ ID NO: 1706120 - protein, 37 aa, Staphylococcus aureus
NEKDIKDFNDVKGKKLAQTFTSNYGKLAKDKGADITK

SEQ ID NO: 1706121 - protein, 8 aa, Staphylococcus aureus
NEKGEFSF

SEQ ID NO: 1706122 - protein, 9 aa, Staphylococcus aureus
NEKSNEKTR

SEQ ID NO: 1706123 - protein, 6 aa, Staphylococcus aureus
NEYKDQ

SEQ ID NO: 1706124 - protein, 6 aa, Staphylococcus aureus
NGQTYT

SEQ ID NO: 1706125 - protein, 9 aa, Staphylococcus aureus
NGTSTPNLS

SEQ ID NO: 1706126 - protein, 17 aa, Staphylococcus aureus
NHADKTAQVNQNSIDAQ

SEQ ID NO: 1706127 - protein, 11 aa, Staphylococcus aureus
NHANASTESVD

SEQ ID NO: 1706128 - protein, 4 aa, Staphylococcus aureus
NHQF

SEQ ID NO: 1706129 - protein, 6 aa, Staphylococcus aureus
NHQNQS

SEQ ID NO: 1706130 - protein, 7 aa, Staphylococcus aureus
NKEESVS

SEQ ID NO: 1706131 - protein, 11 aa, Staphylococcus aureus
NKIESTNVSQT

SEQ ID NO: 1706132 - protein, 32 aa, Staphylococcus aureus
NKVKQTKTVKSPVRKASQAKKVVQQPVQQASK

SEQ ID NO: 1706133 - protein, 10 aa, Staphylococcus aureus
NNEATDEEQN

SEQ ID NO: 1706134 - protein, 63 aa, Staphylococcus aureus
NPNGAQALTTDHNVQGGSNQALPGNSQNTNADTNRDIVNDSQNTPNAHATDNTSTNQALTNHQ

SEQ ID NO: 1706135 - protein, 58 aa, Staphylococcus aureus
NPNGAQALTTDNNVQSDTNQATPVNSQDTNVANNRGLANSAQNTPNQSATTNQSTNQA

SEQ ID NO: 1706136 - protein, 59 aa, Staphylococcus aureus
NQVGPAPIQPSASPAQNNNNSNANSTATEPAANTNNNLASNNNTLNVPNNTDNNDSARH

SEQ ID NO: 1706137 - protein, 6 aa, Staphylococcus aureus
NRTGWV

SEQ ID NO: 1706138 - protein, 4 aa, Staphylococcus aureus
NTEK

SEQ ID NO: 1706139 - protein, 5 aa, Staphylococcus aureus
NVNED

SEQ ID NO: 1706140 - protein, 16 aa, Staphylococcus aureus
NVNRTTNGHGKVEDYT

SEQ ID NO: 1706141 - protein, 61 aa, Staphylococcus aureus
NYSYNNYNNGYSYNNYSRYNNYSNNNQSYNYNNYNSYNTNSYRTGGLGASYSTSSNNVQVT

SEQ ID NO: 1706142 - protein, 17 aa, Staphylococcus aureus
PHTPRITTTAEELRGTA

SEQ ID NO: 1706143 - protein, 47 aa, Staphylococcus aureus
PKYTKREIDKMSEKDKKDKKANENLGLNPSHEGETNPEKIAEKSPAY

SEQ ID NO: 1706144 - protein, 5 aa, Staphylococcus aureus
PNGTI

SEQ ID NO: 1706145 - protein, 17 aa, Staphylococcus aureus
PTAGAEQTNHIANKPQA

SEQ ID NO: 1706146 - protein, 25 aa, Staphylococcus aureus
QAATTKKSDAKAEIAQKASERKTAI

SEQ ID NO: 1706147 - protein, 23 aa, Staphylococcus aureus
QAINQINQNQTNDQVDTTTNQAV

SEQ ID NO: 1706148 - protein, 11 aa, Staphylococcus aureus
QAVERGSNGFN

SEQ ID NO: 1706149 - protein, 17 aa, Staphylococcus aureus
QEVSPQTVKVTGGEEQL

SEQ ID NO: 1706150 - protein, 31 aa, Staphylococcus aureus
QKQYGGKDKFKKALQQQGLTADKYKENLRTA

SEQ ID NO: 1706151 - protein, 10 aa, Staphylococcus aureus
QNINPDNNRL

SEQ ID NO: 1706152 - protein, 17 aa, Staphylococcus aureus
QNNTTATHQNAKVNKTY

SEQ ID NO: 1706153 - protein, 7 aa, Staphylococcus aureus
QPKGEIM

SEQ ID NO: 1706154 - protein, 20 aa, Staphylococcus aureus
QQERPESIPALTSEKNHNQT

SEQ ID NO: 1706155 - protein, 9 aa, Staphylococcus aureus
QQTAKAEHN

SEQ ID NO: 1706156 - protein, 20 aa, Staphylococcus aureus
QRNPGFNETEKGSYGSPKIK

SEQ ID NO: 1706157 - protein, 13 aa, Staphylococcus aureus
QSNLWKSKDNGFY

SEQ ID NO: 1706158 - protein, 6 aa, Staphylococcus aureus
QTNNQL

SEQ ID NO: 1706159 - protein, 10 aa, Staphylococcus aureus
QYGHNAKELR

SEQ ID NO: 1706160 - protein, 8 aa, Staphylococcus aureus
RAKDGHTI

SEQ ID NO: 1706161 - protein, 15 aa, Staphylococcus aureus
REDKGIHRDNEKRYP

SEQ ID NO: 1706162 - protein, 4 aa, Staphylococcus aureus
RFDE

SEQ ID NO: 1706163 - protein, 18 aa, Staphylococcus aureus
RHPKTTLNTDENKKKVKD

SEQ ID NO: 1706164 - protein, 10 aa, Staphylococcus aureus
RIKKRKNPGL

SEQ ID NO: 1706165 - protein, 9 aa, Staphylococcus aureus
RITGGGNHY

SEQ ID NO: 1706166 - protein, 17 aa, Staphylococcus aureus
RKYNNGDVSINENVPSY

SEQ ID NO: 1706167 - protein, 26 aa, Staphylococcus aureus
RLKSTDANRYVKNPQTAHIEILLEKS

SEQ ID NO: 1706168 - protein, 9 aa, Staphylococcus aureus
RNTRTAKGN

SEQ ID NO: 1706169 - protein, 9 aa, Staphylococcus aureus
RQKSKNESV

SEQ ID NO: 1706170 - protein, 58 aa, Staphylococcus aureus
SAAKPAALETQYKAAAPKAKTEATPKVTTFSASAQPRSVAATPKTSLPKYKPQVNSSI

SEQ ID NO: 1706171 - protein, 13 aa, Staphylococcus aureus
SAVVSGEKNPYVS

SEQ ID NO: 1706172 - protein, 7 aa, Staphylococcus aureus
SGYREKD

SEQ ID NO: 1706173 - protein, 26 aa, Staphylococcus aureus
SKVKNQLASQRGVTTEKINNAQTATY

SEQ ID NO: 1706174 - protein, 8 aa, Staphylococcus aureus
SQKNSQEH

SEQ ID NO: 1706175 - protein, 10 aa, Staphylococcus aureus
SRNAQIKDTF

SEQ ID NO: 1706176 - protein, 13 aa, Staphylococcus aureus
STGGGTGNSPARL

SEQ ID NO: 1706177 - protein, 6 aa, Staphylococcus aureus
STVTAE

SEQ ID NO: 1706178 - protein, 18 aa, Staphylococcus aureus
SVGGITKANRKKVDYKTG

SEQ ID NO: 1706179 - protein, 17 aa, Staphylococcus aureus
SVKGGVSKEDTKASSDG

SEQ ID NO: 1706180 - protein, 15 aa, Staphylococcus aureus
SVQAKTEVKQQSEAD

SEQ ID NO: 1706181 - protein, 24 aa, Staphylococcus aureus
SYNPNAPNYSAEYKINDDDNNIKQ

SEQ ID NO: 1706182 - protein, 21 aa, Staphylococcus aureus
TAKPTPTPIPKPSTPTTNNKL

SEQ ID NO: 1706183 - protein, 19 aa, Staphylococcus aureus
TAKSPVNVNQSYSIKSGTK

SEQ ID NO: 1706184 - protein, 8 aa, Staphylococcus aureus
TDKERFKD

SEQ ID NO: 1706185 - protein, 12 aa, Staphylococcus aureus
TEIGNNGNFGAS

SEQ ID NO: 1706186 - protein, 22 aa, Staphylococcus aureus
TEKGKGILDKQGTKEITGKTKF

SEQ ID NO: 1706187 - protein, 19 aa, Staphylococcus aureus
TENRNKGKLKITGGGNNYT

SEQ ID NO: 1706188 - protein, 10 aa, Staphylococcus aureus
TFAPDSDKIL

SEQ ID NO: 1706189 - protein, 15 aa, Staphylococcus aureus
TGGVTPAASPSDKPY

SEQ ID NO: 1706190 - protein, 8 aa, Staphylococcus aureus
TKDEDTIE

SEQ ID NO: 1706191 - protein, 21 aa, Staphylococcus aureus
TKDYSKESRVNENSKYDTPIP

SEQ ID NO: 1706192 - protein, 8 aa, Staphylococcus aureus
TKNGGKYT

SEQ ID NO: 1706193 - protein, 9 aa, Staphylococcus aureus
TKPITDEKL

SEQ ID NO: 1706194 - protein, 17 aa, Staphylococcus aureus
TKPTGHNTATRQAETYR

SEQ ID NO: 1706195 - protein, 10 aa, Staphylococcus aureus
TLDTTQDERN

SEQ ID NO: 1706196 - protein, 18 aa, Staphylococcus aureus
TNEDENFVKDEQRAGVDA

SEQ ID NO: 1706197 - protein, 9 aa, Staphylococcus aureus
TNKDEVEEL

SEQ ID NO: 1706198 - protein, 14 aa, Staphylococcus aureus
TNKYEYGEKEYKQA

SEQ ID NO: 1706199 - protein, 30 aa, Staphylococcus aureus; identical to SEQ ID NO: 1644465

SEQ ID NO: 1706200 - protein, 46 aa, Staphylococcus aureus
TPRLEDKKAKKTESIPTGNNVTQLKQKASVTMPTSQFKSNNYTYNE

SEQ ID NO: 1706201 - protein, 11 aa, Staphylococcus aureus
TQQKSGEESEV

SEQ ID NO: 1706202 - protein, 5 aa, Staphylococcus aureus
TSYTQ

SEQ ID NO: 1706203 - protein, 22 aa, Staphylococcus aureus
TTTPTTPSKPTTPSKPSTGKLT

SEQ ID NO: 1706204 - protein, 35 aa, Staphylococcus aureus
TVKPKANQAIEAKAEDTKESIDHSDQLTAEEKTEA

SEQ ID NO: 1706205 - protein, 7 aa, Staphylococcus aureus
VDEFNSE

SEQ ID NO: 1706206 - protein, 4 aa, Staphylococcus aureus
VEPG

SEQ ID NO: 1706207 - protein, 17 aa, Staphylococcus aureus
VGGITKTNSKKVDHKAE

SEQ ID NO: 1706208 - protein, 13 aa, Staphylococcus aureus
VKTAKAEEKMTNG

SEQ ID NO: 1706209 - protein, 12 aa, Staphylococcus aureus
VQDKSDKKRAVN

SEQ ID NO: 1706210 - protein, 14 aa, Staphylococcus aureus
VQQTAKAENNVTKI

SEQ ID NO: 1706211 - protein, 17 aa, Staphylococcus aureus
VTASDSSDSGNVQHDRN

SEQ ID NO: 1706212 - protein, 10 aa, Staphylococcus aureus
VTKEKGEDAF

SEQ ID NO: 1706213 - protein, 7 aa, Staphylococcus aureus
VTPGQAS

SEQ ID NO: 1706214 - protein, 13 aa, Staphylococcus aureus
VTTNNPASKQVDK

SEQ ID NO: 1706215 - protein, 8 aa, Staphylococcus aureus
VYKGTGTM

SEQ ID NO: 1706216 - protein, 29 aa, Staphylococcus aureus
YDKEDKAKELNKDLDNKIASMKDKTKKFN

SEQ ID NO: 1706217 - protein, 16 aa, Staphylococcus aureus
YDKEGYRDGEFEKGDK

SEQ ID NO: 1706218 - protein, 11 aa, Staphylococcus aureus
YTNKPENRDNF

SEQ ID NO: 1706219 - protein, 8 aa, Staphylococcus aureus
AAKQDSKV

SEQ ID NO: 1706220 - protein, 10 aa, Staphylococcus aureus
AAQNAAKQHL

SEQ ID NO: 1706221 - protein, 11 aa, Staphylococcus aureus
AEFTDQDTGEK

SEQ ID NO: 1706222 - protein, 12 aa, Staphylococcus aureus
AMDDSTKAKYKK

SEQ ID NO: 1706223 - protein, 12 aa, Staphylococcus aureus
ANNEATDEEQNA

SEQ ID NO: 1706224 - protein, 15 aa, Staphylococcus aureus
ANTNADVEQVKTNAI

SEQ ID NO: 1706225 - protein, 9 aa, Staphylococcus aureus
APDDEEDAL

SEQ ID NO: 1706226 - protein, 47 aa, Staphylococcus aureus
AQKDAEKKVAPKVEAPQIQSPQIEKPKAESPKVEVPQIQSPKVEVPQ

SEQ ID NO: 1706227 - protein, 8 aa, Staphylococcus aureus
AQQDENKE

SEQ ID NO: 1706228 - protein, 29 aa, Staphylococcus aureus
ARDAVKQQYEAKKHEIEQAEHATDEEKQV

SEQ ID NO: 1706229 - protein, 21 aa, Staphylococcus aureus
ARPQFNKPAAKTEATIKKEQK

SEQ ID NO: 1706230 - protein, 6 aa, Staphylococcus aureus
ATLNDI

SEQ ID NO: 1706231 - protein, 20 aa, Staphylococcus aureus
ATQVKTDARNAVNEKAREAI

SEQ ID NO: 1706232 - protein, 17 aa, Staphylococcus aureus
CNSNSSHAKELNDLEKK

SEQ ID NO: 1706233 - protein, 7 aa, Staphylococcus aureus
DENKVEI

SEQ ID NO: 1706234 - protein, 6 aa, Staphylococcus aureus
DGSSKF

SEQ ID NO: 1706235 - protein, 14 aa, Staphylococcus aureus
DGTSIERIEVNLKS

SEQ ID NO: 1706236 - protein, 40 aa, Staphylococcus aureus
DKDKDEKIEQYDKNVKEQASKDKKQQAKPQIPKDKSKVAG

SEQ ID NO: 1706237 - protein, 11 aa, Staphylococcus aureus
DKEQYKEGLQG

SEQ ID NO: 1706238 - protein, 42 aa, Staphylococcus aureus
DNNKAIQNDLPDQKVDDKNDKNAVNKEEKHDNRENNSAETKV

SEQ ID NO: 1706239 - protein, 25 aa, Staphylococcus aureus
DPNGRLSTVGGVTKKNNKTSETNTP

SEQ ID NO: 1706240 - protein, 13 aa, Staphylococcus aureus
DSATGKGRNGFYK

SEQ ID NO: 1706241 - protein, 6 aa, Staphylococcus aureus
DSELGE

SEQ ID NO: 1706242 - protein, 15 aa, Staphylococcus aureus
DSKGYAQSKDTKYPV

SEQ ID NO: 1706243 - protein, 16 aa, Staphylococcus aureus
DTADGYAGVKGIGEKT

SEQ ID NO: 1706244 - protein, 15 aa, Staphylococcus aureus
DYTSVGTRKQPNLEE

SEQ ID NO: 1706245 - protein, 7 aa, Staphylococcus aureus
EDLSERG

SEQ ID NO: 1706246 - protein, 42 aa, Staphylococcus aureus
EEASNRPKKRSRRAAPTDPNATPADPTATPADPTAGNGSAPV

SEQ ID NO: 1706247 - protein, 24 aa, Staphylococcus aureus
EETQQIANAEKNVTQVKDTNNFPY

SEQ ID NO: 1706248 - protein, 8 aa, Staphylococcus aureus
EKGNAKQG

SEQ ID NO: 1706249 - protein, 23 aa, Staphylococcus aureus
EKVGNGAEHSKTLNAVRGQNNQW

SEQ ID NO: 1706250 - protein, 37 aa, Staphylococcus aureus
EKVQPQQKNQANDKITDHNFNNEQEVKPQKDEKTLSV

SEQ ID NO: 1706251 - protein, 15 aa, Staphylococcus aureus
EKYEEPEYKEAVKKY

SEQ ID NO: 1706252 - protein, 9 aa, Staphylococcus aureus
EPGNSGSAV

SEQ ID NO: 1706253 - protein, 15 aa, Staphylococcus aureus
EQANGSLVKQDGKVI

SEQ ID NO: 1706254 - protein, 13 aa, Staphylococcus aureus
EQGQEMTPNNKQQ

SEQ ID NO: 1706255 - protein, 18 aa, Staphylococcus aureus
ESFEYSNVSGKVENYNGS

SEQ ID NO: 1706256 - protein, 46 aa, Staphylococcus aureus
EVSSSSPDLGEDEEDEEVEEASTDKAGVEEESTEAKVTYTTPRYEK

SEQ ID NO: 1706257 - protein, 9 aa, Staphylococcus aureus
FKGESLKSR

SEQ ID NO: 1706258 - protein, 10 aa, Staphylococcus aureus
FKSKASKVTV

SEQ ID NO: 1706259 - protein, 16 aa, Staphylococcus aureus
FKTNKKINGDTKDIAE

SEQ ID NO: 1706260 - protein, 11 aa, Staphylococcus aureus
FSEYKKDALAK

SEQ ID NO: 1706261 - protein, 6 aa, Staphylococcus aureus
GDASYT

SEQ ID NO: 1706262 - protein, 11 aa, Staphylococcus aureus
GERPTESPGVP

SEQ ID NO: 1706263 - protein, 6 aa, Staphylococcus aureus
GESLKS

SEQ ID NO: 1706264 - protein, 5 aa, Staphylococcus aureus
GGGYG

SEQ ID NO: 1706265 - protein, 16 aa, Staphylococcus aureus
GGITKSNSKKVDHKAG

SEQ ID NO: 1706266 - protein, 12 aa, Staphylococcus aureus
GKDDKKYDEGVH

SEQ ID NO: 1706267 - protein, 11 aa, Staphylococcus aureus
GKSADSVENGG

SEQ ID NO: 1706268 - protein, 5 aa, Staphylococcus aureus
GNVGS

SEQ ID NO: 1706269 - protein, 11 aa, Staphylococcus aureus
GSGNLDGSSIG

SEQ ID NO: 1706270 - protein, 12 aa, Staphylococcus aureus
GTGNLKGSSIGY

SEQ ID NO: 1706271 - protein, 6 aa, Staphylococcus aureus
GTPRSL

SEQ ID NO: 1706272 - protein, 7 aa, Staphylococcus aureus
GYGPGVV

SEQ ID NO: 1706273 - protein, 18 aa, Staphylococcus aureus
HHEKQAEQLVEETKDNID

SEQ ID NO: 1706274 - protein, 14 aa, Staphylococcus aureus
HNKKTKDHYIETQE

SEQ ID NO: 1706275 - protein, 67 aa, Staphylococcus aureus
HNNGSIANQATPTSVQSSTPSAQNNNHTDGNTTATETVSNANNKDVVSNNTTLNVPNKTNENGSGGH

SEQ ID NO: 1706276 - protein, 15 aa, Staphylococcus aureus
HPLNKEQVNQITAIF

SEQ ID NO: 1706277 - protein, 12 aa, Staphylococcus aureus
HTPDATQDEIQD

SEQ ID NO: 1706278 - protein, 13 aa, Staphylococcus aureus
IEATTTAQDLERV

SEQ ID NO: 1706279 - protein, 16 aa, Staphylococcus aureus
IENNQNLKVSKESGFR

SEQ ID NO: 1706280 - protein, 14 aa, Staphylococcus aureus
IKPGAQKITGTTLP

SEQ ID NO: 1706281 - protein, 12 aa, Staphylococcus aureus
IKQTTQSLNTAM

SEQ ID NO: 1706282 - protein, 23 aa, Staphylococcus aureus
IKSTDSSKNPVTTIENRKANDYK

SEQ ID NO: 1706283 - protein, 12 aa, Staphylococcus aureus
INPNGNRFDAND

SEQ ID NO: 1706284 - protein, 37 aa, Staphylococcus aureus
IQPATTTKDNAKQAIATKANERKTAIAQTQDITAEEI

SEQ ID NO: 1706285 - protein, 73 aa, Staphylococcus aureus
IQTQAKVKPAADTEVENAYNTRKQEIQNSNASTTEEKEAAYTELDAKKQEARTNLDAANTNSDVTTAKDNGIA

SEQ ID NO: 1706286 - protein, 6 aa, Staphylococcus aureus
ISDDAH

SEQ ID NO: 1706287 - protein, 97 aa, Staphylococcus aureus
ISDYEQPRNGEKSTNDSNKNSDNSIKNDTDTQSSKQDKADNQKAPKSNNTKPSTSNKQPNSPKPTQPNQSNSQPASDDKVNQKSSSKDNQSMSDSAL

SEQ ID NO: 1706288 - protein, 22 aa, Staphylococcus aureus
ISYTQKSYVSEVDKQNSKSVKW

SEQ ID NO: 1706289 - protein, 11 aa, Staphylococcus aureus
ITDSTQTKMDA

SEQ ID NO: 1706290 - protein, 72 aa, Staphylococcus aureus
ITPDANVKPAAKQAIADKVQAQETAIDANNGSTTEEKEAAKQQVQTEKTAADAAIDAAHSNVEVEAAKNAEI

SEQ ID NO: 1706291 - protein, 17 aa, Staphylococcus aureus
ITSEGQAVQAAEKQERV

SEQ ID NO: 1706292 - protein, 24 aa, Staphylococcus aureus
IVTTQSANAEVASALKTEQAIKSK

SEQ ID NO: 1706293 - protein, 16 aa, Staphylococcus aureus
KDDTQTTNSDNQETNS

SEQ ID NO: 1706294 - protein, 21 aa, Staphylococcus aureus
KDEMKNYSKPISTYAPSSDKI

SEQ ID NO: 1706295 - protein, 36 aa, Staphylococcus aureus
KDGHRGGAWKGASSIKNLGSKKTRSGTYDANLKRIG

SEQ ID NO: 1706296 - protein, 7 aa, Staphylococcus aureus
KDPVRIT

SEQ ID NO: 1706297 - protein, 11 aa, Staphylococcus aureus
KFEATENEAEK

SEQ ID NO: 1706298 - protein, 7 aa, Staphylococcus aureus
KGTTKYG

SEQ ID NO: 1706299 - protein, 11 aa, Staphylococcus aureus
KIATGTPDGVH

SEQ ID NO: 1706300 - protein, 14 aa, Staphylococcus aureus
KKDENGRPQDKQIE

SEQ ID NO: 1706301 - protein, 35 aa, Staphylococcus aureus
KKQAAKDEIDQLQATQTNVINNDQNATNEEKEAAI

SEQ ID NO: 1706302 - protein, 5 aa, Staphylococcus aureus
KNDEI

SEQ ID NO: 1706303 - protein, 7 aa, Staphylococcus aureus
KNKYGVE

SEQ ID NO: 1706304 - protein, 16 aa, Staphylococcus aureus
KNTSTSNESGVRFELT

SEQ ID NO: 1706305 - protein, 14 aa, Staphylococcus aureus
KNVTGYKYTEKGKD

SEQ ID NO: 1706306 - protein, 11 aa, Staphylococcus aureus
KQQIAGAVTNA

SEQ ID NO: 1706307 - protein, 17 aa, Staphylococcus aureus
KTSVESDSSYKQTDYLS

SEQ ID NO: 1706308 - protein, 5 aa, Staphylococcus aureus
KYGVD

SEQ ID NO: 1706309 - protein, 35 aa, Staphylococcus aureus; identical to SEQ ID NO: 1640040

SEQ ID NO: 1706310 - protein, 12 aa, Staphylococcus aureus
LESNEQQQRSDN

SEQ ID NO: 1706311 - protein, 17 aa, Staphylococcus aureus
LKDKSNKSNSYENYRDS

SEQ ID NO: 1706312 - protein, 9 aa, Staphylococcus aureus
LQQRPKETL

SEQ ID NO: 1706313 - protein, 25 aa, Staphylococcus aureus
LSITKKDEKGKISHDDSEYKITKEE

SEQ ID NO: 1706314 - protein, 19 aa, Staphylococcus aureus
MKHKNTKLKTDENKTKVKD

SEQ ID NO: 1706315 - protein, 73 aa, Staphylococcus aureus
NANNENKKKEDEKKSEVKKEATKNNDKPKNEKKNQDINKNNNEQVQNVNNKQPVLNNNSNHNNQQQSNKNNYT

SEQ ID NO: 1706316 - protein, 18 aa, Staphylococcus aureus
NDDGQNIADKPASKQAGH

SEQ ID NO: 1706317 - protein, 5 aa, Staphylococcus aureus
NERNS

SEQ ID NO: 1706318 - protein, 7 aa, Staphylococcus aureus
NGEDLDA

SEQ ID NO: 1706319 - protein, 27 aa, Staphylococcus aureus
NINNSNSKINTNKINENIYSKNNRNYI

SEQ ID NO: 1706320 - protein, 9 aa, Staphylococcus aureus
NIPTNKAPK

SEQ ID NO: 1706321 - protein, 9 aa, Staphylococcus aureus
NLPESEKAI

SEQ ID NO: 1706322 - protein, 5 aa, Staphylococcus aureus
NMPYP

SEQ ID NO: 1706323 - protein, 17 aa, Staphylococcus aureus
NNEQEVKPQKDEKTLSV

SEQ ID NO: 1706324 - protein, 9 aa, Staphylococcus aureus
NNGVGNEED

SEQ ID NO: 1706325 - protein, 12 aa, Staphylococcus aureus
NPESTNSVSDIE

SEQ ID NO: 1706326 - protein, 6 aa, Staphylococcus aureus
NPKDQN

SEQ ID NO: 1706327 - protein, 6 aa, Staphylococcus aureus
NQFAKG

SEQ ID NO: 1706328 - protein, 9 aa, Staphylococcus aureus
NQTTNPTMS

SEQ ID NO: 1706329 - protein, 10 aa, Staphylococcus aureus
NTKRPNYSKK

SEQ ID NO: 1706330 - protein, 7 aa, Staphylococcus aureus
NTKRTTG

SEQ ID NO: 1706331 - protein, 63 aa, Staphylococcus aureus; identical to SEQ ID NO: 1641744

SEQ ID NO: 1706332 - protein, 39 aa, Staphylococcus aureus; identical to SEQ ID NO: 1641773

SEQ ID NO: 1706333 - protein, 31 aa, Staphylococcus aureus; identical to SEQ ID NO: 1641812

SEQ ID NO: 1706334 - protein, 5 aa, Staphylococcus aureus
PNDEM

SEQ ID NO: 1706335 - protein, 4 aa, Staphylococcus aureus
PNQF

SEQ ID NO: 1706336 - protein, 13 aa, Staphylococcus aureus
PNTPINSSSEAKA

SEQ ID NO: 1706337 - protein, 6 aa, Staphylococcus aureus
PQGTIQ

SEQ ID NO: 1706338 - protein, 68 aa, Staphylococcus aureus
PTAYADTPQKDTTAKTTSHDSKKSNDDETSKDTTSKDTDKADNNNTSNQDNNDKKFKTIDDSTSDSNN

SEQ ID NO: 1706339 - protein, 68 aa, Staphylococcus aureus
PTAYADTPQKDTTAKTTSHDSKKSTDDETSKDTTSKDIDKADNNNTSNQDNNDKKVKTIDDSTSDSNN

SEQ ID NO: 1706340 - protein, 16 aa, Staphylococcus aureus
QAVTNNDVKRVETNGI

SEQ ID NO: 1706341 - protein, 5 aa, Staphylococcus aureus
QEAVD

SEQ ID NO: 1706342 - protein, 21 aa, Staphylococcus aureus
QKAYGKDLKKENNKTKESDSG

SEQ ID NO: 1706343 - protein, 6 aa, Staphylococcus aureus
QMQDGD

SEQ ID NO: 1706344 - protein, 14 aa, Staphylococcus aureus
QNSATGKERNGFYK

SEQ ID NO: 1706345 - protein, 21 aa, Staphylococcus aureus
QQTAKAEHNVKQVQNTNISPY

SEQ ID NO: 1706346 - protein, 6 aa, Staphylococcus aureus
QRDESI

SEQ ID NO: 1706347 - protein, 12 aa, Staphylococcus aureus
QYTSSEDTSYES

SEQ ID NO: 1706348 - protein, 18 aa, Staphylococcus aureus
RIGTTKRVEVSQGNVQTK

SEQ ID NO: 1706349 - protein, 6 aa, Staphylococcus aureus
RKDAVN

SEQ ID NO: 1706350 - protein, 4 aa, Staphylococcus aureus
RKKE

SEQ ID NO: 1706351 - protein, 34 aa, Staphylococcus aureus; identical to SEQ ID NO: 1566267

SEQ ID NO: 1706352 - protein, 7 aa, Staphylococcus aureus
SDQGITK

SEQ ID NO: 1706353 - protein, 10 aa, Staphylococcus aureus
SFDGDYKQNI

SEQ ID NO: 1706354 - protein, 10 aa, Staphylococcus aureus
SIQSNGKDMN

SEQ ID NO: 1706355 - protein, 6 aa, Staphylococcus aureus
SKSRNL

SEQ ID NO: 1706356 - protein, 5 aa, Staphylococcus aureus
SSSAI

SEQ ID NO: 1706357 - protein, 14 aa, Staphylococcus aureus
SSVGESEDAKGGNL

SEQ ID NO: 1706358 - protein, 14 aa, Staphylococcus aureus
SSVGKSEPAKGGNL

SEQ ID NO: 1706359 - protein, 107 aa, Staphylococcus aureus
STSAITTTAQAVNAEQNHTANPEQAAKSNTENVSTSLSTQTEQTPKSNIQKATQPAPSGTTQSLPNAQPQSTQPTPSVTTPPSSNVETPQPTSPTTKQAQKEINPKF

SEQ ID NO: 1706360 - protein, 8 aa, Staphylococcus aureus
SYAQGDIG

SEQ ID NO: 1706361 - protein, 40 aa, Staphylococcus aureus
TKPEENKANAKSDQQGKVNKPKQQAKTLPDTGMSHNDDLP

SEQ ID NO: 1706362 - protein, 9 aa, Staphylococcus aureus
TKPIADDKL

SEQ ID NO: 1706363 - protein, 11 aa, Staphylococcus aureus
TMDDSTKTRYK

SEQ ID NO: 1706364 - protein, 11 aa, Staphylococcus aureus
TMDKSTKAKYK

SEQ ID NO: 1706365 - protein, 141 aa, Staphylococcus aureus
TNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINT

SEQ ID NO: 1706366 - protein, 9 aa, Staphylococcus aureus
TNVQTPDYE

SEQ ID NO: 1706367 - protein, 9 aa, Staphylococcus aureus
TNVQTTDYE

SEQ ID NO: 1706368 - protein, 13 aa, Staphylococcus aureus
TPFNDSNQNDTTL

SEQ ID NO: 1706369 - protein, 6 aa, Staphylococcus aureus
TQGPTI

SEQ ID NO: 1706370 - protein, 17 aa, Staphylococcus aureus
TSLEDIDKAETKYDHTK

SEQ ID NO: 1706371 - protein, 24 aa, Staphylococcus aureus
TSPQVAAQAAKKLGYSATKHVSHG

SEQ ID NO: 1706372 - protein, 18 aa, Staphylococcus aureus
TSQTRDGGSEADQIPSGY

SEQ ID NO: 1706373 - protein, 20 aa, Staphylococcus aureus
TSTAQTVNASEHESKYENVT

SEQ ID NO: 1706374 - protein, 14 aa, Staphylococcus aureus
TSVNSDSSYNQNNY

SEQ ID NO: 1706375 - protein, 5 aa, Staphylococcus aureus
TTNDL

SEQ ID NO: 1706376 - protein, 18 aa, Staphylococcus aureus
TVKGPEYPTMENKTLQGE

SEQ ID NO: 1706377 - protein, 13 aa, Staphylococcus aureus
VNANDSTDHGNFN

SEQ ID NO: 1706378 - protein, 11 aa, Staphylococcus aureus
VQAQTQSPTTY

SEQ ID NO: 1706379 - protein, 7 aa, Staphylococcus aureus
VQNDQYG

SEQ ID NO: 1706380 - protein, 38 aa, Staphylococcus aureus
VRQAATARKAQNATVSNATDEEVAEANAAVDAAQTEGL

SEQ ID NO: 1706381 - protein, 43 aa, Staphylococcus aureus
YDKSNAPNNNHQNQSRTNDNHQHANQRDLNNNQYHSSLSGQYT

SEQ ID NO: 1706382 - protein, 25 aa, Staphylococcus aureus
YDQYDENNQDMKKKFDAKEKEAKKL

SEQ ID NO: 1706383 - protein, 26 aa, Staphylococcus aureus
YGKNPSQKVEDLTKNRKGQTTPKNNS

SEQ ID NO: 1706384 - protein, 7 aa, Staphylococcus aureus
YLPKAAT

SEQ ID NO: 1706385 - protein, 8 aa, Staphylococcus aureus
YNIPTDKA

SEQ ID NO: 1706386 - protein, 10 aa, Staphylococcus aureus
YSDSAKTFEI

SEQ ID NO: 1706387 - protein, 9 aa, Staphylococcus aureus
AAVTAANTN

SEQ ID NO: 1706388 - protein, 21 aa, Staphylococcus aureus
ADGTNVQWSNGAGAGANKPLP

SEQ ID NO: 1706389 - protein, 8 aa, Staphylococcus aureus
AKEKEKAL

SEQ ID NO: 1706390 - protein, 11 aa, Staphylococcus aureus
AKTQDKDYLTQ

SEQ ID NO: 1706391 - protein, 8 aa, Staphylococcus aureus
CTTDKKEI

SEQ ID NO: 1706392 - protein, 8 aa, Staphylococcus aureus
DAFGNGET

SEQ ID NO: 1706393 - protein, 6 aa, Staphylococcus aureus
DAKHGF

SEQ ID NO: 1706394 - protein, 21 aa, Staphylococcus aureus
DGTTFDADAVKKNIDAVQQNK

SEQ ID NO: 1706395 - protein, 7 aa, Staphylococcus aureus
DGTTHTI

SEQ ID NO: 1706396 - protein, 15 aa, Staphylococcus aureus
DKNNPQNYQAKGNVA

SEQ ID NO: 1706397 - protein, 36 aa, Staphylococcus aureus
DKSDNTKSSVSGKVGADLTSGNGTTFKKRFIDKITI

SEQ ID NO: 1706398 - protein, 7 aa, Staphylococcus aureus
DNTPLTI

SEQ ID NO: 1706399 - protein, 14 aa, Staphylococcus aureus
DVKTGSKAKADSYV

SEQ ID NO: 1706400 - protein, 7 aa, Staphylococcus aureus
EDFSERG

SEQ ID NO: 1706401 - protein, 17 aa, Staphylococcus aureus
EKVQPQQNNQANDKITN

SEQ ID NO: 1706402 - protein, 18 aa, Staphylococcus aureus
ENIQGAKDYHEGKTDHIS

SEQ ID NO: 1706403 - protein, 6 aa, Staphylococcus aureus
ETNVEN

SEQ ID NO: 1706404 - protein, 34 aa, Staphylococcus aureus
FGGNHKLSSKKSEESKQETVKKESEEEKDPDLEK

SEQ ID NO: 1706405 - protein, 15 aa, Staphylococcus aureus
GKPGDTVVDDHTDDE

SEQ ID NO: 1706406 - protein, 12 aa, Staphylococcus aureus
GMKEARKGVGYK

SEQ ID NO: 1706407 - protein, 30 aa, Staphylococcus aureus; identical to SEQ ID NO: 1568897

SEQ ID NO: 1706408 - protein, 14 aa, Staphylococcus aureus
GQAPNKNNTTIGQD

SEQ ID NO: 1706409 - protein, 15 aa, Staphylococcus aureus
GQDFPTGNGASASDY

SEQ ID NO: 1706410 - protein, 13 aa, Staphylococcus aureus
GQSHTTTNNPIRE

SEQ ID NO: 1706411 - protein, 16 aa, Staphylococcus aureus
GTFKYQSRPKFNTTPK

SEQ ID NO: 1706412 - protein, 18 aa, Staphylococcus aureus
HLDDPVSTDGKKPGTITQ

SEQ ID NO: 1706413 - protein, 31 aa, Staphylococcus aureus; identical to SEQ ID NO: 1638372

SEQ ID NO: 1706414 - protein, 7 aa, Staphylococcus aureus
ITTDEIS

SEQ ID NO: 1706415 - protein, 30 aa, Staphylococcus aureus; identical to SEQ ID NO: 1638596

SEQ ID NO: 1706416 - protein, 7 aa, Staphylococcus aureus
KASDAKE

SEQ ID NO: 1706417 - protein, 8 aa, Staphylococcus aureus
KDGKLTGY

SEQ ID NO: 1706418 - protein, 14 aa, Staphylococcus aureus
KGDSRVSYSDITKK

SEQ ID NO: 1706419 - protein, 7 aa, Staphylococcus aureus
KGEAIKK

SEQ ID NO: 1706420 - protein, 12 aa, Staphylococcus aureus
KGRLTKSFTSNL

SEQ ID NO: 1706421 - protein, 16 aa, Staphylococcus aureus
KKDGAINKGDYNNNNV

SEQ ID NO: 1706422 - protein, 6 aa, Staphylococcus aureus
KKMESR

SEQ ID NO: 1706423 - protein, 11 aa, Staphylococcus aureus
KKNSKGRPQYI

SEQ ID NO: 1706424 - protein, 24 aa, Staphylococcus aureus
KLTDTNRYVKNPRHAEIEVILEKS

SEQ ID NO: 1706425 - protein, 113 aa, Staphylococcus aureus
KNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREI

SEQ ID NO: 1706426 - protein, 17 aa, Staphylococcus aureus
KNYSNGDVSINENVPSY

SEQ ID NO: 1706427 - protein, 18 aa, Staphylococcus aureus
KPAARQSVGVKAEAQNAL

SEQ ID NO: 1706428 - protein, 20 aa, Staphylococcus aureus
KQANTNAEVDQAATVAENNI

SEQ ID NO: 1706429 - protein, 8 aa, Staphylococcus aureus
KQPEGDQR

SEQ ID NO: 1706430 - protein, 12 aa, Staphylococcus aureus
KSSNFSKDKKLD

SEQ ID NO: 1706431 - protein, 9 aa, Staphylococcus aureus
KTAQNKEGA

SEQ ID NO: 1706432 - protein, 12 aa, Staphylococcus aureus
KVQAAQTKINEA

SEQ ID NO: 1706433 - protein, 8 aa, Staphylococcus aureus
LAKSDKIR

SEQ ID NO: 1706434 - protein, 9 aa, Staphylococcus aureus
LAKSDKIRK

SEQ ID NO: 1706435 - protein, 20 aa, Staphylococcus aureus
LENYKDGDISYNPEVPSYSA

SEQ ID NO: 1706436 - protein, 19 aa, Staphylococcus aureus
LKKYKAENKYRKATGQAPI

SEQ ID NO: 1706437 - protein, 7 aa, Staphylococcus aureus
LQATTEG

SEQ ID NO: 1706438 - protein, 5 aa, Staphylococcus aureus
LQENR

SEQ ID NO: 1706439 - protein, 51 aa, Staphylococcus aureus; identical to SEQ ID NO: 1569177

SEQ ID NO: 1706440 - protein, 10 aa, Staphylococcus aureus
LQQAARTGSP

SEQ ID NO: 1706441 - protein, 10 aa, Staphylococcus aureus
NAATGTNDAN

SEQ ID NO: 1706442 - protein, 6 aa, Staphylococcus aureus
NDSRSW

SEQ ID NO: 1706443 - protein, 10 aa, Staphylococcus aureus
NEDLANASKD

SEQ ID NO: 1706444 - protein, 7 aa, Staphylococcus aureus
NGKTQVV

SEQ ID NO: 1706445 - protein, 9 aa, Staphylococcus aureus
NGTSTPIAS

SEQ ID NO: 1706446 - protein, 6 aa, Staphylococcus aureus
NINGEN

SEQ ID NO: 1706447 - protein, 11 aa, Staphylococcus aureus
NLKGSSVGDRK

SEQ ID NO: 1706448 - protein, 21 aa, Staphylococcus aureus
NNGVDNGDVDDALTQGKAAID

SEQ ID NO: 1706449 - protein, 7 aa, Staphylococcus aureus
NQAYNSD

SEQ ID NO: 1706450 - protein, 9 aa, Staphylococcus aureus
NSYGPSKDV

SEQ ID NO: 1706451 - protein, 6 aa, Staphylococcus aureus
PAPYKN

SEQ ID NO: 1706452 - protein, 19 aa, Staphylococcus aureus
PEVTKDKTTHVGERKGGPY

SEQ ID NO: 1706453 - protein, 15 aa, Staphylococcus aureus
PEYQTANAAKTATVT

SEQ ID NO: 1706454 - protein, 11 aa, Staphylococcus aureus
PGSHDSGSFTL

SEQ ID NO: 1706455 - protein, 362 aa, Staphylococcus aureus
PQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSM

SEQ ID NO: 1706456 - protein, 39 aa, Staphylococcus aureus; identical to SEQ ID NO: 1569339

SEQ ID NO: 1706457 - protein, 24 aa, Staphylococcus aureus
PSNGFGGQPVTNSNVRANHSNSTV

SEQ ID NO: 1706458 - protein, 6 aa, Staphylococcus aureus
PSYGKF

SEQ ID NO: 1706459 - protein, 8 aa, Staphylococcus aureus
PTQMQNGD

SEQ ID NO: 1706460 - protein, 19 aa, Staphylococcus aureus
PTSANTNAFRPGGVNPLNE

SEQ ID NO: 1706461 - protein, 9 aa, Staphylococcus aureus
QAPKQTVAK

SEQ ID NO: 1706462 - protein, 4 aa, Staphylococcus aureus
QLQP

SEQ ID NO: 1706463 - protein, 9 aa, Staphylococcus aureus
QNKGEPMKS

SEQ ID NO: 1706464 - protein, 20 aa, Staphylococcus aureus
QPEVTKDKTTHVGERKGGPY

SEQ ID NO: 1706465 - protein, 16 aa, Staphylococcus aureus
QQQGLTADKYKENLRT

SEQ ID NO: 1706466 - protein, 10 aa, Staphylococcus aureus
QTHNTSDSKY

SEQ ID NO: 1706467 - protein, 7 aa, Staphylococcus aureus
RGIGERE

SEQ ID NO: 1706468 - protein, 4 aa, Staphylococcus aureus
RGIN

SEQ ID NO: 1706469 - protein, 7 aa, Staphylococcus aureus
RNAEEVG

SEQ ID NO: 1706470 - protein, 6 aa, Staphylococcus aureus
RNRSGQ

SEQ ID NO: 1706471 - protein, 4 aa, Staphylococcus aureus
RSAW

SEQ ID NO: 1706472 - protein, 6 aa, Staphylococcus aureus
RSHPYN

SEQ ID NO: 1706473 - protein, 14 aa, Staphylococcus aureus
SKAEPSETKAYINV

SEQ ID NO: 1706474 - protein, 7 aa, Staphylococcus aureus
SKTSKVI

SEQ ID NO: 1706475 - protein, 38 aa, Staphylococcus aureus
SNRASAVVSGEENPYKSESLKLNGKRSTTITSDKYEEN

SEQ ID NO: 1706476 - protein, 10 aa, Staphylococcus aureus
SSNPVTVDNH

SEQ ID NO: 1706477 - protein, 12 aa, Staphylococcus aureus
TALTGDEKQRIT

SEQ ID NO: 1706478 - protein, 12 aa, Staphylococcus aureus
TDAENKSEIPNH

SEQ ID NO: 1706479 - protein, 4 aa, Staphylococcus aureus
TGKV

SEQ ID NO: 1706480 - protein, 11 aa, Staphylococcus aureus
TGNLKGSSVGY

SEQ ID NO: 1706481 - protein, 13 aa, Staphylococcus aureus
TKDFPSGNSGVDI

SEQ ID NO: 1706482 - protein, 13 aa, Staphylococcus aureus
TKDFPSSNSGVDM

SEQ ID NO: 1706483 - protein, 14 aa, Staphylococcus aureus
TKGKTYEKEKNIQS

SEQ ID NO: 1706484 - protein, 9 aa, Staphylococcus aureus
TQKSDAVKA

SEQ ID NO: 1706485 - protein, 124 aa, Staphylococcus aureus; identical to SEQ ID NO: 1569600

SEQ ID NO: 1706486 - protein, 29 aa, Staphylococcus aureus
TTSTQPPKAPISFSSEAKAYNISENETNI

SEQ ID NO: 1706487 - protein, 81 aa, Staphylococcus aureus
TTTTQEANATTPSSTKVEAPQSTPPSTKVEAPQSKPNATTPPSTKVETPQQTPNATTPSSTKVETPQSPTTKQVPTEINPK

SEQ ID NO: 1706488 - protein, 8 aa, Staphylococcus aureus
VEGQENQL

SEQ ID NO: 1706489 - protein, 4 aa, Staphylococcus aureus
VKAS

SEQ ID NO: 1706490 - protein, 10 aa, Staphylococcus aureus
VKNDDNRNAY

SEQ ID NO: 1706491 - protein, 17 aa, Staphylococcus aureus
VKNYDGKYIGEHKKRNE

SEQ ID NO: 1706492 - protein, 23 aa, Staphylococcus aureus
VKPDPPRIDGNSVTYKAGLTNQQ

SEQ ID NO: 1706493 - protein, 12 aa, Staphylococcus aureus
VKTGSKANAERY

SEQ ID NO: 1706494 - protein, 14 aa, Staphylococcus aureus
VNANDSTDHGNFNG

SEQ ID NO: 1706495 - protein, 14 aa, Staphylococcus aureus
VNASEHEAKYENVT

SEQ ID NO: 1706496 - protein, 61 aa, Staphylococcus aureus
VQPKAANKTGNAQVNQKVDTTQVNGDTRATQSTTSNNAKPVTKSTNTTAPKTNNNVTSAGY

SEQ ID NO: 1706497 - protein, 18 aa, Staphylococcus aureus
VQSVQAKTEVKQQSESEL

SEQ ID NO: 1706498 - protein, 21 aa, Staphylococcus aureus
VQVSQNSKNLKAYYTQPSVEY

SEQ ID NO: 1706499 - protein, 10 aa, Staphylococcus aureus
YAPKNQNEEF

SEQ ID NO: 1706500 - protein, 23 aa, Staphylococcus aureus
YKDKLQEDKKGYASISKENISKY

SEQ ID NO: 1706501 - protein, 14 aa, Staphylococcus aureus
YKNKVNDKKIDEQI

SEQ ID NO: 1706502 - protein, 20 aa, Staphylococcus aureus
YNEVKTELENTELANNYKGK

SEQ ID NO: 1706503 - protein, 9 aa, Staphylococcus aureus
YNIPTDKSP

SEQ ID NO: 1706504 - protein, 11 aa, Staphylococcus aureus
YRDGSSTTLDA

SEQ ID NO: 1706505 - protein, 78 aa, Staphylococcus aureus
AANGQTAGFSNVAGADYTTSYNQGSDVQSVSYNAQSSNSNVEAVSAPTYHNYSTSTTSSSVRLSNGNTAGATGSSAAQ

SEQ ID NO: 1706506 - protein, 8 aa, Staphylococcus aureus
AGQTPVGR

SEQ ID NO: 1706507 - protein, 5 aa, Staphylococcus aureus
AHLPS

SEQ ID NO: 1706508 - protein, 12 aa, Staphylococcus aureus
AIKGNAEQSRSA

SEQ ID NO: 1706509 - protein, 16 aa, Staphylococcus aureus
AKSDVNQTPVGTGPYQ

SEQ ID NO: 1706510 - protein, 12 aa, Staphylococcus aureus
AKSNKPGELSNE

SEQ ID NO: 1706511 - protein, 16 aa, Staphylococcus aureus
ALNQAKQNLTADTHEL

SEQ ID NO: 1706512 - protein, 31 aa, Staphylococcus aureus
APWGTQSTTTPTTPSKPSTPSKPSTPSTGKL

SEQ ID NO: 1706513 - protein, 5 aa, Staphylococcus aureus
ASAIE

SEQ ID NO: 1706514 - protein, 12 aa, Staphylococcus aureus
ASPKVGQPAPKV

SEQ ID NO: 1706515 - protein, 10 aa, Staphylococcus aureus
AVKEGKAKIN

SEQ ID NO: 1706516 - protein, 12 aa, Staphylococcus aureus
DEHDTEISNSNI

SEQ ID NO: 1706517 - protein, 20 aa, Staphylococcus aureus
DKEGYRDDEFDKNDKGTWTI

SEQ ID NO: 1706518 - protein, 16 aa, Staphylococcus aureus
DKEGYRDGEFEKGDKG

SEQ ID NO: 1706519 - protein, 6 aa, Staphylococcus aureus
DKKPQR

SEQ ID NO: 1706520 - protein, 6 aa, Staphylococcus aureus
DNGTIH

SEQ ID NO: 1706521 - protein, 16 aa, Staphylococcus aureus
DNPDTWKNTVGNTHKT

SEQ ID NO: 1706522 - protein, 17 aa, Staphylococcus aureus
DSDSSLRSEDKGDDMST

SEQ ID NO: 1706523 - protein, 4 aa, Staphylococcus aureus
DSFN

SEQ ID NO: 1706524 - protein, 10 aa, Staphylococcus aureus
DSLSKSPENW

SEQ ID NO: 1706525 - protein, 18 aa, Staphylococcus aureus
EAAATGTGKGVLGDTKDI

SEQ ID NO: 1706526 - protein, 12 aa, Staphylococcus aureus
EAINKTQNVGYK

SEQ ID NO: 1706527 - protein, 18 aa, Staphylococcus aureus
EASAANVAGIAGTNNGIT

SEQ ID NO: 1706528 - protein, 67 aa, Staphylococcus aureus; identical to SEQ ID NO: 1626753

SEQ ID NO: 1706529 - protein, 8 aa, Staphylococcus aureus
EVPEADTH

SEQ ID NO: 1706530 - protein, 13 aa, Staphylococcus aureus
GDGDLKGSSIGSK

SEQ ID NO: 1706531 - protein, 11 aa, Staphylococcus aureus
GDNKKRLESSV

SEQ ID NO: 1706532 - protein, 10 aa, Staphylococcus aureus
GKLPDEKNYK

SEQ ID NO: 1706533 - protein, 21 aa, Staphylococcus aureus
GMKDNDKQGSNDNGSSKSPYH

SEQ ID NO: 1706534 - protein, 10 aa, Staphylococcus aureus
GNKPSGESTR

SEQ ID NO: 1706535 - protein, 14 aa, Staphylococcus aureus
GQARNTGERVSAED

SEQ ID NO: 1706536 - protein, 17 aa, Staphylococcus aureus
GRDGIRSNAIAPGTIET

SEQ ID NO: 1706537 - protein, 8 aa, Staphylococcus aureus
GTFNPADT

SEQ ID NO: 1706538 - protein, 4 aa, Staphylococcus aureus
GYKY

SEQ ID NO: 1706539 - protein, 11 aa, Staphylococcus aureus
HEKGSGDTSEF

SEQ ID NO: 1706540 - protein, 21 aa, Staphylococcus aureus
HGGATNKTQCSYGGVTLSDNN

SEQ ID NO: 1706541 - protein, 5 aa, Staphylococcus aureus
HSNDA

SEQ ID NO: 1706542 - protein, 47 aa, Staphylococcus aureus
IGDQTTDDGVTRIKDQGIQTLSGDTATPVVKPNAKQAIRDKAAKQRE

SEQ ID NO: 1706543 - protein, 9 aa, Staphylococcus aureus
ITGGSNNYT

SEQ ID NO: 1706544 - protein, 33 aa, Staphylococcus aureus; identical to SEQ ID NO: 1569000

SEQ ID NO: 1706545 - protein, 16 aa, Staphylococcus aureus
KEGFRDQEFDKGDKGT

SEQ ID NO: 1706546 - protein, 17 aa, Staphylococcus aureus
KEGFRDQEFEKGDKGNW

SEQ ID NO: 1706547 - protein, 6 aa, Staphylococcus aureus
KEGNDI

SEQ ID NO: 1706548 - protein, 16 aa, Staphylococcus aureus
KGEDKGKHQDNEKRYP

SEQ ID NO: 1706549 - protein, 8 aa, Staphylococcus aureus
KKATAREQ

SEQ ID NO: 1706550 - protein, 6 aa, Staphylococcus aureus
KKNDEI

SEQ ID NO: 1706551 - protein, 13 aa, Staphylococcus aureus
KKNYTKKSNSENV

SEQ ID NO: 1706552 - protein, 5 aa, Staphylococcus aureus
KNVDM

SEQ ID NO: 1706553 - protein, 28 aa, Staphylococcus aureus
KQNRPNSITKYDPTKHNFKEKSENKPNF

SEQ ID NO: 1706554 - protein, 7 aa, Staphylococcus aureus
KVPNIKN

SEQ ID NO: 1706555 - protein, 27 aa, Staphylococcus aureus
LAPLQAAKTQLQNDIDQPTSTTGMTSA

SEQ ID NO: 1706556 - protein, 57 aa, Staphylococcus aureus; identical to SEQ ID NO: 1627333

SEQ ID NO: 1706557 - protein, 17 aa, Staphylococcus aureus
LENYKDGEVTYNPEAPI

SEQ ID NO: 1706558 - protein, 8 aa, Staphylococcus aureus
LSAARTKI

SEQ ID NO: 1706559 - protein, 9 aa, Staphylococcus aureus
LYNGDYNKG

SEQ ID NO: 1706560 - protein, 21 aa, Staphylococcus aureus
LYNNSYNKGQIKITGADNNYT

SEQ ID NO: 1706561 - protein, 11 aa, Staphylococcus aureus
NANKSNSFNEQ

SEQ ID NO: 1706562 - protein, 27 aa, Staphylococcus aureus
NATPDATDDEKNAAINTLNQDRQQAIE

SEQ ID NO: 1706563 - protein, 11 aa, Staphylococcus aureus
NDERATPQQVN

SEQ ID NO: 1706564 - protein, 19 aa, Staphylococcus aureus
NENRNKGKLKITGGGNNYT

SEQ ID NO: 1706565 - protein, 10 aa, Staphylococcus aureus
NESAANGAGA

SEQ ID NO: 1706566 - protein, 36 aa, Staphylococcus aureus; identical to SEQ ID NO: 1569256

SEQ ID NO: 1706567 - protein, 10 aa, Staphylococcus aureus
NNSTHNAADA

SEQ ID NO: 1706568 - protein, 10 aa, Staphylococcus aureus
NQNTDNTNEA

SEQ ID NO: 1706569 - protein, 17 aa, Staphylococcus aureus
NRTGTTTGKKPASITAY

SEQ ID NO: 1706570 - protein, 39 aa, Staphylococcus aureus; identical to SEQ ID NO: 1568335

SEQ ID NO: 1706571 - protein, 11 aa, Staphylococcus aureus
NTTYGSGNTAV

SEQ ID NO: 1706572 - protein, 17 aa, Staphylococcus aureus
PGANQTVNTHAGNVTTY

SEQ ID NO: 1706573 - protein, 11 aa, Staphylococcus aureus
PIKKEDKQEVR

SEQ ID NO: 1706574 - protein, 18 aa, Staphylococcus aureus
PNLNADATTNTTPQIKGA

SEQ ID NO: 1706575 - protein, 17 aa, Staphylococcus aureus
QIDQDRSNAQVDKTATL

SEQ ID NO: 1706576 - protein, 11 aa, Staphylococcus aureus
QLKGDVKVKER

SEQ ID NO: 1706577 - protein, 19 aa, Staphylococcus aureus
QNRPSLSDNYTQPTTPNPI

SEQ ID NO: 1706578 - protein, 59 aa, Staphylococcus aureus; identical to SEQ ID NO: 1624622

SEQ ID NO: 1706579 - protein, 19 aa, Staphylococcus aureus
RNGSREEIEYQKKHGGEIS

SEQ ID NO: 1706580 - protein, 9 aa, Staphylococcus aureus
RYNHNSGVR

SEQ ID NO: 1706581 - protein, 10 aa, Staphylococcus aureus
SIQPNGKDMN

SEQ ID NO: 1706582 - protein, 13 aa, Staphylococcus aureus
SKSDFKSKNNNVS

SEQ ID NO: 1706583 - protein, 7 aa, Staphylococcus aureus
SKTNHGY

SEQ ID NO: 1706584 - protein, 22 aa, Staphylococcus aureus
SKVQNTIKTDIKQEDSNTHVYK

SEQ ID NO: 1706585 - protein, 20 aa, Staphylococcus aureus
SNDNSTSKQHVSISNQGIIT

SEQ ID NO: 1706586 - protein, 7 aa, Staphylococcus aureus
SVFEPDE

SEQ ID NO: 1706587 - protein, 31 aa, Staphylococcus aureus
TATSQSPHSPISMSSEAKAYNISESETNVNE

SEQ ID NO: 1706588 - protein, 17 aa, Staphylococcus aureus
TFTGGVTPVAKPSDKHY

SEQ ID NO: 1706589 - protein, 8 aa, Staphylococcus aureus
TNTSISPY

SEQ ID NO: 1706590 - protein, 34 aa, Staphylococcus aureus; identical to SEQ ID NO: 1569598

SEQ ID NO: 1706591 - protein, 33 aa, Staphylococcus aureus; identical to SEQ ID NO: 1569608

SEQ ID NO: 1706592 - protein, 11 aa, Staphylococcus aureus
TYTTQDEHGRA

SEQ ID NO: 1706593 - protein, 19 aa, Staphylococcus aureus
VASTIKDKDKKRSLEDKLD

SEQ ID NO: 1706594 - protein, 18 aa, Staphylococcus aureus
VATQGSGETISDEQRSDD

SEQ ID NO: 1706595 - protein, 10 aa, Staphylococcus aureus
VDSSAASKIV

SEQ ID NO: 1706596 - protein, 29 aa, Staphylococcus aureus
VGGITKTNSKKVDHKAELSVTKKDNQGMI

SEQ ID NO: 1706597 - protein, 12 aa, Staphylococcus aureus
VQPAKPTVTETA

SEQ ID NO: 1706598 - protein, 9 aa, Staphylococcus aureus
VSTEDTYKK

SEQ ID NO: 1706599 - protein, 19 aa, Staphylococcus aureus
VTAANATKTALDQARNGLT

SEQ ID NO: 1706600 - protein, 16 aa, Staphylococcus aureus
VTRNESVDSNDSASVH

SEQ ID NO: 1706601 - protein, 8 aa, Staphylococcus aureus
YKDKAGTF

SEQ ID NO: 1706602 - protein, 8 aa, Staphylococcus aureus
YKNQNTVT

SEQ ID NO: 1706603 - protein, 10 aa, Staphylococcus aureus
YNDSSTEEVQ

SEQ ID NO: 1706604 - protein, 5 aa, Staphylococcus aureus
AEAAT

SEQ ID NO: 1706605 - protein, 7 aa, Staphylococcus aureus
AIQKYGK

SEQ ID NO: 1706606 - protein, 56 aa, Staphylococcus aureus
ANEVKESGGPASGGSNYGNSNPELKKRVQETIKQEGKKISSDAVTASGSGLDPDIT

SEQ ID NO: 1706607 - protein, 41 aa, Staphylococcus aureus
ANQHKENNSKSNDTTKKTQETDNTTQSNTEKQMTPQEAEDI

SEQ ID NO: 1706608 - protein, 31 aa, Staphylococcus aureus
ASVDKTSNSTKTTDYKIENGETLKVPEKPKR

SEQ ID NO: 1706609 - protein, 6 aa, Staphylococcus aureus
AVNKDN

SEQ ID NO: 1706610 - protein, 14 aa, Staphylococcus aureus
CHGGETNKTQCSYG

SEQ ID NO: 1706611 - protein, 24 aa, Staphylococcus aureus
DDVEAPSDFAKLSDQSDLMRAEVS

SEQ ID NO: 1706612 - protein, 7 aa, Staphylococcus aureus
DKHINDN

SEQ ID NO: 1706613 - protein, 9 aa, Staphylococcus aureus
DKLPDRKNY

SEQ ID NO: 1706614 - protein, 7 aa, Staphylococcus aureus
DKSYDKD

SEQ ID NO: 1706615 - protein, 9 aa, Staphylococcus aureus
DKTDNENVK

SEQ ID NO: 1706616 - protein, 5 aa, Staphylococcus aureus
DPTYD

SEQ ID NO: 1706617 - protein, 6 aa, Staphylococcus aureus
DQNVQT

SEQ ID NO: 1706618 - protein, 6 aa, Staphylococcus aureus
DQVPVG

SEQ ID NO: 1706619 - protein, 6 aa, Staphylococcus aureus
DSMPYP

SEQ ID NO: 1706620 - protein, 7 aa, Staphylococcus aureus
DYREQLE

SEQ ID NO: 1706621 - protein, 12 aa, Staphylococcus aureus
EAINKTQNVGYQ

SEQ ID NO: 1706622 - protein, 5 aa, Staphylococcus aureus
EDKDM

SEQ ID NO: 1706623 - protein, 4 aa, Staphylococcus aureus
EEIS

SEQ ID NO: 1706624 - protein, 12 aa, Staphylococcus aureus
EKKVERKAPKLE

SEQ ID NO: 1706625 - protein, 16 aa, Staphylococcus aureus
FANPTDLENKKTNDRL

SEQ ID NO: 1706626 - protein, 5 aa, Staphylococcus aureus
FDPIS

SEQ ID NO: 1706627 - protein, 14 aa, Staphylococcus aureus
GENDVERVAKAKPD

SEQ ID NO: 1706628 - protein, 18 aa, Staphylococcus aureus
GKSDETKEDSKEEQIKKS

SEQ ID NO: 1706629 - protein, 39 aa, Staphylococcus aureus
GQAEASEANEKPSTNQESKVVSQTEQNSKETKTVESNKN

SEQ ID NO: 1706630 - protein, 4 aa, Staphylococcus aureus
GVST

SEQ ID NO: 1706631 - protein, 125 aa, Staphylococcus aureus
HSTSSSNNQEQENKSTHKKTETEENDQQDDSADKTDKNQNNGNNDTNDNQPSSPSNVPNNHSTVPSNTQPAQPKDSNSNKNNTHGGGSQSSTNNQNNQQQNTPPANKSNNTNTPSKQTPQAQSPK

SEQ ID NO: 1706632 - protein, 19 aa, Staphylococcus aureus
IDNGDATAQQISDEKHRVD

SEQ ID NO: 1706633 - protein, 18 aa, Staphylococcus aureus
INQNQTNDQVDATTNQAI

SEQ ID NO: 1706634 - protein, 14 aa, Staphylococcus aureus
IPTKDIKDENIKKE

SEQ ID NO: 1706635 - protein, 5 aa, Staphylococcus aureus
ITKKN

SEQ ID NO: 1706636 - protein, 26 aa, Staphylococcus aureus
KAENDPKKSAKDLKAYYDKGYKTDIT

SEQ ID NO: 1706637 - protein, 6 aa, Staphylococcus aureus
KDDKAY

SEQ ID NO: 1706638 - protein, 10 aa, Staphylococcus aureus
KDYGEHAKEL

SEQ ID NO: 1706639 - protein, 37 aa, Staphylococcus aureus
KEGGRQIGQFSSKDNDYNPPGYSTLPTVKADENGNVT

SEQ ID NO: 1706640 - protein, 5 aa, Staphylococcus aureus
KEIEH

SEQ ID NO: 1706641 - protein, 8 aa, Staphylococcus aureus
KGTTKYGK

SEQ ID NO: 1706642 - protein, 31 aa, Staphylococcus aureus; identical to SEQ ID NO: 1639180

SEQ ID NO: 1706643 - protein, 10 aa, Staphylococcus aureus
KPKVRRKRAA

SEQ ID NO: 1706644 - protein, 18 aa, Staphylococcus aureus
KQEVSPQTVKVTGGEEQL

SEQ ID NO: 1706645 - protein, 11 aa, Staphylococcus aureus
KQHTKSNKALN

SEQ ID NO: 1706646 - protein, 23 aa, Staphylococcus aureus
KQPEGDQRVYRTSTYDLTTDEIS

SEQ ID NO: 1706647 - protein, 9 aa, Staphylococcus aureus
KSKLDSKRL

SEQ ID NO: 1706648 - protein, 8 aa, Staphylococcus aureus
KSSNKNTN

SEQ ID NO: 1706649 - protein, 7 aa, Staphylococcus aureus
KTNDPNV

SEQ ID NO: 1706650 - protein, 12 aa, Staphylococcus aureus
KVDDETVQKFND

SEQ ID NO: 1706651 - protein, 22 aa, Staphylococcus aureus
LARASDYFSEAGATPATKAFGR

SEQ ID NO: 1706652 - protein, 5 aa, Staphylococcus aureus
LDSGK

SEQ ID NO: 1706653 - protein, 7 aa, Staphylococcus aureus
LPAQNSF

SEQ ID NO: 1706654 - protein, 7 aa, Staphylococcus aureus
NGNTVTE

SEQ ID NO: 1706655 - protein, 26 aa, Staphylococcus aureus
NMKEEQKKEANTNKTDSKEEKIKKSF

SEQ ID NO: 1706656 - protein, 12 aa, Staphylococcus aureus
NPETTNTASNIE

SEQ ID NO: 1706657 - protein, 8 aa, Staphylococcus aureus
NSRTTNGY

SEQ ID NO: 1706658 - protein, 9 aa, Staphylococcus aureus
NTKTTTGKY

SEQ ID NO: 1706659 - protein, 10 aa, Staphylococcus aureus
NYSDNTKSFD

SEQ ID NO: 1706660 - protein, 5 aa, Staphylococcus aureus
PYAGS

SEQ ID NO: 1706661 - protein, 13 aa, Staphylococcus aureus
QQTAKAEHNVTKI

SEQ ID NO: 1706662 - protein, 4 aa, Staphylococcus aureus
QSID

SEQ ID NO: 1706663 - protein, 22 aa, Staphylococcus aureus
QTSYTTTVGGTLASGTQASGYA

SEQ ID NO: 1706664 - protein, 13 aa, Staphylococcus aureus
QVNSAKNNLDGTR

SEQ ID NO: 1706665 - protein, 5 aa, Staphylococcus aureus
RGNKY

SEQ ID NO: 1706666 - protein, 16 aa, Staphylococcus aureus
RQDKGIHRDNEKKYPV

SEQ ID NO: 1706667 - protein, 8 aa, Staphylococcus aureus
SEAKANER

SEQ ID NO: 1706668 - protein, 10 aa, Staphylococcus aureus
SITDAQKNNL

SEQ ID NO: 1706669 - protein, 12 aa, Staphylococcus aureus
SKNQTKDIPKTV

SEQ ID NO: 1706670 - protein, 17 aa, Staphylococcus aureus
SKQNEKAQNKSVNPNEY

SEQ ID NO: 1706671 - protein, 21 aa, Staphylococcus aureus
SSSDTAEKAKEDSKEEQIKKS

SEQ ID NO: 1706672 - protein, 13 aa, Staphylococcus aureus
TAINDKSGTLASQ

SEQ ID NO: 1706673 - protein, 4 aa, Staphylococcus aureus
TIDH

SEQ ID NO: 1706674 - protein, 23 aa, Staphylococcus aureus
TISYTQKSYVSEVDKQNSKSVKW

SEQ ID NO: 1706675 - protein, 21 aa, Staphylococcus aureus
TKDYSKESRVNEKSKKGATVS

SEQ ID NO: 1706676 - protein, 17 aa, Staphylococcus aureus
TKYKGGDISYNPEAPIY

SEQ ID NO: 1706677 - protein, 18 aa, Staphylococcus aureus
TLGTPHNGTHASDLAGNE

SEQ ID NO: 1706678 - protein, 6 aa, Staphylococcus aureus
TLSGQY

SEQ ID NO: 1706679 - protein, 25 aa, Staphylococcus aureus
TQDAKNNVIPVSNGDHYQWYSSIYG

SEQ ID NO: 1706680 - protein, 16 aa, Staphylococcus aureus
TSLDGIKRDTKRWKDE

SEQ ID NO: 1706681 - protein, 10 aa, Staphylococcus aureus
TTATSDSDKL

SEQ ID NO: 1706682 - protein, 8 aa, Staphylococcus aureus
VESRNGMH

SEQ ID NO: 1706683 - protein, 9 aa, Staphylococcus aureus
VKLPKGKKP

SEQ ID NO: 1706684 - protein, 19 aa, Staphylococcus aureus
VKPAARQSVGVKAEAQNAL

SEQ ID NO: 1706685 - protein, 34 aa, Staphylococcus aureus; identical to SEQ ID NO: 1567793

SEQ ID NO: 1706686 - protein, 16 aa, Staphylococcus aureus
VTTHADGTATYGPRVT

SEQ ID NO: 1706687 - protein, 24 aa, Staphylococcus aureus
YDQNANKVTFTSQGVTTARGTHTK

SEQ ID NO: 1706688 - protein, 12 aa, Staphylococcus aureus
YGGVTKKNQGAY

SEQ ID NO: 1706689 - protein, 4 aa, Staphylococcus aureus
YYGK

SEQ ID NO: 1706690 - protein, 7 aa, Staphylococcus aureus
AAKKHDV

SEQ ID NO: 1706691 - protein, 7 aa, Staphylococcus aureus
ADNTPLN

SEQ ID NO: 1706692 - protein, 12 aa, Staphylococcus aureus
AFPEKSKDGKTL

SEQ ID NO: 1706693 - protein, 9 aa, Staphylococcus aureus
AGGTPNKTA

SEQ ID NO: 1706694 - protein, 6 aa, Staphylococcus aureus
AHLPSV

SEQ ID NO: 1706695 - protein, 12 aa, Staphylococcus aureus
AINKTQNNGYEN

SEQ ID NO: 1706696 - protein, 17 aa, Staphylococcus aureus
AITRPKEITKRFVQVME

SEQ ID NO: 1706697 - protein, 16 aa, Staphylococcus aureus
AKAANDTEDIGKGNDV

SEQ ID NO: 1706698 - protein, 11 aa, Staphylococcus aureus
ALGKEKEAEDL

SEQ ID NO: 1706699 - protein, 11 aa, Staphylococcus aureus
ANNEATDEEQN

SEQ ID NO: 1706700 - protein, 10 aa, Staphylococcus aureus
AREEWRKNDG

SEQ ID NO: 1706701 - protein, 6 aa, Staphylococcus aureus
ATPEQL

SEQ ID NO: 1706702 - protein, 4 aa, Staphylococcus aureus
CHTN

SEQ ID NO: 1706703 - protein, 24 aa, Staphylococcus aureus
CSNSNDNNESKKDDADNGKKQEIQ

SEQ ID NO: 1706704 - protein, 7 aa, Staphylococcus aureus
DAKNGFS

SEQ ID NO: 1706705 - protein, 4 aa, Staphylococcus aureus
DDIE

SEQ ID NO: 1706706 - protein, 20 aa, Staphylococcus aureus
DDKTRKDKKEIQSKIGQATA

SEQ ID NO: 1706707 - protein, 5 aa, Staphylococcus aureus
DESKH

SEQ ID NO: 1706708 - protein, 15 aa, Staphylococcus aureus
DGDISYNPEVPSYSA

SEQ ID NO: 1706709 - protein, 12 aa, Staphylococcus aureus
DHLTTKGSLSHD

SEQ ID NO: 1706710 - protein, 4 aa, Staphylococcus aureus
DKYT

SEQ ID NO: 1706711 - protein, 12 aa, Staphylococcus aureus
DQIGHSKKESYS

SEQ ID NO: 1706712 - protein, 6 aa, Staphylococcus aureus
DRDIKS

SEQ ID NO: 1706713 - protein, 18 aa, Staphylococcus aureus
EAAETGKGKGVLGDTKDI

SEQ ID NO: 1706714 - protein, 32 aa, Staphylococcus aureus; identical to SEQ ID NO: 1635913

SEQ ID NO: 1706715 - protein, 15 aa, Staphylococcus aureus
EDKNHDVQKNEKKYP

SEQ ID NO: 1706716 - protein, 16 aa, Staphylococcus aureus
EEKKIKNADISRKSND

SEQ ID NO: 1706717 - protein, 9 aa, Staphylococcus aureus
EESFEPTNI

SEQ ID NO: 1706718 - protein, 17 aa, Staphylococcus aureus
EETQQIANAEKNVTQVK

SEQ ID NO: 1706719 - protein, 6 aa, Staphylococcus aureus
EGNKPV

SEQ ID NO: 1706720 - protein, 10 aa, Staphylococcus aureus
ENKQASPMAD

SEQ ID NO: 1706721 - protein, 8 aa, Staphylococcus aureus
ENYNNGDV

SEQ ID NO: 1706722 - protein, 45 aa, Staphylococcus aureus
EVSSSSPDLGDDEEDEEVEESSTEKAGAEEESTDAKATYTTPRYE

SEQ ID NO: 1706723 - protein, 12 aa, Staphylococcus aureus
EVYNSKDPKYKK

SEQ ID NO: 1706724 - protein, 8 aa, Staphylococcus aureus
FDGDYKQN

SEQ ID NO: 1706725 - protein, 12 aa, Staphylococcus aureus
GISPIPVDEESV

SEQ ID NO: 1706726 - protein, 17 aa, Staphylococcus aureus
GNFNSGPSTGGNGSFNY

SEQ ID NO: 1706727 - protein, 4 aa, Staphylococcus aureus
GQDY

SEQ ID NO: 1706728 - protein, 11 aa, Staphylococcus aureus
GQKYDKEIDEV

SEQ ID NO: 1706729 - protein, 7 aa, Staphylococcus aureus
GTFNPAD

SEQ ID NO: 1706730 - protein, 7 aa, Staphylococcus aureus
GYSYGGD

SEQ ID NO: 1706731 - protein, 12 aa, Staphylococcus aureus
HATRRTTHYGNS

SEQ ID NO: 1706732 - protein, 19 aa, Staphylococcus aureus
IAPGANQTVNTHAGNVTTY

SEQ ID NO: 1706733 - protein, 9 aa, Staphylococcus aureus
INDKLTSKK

SEQ ID NO: 1706734 - protein, 6 aa, Staphylococcus aureus
ISEDAH

SEQ ID NO: 1706735 - protein, 7 aa, Staphylococcus aureus
ISKGENI

SEQ ID NO: 1706736 - protein, 14 aa, Staphylococcus aureus
ISVTNTPNGSNVST

SEQ ID NO: 1706737 - protein, 6 aa, Staphylococcus aureus
ISYNQQ

SEQ ID NO: 1706738 - protein, 17 aa, Staphylococcus aureus
ITSEGQAVQAKEKQERV

SEQ ID NO: 1706739 - protein, 12 aa, Staphylococcus aureus
KAKTENKESHDQ

SEQ ID NO: 1706740 - protein, 13 aa, Staphylococcus aureus
KAPLENAKNQLQH

SEQ ID NO: 1706741 - protein, 5 aa, Staphylococcus aureus
KDDFG

SEQ ID NO: 1706742 - protein, 11 aa, Staphylococcus aureus
KDFKKMSEAKY

SEQ ID NO: 1706743 - protein, 8 aa, Staphylococcus aureus
KDSNTKVS

SEQ ID NO: 1706744 - protein, 47 aa, Staphylococcus aureus; identical to SEQ ID NO: 1567490

SEQ ID NO: 1706745 - protein, 8 aa, Staphylococcus aureus
KERNIDAS

SEQ ID NO: 1706746 - protein, 21 aa, Staphylococcus aureus
KKYKDWTEHNQDQIKKGKTAQ

SEQ ID NO: 1706747 - protein, 11 aa, Staphylococcus aureus
KLTNNEDKAKK

SEQ ID NO: 1706748 - protein, 22 aa, Staphylococcus aureus
KNFVASEDKLNKIADPSAASKI

SEQ ID NO: 1706749 - protein, 8 aa, Staphylococcus aureus
KNQNISYK

SEQ ID NO: 1706750 - protein, 13 aa, Staphylococcus aureus
KNQNISYKDIENK

SEQ ID NO: 1706751 - protein, 7 aa, Staphylococcus aureus
KQNTVPL

SEQ ID NO: 1706752 - protein, 14 aa, Staphylococcus aureus
KQTGPNTAKTAVEQ

SEQ ID NO: 1706753 - protein, 5 aa, Staphylococcus aureus
KSSVD

SEQ ID NO: 1706754 - protein, 7 aa, Staphylococcus aureus
KTTYYNY

SEQ ID NO: 1706755 - protein, 20 aa, Staphylococcus aureus
KVAEANQAKDQLNTARQGLT

SEQ ID NO: 1706756 - protein, 4 aa, Staphylococcus aureus
LEGS

SEQ ID NO: 1706757 - protein, 9 aa, Staphylococcus aureus
LSAARTKIQ

SEQ ID NO: 1706758 - protein, 40 aa, Staphylococcus aureus; identical to SEQ ID NO: 1640481

SEQ ID NO: 1706759 - protein, 6 aa, Staphylococcus aureus
MSGHDP

SEQ ID NO: 1706760 - protein, 7 aa, Staphylococcus aureus
NAAPNHA

SEQ ID NO: 1706761 - protein, 11 aa, Staphylococcus aureus
NAVKEGKAKIN

SEQ ID NO: 1706762 - protein, 51 aa, Staphylococcus aureus
NDDQPNNPDNPDNPNNPDNPNNPDEPNNPDNPNNPDNPDNGDNNNSDNPDA

SEQ ID NO: 1706763 - protein, 10 aa, Staphylococcus aureus
NEPAANGAGA

SEQ ID NO: 1706764 - protein, 16 aa, Staphylococcus aureus
NIYSGYTKPNPKDTIS

SEQ ID NO: 1706765 - protein, 8 aa, Staphylococcus aureus
NKIDSVNV

SEQ ID NO: 1706766 - protein, 9 aa, Staphylococcus aureus
NNRLTEEKK

SEQ ID NO: 1706767 - protein, 58 aa, Staphylococcus aureus
NPNGAQALTTDNNVQSDTNQATPVNSQDKDVANNRGLANSAQNTPNQSATTNQATNQA

SEQ ID NO: 1706768 - protein, 10 aa, Staphylococcus aureus
NQNTGNTTDA

SEQ ID NO: 1706769 - protein, 4 aa, Staphylococcus aureus
NTDH

SEQ ID NO: 1706770 - protein, 6 aa, Staphylococcus aureus
NYDNQA

SEQ ID NO: 1706771 - protein, 12 aa, Staphylococcus aureus
PGSHDSGSFTLT

SEQ ID NO: 1706772 - protein, 8 aa, Staphylococcus aureus
PINQQDHK

SEQ ID NO: 1706773 - protein, 4 aa, Staphylococcus aureus
PTIP

SEQ ID NO: 1706774 - protein, 8 aa, Staphylococcus aureus
PYSQNPRD

SEQ ID NO: 1706775 - protein, 17 aa, Staphylococcus aureus
QQQGLTADKYKENLRTA

SEQ ID NO: 1706776 - protein, 22 aa, Staphylococcus aureus
QQTAKAENSVKQITNTNVAPYS

SEQ ID NO: 1706777 - protein, 4 aa, Staphylococcus aureus
RADA

SEQ ID NO: 1706778 - protein, 15 aa, Staphylococcus aureus
REGATDLNRKTSLNP

SEQ ID NO: 1706779 - protein, 5 aa, Staphylococcus aureus
RNRSG

SEQ ID NO: 1706780 - protein, 6 aa, Staphylococcus aureus
RQPALT

SEQ ID NO: 1706781 - protein, 23 aa, Staphylococcus aureus
SDLNQTQKNALTQQVNNAQNVQA

SEQ ID NO: 1706782 - protein, 12 aa, Staphylococcus aureus
SKQEVADTKSKV

SEQ ID NO: 1706783 - protein, 7 aa, Staphylococcus aureus
SKRENSH

SEQ ID NO: 1706784 - protein, 8 aa, Staphylococcus aureus
SKSKAGQI

SEQ ID NO: 1706785 - protein, 18 aa, Staphylococcus aureus
SNGLSGGGNGSKSFSETI

SEQ ID NO: 1706786 - protein, 17 aa, Staphylococcus aureus
SNRASAVVSGEKNPYVS

SEQ ID NO: 1706787 - protein, 14 aa, Staphylococcus aureus
SQSNGYKIGKPSLN

SEQ ID NO: 1706788 - protein, 5 aa, Staphylococcus aureus
STHAD

SEQ ID NO: 1706789 - protein, 17 aa, Staphylococcus aureus
STQFPNTPINSSSEAKA

SEQ ID NO: 1706790 - protein, 18 aa, Staphylococcus aureus
TAQKTHLTNQINSGTTVA

SEQ ID NO: 1706791 - protein, 4 aa, Staphylococcus aureus
THDD

SEQ ID NO: 1706792 - protein, 13 aa, Staphylococcus aureus
TKDFPSNNSGVDV

SEQ ID NO: 1706793 - protein, 13 aa, Staphylococcus aureus
TPFNDKTQNDTTL

SEQ ID NO: 1706794 - protein, 18 aa, Staphylococcus aureus
TSDRTIPTAQEVSQMNAG

SEQ ID NO: 1706795 - protein, 17 aa, Staphylococcus aureus
TSNDTLKKTEDKEKRYP

SEQ ID NO: 1706796 - protein, 21 aa, Staphylococcus aureus
TTYTTTVGGTLASGTQASGYA

SEQ ID NO: 1706797 - protein, 11 aa, Staphylococcus aureus
TVKTNKKNVTV

SEQ ID NO: 1706798 - protein, 8 aa, Staphylococcus aureus
TYGPNKDV

SEQ ID NO: 1706799 - protein, 33 aa, Staphylococcus aureus; identical to SEQ ID NO: 1567782

SEQ ID NO: 1706800 - protein, 9 aa, Staphylococcus aureus
VDKYKGKKV

SEQ ID NO: 1706801 - protein, 15 aa, Staphylococcus aureus
VQPAKPTVTETAAGA

SEQ ID NO: 1706802 - protein, 13 aa, Staphylococcus aureus
VSKESGNLAKSYA

SEQ ID NO: 1706803 - protein, 11 aa, Staphylococcus aureus
VTSRDDKNEIA

SEQ ID NO: 1706804 - protein, 14 aa, Staphylococcus aureus
WGPYGRDSYHSTYG

SEQ ID NO: 1706805 - protein, 13 aa, Staphylococcus aureus
YAAGTGHQAHAAE

SEQ ID NO: 1706806 - protein, 43 aa, Staphylococcus aureus
YDKNNTPNNNHQNQSRTNDNHQHANQRDLNNNQYHSSLSGQYT

SEQ ID NO: 1706807 - protein, 16 aa, Staphylococcus aureus
YKQESYRTSLDKRTNF

SEQ ID NO: 1706808 - protein, 10 aa, Staphylococcus aureus
YNDGSTEEVQ

SEQ ID NO: 1706809 - protein, 12 aa, Staphylococcus aureus
AAESHTVSTNPY

SEQ ID NO: 1706810 - protein, 4 aa, Staphylococcus aureus
APQV

SEQ ID NO: 1706811 - protein, 71 aa, Staphylococcus aureus
ATGTNGADMSAQAPATNNVAPSAVQANQVQSQEVEAPQNAQTQQPQASTSNNSQVTATPTESKSSEGSSVN

SEQ ID NO: 1706812 - protein, 7 aa, Staphylococcus aureus
AVTAANT

SEQ ID NO: 1706813 - protein, 8 aa, Staphylococcus aureus
DAQTGKVT

SEQ ID NO: 1706814 - protein, 7 aa, Staphylococcus aureus
DATLNDI

SEQ ID NO: 1706815 - protein, 6 aa, Staphylococcus aureus
DDGKHL

SEQ ID NO: 1706816 - protein, 18 aa, Staphylococcus aureus
DKEGYRDSEFKKSDKGTW

SEQ ID NO: 1706817 - protein, 16 aa, Staphylococcus aureus
DKNNPQNYQAKGNVAA

SEQ ID NO: 1706818 - protein, 11 aa, Staphylococcus aureus
DKYDENNPDMK

SEQ ID NO: 1706819 - protein, 9 aa, Staphylococcus aureus
DNLTKNNKG

SEQ ID NO: 1706820 - protein, 6 aa, Staphylococcus aureus
DPTKEY

SEQ ID NO: 1706821 - protein, 7 aa, Staphylococcus aureus
DQNVQTA

SEQ ID NO: 1706822 - protein, 16 aa, Staphylococcus aureus
EAQNSNQKKTNKVTNN

SEQ ID NO: 1706823 - protein, 13 aa, Staphylococcus aureus
EEKKIKNGNTDNL

SEQ ID NO: 1706824 - protein, 19 aa, Staphylococcus aureus
ENIQGAKDYHEGKTDHISG

SEQ ID NO: 1706825 - protein, 20 aa, Staphylococcus aureus
GDSRQATNYSIGGVTKSNSV

SEQ ID NO: 1706826 - protein, 12 aa, Staphylococcus aureus
GKDDKKYGEGVH

SEQ ID NO: 1706827 - protein, 4 aa, Staphylococcus aureus
GNKP

SEQ ID NO: 1706828 - protein, 13 aa, Staphylococcus aureus
GNVTGDDSGKIGG

SEQ ID NO: 1706829 - protein, 14 aa, Staphylococcus aureus
GQAPNKDNTRIGED

SEQ ID NO: 1706830 - protein, 5 aa, Staphylococcus aureus
GQSFN

SEQ ID NO: 1706831 - protein, 5 aa, Staphylococcus aureus
GSMSA

SEQ ID NO: 1706832 - protein, 13 aa, Staphylococcus aureus
GTANAEGKITPVS

SEQ ID NO: 1706833 - protein, 14 aa, Staphylococcus aureus
GVATKAGKDPKNDP

SEQ ID NO: 1706834 - protein, 12 aa, Staphylococcus aureus
HADAAENYTNYN

SEQ ID NO: 1706835 - protein, 12 aa, Staphylococcus aureus
HDLNTDKITVDA

SEQ ID NO: 1706836 - protein, 18 aa, Staphylococcus aureus
HLDDPVSTEGKKPGTITQ

SEQ ID NO: 1706837 - protein, 12 aa, Staphylococcus aureus
IDKNKAKNLKDK

SEQ ID NO: 1706838 - protein, 19 aa, Staphylococcus aureus
IDTQTSTTGMTQDSINAYN

SEQ ID NO: 1706839 - protein, 13 aa, Staphylococcus aureus
ISVTNTPNGANVS

SEQ ID NO: 1706840 - protein, 9 aa, Staphylococcus aureus
ITNPEKAKG

SEQ ID NO: 1706841 - protein, 9 aa, Staphylococcus aureus
KAAETTDGQ

SEQ ID NO: 1706842 - protein, 7 aa, Staphylococcus aureus
KGDASYT

SEQ ID NO: 1706843 - protein, 4 aa, Staphylococcus aureus
KGKY

SEQ ID NO: 1706844 - protein, 8 aa, Staphylococcus aureus
KGTSDKGR

SEQ ID NO: 1706845 - protein, 14 aa, Staphylococcus aureus
KKAPKVNVSNLADN

SEQ ID NO: 1706846 - protein, 7 aa, Staphylococcus aureus
KKQSEEF

SEQ ID NO: 1706847 - protein, 10 aa, Staphylococcus aureus
KLTAARNKIQ

SEQ ID NO: 1706848 - protein, 113 aa, Staphylococcus aureus
KNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREI

SEQ ID NO: 1706849 - protein, 14 aa, Staphylococcus aureus
KQSNLWKSKDNGFY

SEQ ID NO: 1706850 - protein, 12 aa, Staphylococcus aureus
KSRNLLKNRSQN

SEQ ID NO: 1706851 - protein, 31 aa, Staphylococcus aureus; identical to SEQ ID NO: 1640066

SEQ ID NO: 1706852 - protein, 5 aa, Staphylococcus aureus
LQTHR

SEQ ID NO: 1706853 - protein, 8 aa, Staphylococcus aureus
LTNDDYNV

SEQ ID NO: 1706854 - protein, 17 aa, Staphylococcus aureus
LTNNKNKSRTVEEYKKS

SEQ ID NO: 1706855 - protein, 9 aa, Staphylococcus aureus
MKKNDRNIQ

SEQ ID NO: 1706856 - protein, 72 aa, Staphylococcus aureus; identical to SEQ ID NO: 1640745

SEQ ID NO: 1706857 - protein, 57 aa, Staphylococcus aureus; identical to SEQ ID NO: 1640747

SEQ ID NO: 1706858 - protein, 7 aa, Staphylococcus aureus
NGLKQGQ

SEQ ID NO: 1706859 - protein, 17 aa, Staphylococcus aureus
NKQTTAQGVTTEKDNGI

SEQ ID NO: 1706860 - protein, 17 aa, Staphylococcus aureus
NKTINSENMHIDIYLYT

SEQ ID NO: 1706861 - protein, 8 aa, Staphylococcus aureus
NTKTTTGK

SEQ ID NO: 1706862 - protein, 11 aa, Staphylococcus aureus
NYKDENRATHT

SEQ ID NO: 1706863 - protein, 4 aa, Staphylococcus aureus
PEKF

SEQ ID NO: 1706864 - protein, 6 aa, Staphylococcus aureus
PFTTPE

SEQ ID NO: 1706865 - protein, 17 aa, Staphylococcus aureus
PHTPTITTTAEQLRGTA

SEQ ID NO: 1706866 - protein, 7 aa, Staphylococcus aureus
PINQQDH

SEQ ID NO: 1706867 - protein, 7 aa, Staphylococcus aureus
PQGTITG

SEQ ID NO: 1706868 - protein, 4 aa, Staphylococcus aureus
PTTF

SEQ ID NO: 1706869 - protein, 13 aa, Staphylococcus aureus
QHADAAENYTNYN

SEQ ID NO: 1706870 - protein, 16 aa, Staphylococcus aureus
QHPFNQAYTKATDKIQ

SEQ ID NO: 1706871 - protein, 6 aa, Staphylococcus aureus
QRAIEA

SEQ ID NO: 1706872 - protein, 10 aa, Staphylococcus aureus
RDGSSTTLDA

SEQ ID NO: 1706873 - protein, 9 aa, Staphylococcus aureus
RKATKQQTN

SEQ ID NO: 1706874 - protein, 5 aa, Staphylococcus aureus
RSLKE

SEQ ID NO: 1706875 - protein, 13 aa, Staphylococcus aureus
SDKDKFKDGENSN

SEQ ID NO: 1706876 - protein, 15 aa, Staphylococcus aureus
SDLKDFNNTEQHNAD

SEQ ID NO: 1706877 - protein, 21 aa, Staphylococcus aureus
SEELNEEEKKSSKRKYDDTLP

SEQ ID NO: 1706878 - protein, 19 aa, Staphylococcus aureus
SELNANKNTTKDKIKNEAV

SEQ ID NO: 1706879 - protein, 10 aa, Staphylococcus aureus
SEVEQQNSKS

SEQ ID NO: 1706880 - protein, 6 aa, Staphylococcus aureus
SHTPKR

SEQ ID NO: 1706881 - protein, 11 aa, Staphylococcus aureus
SINSDSNDSVN

SEQ ID NO: 1706882 - protein, 9 aa, Staphylococcus aureus
SKNGEKKSY

SEQ ID NO: 1706883 - protein, 14 aa, Staphylococcus aureus
SKNVARYESINGEN

SEQ ID NO: 1706884 - protein, 8 aa, Staphylococcus aureus
SSHFTDRD

SEQ ID NO: 1706885 - protein, 5 aa, Staphylococcus aureus
SSSDA

SEQ ID NO: 1706886 - protein, 13 aa, Staphylococcus aureus
STDPVTVDNNGNV

SEQ ID NO: 1706887 - protein, 7 aa, Staphylococcus aureus
STEPSVN

SEQ ID NO: 1706888 - protein, 13 aa, Staphylococcus aureus
STVKQSTKNYPPT

SEQ ID NO: 1706889 - protein, 7 aa, Staphylococcus aureus
SYYTKSS

SEQ ID NO: 1706890 - protein, 11 aa, Staphylococcus aureus
TAKSPVNVNQS

SEQ ID NO: 1706891 - protein, 29 aa, Staphylococcus aureus
TGATVAGNEVSAAEKDKLPATQKAKEMQN

SEQ ID NO: 1706892 - protein, 13 aa, Staphylococcus aureus
THTVSAHRKAQKA

SEQ ID NO: 1706893 - protein, 25 aa, Staphylococcus aureus
TTAQPVKASEQSRLSVTSNDTQELK

SEQ ID NO: 1706894 - protein, 10 aa, Staphylococcus aureus
TTATADSDKF

SEQ ID NO: 1706895 - protein, 19 aa, Staphylococcus aureus
TTESQTVKAAESTQGQHNY

SEQ ID NO: 1706896 - protein, 12 aa, Staphylococcus aureus
TTLPTDGGKPMK

SEQ ID NO: 1706897 - protein, 10 aa, Staphylococcus aureus
TYTTQDEHGQ

SEQ ID NO: 1706898 - protein, 10 aa, Staphylococcus aureus
VDNAKQQVKR

SEQ ID NO: 1706899 - protein, 17 aa, Staphylococcus aureus
VGGITKSNSKKVDHKAG

SEQ ID NO: 1706900 - protein, 9 aa, Staphylococcus aureus
VKNDDNRNA

SEQ ID NO: 1706901 - protein, 18 aa, Staphylococcus aureus
VKQTPNATDEEKQAAVNQ

SEQ ID NO: 1706902 - protein, 11 aa, Staphylococcus aureus
VRAAQTKIDQA

SEQ ID NO: 1706903 - protein, 10 aa, Staphylococcus aureus
YAAGTGHQAH

SEQ ID NO: 1706904 - protein, 12 aa, Staphylococcus aureus
YAKVPKDTQDYR

SEQ ID NO: 1706905 - protein, 17 aa, Staphylococcus aureus
YDKEGYRDGEFEKGDKG

SEQ ID NO: 1706906 - protein, 4 aa, Staphylococcus aureus
YQST

SEQ ID NO: 1706907 - protein, 9 aa, Staphylococcus aureus
YTGEEDWEK

SEQ ID NO: 1706908 - protein, 9 aa, Staphylococcus aureus
AESQTGHAK

SEQ ID NO: 1706909 - protein, 16 aa, Staphylococcus aureus
AFPGSKITVDNTKNTI

SEQ ID NO: 1706910 - protein, 14 aa, Staphylococcus aureus
AKEIEKTKDVSAQK

SEQ ID NO: 1706911 - protein, 6 aa, Staphylococcus aureus
ALPSGD

SEQ ID NO: 1706912 - protein, 11 aa, Staphylococcus aureus
AMDDSTKAKYK

SEQ ID NO: 1706913 - protein, 9 aa, Staphylococcus aureus
APAPYTFDK

SEQ ID NO: 1706914 - protein, 29 aa, Staphylococcus aureus
APWGTQSTTTPTTPSKPTTPSKPSTGKLT

SEQ ID NO: 1706915 - protein, 16 aa, Staphylococcus aureus
DALPNGGIKAKSSISM

SEQ ID NO: 1706916 - protein, 12 aa, Staphylococcus aureus
DDKNGKIQNGDT

SEQ ID NO: 1706917 - protein, 10 aa, Staphylococcus aureus
DENRNNVPLN

SEQ ID NO: 1706918 - protein, 9 aa, Staphylococcus aureus
DIPPTINNP

SEQ ID NO: 1706919 - protein, 7 aa, Staphylococcus aureus
DITKDSS

SEQ ID NO: 1706920 - protein, 17 aa, Staphylococcus aureus
DKEGYRDDEFDKNDKGT

SEQ ID NO: 1706921 - protein, 7 aa, Staphylococcus aureus
DLDNGNY

SEQ ID NO: 1706922 - protein, 7 aa, Staphylococcus aureus
DNRQTED

SEQ ID NO: 1706923 - protein, 21 aa, Staphylococcus aureus
DQHEHGEEHEHEGHDHEKEEH

SEQ ID NO: 1706924 - protein, 11 aa, Staphylococcus aureus
DRNKYKELTHG

SEQ ID NO: 1706925 - protein, 5 aa, Staphylococcus aureus
DSLHD

SEQ ID NO: 1706926 - protein, 16 aa, Staphylococcus aureus
DSPDTWKNTVGNTHKT

SEQ ID NO: 1706927 - protein, 7 aa, Staphylococcus aureus
DTDNQGY

SEQ ID NO: 1706928 - protein, 33 aa, Staphylococcus aureus; identical to SEQ ID NO: 1567374

SEQ ID NO: 1706929 - protein, 7 aa, Staphylococcus aureus
DYSTPLT

SEQ ID NO: 1706930 - protein, 7 aa, Staphylococcus aureus
EGTLAQD

SEQ ID NO: 1706931 - protein, 31 aa, Staphylococcus aureus
EITFTKDGKKHTGKYEYNGKKTLKYPKGNRG

SEQ ID NO: 1706932 - protein, 6 aa, Staphylococcus aureus
EKLSDV

SEQ ID NO: 1706933 - protein, 5 aa, Staphylococcus aureus
EKRYV

SEQ ID NO: 1706934 - protein, 13 aa, Staphylococcus aureus
EKTAKNGAKYADR

SEQ ID NO: 1706935 - protein, 12 aa, Staphylococcus aureus
EKVGNGAEHSKT

SEQ ID NO: 1706936 - protein, 7 aa, Staphylococcus aureus
ELDETQR

SEQ ID NO: 1706937 - protein, 9 aa, Staphylococcus aureus
ESTDTKKNI

SEQ ID NO: 1706938 - protein, 10 aa, Staphylococcus aureus
ESTQDHQQRL

SEQ ID NO: 1706939 - protein, 11 aa, Staphylococcus aureus
FKSKDLNIESS

SEQ ID NO: 1706940 - protein, 7 aa, Staphylococcus aureus
GFKGETV

SEQ ID NO: 1706941 - protein, 26 aa, Staphylococcus aureus
GKSSNKDEGVKDATKTEASKHKGGTL

SEQ ID NO: 1706942 - protein, 18 aa, Staphylococcus aureus
GNAGHEAQASEADLNKAS

SEQ ID NO: 1706943 - protein, 11 aa, Staphylococcus aureus
GQAEASENQNA

SEQ ID NO: 1706944 - protein, 11 aa, Staphylococcus aureus
GQKPAESPGVP

SEQ ID NO: 1706945 - protein, 7 aa, Staphylococcus aureus
GTPKSLT

SEQ ID NO: 1706946 - protein, 130 aa, Staphylococcus aureus
HSTSSNHNNEQDNKATHQKKDTEVNHQKDENTNNTNENQNNNNGVTNGNQSSTPSTVQNNGSTAPANTQPSNPNQSNSNQSNSNQGGSSQPSTNNQNHKQQNTPAPNKSNNANTNESSKQASPSQPQSSK

SEQ ID NO: 1706947 - protein, 24 aa, Staphylococcus aureus
HTDKGKGILDKEGTKVIKGKTKFA

SEQ ID NO: 1706948 - protein, 20 aa, Staphylococcus aureus
IDNGDATAQQISDEKHRVDN

SEQ ID NO: 1706949 - protein, 100 aa, Staphylococcus aureus
IDNLQKENKELKDKKEKLQQEKEKLADKQKDLEKEVKDLKPSKEDNKDDKKDEDKNKDKDKDKEASQDKQSKDQTKSSDKDNHKKPTSADKDQKANDKHQ

SEQ ID NO: 1706950 - protein, 100 aa, Staphylococcus aureus
IDNLQKENKELKDKKEKLQQEKEKLADKQKDLEKEVKDLKPSKEDNKDDKKDEDKNKDKDKDKEASQDKQSKDQTKSSDKDNHKKPTSTDKDQKANDKHQ

SEQ ID NO: 1706951 - protein, 14 aa, Staphylococcus aureus
IKPGDTSIQGTTLP

SEQ ID NO: 1706952 - protein, 4 aa, Staphylococcus aureus
INDP

SEQ ID NO: 1706953 - protein, 37 aa, Staphylococcus aureus
IQPATTTKDNAKEAIATKANERKTAIAQTQDITAEEI

SEQ ID NO: 1706954 - protein, 27 aa, Staphylococcus aureus
ISNQPHSIAKAEKNVKEITDATKEPYN

SEQ ID NO: 1706955 - protein, 17 aa, Staphylococcus aureus
ITNNGASYDDLPKHANT

SEQ ID NO: 1706956 - protein, 9 aa, Staphylococcus aureus
ITPDGATIT

SEQ ID NO: 1706957 - protein, 8 aa, Staphylococcus aureus
KASEITDS

SEQ ID NO: 1706958 - protein, 4 aa, Staphylococcus aureus
KDEN

SEQ ID NO: 1706959 - protein, 10 aa, Staphylococcus aureus
KDGEKQEIDL

SEQ ID NO: 1706960 - protein, 6 aa, Staphylococcus aureus
KDNEDV

SEQ ID NO: 1706961 - protein, 13 aa, Staphylococcus aureus
KDVSSVEDSDSSF

SEQ ID NO: 1706962 - protein, 6 aa, Staphylococcus aureus
KEAQSL

SEQ ID NO: 1706963 - protein, 65 aa, Staphylococcus aureus
KETREAVANADESWKTRTVKNYGESETKSPVVKEEKKVEEPQLPKVGNQQEDKITVGTTEEAPLP

SEQ ID NO: 1706964 - protein, 6 aa, Staphylococcus aureus
KGEQVG

SEQ ID NO: 1706965 - protein, 8 aa, Staphylococcus aureus
KGRLTKSF

SEQ ID NO: 1706966 - protein, 11 aa, Staphylococcus aureus
KITADGNNYTI

SEQ ID NO: 1706967 - protein, 12 aa, Staphylococcus aureus
KITNEQQKEFVN

SEQ ID NO: 1706968 - protein, 17 aa, Staphylococcus aureus
KKEKDEKSAEVETQTKA

SEQ ID NO: 1706969 - protein, 14 aa, Staphylococcus aureus
KKSNEVNPEFNKDK

SEQ ID NO: 1706970 - protein, 11 aa, Staphylococcus aureus
KLDAKNTWNSL

SEQ ID NO: 1706971 - protein, 13 aa, Staphylococcus aureus
KMAQEQEKLKEER

SEQ ID NO: 1706972 - protein, 6 aa, Staphylococcus aureus
KNTATF

SEQ ID NO: 1706973 - protein, 9 aa, Staphylococcus aureus
KPTQMQDGD

SEQ ID NO: 1706974 - protein, 7 aa, Staphylococcus aureus
KQAIEAN

SEQ ID NO: 1706975 - protein, 11 aa, Staphylococcus aureus
KQDKDTKAPIA

SEQ ID NO: 1706976 - protein, 11 aa, Staphylococcus aureus
KQSQARQTAED

SEQ ID NO: 1706977 - protein, 9 aa, Staphylococcus aureus
KRGIDPKKY

SEQ ID NO: 1706978 - protein, 26 aa, Staphylococcus aureus
KSDSEFSKELSNVKKQLKDKSKVSVT

SEQ ID NO: 1706979 - protein, 15 aa, Staphylococcus aureus
LDADESKRNAYTQAV

SEQ ID NO: 1706980 - protein, 10 aa, Staphylococcus aureus
LQEAARTRNP

SEQ ID NO: 1706981 - protein, 31 aa, Staphylococcus aureus; identical to SEQ ID NO: 1640442

SEQ ID NO: 1706982 - protein, 6 aa, Staphylococcus aureus
MLPEDT

SEQ ID NO: 1706983 - protein, 10 aa, Staphylococcus aureus
NAGIEGTVKG

SEQ ID NO: 1706984 - protein, 17 aa, Staphylococcus aureus
NDDTQNIAEKPFSKQAG

SEQ ID NO: 1706985 - protein, 13 aa, Staphylococcus aureus
NGIRPSTNRSVPS

SEQ ID NO: 1706986 - protein, 11 aa, Staphylococcus aureus
NGKTDKNRTKF

SEQ ID NO: 1706987 - protein, 19 aa, Staphylococcus aureus
NKAYADEIDKSKDFTRGYE

SEQ ID NO: 1706988 - protein, 16 aa, Staphylococcus aureus
NKQTGGNTSKADVDNA

SEQ ID NO: 1706989 - protein, 13 aa, Staphylococcus aureus
NNERATPQQVSDA

SEQ ID NO: 1706990 - protein, 8 aa, Staphylococcus aureus
NSDGTNVQ

SEQ ID NO: 1706991 - protein, 16 aa, Staphylococcus aureus
NSNSSHAKELNDLEKK

SEQ ID NO: 1706992 - protein, 4 aa, Staphylococcus aureus
NVYD

SEQ ID NO: 1706993 - protein, 6 aa, Staphylococcus aureus
NYEADD

SEQ ID NO: 1706994 - protein, 19 aa, Staphylococcus aureus
PEVTKDKTAHVGERKGGPY

SEQ ID NO: 1706995 - protein, 7 aa, Staphylococcus aureus
PQGYGSL

SEQ ID NO: 1706996 - protein, 39 aa, Staphylococcus aureus; identical to SEQ ID NO: 1565307

SEQ ID NO: 1706997 - protein, 6 aa, Staphylococcus aureus
PYAGSE

SEQ ID NO: 1706998 - protein, 6 aa, Staphylococcus aureus
PYGPKQ

SEQ ID NO: 1706999 - protein, 14 aa, Staphylococcus aureus
QDDNQNTTPVDKAE

SEQ ID NO: 1707000 - protein, 12 aa, Staphylococcus aureus
QEHGKEEVNGKA

SEQ ID NO: 1707001 - protein, 4 aa, Staphylococcus aureus
QENR

SEQ ID NO: 1707002 - protein, 42 aa, Staphylococcus aureus; identical to SEQ ID NO: 1568387

SEQ ID NO: 1707003 - protein, 9 aa, Staphylococcus aureus
QSINPENNH

SEQ ID NO: 1707004 - protein, 5 aa, Staphylococcus aureus
QYKDQ

SEQ ID NO: 1707005 - protein, 9 aa, Staphylococcus aureus
REGLPAKQD

SEQ ID NO: 1707006 - protein, 33 aa, Staphylococcus aureus
RGTEPEETGDVHDVNDRKGHGTMVSGQTSANGK

SEQ ID NO: 1707007 - protein, 12 aa, Staphylococcus aureus
RNKGKGEPSKLK

SEQ ID NO: 1707008 - protein, 27 aa, Staphylococcus aureus
RNLTQTNTSDDKVATITSGNKSTNVTV

SEQ ID NO: 1707009 - protein, 5 aa, Staphylococcus aureus
RQPAF

SEQ ID NO: 1707010 - protein, 9 aa, Staphylococcus aureus
RQSNLNAGQ

SEQ ID NO: 1707011 - protein, 13 aa, Staphylococcus aureus
RVNPNGNTIEAND

SEQ ID NO: 1707012 - protein, 23 aa, Staphylococcus aureus
SDLNQAQKNALTQQVNSAQNVQA

SEQ ID NO: 1707013 - protein, 17 aa, Staphylococcus aureus
SENSKKLKAYYNQPSIE

SEQ ID NO: 1707014 - protein, 7 aa, Staphylococcus aureus
SGAQVND

SEQ ID NO: 1707015 - protein, 11 aa, Staphylococcus aureus
SGDIKGSSVGY

SEQ ID NO: 1707016 - protein, 12 aa, Staphylococcus aureus
SIQQTANELNTA

SEQ ID NO: 1707017 - protein, 25 aa, Staphylococcus aureus
SKKDGSVVKDNQKEIEIKTDANGIA

SEQ ID NO: 1707018 - protein, 11 aa, Staphylococcus aureus
SKSNKPGEIDD

SEQ ID NO: 1707019 - protein, 9 aa, Staphylococcus aureus
SNASASEEL

SEQ ID NO: 1707020 - protein, 11 aa, Staphylococcus aureus
SNSTHNASDAV

SEQ ID NO: 1707021 - protein, 28 aa, Staphylococcus aureus
STIENESKKDRNTETNTETKSVPEEMEA

SEQ ID NO: 1707022 - protein, 9 aa, Staphylococcus aureus
STNSTQNNI

SEQ ID NO: 1707023 - protein, 10 aa, Staphylococcus aureus
TAVSNDEKQS

SEQ ID NO: 1707024 - protein, 15 aa, Staphylococcus aureus
TGTHSNYYSGPNAIT

SEQ ID NO: 1707025 - protein, 8 aa, Staphylococcus aureus
TGTPDGVH

SEQ ID NO: 1707026 - protein, 6 aa, Staphylococcus aureus
THGSGF

SEQ ID NO: 1707027 - protein, 11 aa, Staphylococcus aureus
TKFADGAKVKD

SEQ ID NO: 1707028 - protein, 9 aa, Staphylococcus aureus
TKTNSIEPI

SEQ ID NO: 1707029 - protein, 17 aa, Staphylococcus aureus
TNQTTNGGSEADQIPSG

SEQ ID NO: 1707030 - protein, 6 aa, Staphylococcus aureus
TQGPTV

SEQ ID NO: 1707031 - protein, 34 aa, Staphylococcus aureus; identical to SEQ ID NO: 1563881

SEQ ID NO: 1707032 - protein, 10 aa, Staphylococcus aureus
TVATHRKAQR

SEQ ID NO: 1707033 - protein, 15 aa, Staphylococcus aureus
TVSPSKIEDGGKTTV

SEQ ID NO: 1707034 - protein, 4 aa, Staphylococcus aureus
TWPG

SEQ ID NO: 1707035 - protein, 8 aa, Staphylococcus aureus
VERQTQQQ

SEQ ID NO: 1707036 - protein, 81 aa, Staphylococcus aureus; identical to SEQ ID NO: 1628068

SEQ ID NO: 1707037 - protein, 54 aa, Staphylococcus aureus
VTTHANGQVSYGARPTYKKPSETNAYNVTTNQDGTVSYGARPTQNKPSETNAYN

SEQ ID NO: 1707038 - protein, 9 aa, Staphylococcus aureus
WEGTQKVKP

SEQ ID NO: 1707039 - protein, 15 aa, Staphylococcus aureus
WPTSGTVKIEGYSKT

SEQ ID NO: 1707040 - protein, 18 aa, Staphylococcus aureus
YDKEGYRDGEFKKDDKGT

SEQ ID NO: 1707041 - protein, 17 aa, Staphylococcus aureus
YDKEGYRDGEFKKGDKG

SEQ ID NO: 1707042 - protein, 10 aa, Staphylococcus aureus
YGDPIYKEAK

SEQ ID NO: 1707043 - protein, 6 aa, Staphylococcus aureus
YGNVGS

SEQ ID NO: 1707044 - protein, 51 aa, Staphylococcus aureus
AGANSATTQAANTRQERTPKLEKAPNTNEEKTSASKIEKISQPKQEEQKTL

SEQ ID NO: 1707045 - protein, 14 aa, Staphylococcus aureus
AGNDGIDVNDKQKL

SEQ ID NO: 1707046 - protein, 6 aa, Staphylococcus aureus
AIANQG

SEQ ID NO: 1707047 - protein, 4 aa, Staphylococcus aureus
AKKA

SEQ ID NO: 1707048 - protein, 62 aa, Staphylococcus aureus
ATTQANSAHKDSQDQNKKEHVDKSQQKDKRNVTNKDKNSTAPDDIGKNGKITKRTETVYDEK

SEQ ID NO: 1707049 - protein, 14 aa, Staphylococcus aureus
CGNNQNENKYKSQI

SEQ ID NO: 1707050 - protein, 15 aa, Staphylococcus aureus
DALPNGEIKARSSIS

SEQ ID NO: 1707051 - protein, 6 aa, Staphylococcus aureus
DEKGEF

SEQ ID NO: 1707052 - protein, 13 aa, Staphylococcus aureus
DEKQEEKNHKNMA

SEQ ID NO: 1707053 - protein, 8 aa, Staphylococcus aureus
DGYTKEHP

SEQ ID NO: 1707054 - protein, 14 aa, Staphylococcus aureus
DHQTFRKDEKVEYD

SEQ ID NO: 1707055 - protein, 4 aa, Staphylococcus aureus
DKDM

SEQ ID NO: 1707056 - protein, 7 aa, Staphylococcus aureus
DKSSYND

SEQ ID NO: 1707057 - protein, 8 aa, Staphylococcus aureus
DKTRPNNI

SEQ ID NO: 1707058 - protein, 8 aa, Staphylococcus aureus
DRGIGERE

SEQ ID NO: 1707059 - protein, 17 aa, Staphylococcus aureus
DTIDGTKIKEINVELEY

SEQ ID NO: 1707060 - protein, 4 aa, Staphylococcus aureus
EDAL

SEQ ID NO: 1707061 - protein, 7 aa, Staphylococcus aureus
EKHPDKA

SEQ ID NO: 1707062 - protein, 8 aa, Staphylococcus aureus
ENKKEDLE

SEQ ID NO: 1707063 - protein, 10 aa, Staphylococcus aureus
EPKLTKQNIE

SEQ ID NO: 1707064 - protein, 21 aa, Staphylococcus aureus
FTDADQGKKDAYTNAVTNAQG

SEQ ID NO: 1707065 - protein, 4 aa, Staphylococcus aureus
FTQS

SEQ ID NO: 1707066 - protein, 14 aa, Staphylococcus aureus
GDGDLKGSSVGSRS

SEQ ID NO: 1707067 - protein, 7 aa, Staphylococcus aureus
GENLESR

SEQ ID NO: 1707068 - protein, 6 aa, Staphylococcus aureus
GGEFRS

SEQ ID NO: 1707069 - protein, 9 aa, Staphylococcus aureus
GGNNDKKVT

SEQ ID NO: 1707070 - protein, 13 aa, Staphylococcus aureus
GNRMVDEDATLND

SEQ ID NO: 1707071 - protein, 93 aa, Staphylococcus aureus
GQDSDQQKDGNKEKDDKAKTEQQDKKTNDSSKDKKDNKDDSKDVNKDNKDNSANDNQQQSNSNATNNDQNQTNNNQSSNNQANNNQKSSYVAP

SEQ ID NO: 1707072 - protein, 6 aa, Staphylococcus aureus
GQNNQW

SEQ ID NO: 1707073 - protein, 13 aa, Staphylococcus aureus
GTHPNSKLIESSN

SEQ ID NO: 1707074 - protein, 5 aa, Staphylococcus aureus
GTKKV

SEQ ID NO: 1707075 - protein, 5 aa, Staphylococcus aureus
GTRIP

SEQ ID NO: 1707076 - protein, 13 aa, Staphylococcus aureus
GTSKNNKPFSRYG

SEQ ID NO: 1707077 - protein, 18 aa, Staphylococcus aureus
GYSSSVSAPGNDDGGHLT

SEQ ID NO: 1707078 - protein, 28 aa, Staphylococcus aureus
IDDENATKQTQKYRDAEQSKKTAYDQAV

SEQ ID NO: 1707079 - protein, 19 aa, Staphylococcus aureus
IDPKTYVKEHQSDYKDIKV

SEQ ID NO: 1707080 - protein, 23 aa, Staphylococcus aureus
IEETPEQKADREFDEKLENTPAY

SEQ ID NO: 1707081 - protein, 25 aa, Staphylococcus aureus
IHSKDPSDEKVYGKVGDQDSNVKNR

SEQ ID NO: 1707082 - protein, 11 aa, Staphylococcus aureus
IIDKTDKETIK

SEQ ID NO: 1707083 - protein, 16 aa, Staphylococcus aureus
IKKDNPELKDFNEEEQ

SEQ ID NO: 1707084 - protein, 6 aa, Staphylococcus aureus
IKKTPV

SEQ ID NO: 1707085 - protein, 17 aa, Staphylococcus aureus
INSPKTITDNKYSEIQD

SEQ ID NO: 1707086 - protein, 8 aa, Staphylococcus aureus
IQNKGEAL

SEQ ID NO: 1707087 - protein, 10 aa, Staphylococcus aureus
IQQTAKAEHN

SEQ ID NO: 1707088 - protein, 14 aa, Staphylococcus aureus
KDEERKKKRATNQR

SEQ ID NO: 1707089 - protein, 10 aa, Staphylococcus aureus
KDIENTHDGT

SEQ ID NO: 1707090 - protein, 15 aa, Staphylococcus aureus
KEDIKAEKNADTNAI

SEQ ID NO: 1707091 - protein, 5 aa, Staphylococcus aureus
KEYPF

SEQ ID NO: 1707092 - protein, 23 aa, Staphylococcus aureus
KLEKERMGESIDGTKINKILVEM

SEQ ID NO: 1707093 - protein, 32 aa, Staphylococcus aureus; identical to SEQ ID NO: 1639374

SEQ ID NO: 1707094 - protein, 9 aa, Staphylococcus aureus
KNKPEKSTI

SEQ ID NO: 1707095 - protein, 19 aa, Staphylococcus aureus
KNYKDGDISYNPEVPSYSA

SEQ ID NO: 1707096 - protein, 5 aa, Staphylococcus aureus
KPSIE

SEQ ID NO: 1707097 - protein, 4 aa, Staphylococcus aureus
KQGG

SEQ ID NO: 1707098 - protein, 28 aa, Staphylococcus aureus
KQLAGLNGESHDFTTTHQSPTTSNHTHN

SEQ ID NO: 1707099 - protein, 8 aa, Staphylococcus aureus
KQNANTAI

SEQ ID NO: 1707100 - protein, 7 aa, Staphylococcus aureus
KSDRGIS

SEQ ID NO: 1707101 - protein, 53 aa, Staphylococcus aureus
KSKKSDKEGLDDKEAKQKAEEIQKEVSKDPSKFGEIAKKESMDTGSAKKDGEL

SEQ ID NO: 1707102 - protein, 7 aa, Staphylococcus aureus
KTHSIDP

SEQ ID NO: 1707103 - protein, 13 aa, Staphylococcus aureus
KTVPAGKYAKQYL

SEQ ID NO: 1707104 - protein, 6 aa, Staphylococcus aureus
LEDEPI

SEQ ID NO: 1707105 - protein, 32 aa, Staphylococcus aureus; identical to SEQ ID NO: 1640226

SEQ ID NO: 1707106 - protein, 52 aa, Staphylococcus aureus; identical to SEQ ID NO: 1632594

SEQ ID NO: 1707107 - protein, 16 aa, Staphylococcus aureus
LNNAQRQNLQSQINGA

SEQ ID NO: 1707108 - protein, 19 aa, Staphylococcus aureus
LNPEKLKQGGAQGGQSGMS

SEQ ID NO: 1707109 - protein, 18 aa, Staphylococcus aureus
LNRTGTTTGKKPASITAY

SEQ ID NO: 1707110 - protein, 51 aa, Staphylococcus aureus; identical to SEQ ID NO: 1565287

SEQ ID NO: 1707111 - protein, 4 aa, Staphylococcus aureus
LSKY

SEQ ID NO: 1707112 - protein, 4 aa, Staphylococcus aureus
LTSL

SEQ ID NO: 1707113 - protein, 23 aa, Staphylococcus aureus
NADIDNAAANNDVDNAKTTNEAT

SEQ ID NO: 1707114 - protein, 17 aa, Staphylococcus aureus
NAGHEAHASEADLNKAS

SEQ ID NO: 1707115 - protein, 9 aa, Staphylococcus aureus
NEKKYQYTG

SEQ ID NO: 1707116 - protein, 17 aa, Staphylococcus aureus
NHADKTAQVNQDSINAQ

SEQ ID NO: 1707117 - protein, 7 aa, Staphylococcus aureus
NHREEFS

SEQ ID NO: 1707118 - protein, 8 aa, Staphylococcus aureus
NIPTEKAP

SEQ ID NO: 1707119 - protein, 53 aa, Staphylococcus aureus
NITDSTQTKMDAYNEVKQAATARKAQNATVSNATNEEVAEADAAVDAAQKQGL

SEQ ID NO: 1707120 - protein, 7 aa, Staphylococcus aureus
NKKEDLE

SEQ ID NO: 1707121 - protein, 7 aa, Staphylococcus aureus
NKNEVED

SEQ ID NO: 1707122 - protein, 15 aa, Staphylococcus aureus
NKQTGSNSDKAAVDR

SEQ ID NO: 1707123 - protein, 17 aa, Staphylococcus aureus
NKQTTSQGVTTEKDNGI

SEQ ID NO: 1707124 - protein, 43 aa, Staphylococcus aureus
NKRNHGSTAVGKYSSFSGVARPGVQSKASAPKAWGGNKTFYSL

SEQ ID NO: 1707125 - protein, 17 aa, Staphylococcus aureus
NKTINSDKLHLDIYLFK

SEQ ID NO: 1707126 - protein, 14 aa, Staphylococcus aureus
NPESTNSASDIESK

SEQ ID NO: 1707127 - protein, 18 aa, Staphylococcus aureus
NQATTNDDVDTAKGDGLN

SEQ ID NO: 1707128 - protein, 6 aa, Staphylococcus aureus
NQENQN

SEQ ID NO: 1707129 - protein, 15 aa, Staphylococcus aureus
NQSGYKEEGKVTFTP

SEQ ID NO: 1707130 - protein, 10 aa, Staphylococcus aureus
NSGGIVSSEP

SEQ ID NO: 1707131 - protein, 14 aa, Staphylococcus aureus
NSKDINKIEVTLKQ

SEQ ID NO: 1707132 - protein, 14 aa, Staphylococcus aureus
NSKDIRGISVTINQ

SEQ ID NO: 1707133 - protein, 39 aa, Staphylococcus aureus; identical to SEQ ID NO: 1565449

SEQ ID NO: 1707134 - protein, 11 aa, Staphylococcus aureus
NTVTEQPVHAE

SEQ ID NO: 1707135 - protein, 9 aa, Staphylococcus aureus
NYAKKKKSI

SEQ ID NO: 1707136 - protein, 4 aa, Staphylococcus aureus
NYNL

SEQ ID NO: 1707137 - protein, 48 aa, Staphylococcus aureus
PQVTHKQAARDAINQATATKRQQINSNREATQEEKNAALNELTQATNH

SEQ ID NO: 1707138 - protein, 9 aa, Staphylococcus aureus
QAANDGNQV

SEQ ID NO: 1707139 - protein, 6 aa, Staphylococcus aureus
QETHKE

SEQ ID NO: 1707140 - protein, 10 aa, Staphylococcus aureus
QKHSNSDNKY

SEQ ID NO: 1707141 - protein, 12 aa, Staphylococcus aureus
QNGINDQNTVKQ

SEQ ID NO: 1707142 - protein, 4 aa, Staphylococcus aureus
QSFN

SEQ ID NO: 1707143 - protein, 17 aa, Staphylococcus aureus
QSGPSLSNNYTNPPLTN

SEQ ID NO: 1707144 - protein, 11 aa, Staphylococcus aureus
QYQLTNDDYNV

SEQ ID NO: 1707145 - protein, 8 aa, Staphylococcus aureus
REEWRKND

SEQ ID NO: 1707146 - protein, 19 aa, Staphylococcus aureus
RIGTTKRVEVSQGNVQTKK

SEQ ID NO: 1707147 - protein, 66 aa, Staphylococcus aureus
SAAKPAALETQYKTAAPKAATTSAPKAKTEATPKVTTFSASAQPRSVAATPKTSLPKYKPQVNSSI

SEQ ID NO: 1707148 - protein, 22 aa, Staphylococcus aureus
SAPTKKPTSPTTYTETTTQVPM

SEQ ID NO: 1707149 - protein, 33 aa, Staphylococcus aureus
SEIKQVSEKNLDGDTKMYTRTATTSDSQKNITQ

SEQ ID NO: 1707150 - protein, 14 aa, Staphylococcus aureus
SGKKDNAVSDKTVR

SEQ ID NO: 1707151 - protein, 32 aa, Staphylococcus aureus; identical to SEQ ID NO: 1564439

SEQ ID NO: 1707152 - protein, 37 aa, Staphylococcus aureus
SIYSSDSSSPVSGKVGEGVTSGGENTLTKRFINKITI

SEQ ID NO: 1707153 - protein, 13 aa, Staphylococcus aureus
SKKHKDKIAKRGE

SEQ ID NO: 1707154 - protein, 14 aa, Staphylococcus aureus
SLKDNYNNKLDKTY

SEQ ID NO: 1707155 - protein, 13 aa, Staphylococcus aureus
SNNATVSQADQTT

SEQ ID NO: 1707156 - protein, 7 aa, Staphylococcus aureus
SPYGPKQ

SEQ ID NO: 1707157 - protein, 27 aa, Staphylococcus aureus
STGANFNNNEASAAAKPLDKSSSSLHH

SEQ ID NO: 1707158 - protein, 34 aa, Staphylococcus aureus; identical to SEQ ID NO: 1565776

SEQ ID NO: 1707159 - protein, 12 aa, Staphylococcus aureus
TGNEKQNFGEDI

SEQ ID NO: 1707160 - protein, 10 aa, Staphylococcus aureus
TKDSKGSSIK

SEQ ID NO: 1707161 - protein, 18 aa, Staphylococcus aureus
TNANGGPNKEEAKSGSEG

SEQ ID NO: 1707162 - protein, 9 aa, Staphylococcus aureus
TNVVGSGKG

SEQ ID NO: 1707163 - protein, 4 aa, Staphylococcus aureus
TPGH

SEQ ID NO: 1707164 - protein, 6 aa, Staphylococcus aureus
TQAESY

SEQ ID NO: 1707165 - protein, 9 aa, Staphylococcus aureus
TSLATPKVS

SEQ ID NO: 1707166 - protein, 8 aa, Staphylococcus aureus
TTANNGRY

SEQ ID NO: 1707167 - protein, 23 aa, Staphylococcus aureus
TTAQPVKASTLEVRSQATQDLSE

SEQ ID NO: 1707168 - protein, 5 aa, Staphylococcus aureus
TTNKG

SEQ ID NO: 1707169 - protein, 28 aa, Staphylococcus aureus
VDNQEKQNNVNQAVQPQNNTNETSKVPA

SEQ ID NO: 1707170 - protein, 10 aa, Staphylococcus aureus
VEPGNSGSAV

SEQ ID NO: 1707171 - protein, 12 aa, Staphylococcus aureus
VGSTDQKSNLSE

SEQ ID NO: 1707172 - protein, 5 aa, Staphylococcus aureus
VIKEN

SEQ ID NO: 1707173 - protein, 23 aa, Staphylococcus aureus
VKPDPPRIDANSVTYKAGLTNQE

SEQ ID NO: 1707174 - protein, 13 aa, Staphylococcus aureus
VKTAKAEEKMTDG

SEQ ID NO: 1707175 - protein, 44 aa, Staphylococcus aureus
VSSPAANALSSKAMDNHPQQTQSSKQQTPKIQKGGNLKPLEQRE

SEQ ID NO: 1707176 - protein, 17 aa, Staphylococcus aureus
VTASDSSDNGNVQHDRN

SEQ ID NO: 1707177 - protein, 10 aa, Staphylococcus aureus
YDIPTSKAPK

SEQ ID NO: 1707178 - protein, 25 aa, Staphylococcus aureus
YDKYDEKNDAMKKKFDATEKEAEKL

SEQ ID NO: 1707179 - protein, 5 aa, Staphylococcus aureus
YDTNG

SEQ ID NO: 1707180 - protein, 22 aa, Staphylococcus aureus
YESPEEKADREFDERMENTPAY

SEQ ID NO: 1707181 - protein, 4 aa, Staphylococcus aureus
YPNE

SEQ ID NO: 1707182 - protein, 6 aa, Staphylococcus aureus
AAQNHA

SEQ ID NO: 1707183 - protein, 6 aa, Staphylococcus aureus
AKEEGL

SEQ ID NO: 1707184 - protein, 11 aa, Staphylococcus aureus
AKHDLTADTHA

SEQ ID NO: 1707185 - protein, 10 aa, Staphylococcus aureus
AKKDSAEFKK

SEQ ID NO: 1707186 - protein, 11 aa, Staphylococcus aureus
AKQNANTAIDG

SEQ ID NO: 1707187 - protein, 20 aa, Staphylococcus aureus
AMRNPKTTLNTDENKKKVKD

SEQ ID NO: 1707188 - protein, 27 aa, Staphylococcus aureus
ANAADSDINIKTGTTDIGSNTTVKTGD

SEQ ID NO: 1707189 - protein, 9 aa, Staphylococcus aureus
APGDKFDQS

SEQ ID NO: 1707190 - protein, 28 aa, Staphylococcus aureus
APKPLAGLNGESHDFTTTHQSPTTSNHT

SEQ ID NO: 1707191 - protein, 7 aa, Staphylococcus aureus
AQGQYSN

SEQ ID NO: 1707192 - protein, 29 aa, Staphylococcus aureus
ARDAVKQQYEAKKREIEQAEHATDEEKQV

SEQ ID NO: 1707193 - protein, 4 aa, Staphylococcus aureus
ASYM

SEQ ID NO: 1707194 - protein, 26 aa, Staphylococcus aureus
AYGKEPDKKVKELSENFTKTTGKNTN

SEQ ID NO: 1707195 - protein, 86 aa, Staphylococcus aureus
CGEKEKPKKEENKKSQTQKHKDSKPKTQQEKMKKVEDKNPPNNSIQNNSNNQNQSQNNQLNNNSDPSNNTPANINKNDSQNTNLND

SEQ ID NO: 1707196 - protein, 15 aa, Staphylococcus aureus
DDKQTTNSDNQENNS

SEQ ID NO: 1707197 - protein, 10 aa, Staphylococcus aureus
DEDDNENDRQ

SEQ ID NO: 1707198 - protein, 13 aa, Staphylococcus aureus
DEERANKKAVNKR

SEQ ID NO: 1707199 - protein, 18 aa, Staphylococcus aureus
DGDNKIIGDSKEEQIKKS

SEQ ID NO: 1707200 - protein, 24 aa, Staphylococcus aureus
DIKDKNSDLKTFNAAEEDKATKEV

SEQ ID NO: 1707201 - protein, 5 aa, Staphylococcus aureus
DKNYS

SEQ ID NO: 1707202 - protein, 11 aa, Staphylococcus aureus
DKQKNKKTPVV

SEQ ID NO: 1707203 - protein, 23 aa, Staphylococcus aureus
DKYDENNPDMKKKFDATEKEATN

SEQ ID NO: 1707204 - protein, 24 aa, Staphylococcus aureus
DNKINTVKPNFNGESTSEYGVFDQ

SEQ ID NO: 1707205 - protein, 11 aa, Staphylococcus aureus
DPNTDTKESLA

SEQ ID NO: 1707206 - protein, 20 aa, Staphylococcus aureus
DSNGKELDRTTTDENGKYQF

SEQ ID NO: 1707207 - protein, 10 aa, Staphylococcus aureus
DYKARGVNEY

SEQ ID NO: 1707208 - protein, 17 aa, Staphylococcus aureus
EDSEGKVYSDERKYPVK

SEQ ID NO: 1707209 - protein, 15 aa, Staphylococcus aureus
EEKKIKNRNTNTSNY

SEQ ID NO: 1707210 - protein, 16 aa, Staphylococcus aureus
EGNFPVQGRSVKSTLH

SEQ ID NO: 1707211 - protein, 29 aa, Staphylococcus aureus
EGSDKSAITTSIGGITKTNGTQHKDTVQN

SEQ ID NO: 1707212 - protein, 7 aa, Staphylococcus aureus
EKKKLQR

SEQ ID NO: 1707213 - protein, 11 aa, Staphylococcus aureus
EKYEEPEYEKA

SEQ ID NO: 1707214 - protein, 11 aa, Staphylococcus aureus
ELPNTGSEEMD

SEQ ID NO: 1707215 - protein, 9 aa, Staphylococcus aureus
ESTQDYQQR

SEQ ID NO: 1707216 - protein, 13 aa, Staphylococcus aureus
ETLETNSSHMTRT

SEQ ID NO: 1707217 - protein, 31 aa, Staphylococcus aureus; identical to SEQ ID NO: 1563555

SEQ ID NO: 1707218 - protein, 13 aa, Staphylococcus aureus
FDKDGEDKATKEV

SEQ ID NO: 1707219 - protein, 33 aa, Staphylococcus aureus
FHESKADNNIENIGDGAEVVKRTEDTSSDKWGV

SEQ ID NO: 1707220 - protein, 27 aa, Staphylococcus aureus
GAESDTANESKVQDIQGNPVSLPNEKP

SEQ ID NO: 1707221 - protein, 12 aa, Staphylococcus aureus
GDKDYGEHAKEL

SEQ ID NO: 1707222 - protein, 6 aa, Staphylococcus aureus
GEYAKA

SEQ ID NO: 1707223 - protein, 7 aa, Staphylococcus aureus
GGKSGAM

SEQ ID NO: 1707224 - protein, 14 aa, Staphylococcus aureus
GGLSKTNSKEFSKE

SEQ ID NO: 1707225 - protein, 8 aa, Staphylococcus aureus
GKEIADTY

SEQ ID NO: 1707226 - protein, 9 aa, Staphylococcus aureus
GKLPDEKNY

SEQ ID NO: 1707227 - protein, 58 aa, Staphylococcus aureus; identical to SEQ ID NO: 1637458

SEQ ID NO: 1707228 - protein, 21 aa, Staphylococcus aureus
GNQMTSDAFAEGGNSGSPVFN

SEQ ID NO: 1707229 - protein, 32 aa, Staphylococcus aureus; identical to SEQ ID NO: 1565237

SEQ ID NO: 1707230 - protein, 11 aa, Staphylococcus aureus
HGAGAGANKPL

SEQ ID NO: 1707231 - protein, 44 aa, Staphylococcus aureus; identical to SEQ ID NO: 1637959

SEQ ID NO: 1707232 - protein, 11 aa, Staphylococcus aureus
IEEINNKNPVL

SEQ ID NO: 1707233 - protein, 12 aa, Staphylococcus aureus
IEKYPQGEHDKQ

SEQ ID NO: 1707234 - protein, 6 aa, Staphylococcus aureus
IHRQNK

SEQ ID NO: 1707235 - protein, 8 aa, Staphylococcus aureus
IKDGDLDS

SEQ ID NO: 1707236 - protein, 12 aa, Staphylococcus aureus
INATNNPNMDAN

SEQ ID NO: 1707237 - protein, 45 aa, Staphylococcus aureus
IPNHDKAAPTSTTPPSNDKTAPKSTKAQDATTDKHPNQQDTHQPA

SEQ ID NO: 1707238 - protein, 73 aa, Staphylococcus aureus
IQTQAKVKPAADTEVENAYNTRKQEIQNSNASTTEEKQAAYTELDTKKQEARTNLDAANTNSDVTTAKDNSIA

SEQ ID NO: 1707239 - protein, 18 aa, Staphylococcus aureus
KDNDGKSLKASSLTLDTK

SEQ ID NO: 1707240 - protein, 24 aa, Staphylococcus aureus
KDTDDKKSSKTFVGGTKVDDQHAS

SEQ ID NO: 1707241 - protein, 15 aa, Staphylococcus aureus
KEGFRDQEFDKRDKG

SEQ ID NO: 1707242 - protein, 11 aa, Staphylococcus aureus
KENFTKDNTVD

SEQ ID NO: 1707243 - protein, 4 aa, Staphylococcus aureus
KGLS

SEQ ID NO: 1707244 - protein, 8 aa, Staphylococcus aureus
KKENPRTD

SEQ ID NO: 1707245 - protein, 10 aa, Staphylococcus aureus
KKLEDGTTKV

SEQ ID NO: 1707246 - protein, 8 aa, Staphylococcus aureus
KKSQYEDY

SEQ ID NO: 1707247 - protein, 24 aa, Staphylococcus aureus
KLTDTNRYVKNPRNAEIEVILEKS

SEQ ID NO: 1707248 - protein, 8 aa, Staphylococcus aureus
KNDATKKS

SEQ ID NO: 1707249 - protein, 16 aa, Staphylococcus aureus
KNDKDGRPQENEKRYP

SEQ ID NO: 1707250 - protein, 17 aa, Staphylococcus aureus
KPAARQSVSAKAEAQNA

SEQ ID NO: 1707251 - protein, 18 aa, Staphylococcus aureus
KPAARQSVSAKAEAQNAL

SEQ ID NO: 1707252 - protein, 8 aa, Staphylococcus aureus
KPTINTKK

SEQ ID NO: 1707253 - protein, 50 aa, Staphylococcus aureus
KPVNDKSYTGWTSDGHTGEDVNTYAYGPRSESFSGNIENTESAKIIFDIF

SEQ ID NO: 1707254 - protein, 10 aa, Staphylococcus aureus
KQAPKQAVTK

SEQ ID NO: 1707255 - protein, 7 aa, Staphylococcus aureus
KQDYGGD

SEQ ID NO: 1707256 - protein, 29 aa, Staphylococcus aureus
KQNRPKSITKYNPTTHNYKTNSDNKPNFD

SEQ ID NO: 1707257 - protein, 7 aa, Staphylococcus aureus
KSEDYYG

SEQ ID NO: 1707258 - protein, 13 aa, Staphylococcus aureus
KTNGRNAQIKENF

SEQ ID NO: 1707259 - protein, 5 aa, Staphylococcus aureus
KVTDK

SEQ ID NO: 1707260 - protein, 27 aa, Staphylococcus aureus
LAPLQTAKTQLQNDIDQPTSTTGMTSA

SEQ ID NO: 1707261 - protein, 4 aa, Staphylococcus aureus
LNPN

SEQ ID NO: 1707262 - protein, 20 aa, Staphylococcus aureus
LNTPQKAKLKEQVGQANRLE

SEQ ID NO: 1707263 - protein, 8 aa, Staphylococcus aureus
MKTESGRK

SEQ ID NO: 1707264 - protein, 25 aa, Staphylococcus aureus
NDKEFKEGMEQARKEVNYAANTDTV

SEQ ID NO: 1707265 - protein, 7 aa, Staphylococcus aureus
NDPDRSH

SEQ ID NO: 1707266 - protein, 4 aa, Staphylococcus aureus
NDTF

SEQ ID NO: 1707267 - protein, 12 aa, Staphylococcus aureus
NGIQDQNTIKQG

SEQ ID NO: 1707268 - protein, 9 aa, Staphylococcus aureus
NGNKNQALQ

SEQ ID NO: 1707269 - protein, 16 aa, Staphylococcus aureus
NKNSGSNLDKAAVENA

SEQ ID NO: 1707270 - protein, 12 aa, Staphylococcus aureus
NLPENDKNGKTI

SEQ ID NO: 1707271 - protein, 25 aa, Staphylococcus aureus
NMKDEQKKEEQTNKTDSKEEQIKKS

SEQ ID NO: 1707272 - protein, 23 aa, Staphylococcus aureus
NSDRSGNTASIGGITKTNGSNYI

SEQ ID NO: 1707273 - protein, 7 aa, Staphylococcus aureus
NSRTCTG

SEQ ID NO: 1707274 - protein, 31 aa, Staphylococcus aureus; identical to SEQ ID NO: 1567635

SEQ ID NO: 1707275 - protein, 8 aa, Staphylococcus aureus
NTKTTKGY

SEQ ID NO: 1707276 - protein, 8 aa, Staphylococcus aureus
NVIGSGDG

SEQ ID NO: 1707277 - protein, 29 aa, Staphylococcus aureus
NWKGTNTKDKWIDRSSERYKIDWEKEEMT

SEQ ID NO: 1707278 - protein, 39 aa, Staphylococcus aureus; identical to SEQ ID NO: 1622449

SEQ ID NO: 1707279 - protein, 35 aa, Staphylococcus aureus; identical to SEQ ID NO: 1633061

SEQ ID NO: 1707280 - protein, 35 aa, Staphylococcus aureus
PGWTKDEQAKAFEEYKKGKEEEARAGASAVPGANI

SEQ ID NO: 1707281 - protein, 9 aa, Staphylococcus aureus
PKGKNMESR

SEQ ID NO: 1707282 - protein, 4 aa, Staphylococcus aureus
PNNK

SEQ ID NO: 1707283 - protein, 5 aa, Staphylococcus aureus
PSFDD

SEQ ID NO: 1707284 - protein, 24 aa, Staphylococcus aureus
PSNGYGGQPVTNSNTRANHSNSTV

SEQ ID NO: 1707285 - protein, 31 aa, Staphylococcus aureus
PTTFKAGSYGSEKGADPQPNTPDDHTPPNQN

SEQ ID NO: 1707286 - protein, 26 aa, Staphylococcus aureus
QAATTKKSDAKAEIAQKASERKTAIE

SEQ ID NO: 1707287 - protein, 40 aa, Staphylococcus aureus
QENKHEKENTHNINNNGSEANENFNNNKNRIENIEDKQKA

SEQ ID NO: 1707288 - protein, 41 aa, Staphylococcus aureus; identical to SEQ ID NO: 1565744

SEQ ID NO: 1707289 - protein, 15 aa, Staphylococcus aureus
QITSQGVTTEKDNGI

SEQ ID NO: 1707290 - protein, 32 aa, Staphylococcus aureus
QLTTDETDAIDNVTNATTNADVETAKNNGINT

SEQ ID NO: 1707291 - protein, 15 aa, Staphylococcus aureus
QRTSKERSKNAQNQQ

SEQ ID NO: 1707292 - protein, 10 aa, Staphylococcus aureus
QRVDNENDKQ

SEQ ID NO: 1707293 - protein, 12 aa, Staphylococcus aureus
QVNSAKNNLDGT

SEQ ID NO: 1707294 - protein, 28 aa, Staphylococcus aureus
QVTTAKNALNGDANVRQAKSDAKANLGT

SEQ ID NO: 1707295 - protein, 8 aa, Staphylococcus aureus
RAQKEKYD

SEQ ID NO: 1707296 - protein, 10 aa, Staphylococcus aureus
RLPSQTQNLY

SEQ ID NO: 1707297 - protein, 9 aa, Staphylococcus aureus
RLSGTTTLD

SEQ ID NO: 1707298 - protein, 14 aa, Staphylococcus aureus
RTISASEISSYNYI

SEQ ID NO: 1707299 - protein, 6 aa, Staphylococcus aureus
SDHARE

SEQ ID NO: 1707300 - protein, 8 aa, Staphylococcus aureus
SKTSKVIE

SEQ ID NO: 1707301 - protein, 16 aa, Staphylococcus aureus
SNKDGKQDSTEKGIKG

SEQ ID NO: 1707302 - protein, 15 aa, Staphylococcus aureus
SNKITGDSKETQIKK

SEQ ID NO: 1707303 - protein, 7 aa, Staphylococcus aureus
SNSNSNL

SEQ ID NO: 1707304 - protein, 9 aa, Staphylococcus aureus
SQGEPTNGI

SEQ ID NO: 1707305 - protein, 13 aa, Staphylococcus aureus
STEEVKEENIKKE

SEQ ID NO: 1707306 - protein, 12 aa, Staphylococcus aureus
TDNSISKNGLTQ

SEQ ID NO: 1707307 - protein, 26 aa, Staphylococcus aureus
TFEYGARPQFNKPAAKTDATIKKEQK

SEQ ID NO: 1707308 - protein, 9 aa, Staphylococcus aureus
TKKDNQGMI

SEQ ID NO: 1707309 - protein, 8 aa, Staphylococcus aureus
TKKYPDEY

SEQ ID NO: 1707310 - protein, 8 aa, Staphylococcus aureus
TNSGQSWQ

SEQ ID NO: 1707311 - protein, 16 aa, Staphylococcus aureus
TQGSGETISDEQRSDD

SEQ ID NO: 1707312 - protein, 12 aa, Staphylococcus aureus
TSALPGRKTGSL

SEQ ID NO: 1707313 - protein, 24 aa, Staphylococcus aureus
TSLNGPQKAKLKEQVGQATTLPNV

SEQ ID NO: 1707314 - protein, 28 aa, Staphylococcus aureus
TSTQLPKTPISFSSEAKAYNISENETNI

SEQ ID NO: 1707315 - protein, 29 aa, Staphylococcus aureus
TTATQTSNSPLNVSTDAKAYHIGQDETNI

SEQ ID NO: 1707316 - protein, 10 aa, Staphylococcus aureus
TTKNGQGATN

SEQ ID NO: 1707317 - protein, 10 aa, Staphylococcus aureus
TYSDNTANNK

SEQ ID NO: 1707318 - protein, 11 aa, Staphylococcus aureus
VAAPQQGTNVN

SEQ ID NO: 1707319 - protein, 14 aa, Staphylococcus aureus
VGGITKTNSKKVNH

SEQ ID NO: 1707320 - protein, 12 aa, Staphylococcus aureus
VGQGFQPPAEKD

SEQ ID NO: 1707321 - protein, 4 aa, Staphylococcus aureus
VKKY

SEQ ID NO: 1707322 - protein, 20 aa, Staphylococcus aureus
VNAQGKDTTPEGYTKKEDGL

SEQ ID NO: 1707323 - protein, 14 aa, Staphylococcus aureus
VNASEHKAKYENVT

SEQ ID NO: 1707324 - protein, 10 aa, Staphylococcus aureus
VQSNANTLDQ

SEQ ID NO: 1707325 - protein, 12 aa, Staphylococcus aureus
VTESGANDTKQF

SEQ ID NO: 1707326 - protein, 17 aa, Staphylococcus aureus
VTSRTISANQAGSYNFI

SEQ ID NO: 1707327 - protein, 27 aa, Staphylococcus aureus
VTTHANGQVSYGARPTQKKPSETNAYN

SEQ ID NO: 1707328 - protein, 5 aa, Staphylococcus aureus
VYPTK

SEQ ID NO: 1707329 - protein, 17 aa, Staphylococcus aureus
VYSKQDRRYFKGNRDYE

SEQ ID NO: 1707330 - protein, 7 aa, Staphylococcus aureus
YEQGGDI

SEQ ID NO: 1707331 - protein, 23 aa, Staphylococcus aureus
YGARPQFNKPAAKTDATIKKEQK

SEQ ID NO: 1707332 - protein, 7 aa, Staphylococcus aureus
YKEAKDR

SEQ ID NO: 1707333 - protein, 9 aa, Staphylococcus aureus
YKKAVNSEK

SEQ ID NO: 1707334 - protein, 10 aa, Staphylococcus aureus
YKTEPKDGKI

SEQ ID NO: 1707335 - protein, 7 aa, Staphylococcus aureus
YPNPYKN

SEQ ID NO: 1707336 - protein, 9 aa, Staphylococcus aureus
YRTQKEKYD

SEQ ID NO: 1707337 - protein, 13 aa, Staphylococcus aureus
YTIDDSVKEGDTF

SEQ ID NO: 1707338 - protein, 6 aa, Staphylococcus aureus
AENKEV

SEQ ID NO: 1707339 - protein, 6 aa, Staphylococcus aureus
AFNPNF

SEQ ID NO: 1707340 - protein, 11 aa, Staphylococcus aureus
AGGTDPDPSDL

SEQ ID NO: 1707341 - protein, 22 aa, Staphylococcus aureus
AINQINQNQTNDQVDTTTNQAV

SEQ ID NO: 1707342 - protein, 11 aa, Staphylococcus aureus
ALSPSLRHGGT

SEQ ID NO: 1707343 - protein, 16 aa, Staphylococcus aureus
ANHVKTANRASQADID

SEQ ID NO: 1707344 - protein, 42 aa, Staphylococcus aureus; identical to SEQ ID NO: 1565813

SEQ ID NO: 1707345 - protein, 9 aa, Staphylococcus aureus
AREEWRKND

SEQ ID NO: 1707346 - protein, 15 aa, Staphylococcus aureus
ARPRFNKPSETNAYN

SEQ ID NO: 1707347 - protein, 8 aa, Staphylococcus aureus
ASGLPTDG

SEQ ID NO: 1707348 - protein, 12 aa, Staphylococcus aureus
ATPDVTEDEIQD

SEQ ID NO: 1707349 - protein, 21 aa, Staphylococcus aureus
ATQVKTDTRNVVNDKAREAIT

SEQ ID NO: 1707350 - protein, 73 aa, Staphylococcus aureus; identical to SEQ ID NO: 1628295

SEQ ID NO: 1707351 - protein, 19 aa, Staphylococcus aureus
CGKGNETKEGSKEEQIKKS

SEQ ID NO: 1707352 - protein, 31 aa, Staphylococcus aureus
CGSNKITGDSKEEQIKKSFAKSLDKYPTENL

SEQ ID NO: 1707353 - protein, 12 aa, Staphylococcus aureus
DDEDDNSEHQIN

SEQ ID NO: 1707354 - protein, 17 aa, Staphylococcus aureus
DDVEAPSDYEKIRAEVS

SEQ ID NO: 1707355 - protein, 17 aa, Staphylococcus aureus
DHTRQLTNDSDNRTKSE

SEQ ID NO: 1707356 - protein, 13 aa, Staphylococcus aureus
DIKQTTQSLNTAM

SEQ ID NO: 1707357 - protein, 9 aa, Staphylococcus aureus
DISTKETPK

SEQ ID NO: 1707358 - protein, 17 aa, Staphylococcus aureus
DKEGYCDDQFDKNDKGT

SEQ ID NO: 1707359 - protein, 17 aa, Staphylococcus aureus
DKEGYRDGEFEKDDKGT

SEQ ID NO: 1707360 - protein, 17 aa, Staphylococcus aureus
DKEGYRDGEFKKGDKGK

SEQ ID NO: 1707361 - protein, 6 aa, Staphylococcus aureus
DLTSLD

SEQ ID NO: 1707362 - protein, 14 aa, Staphylococcus aureus
DNGIRPSTNRSVPS

SEQ ID NO: 1707363 - protein, 8 aa, Staphylococcus aureus
DNKTVESE

SEQ ID NO: 1707364 - protein, 13 aa, Staphylococcus aureus
DSATGKERNGFYK

SEQ ID NO: 1707365 - protein, 22 aa, Staphylococcus aureus
DSSSNNAENQREDSKEEQIKKS

SEQ ID NO: 1707366 - protein, 15 aa, Staphylococcus aureus
DSVTSTSTSSTYTIN

SEQ ID NO: 1707367 - protein, 9 aa, Staphylococcus aureus
DVKKVKDGA

SEQ ID NO: 1707368 - protein, 6 aa, Staphylococcus aureus
EAPKTQ

SEQ ID NO: 1707369 - protein, 9 aa, Staphylococcus aureus
EDAYSETTK

SEQ ID NO: 1707370 - protein, 11 aa, Staphylococcus aureus
EDVRHSSNKPE

SEQ ID NO: 1707371 - protein, 67 aa, Staphylococcus aureus; identical to SEQ ID NO: 1636079

SEQ ID NO: 1707372 - protein, 12 aa, Staphylococcus aureus
EGSDKSAITTSI

SEQ ID NO: 1707373 - protein, 8 aa, Staphylococcus aureus
EHANNTID

SEQ ID NO: 1707374 - protein, 17 aa, Staphylococcus aureus
EINKSQKDTQKTDEYYE

SEQ ID NO: 1707375 - protein, 5 aa, Staphylococcus aureus
EKNLI

SEQ ID NO: 1707376 - protein, 5 aa, Staphylococcus aureus
ENNQK

SEQ ID NO: 1707377 - protein, 38 aa, Staphylococcus aureus
EPASNRPKKRSRRAAPADPNATPADPAAAAVGNGGAPV

SEQ ID NO: 1707378 - protein, 20 aa, Staphylococcus aureus
EPKPKTVPSNNKSNSNNSTL

SEQ ID NO: 1707379 - protein, 44 aa, Staphylococcus aureus
ERKRTKKKQLEKEKANTLNQNTNDTESSNQEPSLQQDKEQKDNK

SEQ ID NO: 1707380 - protein, 5 aa, Staphylococcus aureus
ESKDF

SEQ ID NO: 1707381 - protein, 10 aa, Staphylococcus aureus
FKTKKDEVTV

SEQ ID NO: 1707382 - protein, 12 aa, Staphylococcus aureus
FSEYKKDALAKI

SEQ ID NO: 1707383 - protein, 7 aa, Staphylococcus aureus
GDDGLPK

SEQ ID NO: 1707384 - protein, 15 aa, Staphylococcus aureus
GEYAKAYKKAVNSEK

SEQ ID NO: 1707385 - protein, 5 aa, Staphylococcus aureus
GEYGR

SEQ ID NO: 1707386 - protein, 9 aa, Staphylococcus aureus
GFKYTDEGK

SEQ ID NO: 1707387 - protein, 14 aa, Staphylococcus aureus
GGGDLKNSSVGQND

SEQ ID NO: 1707388 - protein, 14 aa, Staphylococcus aureus
GHNGTKKGEEYGHK

SEQ ID NO: 1707389 - protein, 11 aa, Staphylococcus aureus
GIADDGKKKRI

SEQ ID NO: 1707390 - protein, 17 aa, Staphylococcus aureus
GIPRSDAKTLTYIVFLV

SEQ ID NO: 1707391 - protein, 18 aa, Staphylococcus aureus
GKGNETKEGSKEEQIKKS

SEQ ID NO: 1707392 - protein, 10 aa, Staphylococcus aureus
GKIDKNRTKF

SEQ ID NO: 1707393 - protein, 86 aa, Staphylococcus aureus
GNDENQEESKKEVKSKEKKIEKEKENKSKKDKEKEVATQQQPDNQTVEQPQSQEQSVQQPQQQIPQNSVPQQNVQVQQNKKQKVDL

SEQ ID NO: 1707394 - protein, 11 aa, Staphylococcus aureus
GNSGGIVSSEP

SEQ ID NO: 1707395 - protein, 4 aa, Staphylococcus aureus
GQCN

SEQ ID NO: 1707396 - protein, 72 aa, Staphylococcus aureus; identical to SEQ ID NO: 1623225

SEQ ID NO: 1707397 - protein, 6 aa, Staphylococcus aureus
GTGQAE

SEQ ID NO: 1707398 - protein, 6 aa, Staphylococcus aureus
GVTSTT

SEQ ID NO: 1707399 - protein, 13 aa, Staphylococcus aureus
HGGATNKTQCSYG

SEQ ID NO: 1707400 - protein, 7 aa, Staphylococcus aureus
HGKDSPL

SEQ ID NO: 1707401 - protein, 19 aa, Staphylococcus aureus
HGLSQREYNDRVSEIINND

SEQ ID NO: 1707402 - protein, 13 aa, Staphylococcus aureus
HGTDTNDHGDFNG

SEQ ID NO: 1707403 - protein, 9 aa, Staphylococcus aureus
HKSEAGTSS

SEQ ID NO: 1707404 - protein, 125 aa, Staphylococcus aureus
HSTSSSNNQEQENKSTHKKTETEENDQQDDSADKTDKNQNNGNNVTNDNQPSSPSNVPNNHSTVPSNTQPAQPKDSNSNKNNTHGGGSQSSTNNQNNQQQNTPPANKSNNTNTPSKQTPQAQSPK

SEQ ID NO: 1707405 - protein, 14 aa, Staphylococcus aureus
IANNDVKRVETNGI

SEQ ID NO: 1707406 - protein, 6 aa, Staphylococcus aureus
IGSGTG

SEQ ID NO: 1707407 - protein, 15 aa, Staphylococcus aureus
IPTKEIKDEKIKKEI

SEQ ID NO: 1707408 - protein, 19 aa, Staphylococcus aureus
ITNEDENFVKDDQRAGVDA

SEQ ID NO: 1707409 - protein, 27 aa, Staphylococcus aureus
KAGSYGSEKGADPQPNTPDDHTPPNQN

SEQ ID NO: 1707410 - protein, 5 aa, Staphylococcus aureus
KEEVS

SEQ ID NO: 1707411 - protein, 25 aa, Staphylococcus aureus
KEKDGSTFSKKLDDSEVKKQGKQMA

SEQ ID NO: 1707412 - protein, 7 aa, Staphylococcus aureus
KEKEEAF

SEQ ID NO: 1707413 - protein, 12 aa, Staphylococcus aureus
KFEYNTEKPPIN

SEQ ID NO: 1707414 - protein, 13 aa, Staphylococcus aureus
KITVKKESHTGKW

SEQ ID NO: 1707415 - protein, 35 aa, Staphylococcus aureus; identical to SEQ ID NO: 1629274

SEQ ID NO: 1707416 - protein, 28 aa, Staphylococcus aureus
KLEHNNKALRDTAKKNLDDSKENEVKGA

SEQ ID NO: 1707417 - protein, 10 aa, Staphylococcus aureus
KLNNSDENVK

SEQ ID NO: 1707418 - protein, 23 aa, Staphylococcus aureus
KNKKVINKKTEKEDTMNENDNFK

SEQ ID NO: 1707419 - protein, 14 aa, Staphylococcus aureus
KNQNISYKDLEDKV

SEQ ID NO: 1707420 - protein, 6 aa, Staphylococcus aureus
KNTDGS

SEQ ID NO: 1707421 - protein, 19 aa, Staphylococcus aureus
KNYQDGSITTNENIPSYEA

SEQ ID NO: 1707422 - protein, 18 aa, Staphylococcus aureus
KQEVSPQTVKITGGEEQL

SEQ ID NO: 1707423 - protein, 14 aa, Staphylococcus aureus
KSTGGGTANSPARL

SEQ ID NO: 1707424 - protein, 19 aa, Staphylococcus aureus
LKKYKAESKYRKATGQAPI

SEQ ID NO: 1707425 - protein, 21 aa, Staphylococcus aureus
LQNEKGEVIGTTETDENGKYR

SEQ ID NO: 1707426 - protein, 14 aa, Staphylococcus aureus
MDPTATNNKEFTVT

SEQ ID NO: 1707427 - protein, 19 aa, Staphylococcus aureus
NAANNEANKFGSNNKVYND

SEQ ID NO: 1707428 - protein, 8 aa, Staphylococcus aureus
NDDEQNVE

SEQ ID NO: 1707429 - protein, 8 aa, Staphylococcus aureus
NIPTNKAP

SEQ ID NO: 1707430 - protein, 10 aa, Staphylococcus aureus
NITTKKAPKL

SEQ ID NO: 1707431 - protein, 16 aa, Staphylococcus aureus
NLNNAQKGAVTGNINQ

SEQ ID NO: 1707432 - protein, 18 aa, Staphylococcus aureus
NNAQRTAANAEVDQAPNL

SEQ ID NO: 1707433 - protein, 23 aa, Staphylococcus aureus
NNMPPTDFSTEGMSEQAQKQIEE

SEQ ID NO: 1707434 - protein, 15 aa, Staphylococcus aureus
NQANGTNANQSQVEA

SEQ ID NO: 1707435 - protein, 10 aa, Staphylococcus aureus
NQNLDKPRNI

SEQ ID NO: 1707436 - protein, 39 aa, Staphylococcus aureus
NYKDTHSYKDRINAQQKVNTLSEGHQKRFNKQINKVYNG

SEQ ID NO: 1707437 - protein, 24 aa, Staphylococcus aureus
PAGLTQTGTNTTEDDKDADGGEVD

SEQ ID NO: 1707438 - protein, 68 aa, Staphylococcus aureus
PTAYADTPQKDTTAKTTSHDSKKSNDDETSKDTTSKDIDKADKNNTSNQDNNDKKFKTIDDSTSDSNN

SEQ ID NO: 1707439 - protein, 14 aa, Staphylococcus aureus
PTEQINDEKIKKEI

SEQ ID NO: 1707440 - protein, 10 aa, Staphylococcus aureus
QDKDQVKQSV

SEQ ID NO: 1707441 - protein, 69 aa, Staphylococcus aureus
QKVTTSPSTKVKATQPTPSVTTPPSPNVQPQSPQPTPNPTTPHSSNVETKQPQSPTTKQAQKEINPKYK

SEQ ID NO: 1707442 - protein, 13 aa, Staphylococcus aureus
QSVQTNGQSLNNA

SEQ ID NO: 1707443 - protein, 5 aa, Staphylococcus aureus
RDDEG

SEQ ID NO: 1707444 - protein, 33 aa, Staphylococcus aureus; identical to SEQ ID NO: 1564182

SEQ ID NO: 1707445 - protein, 12 aa, Staphylococcus aureus
RLDKSTKSAVEN

SEQ ID NO: 1707446 - protein, 7 aa, Staphylococcus aureus
RNTETAK

SEQ ID NO: 1707447 - protein, 34 aa, Staphylococcus aureus; identical to SEQ ID NO: 1566471

SEQ ID NO: 1707448 - protein, 9 aa, Staphylococcus aureus
RSSDKTGGY

SEQ ID NO: 1707449 - protein, 6 aa, Staphylococcus aureus
RYSGQE

SEQ ID NO: 1707450 - protein, 47 aa, Staphylococcus aureus; identical to SEQ ID NO: 1564006

SEQ ID NO: 1707451 - protein, 7 aa, Staphylococcus aureus
SDGTQEL

SEQ ID NO: 1707452 - protein, 16 aa, Staphylococcus aureus
SENNNRVNKDKEEKYE

SEQ ID NO: 1707453 - protein, 15 aa, Staphylococcus aureus
SESMAEDLEKIAEKA

SEQ ID NO: 1707454 - protein, 28 aa, Staphylococcus aureus
SIANKDATKASEDYVDANNDKQTAYNNA

SEQ ID NO: 1707455 - protein, 7 aa, Staphylococcus aureus
SKGDVKK

SEQ ID NO: 1707456 - protein, 12 aa, Staphylococcus aureus
SKSNKPGEIDDE

SEQ ID NO: 1707457 - protein, 15 aa, Staphylococcus aureus
SLKNNGNSGASLDTN

SEQ ID NO: 1707458 - protein, 15 aa, Staphylococcus aureus
SNKDGKQDSTEKGIK

SEQ ID NO: 1707459 - protein, 13 aa, Staphylococcus aureus
SPFKTTQDNATLS

SEQ ID NO: 1707460 - protein, 6 aa, Staphylococcus aureus
SPVPED

SEQ ID NO: 1707461 - protein, 19 aa, Staphylococcus aureus
SSATRVSGVDTVKQNAQHL

SEQ ID NO: 1707462 - protein, 6 aa, Staphylococcus aureus
STNNKI

SEQ ID NO: 1707463 - protein, 29 aa, Staphylococcus aureus
STVTTTKQALNGDRKVTDAKNNANQTLST

SEQ ID NO: 1707464 - protein, 13 aa, Staphylococcus aureus
TAHPNGDKGNGGI

SEQ ID NO: 1707465 - protein, 10 aa, Staphylococcus aureus
TAKASTNDNI

SEQ ID NO: 1707466 - protein, 4 aa, Staphylococcus aureus
TAST

SEQ ID NO: 1707467 - protein, 20 aa, Staphylococcus aureus
TKDYSGKSQVNAGSKNGTLI

SEQ ID NO: 1707468 - protein, 16 aa, Staphylococcus aureus
TKKQVEDKKKDKANYQ

SEQ ID NO: 1707469 - protein, 158 aa, Staphylococcus aureus
TNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINT

SEQ ID NO: 1707470 - protein, 9 aa, Staphylococcus aureus
TQANTALNG

SEQ ID NO: 1707471 - protein, 25 aa, Staphylococcus aureus
TQDAKNNVIPVSNGNHYQWYSSIYG

SEQ ID NO: 1707472 - protein, 51 aa, Staphylococcus aureus; identical to SEQ ID NO: 1563879

SEQ ID NO: 1707473 - protein, 10 aa, Staphylococcus aureus
TTELKNENMV

SEQ ID NO: 1707474 - protein, 6 aa, Staphylococcus aureus
TVNPNS

SEQ ID NO: 1707475 - protein, 13 aa, Staphylococcus aureus
VDDEDDNSEHQIN

SEQ ID NO: 1707476 - protein, 9 aa, Staphylococcus aureus
VEGQDNQLL

SEQ ID NO: 1707477 - protein, 9 aa, Staphylococcus aureus
VKDNDTPIA

SEQ ID NO: 1707478 - protein, 9 aa, Staphylococcus aureus
VKTVENDNV

SEQ ID NO: 1707479 - protein, 7 aa, Staphylococcus aureus
VQAGDSL

SEQ ID NO: 1707480 - protein, 11 aa, Staphylococcus aureus
VTNTEKLPTPI

SEQ ID NO: 1707481 - protein, 8 aa, Staphylococcus aureus
YEAKRLKD

SEQ ID NO: 1707482 - protein, 5 aa, Staphylococcus aureus
YPGIS

SEQ ID NO: 1707483 - protein, 7 aa, Staphylococcus aureus
YSYNSTG

SEQ ID NO: 1707484 - protein, 11 aa, Staphylococcus aureus
AANNAKALKDH

SEQ ID NO: 1707485 - protein, 17 aa, Staphylococcus aureus
AANNGVAQIKPTNSGLY

SEQ ID NO: 1707486 - protein, 11 aa, Staphylococcus aureus
AAPEKTYKSQL

SEQ ID NO: 1707487 - protein, 10 aa, Staphylococcus aureus
AENIHPNNRQ

SEQ ID NO: 1707488 - protein, 51 aa, Staphylococcus aureus
AGANSATTQAANTRQERTPKLEKAPNTNEEKTSASKIEKISQPKQEEQKSL

SEQ ID NO: 1707489 - protein, 23 aa, Staphylococcus aureus
AGGNYTNASPDKQGAYTDAYNAA

SEQ ID NO: 1707490 - protein, 16 aa, Staphylococcus aureus
ANKVTETIRKETDAKP

SEQ ID NO: 1707491 - protein, 10 aa, Staphylococcus aureus
ANNEKRALQN

SEQ ID NO: 1707492 - protein, 4 aa, Staphylococcus aureus
AQNV

SEQ ID NO: 1707493 - protein, 8 aa, Staphylococcus aureus
AVNNRKGK

SEQ ID NO: 1707494 - protein, 4 aa, Staphylococcus aureus
AYNE

SEQ ID NO: 1707495 - protein, 11 aa, Staphylococcus aureus
DDEDDNENDRQ

SEQ ID NO: 1707496 - protein, 16 aa, Staphylococcus aureus
DDVEVPSDYVFRAEVS

SEQ ID NO: 1707497 - protein, 7 aa, Staphylococcus aureus
DKDGNFK

SEQ ID NO: 1707498 - protein, 5 aa, Staphylococcus aureus
DLEDR

SEQ ID NO: 1707499 - protein, 12 aa, Staphylococcus aureus
DPKKDNNGYKSY

SEQ ID NO: 1707500 - protein, 9 aa, Staphylococcus aureus
DQIQGGQQL

SEQ ID NO: 1707501 - protein, 16 aa, Staphylococcus aureus
DSDSSLRSKDKGDDMS

SEQ ID NO: 1707502 - protein, 11 aa, Staphylococcus aureus
DSELGEGQEFP

SEQ ID NO: 1707503 - protein, 16 aa, Staphylococcus aureus
DTNKDGKQDANEKGIK

SEQ ID NO: 1707504 - protein, 5 aa, Staphylococcus aureus
EDFYG

SEQ ID NO: 1707505 - protein, 15 aa, Staphylococcus aureus
EKYEEPEYEKAVKKY

SEQ ID NO: 1707506 - protein, 4 aa, Staphylococcus aureus
ELPP

SEQ ID NO: 1707507 - protein, 9 aa, Staphylococcus aureus
ENDQKRNDM

SEQ ID NO: 1707508 - protein, 13 aa, Staphylococcus aureus
ETSALPGRKSGSL

SEQ ID NO: 1707509 - protein, 10 aa, Staphylococcus aureus
ETVNGRQYSI

SEQ ID NO: 1707510 - protein, 14 aa, Staphylococcus aureus
FAEGGNSGSPVFNN

SEQ ID NO: 1707511 - protein, 11 aa, Staphylococcus aureus
FKSNNNSELSK

SEQ ID NO: 1707512 - protein, 6 aa, Staphylococcus aureus
GGALKS

SEQ ID NO: 1707513 - protein, 86 aa, Staphylococcus aureus
GQDSDQQKDSNKEKDDKAKTEQQDKKTNDSSKDKKDNKDDSKDVNKDNKDNSANDNQQQSNSNATNNDQNQTNNNQSSNNQKSSYV

SEQ ID NO: 1707514 - protein, 88 aa, Staphylococcus aureus
GQDSDQQKDSNKEKDDKAKTEQQDKKTNDSSKDKKDNKDDSKDVNKDNKDNSANDNQQQSNSNATNNDQNQTNNNQSSNNQKSSYVAP

SEQ ID NO: 1707515 - protein, 7 aa, Staphylococcus aureus
GTNNGIT

SEQ ID NO: 1707516 - protein, 14 aa, Staphylococcus aureus
HKTISTNKVSTNKK

SEQ ID NO: 1707517 - protein, 10 aa, Staphylococcus aureus
HQSINPENNH

SEQ ID NO: 1707518 - protein, 17 aa, Staphylococcus aureus
HTAQSNANTLDQAMNTL

SEQ ID NO: 1707519 - protein, 7 aa, Staphylococcus aureus
IAAPGGS

SEQ ID NO: 1707520 - protein, 20 aa, Staphylococcus aureus
IEATTTAQDLERVKNEEISK

SEQ ID NO: 1707521 - protein, 4 aa, Staphylococcus aureus
IKEN

SEQ ID NO: 1707522 - protein, 33 aa, Staphylococcus aureus
IKGTVDKNGKLTLSDGKTSKVMPTNAKDKKGND

SEQ ID NO: 1707523 - protein, 10 aa, Staphylococcus aureus
IKKEKEIPNG

SEQ ID NO: 1707524 - protein, 10 aa, Staphylococcus aureus
INGTPNATLT

SEQ ID NO: 1707525 - protein, 20 aa, Staphylococcus aureus
INNGVDNGDVDDALTQGKAA

SEQ ID NO: 1707526 - protein, 6 aa, Staphylococcus aureus
KARKEI

SEQ ID NO: 1707527 - protein, 7 aa, Staphylococcus aureus
KASDSKE

SEQ ID NO: 1707528 - protein, 47 aa, Staphylococcus aureus; identical to SEQ ID NO: 1565879

SEQ ID NO: 1707529 - protein, 11 aa, Staphylococcus aureus
KKNFTKDNTVD

SEQ ID NO: 1707530 - protein, 9 aa, Staphylococcus aureus
KNESVKEIG

SEQ ID NO: 1707531 - protein, 6 aa, Staphylococcus aureus
KNNETQ

SEQ ID NO: 1707532 - protein, 35 aa, Staphylococcus aureus; identical to SEQ ID NO: 1564130

SEQ ID NO: 1707533 - protein, 12 aa, Staphylococcus aureus
KPASLAQTNQHY

SEQ ID NO: 1707534 - protein, 26 aa, Staphylococcus aureus
KSDSEFSKELSNVKKQLKDKSKLSVT

SEQ ID NO: 1707535 - protein, 10 aa, Staphylococcus aureus
KSNNNSELSK

SEQ ID NO: 1707536 - protein, 5 aa, Staphylococcus aureus
KSRNL

SEQ ID NO: 1707537 - protein, 9 aa, Staphylococcus aureus
KSSQERKTN

SEQ ID NO: 1707538 - protein, 9 aa, Staphylococcus aureus
KTEPKDGKI

SEQ ID NO: 1707539 - protein, 19 aa, Staphylococcus aureus
KVAEANQAKDQLNTARQGL

SEQ ID NO: 1707540 - protein, 8 aa, Staphylococcus aureus
KVNEQKTF

SEQ ID NO: 1707541 - protein, 9 aa, Staphylococcus aureus
KVPKGTQQY

SEQ ID NO: 1707542 - protein, 11 aa, Staphylococcus aureus
LDKTQTNAEVA

SEQ ID NO: 1707543 - protein, 7 aa, Staphylococcus aureus
LSNGTYS

SEQ ID NO: 1707544 - protein, 11 aa, Staphylococcus aureus
MATQNKGEALK

SEQ ID NO: 1707545 - protein, 21 aa, Staphylococcus aureus
NAHAEQKSDNIGKLNQKNEST

SEQ ID NO: 1707546 - protein, 30 aa, Staphylococcus aureus; identical to SEQ ID NO: 1563971

SEQ ID NO: 1707547 - protein, 30 aa, Staphylococcus aureus; identical to SEQ ID NO: 1566433

SEQ ID NO: 1707548 - protein, 5 aa, Staphylococcus aureus
NIKKY

SEQ ID NO: 1707549 - protein, 12 aa, Staphylococcus aureus
NTVTEQPVHAEN

SEQ ID NO: 1707550 - protein, 11 aa, Staphylococcus aureus
PAALAQTNQHY

SEQ ID NO: 1707551 - protein, 5 aa, Staphylococcus aureus
PADVY

SEQ ID NO: 1707552 - protein, 9 aa, Staphylococcus aureus
PDGYGNSET

SEQ ID NO: 1707553 - protein, 68 aa, Staphylococcus aureus
PTAYADTPQKDTTAKTTSHDSKKSNDDETSKDTTSKDIDKADNNNTSNQDNNDKKFKTIDDSTSDSNN

SEQ ID NO: 1707554 - protein, 17 aa, Staphylococcus aureus
QDYKKSGFKMNDRKQSV

SEQ ID NO: 1707555 - protein, 36 aa, Staphylococcus aureus; identical to SEQ ID NO: 1565941

SEQ ID NO: 1707556 - protein, 28 aa, Staphylococcus aureus
QNVNSTKTALNGDAKLNEAKAAAKQTLG

SEQ ID NO: 1707557 - protein, 20 aa, Staphylococcus aureus
QPEVTKDKTAHVGERKGGPY

SEQ ID NO: 1707558 - protein, 22 aa, Staphylococcus aureus
QQSTTVAEAQGNEQKANNVDAA

SEQ ID NO: 1707559 - protein, 10 aa, Staphylococcus aureus
QRIDNENDKK

SEQ ID NO: 1707560 - protein, 8 aa, Staphylococcus aureus
QTANPTMS

SEQ ID NO: 1707561 - protein, 27 aa, Staphylococcus aureus
QVTSTKDALNGDAKLAEAKAAAKQNLG

SEQ ID NO: 1707562 - protein, 5 aa, Staphylococcus aureus
QYNHP

SEQ ID NO: 1707563 - protein, 9 aa, Staphylococcus aureus
RHNNTSPWV

SEQ ID NO: 1707564 - protein, 17 aa, Staphylococcus aureus
RKIDESSEKSKDSKFKI

SEQ ID NO: 1707565 - protein, 14 aa, Staphylococcus aureus
RKQNAAKKSKITVT

SEQ ID NO: 1707566 - protein, 15 aa, Staphylococcus aureus
SAHHSSKGKGGGNYD

SEQ ID NO: 1707567 - protein, 15 aa, Staphylococcus aureus
SEYQTANAAKTATVT

SEQ ID NO: 1707568 - protein, 5 aa, Staphylococcus aureus
SKGLS

SEQ ID NO: 1707569 - protein, 5 aa, Staphylococcus aureus
SKKDF

SEQ ID NO: 1707570 - protein, 13 aa, Staphylococcus aureus
SKSRNLLKNRSQN

SEQ ID NO: 1707571 - protein, 16 aa, Staphylococcus aureus
SLQGSINDKDATLRNQ

SEQ ID NO: 1707572 - protein, 6 aa, Staphylococcus aureus
SNTLGY

SEQ ID NO: 1707573 - protein, 12 aa, Staphylococcus aureus
SPFKTTQDNATL

SEQ ID NO: 1707574 - protein, 29 aa, Staphylococcus aureus
SPLVNGSEKSEEINEKDLRKKSELQGTAL

SEQ ID NO: 1707575 - protein, 28 aa, Staphylococcus aureus
SQVTNAKGALNGNHNLEQAKSNANTTIN

SEQ ID NO: 1707576 - protein, 7 aa, Staphylococcus aureus
SRKMSNA

SEQ ID NO: 1707577 - protein, 10 aa, Staphylococcus aureus
SSGSDTFTNS

SEQ ID NO: 1707578 - protein, 14 aa, Staphylococcus aureus
STTGGNSGSPVFNE

SEQ ID NO: 1707579 - protein, 17 aa, Staphylococcus aureus
TAQKTNLTNQINSGTTV

SEQ ID NO: 1707580 - protein, 23 aa, Staphylococcus aureus
TEKGKGILDKEGTKVIKGKTKFA

SEQ ID NO: 1707581 - protein, 6 aa, Staphylococcus aureus
TFAEGK

SEQ ID NO: 1707582 - protein, 12 aa, Staphylococcus aureus
TLKAQKGKTEFY

SEQ ID NO: 1707583 - protein, 15 aa, Staphylococcus aureus
TLNSNKPTPRGPIGA

SEQ ID NO: 1707584 - protein, 9 aa, Staphylococcus aureus
TNDEPATRR

SEQ ID NO: 1707585 - protein, 18 aa, Staphylococcus aureus
TNKSVTNSNDAGVNFELT

SEQ ID NO: 1707586 - protein, 19 aa, Staphylococcus aureus
TTATQTSNSPLNVSTDAKA

SEQ ID NO: 1707587 - protein, 34 aa, Staphylococcus aureus; identical to SEQ ID NO: 1566511

SEQ ID NO: 1707588 - protein, 24 aa, Staphylococcus aureus
VKAEDTKESIDQSDQLTAEEKTEA

SEQ ID NO: 1707589 - protein, 13 aa, Staphylococcus aureus
VKTGTKAKADSYV

SEQ ID NO: 1707590 - protein, 25 aa, Staphylococcus aureus
VKTSDTSLKLDNKSAISNGNEINQD

SEQ ID NO: 1707591 - protein, 33 aa, Staphylococcus aureus; identical to SEQ ID NO: 1566129

SEQ ID NO: 1707592 - protein, 16 aa, Staphylococcus aureus
VQQTAKAENNVTKVKD

SEQ ID NO: 1707593 - protein, 22 aa, Staphylococcus aureus
VSEPSKKPTTPPTYTETTTQLP

SEQ ID NO: 1707594 - protein, 13 aa, Staphylococcus aureus
VSGGATGAAASCF

SEQ ID NO: 1707595 - protein, 10 aa, Staphylococcus aureus
VSKNYKVGDR

SEQ ID NO: 1707596 - protein, 19 aa, Staphylococcus aureus
VTAANAAKTALDQARNGLT

SEQ ID NO: 1707597 - protein, 27 aa, Staphylococcus aureus
VTTHANGQVSYGARPTYKKPSETNAYN

SEQ ID NO: 1707598 - protein, 10 aa, Staphylococcus aureus
YHIGQDETNI

SEQ ID NO: 1707599 - protein, 9 aa, Staphylococcus aureus
YNIPTEKAP

SEQ ID NO: 1707600 - protein, 28 aa, Staphylococcus aureus
YSPAFTKGEKVDLNTKRTKKSQHTSEGT

SEQ ID NO: 1707601 - protein, 54 aa, Staphylococcus aureus
AAANADVDNAVTQANSNIEAANSQNDVDQAKTTGENSIDQVTPTVNKKATARNE

SEQ ID NO: 1707602 - protein, 29 aa, Staphylococcus aureus
ADKTNTLASSKYVNADSTKQNAYTTKVTN

SEQ ID NO: 1707603 - protein, 17 aa, Staphylococcus aureus
ADTNDTIAEKTVEGGPT

SEQ ID NO: 1707604 - protein, 47 aa, Staphylococcus aureus; identical to SEQ ID NO: 1564038

SEQ ID NO: 1707605 - protein, 4 aa, Staphylococcus aureus
AFNQ

SEQ ID NO: 1707606 - protein, 5 aa, Staphylococcus aureus
AIANQ

SEQ ID NO: 1707607 - protein, 14 aa, Staphylococcus aureus
AKASEVNENVEKQN

SEQ ID NO: 1707608 - protein, 15 aa, Staphylococcus aureus
AKASEVNENVKKQNH

SEQ ID NO: 1707609 - protein, 12 aa, Staphylococcus aureus
AKGNKSDELDDE

SEQ ID NO: 1707610 - protein, 11 aa, Staphylococcus aureus
AKSNKPGEIDD

SEQ ID NO: 1707611 - protein, 20 aa, Staphylococcus aureus
ARPQFNKPAAKTDATIKKEQ

SEQ ID NO: 1707612 - protein, 15 aa, Staphylococcus aureus
ASKDEPSLADMQQSA

SEQ ID NO: 1707613 - protein, 18 aa, Staphylococcus aureus
CGKGNETKEGSKETQIKK

SEQ ID NO: 1707614 - protein, 37 aa, Staphylococcus aureus
CSTTNNESNKETKSVPEEMDASKYVGQGFQPPAEKDA

SEQ ID NO: 1707615 - protein, 4 aa, Staphylococcus aureus
DIDP

SEQ ID NO: 1707616 - protein, 22 aa, Staphylococcus aureus
DKEFKEGMQRARKELNYTANTD

SEQ ID NO: 1707617 - protein, 11 aa, Staphylococcus aureus
DKGQRTDKYGR

SEQ ID NO: 1707618 - protein, 9 aa, Staphylococcus aureus
DKKDEGKSK

SEQ ID NO: 1707619 - protein, 24 aa, Staphylococcus aureus
DKYDEKNDAMKKKFDATEKEAEKL

SEQ ID NO: 1707620 - protein, 22 aa, Staphylococcus aureus
DNKINTVKPNYNGKSTSEYGVF

SEQ ID NO: 1707621 - protein, 99 aa, Staphylococcus aureus
DNLQKENKELKDKKEKLQQEKEKLADKQKDLEKEVKDLKPSKEDNKDDKKDEDKNKDKDKDKEASQDKQSKDQTKSSDKDNHKKPTSTDKDQKANDKHQ

SEQ ID NO: 1707622 - protein, 42 aa, Staphylococcus aureus; identical to SEQ ID NO: 1628423

SEQ ID NO: 1707623 - protein, 75 aa, Staphylococcus aureus; identical to SEQ ID NO: 1635583

SEQ ID NO: 1707624 - protein, 33 aa, Staphylococcus aureus; identical to SEQ ID NO: 1566344

SEQ ID NO: 1707625 - protein, 18 aa, Staphylococcus aureus
DTNKNGIQDQDEKGISGV

SEQ ID NO: 1707626 - protein, 33 aa, Staphylococcus aureus; identical to SEQ ID NO: 1565658

SEQ ID NO: 1707627 - protein, 15 aa, Staphylococcus aureus
EFSKKHKDKIAKRGE

SEQ ID NO: 1707628 - protein, 6 aa, Staphylococcus aureus
ELEDEG

SEQ ID NO: 1707629 - protein, 4 aa, Staphylococcus aureus
ELTK

SEQ ID NO: 1707630 - protein, 9 aa, Staphylococcus aureus
EVPEADTHR

SEQ ID NO: 1707631 - protein, 45 aa, Staphylococcus aureus
EVSSSDPYLGDDEEDEEVEETSTEEVGAEEESTEAKATYTTPRYE

SEQ ID NO: 1707632 - protein, 15 aa, Staphylococcus aureus
FAEGGNSGSPVFNNK

SEQ ID NO: 1707633 - protein, 14 aa, Staphylococcus aureus
FNNKSLSDKYKNKN

SEQ ID NO: 1707634 - protein, 13 aa, Staphylococcus aureus
FTNNQSGGAGQEV

SEQ ID NO: 1707635 - protein, 46 aa, Staphylococcus aureus
GDQTTDDGVTRIKDQGIQTLSGDTATPVVKPNAKKAIRDKATKQRE

SEQ ID NO: 1707636 - protein, 6 aa, Staphylococcus aureus
GGGGIP

SEQ ID NO: 1707637 - protein, 13 aa, Staphylococcus aureus
GIGKEAKIKKSFE

SEQ ID NO: 1707638 - protein, 19 aa, Staphylococcus aureus
GKVDGGPSQVIKPGKEKTI

SEQ ID NO: 1707639 - protein, 9 aa, Staphylococcus aureus
GQAIPNGTF

SEQ ID NO: 1707640 - protein, 12 aa, Staphylococcus aureus
GSGDIKGSSVGY

SEQ ID NO: 1707641 - protein, 5 aa, Staphylococcus aureus
GVGTT

SEQ ID NO: 1707642 - protein, 4 aa, Staphylococcus aureus
HGGY

SEQ ID NO: 1707643 - protein, 13 aa, Staphylococcus aureus
HPSPNTAKQVYNG

SEQ ID NO: 1707644 - protein, 10 aa, Staphylococcus aureus
HQDGTTSTVT

SEQ ID NO: 1707645 - protein, 19 aa, Staphylococcus aureus
IEATTTAQDLERVKNEEIS

SEQ ID NO: 1707646 - protein, 4 aa, Staphylococcus aureus
IGES

SEQ ID NO: 1707647 - protein, 5 aa, Staphylococcus aureus
ITTQL

SEQ ID NO: 1707648 - protein, 21 aa, Staphylococcus aureus
KAINDINQTTPATTAKAAALE

SEQ ID NO: 1707649 - protein, 7 aa, Staphylococcus aureus
KDENGNV

SEQ ID NO: 1707650 - protein, 4 aa, Staphylococcus aureus
KDGF

SEQ ID NO: 1707651 - protein, 10 aa, Staphylococcus aureus
KDKLPDRKNY

SEQ ID NO: 1707652 - protein, 5 aa, Staphylococcus aureus
KEEIS

SEQ ID NO: 1707653 - protein, 7 aa, Staphylococcus aureus
KFNPDAK

SEQ ID NO: 1707654 - protein, 6 aa, Staphylococcus aureus
KGENTF

SEQ ID NO: 1707655 - protein, 47 aa, Staphylococcus aureus
KGTNRTYSNDPKQNITDSAAGGTAFSSGHKTYNGAIGVDSNKQKVKT

SEQ ID NO: 1707656 - protein, 6 aa, Staphylococcus aureus
KKAATL

SEQ ID NO: 1707657 - protein, 6 aa, Staphylococcus aureus
KKAEVE

SEQ ID NO: 1707658 - protein, 4 aa, Staphylococcus aureus
KKDF

SEQ ID NO: 1707659 - protein, 6 aa, Staphylococcus aureus
KKGDKV

SEQ ID NO: 1707660 - protein, 7 aa, Staphylococcus aureus
KNGDTLI

SEQ ID NO: 1707661 - protein, 5 aa, Staphylococcus aureus
KNYED

SEQ ID NO: 1707662 - protein, 8 aa, Staphylococcus aureus
KPNNTHEQ

SEQ ID NO: 1707663 - protein, 6 aa, Staphylococcus aureus
KPQFTY

SEQ ID NO: 1707664 - protein, 18 aa, Staphylococcus aureus
KPSINTKKPFYDDINPIE

SEQ ID NO: 1707665 - protein, 12 aa, Staphylococcus aureus
KRENATTDKTAY

SEQ ID NO: 1707666 - protein, 24 aa, Staphylococcus aureus
KRSPKYNPGMNNHDETDGESEDIQ

SEQ ID NO: 1707667 - protein, 10 aa, Staphylococcus aureus
KSEAQAKKEK

SEQ ID NO: 1707668 - protein, 6 aa, Staphylococcus aureus
KSSVDD

SEQ ID NO: 1707669 - protein, 16 aa, Staphylococcus aureus
KTEKYEVAQDNQKKYP

SEQ ID NO: 1707670 - protein, 5 aa, Staphylococcus aureus
KTKKK

SEQ ID NO: 1707671 - protein, 14 aa, Staphylococcus aureus
KTQGANTSKQDVEA

SEQ ID NO: 1707672 - protein, 16 aa, Staphylococcus aureus
KYNNGEFSYNPEAPIY

SEQ ID NO: 1707673 - protein, 14 aa, Staphylococcus aureus
LADQAKKDDERATK

SEQ ID NO: 1707674 - protein, 5 aa, Staphylococcus aureus
LDENT

SEQ ID NO: 1707675 - protein, 12 aa, Staphylococcus aureus
LKDKPNMPQKSQ

SEQ ID NO: 1707676 - protein, 19 aa, Staphylococcus aureus
LKSYNNGDVSINSNVPSYD

SEQ ID NO: 1707677 - protein, 14 aa, Staphylococcus aureus
LNKSTGPNTAQNAV

SEQ ID NO: 1707678 - protein, 6 aa, Staphylococcus aureus
LPNGDY

SEQ ID NO: 1707679 - protein, 11 aa, Staphylococcus aureus
LPSGQGTRNVE

SEQ ID NO: 1707680 - protein, 9 aa, Staphylococcus aureus
LSKTSKVIE

SEQ ID NO: 1707681 - protein, 22 aa, Staphylococcus aureus
LSRASDYFSEAGATPATKAFGR

SEQ ID NO: 1707682 - protein, 10 aa, Staphylococcus aureus
LTAARNKVQQ

SEQ ID NO: 1707683 - protein, 9 aa, Staphylococcus aureus
LYNGEFNKG

SEQ ID NO: 1707684 - protein, 58 aa, Staphylococcus aureus; identical to SEQ ID NO: 1632710

SEQ ID NO: 1707685 - protein, 12 aa, Staphylococcus aureus
NAKAGKYQEKYQ

SEQ ID NO: 1707686 - protein, 19 aa, Staphylococcus aureus
NAKAPSRDVKGQNLTHGTN

SEQ ID NO: 1707687 - protein, 44 aa, Staphylococcus aureus; identical to SEQ ID NO: 1564149

SEQ ID NO: 1707688 - protein, 16 aa, Staphylococcus aureus
NATTGATREEKQEAIN

SEQ ID NO: 1707689 - protein, 8 aa, Staphylococcus aureus
NDNKTATV

SEQ ID NO: 1707690 - protein, 13 aa, Staphylococcus aureus
NERFDNPEYKEAM

SEQ ID NO: 1707691 - protein, 15 aa, Staphylococcus aureus
NHDDLKNNFSTDSKN

SEQ ID NO: 1707692 - protein, 10 aa, Staphylococcus aureus
NHENSYSKNY

SEQ ID NO: 1707693 - protein, 17 aa, Staphylococcus aureus
NLNDRNSHHLKEAERDL

SEQ ID NO: 1707694 - protein, 37 aa, Staphylococcus aureus; identical to SEQ ID NO: 1566438

SEQ ID NO: 1707695 - protein, 24 aa, Staphylococcus aureus
NNVNSAKHALNGTQNLNNAKQAAI

SEQ ID NO: 1707696 - protein, 5 aa, Staphylococcus aureus
NQNIR

SEQ ID NO: 1707697 - protein, 32 aa, Staphylococcus aureus
NQTSDKYEEDSNIDAEKFEKDNKPVYEENNMK

SEQ ID NO: 1707698 - protein, 15 aa, Staphylococcus aureus
NVQRQNLQSQINGAH

SEQ ID NO: 1707699 - protein, 10 aa, Staphylococcus aureus
NYKNQNTVTF

SEQ ID NO: 1707700 - protein, 9 aa, Staphylococcus aureus
PAAVASNNV

SEQ ID NO: 1707701 - protein, 21 aa, Staphylococcus aureus
PIANAESNSNIKAKDKKHVQV

SEQ ID NO: 1707702 - protein, 6 aa, Staphylococcus aureus
PQIQKN

SEQ ID NO: 1707703 - protein, 15 aa, Staphylococcus aureus
PSKLNKDQIKEEMLA

SEQ ID NO: 1707704 - protein, 15 aa, Staphylococcus aureus
PTNANTNAFRPGGVQ

SEQ ID NO: 1707705 - protein, 14 aa, Staphylococcus aureus
QDDMKKVKKENKKL

SEQ ID NO: 1707706 - protein, 7 aa, Staphylococcus aureus
QEGALNS

SEQ ID NO: 1707707 - protein, 7 aa, Staphylococcus aureus
QGKPALD

SEQ ID NO: 1707708 - protein, 12 aa, Staphylococcus aureus
QHDADYHEENMT

SEQ ID NO: 1707709 - protein, 31 aa, Staphylococcus aureus; identical to SEQ ID NO: 1566089

SEQ ID NO: 1707710 - protein, 12 aa, Staphylococcus aureus
QRINPEVKKNAL

SEQ ID NO: 1707711 - protein, 27 aa, Staphylococcus aureus
QSVTSTENALNGDANLQRAKTEATQAI

SEQ ID NO: 1707712 - protein, 26 aa, Staphylococcus aureus
QVNTTKAALNGTQNLEKAKQHANTAI

SEQ ID NO: 1707713 - protein, 10 aa, Staphylococcus aureus
RDTTGTNDAN

SEQ ID NO: 1707714 - protein, 59 aa, Staphylococcus aureus; identical to SEQ ID NO: 1627696

SEQ ID NO: 1707715 - protein, 5 aa, Staphylococcus aureus
SAHSE

SEQ ID NO: 1707716 - protein, 17 aa, Staphylococcus aureus
SHDERKNLNSSQGKNEI

SEQ ID NO: 1707717 - protein, 9 aa, Staphylococcus aureus
SKEENSELS

SEQ ID NO: 1707718 - protein, 7 aa, Staphylococcus aureus
SKEGRDI

SEQ ID NO: 1707719 - protein, 4 aa, Staphylococcus aureus
SNVK

SEQ ID NO: 1707720 - protein, 9 aa, Staphylococcus aureus
SPINGDLDG

SEQ ID NO: 1707721 - protein, 61 aa, Staphylococcus aureus; identical to SEQ ID NO: 1566488

SEQ ID NO: 1707722 - protein, 6 aa, Staphylococcus aureus
SYGPKQ

SEQ ID NO: 1707723 - protein, 8 aa, Staphylococcus aureus
TGSNTVSV

SEQ ID NO: 1707724 - protein, 19 aa, Staphylococcus aureus
TKKARFDDKKVVSFGAFED

SEQ ID NO: 1707725 - protein, 11 aa, Staphylococcus aureus
TNDERNRKEKI

SEQ ID NO: 1707726 - protein, 7 aa, Staphylococcus aureus
TNVSGSF

SEQ ID NO: 1707727 - protein, 21 aa, Staphylococcus aureus
TPETKHPKKGVEKYGPEASAF

SEQ ID NO: 1707728 - protein, 26 aa, Staphylococcus aureus
TRNESVDSNDSASVTVTPQLQATTEG

SEQ ID NO: 1707729 - protein, 34 aa, Staphylococcus aureus; identical to SEQ ID NO: 1566508

SEQ ID NO: 1707730 - protein, 21 aa, Staphylococcus aureus
TVGGAGTGGLGGASAASVIPG

SEQ ID NO: 1707731 - protein, 33 aa, Staphylococcus aureus; identical to SEQ ID NO: 1566300

SEQ ID NO: 1707732 - protein, 61 aa, Staphylococcus aureus; identical to SEQ ID NO: 1566514

SEQ ID NO: 1707733 - protein, 7 aa, Staphylococcus aureus
VDRNDIE

SEQ ID NO: 1707734 - protein, 12 aa, Staphylococcus aureus
VNTAKDALNGDA

SEQ ID NO: 1707735 - protein, 18 aa, Staphylococcus aureus
VQSVQAKAEVKQQSESEL

SEQ ID NO: 1707736 - protein, 14 aa, Staphylococcus aureus
VTAAKNKATSLNTA

SEQ ID NO: 1707737 - protein, 11 aa, Staphylococcus aureus
VTTDADGKYKF

SEQ ID NO: 1707738 - protein, 97 aa, Staphylococcus aureus; identical to SEQ ID NO: 1645171

SEQ ID NO: 1707739 - protein, 35 aa, Staphylococcus aureus
YKDNPTSQEGKWANQKLKKYKAENKYRKATGQAPI

SEQ ID NO: 1707740 - protein, 27 aa, Staphylococcus aureus
YKDTQSADARMKAKQKVNTLSKPHQNY

SEQ ID NO: 1707741 - protein, 5 aa, Staphylococcus aureus
YNDPS

SEQ ID NO: 1707742 - protein, 13 aa, Staphylococcus aureus
YPDNSSTDNGKID

SEQ ID NO: 1707743 - protein, 6 aa, Staphylococcus aureus
YSTPLT

SEQ ID NO: 1707744 - protein, 8 aa, Staphylococcus aureus
YTGEEDWE

SEQ ID NO: 1707745 - protein, 14 aa, Staphylococcus aureus
AAFQKDAKAKYKDA

SEQ ID NO: 1707746 - protein, 13 aa, Staphylococcus aureus
ADTSQLDKAKSIG

SEQ ID NO: 1707747 - protein, 8 aa, Staphylococcus aureus
AFGSNYDR

SEQ ID NO: 1707748 - protein, 17 aa, Staphylococcus aureus
AFYDDNDPIEYGVYRKD

SEQ ID NO: 1707749 - protein, 14 aa, Staphylococcus aureus
AHASDSLSKSPENW

SEQ ID NO: 1707750 - protein, 12 aa, Staphylococcus aureus
AHGQNMTKAQVE

SEQ ID NO: 1707751 - protein, 14 aa, Staphylococcus aureus
AHHSSKGKGGGNYD

SEQ ID NO: 1707752 - protein, 42 aa, Staphylococcus aureus; identical to SEQ ID NO: 1566143

SEQ ID NO: 1707753 - protein, 34 aa, Staphylococcus aureus; identical to SEQ ID NO: 1567009

SEQ ID NO: 1707754 - protein, 13 aa, Staphylococcus aureus
AKAEDLHDKSELT

SEQ ID NO: 1707755 - protein, 7 aa, Staphylococcus aureus
AKKHKDT

SEQ ID NO: 1707756 - protein, 7 aa, Staphylococcus aureus
AKKYKDE

SEQ ID NO: 1707757 - protein, 15 aa, Staphylococcus aureus
ALDKQSNAKTGKYEL

SEQ ID NO: 1707758 - protein, 14 aa, Staphylococcus aureus
ANNNKAKADSHSKQ

SEQ ID NO: 1707759 - protein, 11 aa, Staphylococcus aureus
ATEANDKNAYG

SEQ ID NO: 1707760 - protein, 10 aa, Staphylococcus aureus
ATKNTDTYNA

SEQ ID NO: 1707761 - protein, 4 aa, Staphylococcus aureus
AYGQ

SEQ ID NO: 1707762 - protein, 22 aa, Staphylococcus aureus
CDGDNKITGDSKETQIKKSFSK

SEQ ID NO: 1707763 - protein, 17 aa, Staphylococcus aureus
DAAHTNAEVEAAKKAAI

SEQ ID NO: 1707764 - protein, 20 aa, Staphylococcus aureus
DALQQQVNSQVDNSHYTTAS

SEQ ID NO: 1707765 - protein, 17 aa, Staphylococcus aureus
DDVEVPSDFEKIRAEVS

SEQ ID NO: 1707766 - protein, 14 aa, Staphylococcus aureus
DEFNEKDQQKNIML

SEQ ID NO: 1707767 - protein, 17 aa, Staphylococcus aureus
DGDNKITGDSKEEQIKK

SEQ ID NO: 1707768 - protein, 13 aa, Staphylococcus aureus
DGKKPSEDMRGKK

SEQ ID NO: 1707769 - protein, 22 aa, Staphylococcus aureus
DGVSKDCKVADKSGQAITYASR

SEQ ID NO: 1707770 - protein, 21 aa, Staphylococcus aureus
DIKDPNNGETIATAKHDTANN

SEQ ID NO: 1707771 - protein, 16 aa, Staphylococcus aureus
DKDGVQGTDSKEKPMA

SEQ ID NO: 1707772 - protein, 14 aa, Staphylococcus aureus
DKKNNYPSNYGKND

SEQ ID NO: 1707773 - protein, 14 aa, Staphylococcus aureus
DKNNPQNYQARGNV

SEQ ID NO: 1707774 - protein, 7 aa, Staphylococcus aureus
DKQHYHT

SEQ ID NO: 1707775 - protein, 28 aa, Staphylococcus aureus
DLAPKATNNKEYTINTEIGNNGNFGASL

SEQ ID NO: 1707776 - protein, 14 aa, Staphylococcus aureus
DNGIRPSTNRSVPT

SEQ ID NO: 1707777 - protein, 8 aa, Staphylococcus aureus
DNKTIDAE

SEQ ID NO: 1707778 - protein, 4 aa, Staphylococcus aureus
DNNN

SEQ ID NO: 1707779 - protein, 17 aa, Staphylococcus aureus
DPKELNDYKYDPEKAKK

SEQ ID NO: 1707780 - protein, 11 aa, Staphylococcus aureus
DQIKDKNSNIT

SEQ ID NO: 1707781 - protein, 10 aa, Staphylococcus aureus
DRNKYKELTH

SEQ ID NO: 1707782 - protein, 6 aa, Staphylococcus aureus
DSEISK

SEQ ID NO: 1707783 - protein, 12 aa, Staphylococcus aureus
DSGDNKNYQAQG

SEQ ID NO: 1707784 - protein, 6 aa, Staphylococcus aureus
DSIDDL

SEQ ID NO: 1707785 - protein, 5 aa, Staphylococcus aureus
DVESL

SEQ ID NO: 1707786 - protein, 17 aa, Staphylococcus aureus
EAAATGTGKGVLGDTKD

SEQ ID NO: 1707787 - protein, 10 aa, Staphylococcus aureus
EAPIKNPKKA

SEQ ID NO: 1707788 - protein, 11 aa, Staphylococcus aureus
EAVSNTGTQLN

SEQ ID NO: 1707789 - protein, 12 aa, Staphylococcus aureus
EDNGMMGQIKVT

SEQ ID NO: 1707790 - protein, 12 aa, Staphylococcus aureus
EGGHLEKTKKLK

SEQ ID NO: 1707791 - protein, 11 aa, Staphylococcus aureus
EIKKDKEIPNG

SEQ ID NO: 1707792 - protein, 10 aa, Staphylococcus aureus
EKGTKNTAQF

SEQ ID NO: 1707793 - protein, 4 aa, Staphylococcus aureus
EPSF

SEQ ID NO: 1707794 - protein, 17 aa, Staphylococcus aureus
ESDSSLRSEDKGDDMST

SEQ ID NO: 1707795 - protein, 5 aa, Staphylococcus aureus
ESTGK

SEQ ID NO: 1707796 - protein, 9 aa, Staphylococcus aureus
ETKLSDNAK

SEQ ID NO: 1707797 - protein, 4 aa, Staphylococcus aureus
FNGV

SEQ ID NO: 1707798 - protein, 7 aa, Staphylococcus aureus
FNSGFNK

SEQ ID NO: 1707799 - protein, 30 aa, Staphylococcus aureus; identical to SEQ ID NO: 1566022

SEQ ID NO: 1707800 - protein, 20 aa, Staphylococcus aureus
FVASEDKLNKIADSSAASKI

SEQ ID NO: 1707801 - protein, 17 aa, Staphylococcus aureus
GGITKTNGTQHKDTVQN

SEQ ID NO: 1707802 - protein, 13 aa, Staphylococcus aureus
GGNGPGNKSTKGY

SEQ ID NO: 1707803 - protein, 9 aa, Staphylococcus aureus
GHINETSAA

SEQ ID NO: 1707804 - protein, 7 aa, Staphylococcus aureus
GITKKNV

SEQ ID NO: 1707805 - protein, 17 aa, Staphylococcus aureus
GKEGYRDGEFKKDDKGT

SEQ ID NO: 1707806 - protein, 4 aa, Staphylococcus aureus
GKIT

SEQ ID NO: 1707807 - protein, 8 aa, Staphylococcus aureus
GKSQGRDI

SEQ ID NO: 1707808 - protein, 16 aa, Staphylococcus aureus
GPEYPTMENKTVQGEI

SEQ ID NO: 1707809 - protein, 7 aa, Staphylococcus aureus
GSNARDL

SEQ ID NO: 1707810 - protein, 4 aa, Staphylococcus aureus
GSNF

SEQ ID NO: 1707811 - protein, 5 aa, Staphylococcus aureus
GSYID

SEQ ID NO: 1707812 - protein, 13 aa, Staphylococcus aureus
GTTLNSEKLAQER

SEQ ID NO: 1707813 - protein, 142 aa, Staphylococcus aureus
HEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQ

SEQ ID NO: 1707814 - protein, 8 aa, Staphylococcus aureus
HNNTSPWV

SEQ ID NO: 1707815 - protein, 75 aa, Staphylococcus aureus; identical to SEQ ID NO: 1565687

SEQ ID NO: 1707816 - protein, 15 aa, Staphylococcus aureus
HQTVTTKSVSTDKKM

SEQ ID NO: 1707817 - protein, 4 aa, Staphylococcus aureus
HTVP

SEQ ID NO: 1707818 - protein, 27 aa, Staphylococcus aureus
IANNDATKASEDYVDANNDKQTAYNNA

SEQ ID NO: 1707819 - protein, 4 aa, Staphylococcus aureus
IKRN

SEQ ID NO: 1707820 - protein, 26 aa, Staphylococcus aureus
IPTKQAPELKLKGSGNLKGSSVGSKD

SEQ ID NO: 1707821 - protein, 6 aa, Staphylococcus aureus
IQDADS

SEQ ID NO: 1707822 - protein, 4 aa, Staphylococcus aureus
ISEN

SEQ ID NO: 1707823 - protein, 6 aa, Staphylococcus aureus
ISGTPD

SEQ ID NO: 1707824 - protein, 55 aa, Staphylococcus aureus
ITPDANVKPAAKQAIADKVQAQETAIDGNNGSTTEEKAAAKQQVQTEKTTADAAI

SEQ ID NO: 1707825 - protein, 5 aa, Staphylococcus aureus
KAATL

SEQ ID NO: 1707826 - protein, 12 aa, Staphylococcus aureus
KAEKVDKNRPVT

SEQ ID NO: 1707827 - protein, 7 aa, Staphylococcus aureus
KDEAIKK

SEQ ID NO: 1707828 - protein, 31 aa, Staphylococcus aureus; identical to SEQ ID NO: 1627159

SEQ ID NO: 1707829 - protein, 15 aa, Staphylococcus aureus
KEKSTNKDTTPKVDK

SEQ ID NO: 1707830 - protein, 65 aa, Staphylococcus aureus
KETREAIANADESWKTRTVKNYGESETKSPVVKEEKKVEEPQLPKVGNQQEDKITVGTTEEAPLP

SEQ ID NO: 1707831 - protein, 7 aa, Staphylococcus aureus
KGENDYE

SEQ ID NO: 1707832 - protein, 7 aa, Staphylococcus aureus
KKENRPI

SEQ ID NO: 1707833 - protein, 6 aa, Staphylococcus aureus
KNRSQN

SEQ ID NO: 1707834 - protein, 13 aa, Staphylococcus aureus
KNWEGQASSNGFK

SEQ ID NO: 1707835 - protein, 13 aa, Staphylococcus aureus
KQHGPNTAQNAVE

SEQ ID NO: 1707836 - protein, 21 aa, Staphylococcus aureus
KQNTISTDKVSTQKKEVTAQE

SEQ ID NO: 1707837 - protein, 9 aa, Staphylococcus aureus
KSDEISGEK

SEQ ID NO: 1707838 - protein, 10 aa, Staphylococcus aureus
KTNDQGKIEK

SEQ ID NO: 1707839 - protein, 13 aa, Staphylococcus aureus
KVDDETVQKFNDG

SEQ ID NO: 1707840 - protein, 4 aa, Staphylococcus aureus
KVEM

SEQ ID NO: 1707841 - protein, 9 aa, Staphylococcus aureus
KVQNDQYGL

SEQ ID NO: 1707842 - protein, 11 aa, Staphylococcus aureus
KYQVTNDDYNV

SEQ ID NO: 1707843 - protein, 7 aa, Staphylococcus aureus
LAPSARK

SEQ ID NO: 1707844 - protein, 8 aa, Staphylococcus aureus
LEDKNSKL

SEQ ID NO: 1707845 - protein, 4 aa, Staphylococcus aureus
LEGM

SEQ ID NO: 1707846 - protein, 23 aa, Staphylococcus aureus
LEKESIQDVKNTKKYKNVERSKS

SEQ ID NO: 1707847 - protein, 13 aa, Staphylococcus aureus
LKDNYNNKLDKTY

SEQ ID NO: 1707848 - protein, 34 aa, Staphylococcus aureus; identical to SEQ ID NO: 1565572

SEQ ID NO: 1707849 - protein, 8 aa, Staphylococcus aureus
LPKARLSK

SEQ ID NO: 1707850 - protein, 5 aa, Staphylococcus aureus
MKEEK

SEQ ID NO: 1707851 - protein, 10 aa, Staphylococcus aureus
MKKNDRNIQQ

SEQ ID NO: 1707852 - protein, 17 aa, Staphylococcus aureus
NAGHEAQASEADLNKAS

SEQ ID NO: 1707853 - protein, 33 aa, Staphylococcus aureus; identical to SEQ ID NO: 1565723

SEQ ID NO: 1707854 - protein, 33 aa, Staphylococcus aureus; identical to SEQ ID NO: 1565905

SEQ ID NO: 1707855 - protein, 30 aa, Staphylococcus aureus
NAYANEEQKSSLLENQKEKLKSKNIEVSQM

SEQ ID NO: 1707856 - protein, 19 aa, Staphylococcus aureus
NDAQKQALTTQVEQAPDIA

SEQ ID NO: 1707857 - protein, 8 aa, Staphylococcus aureus
NGEEDNSY

SEQ ID NO: 1707858 - protein, 10 aa, Staphylococcus aureus
NGKLSKKNKN

SEQ ID NO: 1707859 - protein, 15 aa, Staphylococcus aureus
NKDHGANKDKQAVEQ

SEQ ID NO: 1707860 - protein, 9 aa, Staphylococcus aureus
NQGDSGNDL

SEQ ID NO: 1707861 - protein, 22 aa, Staphylococcus aureus
NSSSDTAEKAKEDSKEEQIKKS

SEQ ID NO: 1707862 - protein, 9 aa, Staphylococcus aureus
NTKKATGYY

SEQ ID NO: 1707863 - protein, 13 aa, Staphylococcus aureus
NVTINGKKFDPNR

SEQ ID NO: 1707864 - protein, 15 aa, Staphylococcus aureus
NYTKTKDEDGTQGDT

SEQ ID NO: 1707865 - protein, 5 aa, Staphylococcus aureus
PSEIT

SEQ ID NO: 1707866 - protein, 14 aa, Staphylococcus aureus
PTKPIKDEKLKKEI

SEQ ID NO: 1707867 - protein, 34 aa, Staphylococcus aureus
PTTFKAGSYGSEKGADPQPNTPDDHTPPNQNEKV

SEQ ID NO: 1707868 - protein, 13 aa, Staphylococcus aureus
QDFPAGNGSSAAD

SEQ ID NO: 1707869 - protein, 29 aa, Staphylococcus aureus
QGIADKDQTKANGNFVNADTDKQNAYNNA

SEQ ID NO: 1707870 - protein, 39 aa, Staphylococcus aureus
QHADAAENYTNYNYNTTQTTTTTTTTTTTSSISHSGNLY

SEQ ID NO: 1707871 - protein, 9 aa, Staphylococcus aureus
QNKNEDMQK

SEQ ID NO: 1707872 - protein, 11 aa, Staphylococcus aureus
QTDKKSVTAQE

SEQ ID NO: 1707873 - protein, 49 aa, Staphylococcus aureus; identical to SEQ ID NO: 1567213

SEQ ID NO: 1707874 - protein, 10 aa, Staphylococcus aureus
RSMTENKEGK

SEQ ID NO: 1707875 - protein, 6 aa, Staphylococcus aureus
SAHSEQ

SEQ ID NO: 1707876 - protein, 9 aa, Staphylococcus aureus
SDKVPQKVK

SEQ ID NO: 1707877 - protein, 44 aa, Staphylococcus aureus
SELNANKNTTKDKIKNEAVVKTSDTSLKLDNKSAISNGNEINQD

SEQ ID NO: 1707878 - protein, 15 aa, Staphylococcus aureus
SGEKDNAVSDKTVRQ

SEQ ID NO: 1707879 - protein, 10 aa, Staphylococcus aureus
SGQSVHTPHE

SEQ ID NO: 1707880 - protein, 21 aa, Staphylococcus aureus
SINNAQKRDLTTKIDQATTVA

SEQ ID NO: 1707881 - protein, 15 aa, Staphylococcus aureus
SKANGSNASQTEVEQ

SEQ ID NO: 1707882 - protein, 13 aa, Staphylococcus aureus
SKDIRGISVTINQ

SEQ ID NO: 1707883 - protein, 13 aa, Staphylococcus aureus
SKDNVGKVTGGKT

SEQ ID NO: 1707884 - protein, 7 aa, Staphylococcus aureus
SKDTRQF

SEQ ID NO: 1707885 - protein, 7 aa, Staphylococcus aureus
SKEDRDI

SEQ ID NO: 1707886 - protein, 4 aa, Staphylococcus aureus
SKKV

SEQ ID NO: 1707887 - protein, 12 aa, Staphylococcus aureus
SKSNKPDEIDDE

SEQ ID NO: 1707888 - protein, 9 aa, Staphylococcus aureus
SLEPGQKAK

SEQ ID NO: 1707889 - protein, 10 aa, Staphylococcus aureus
SNGDVGPGNL

SEQ ID NO: 1707890 - protein, 5 aa, Staphylococcus aureus
SNNQS

SEQ ID NO: 1707891 - protein, 17 aa, Staphylococcus aureus
SPKNKDDLNKSKEDMNY

SEQ ID NO: 1707892 - protein, 24 aa, Staphylococcus aureus
SQSDTAENPKEGSKEAQIKKSFSK

SEQ ID NO: 1707893 - protein, 40 aa, Staphylococcus aureus
SRTEHRESEPQVTELTSANKVSALSNPKDGFLKKFLYHLK

SEQ ID NO: 1707894 - protein, 36 aa, Staphylococcus aureus
SSANASQTDNGVNRSGSEDPTVYSATSTKKLHKEPA

SEQ ID NO: 1707895 - protein, 27 aa, Staphylococcus aureus
STIENESKKDRNTETNTETKSVPEEME

SEQ ID NO: 1707896 - protein, 8 aa, Staphylococcus aureus
STNSTQNN

SEQ ID NO: 1707897 - protein, 8 aa, Staphylococcus aureus
STQDYQQR

SEQ ID NO: 1707898 - protein, 13 aa, Staphylococcus aureus
STQIDDGAETNYD

SEQ ID NO: 1707899 - protein, 5 aa, Staphylococcus aureus
TAAEG

SEQ ID NO: 1707900 - protein, 23 aa, Staphylococcus aureus
TDKGKGILDKEGTKVIKGKTKFA

SEQ ID NO: 1707901 - protein, 18 aa, Staphylococcus aureus
TEDSKGYSRSKEKKYPVK

SEQ ID NO: 1707902 - protein, 24 aa, Staphylococcus aureus
TFAPDSDKILSSVGKAELAKGGNL

SEQ ID NO: 1707903 - protein, 12 aa, Staphylococcus aureus
TIKQTAQDLNQA

SEQ ID NO: 1707904 - protein, 16 aa, Staphylococcus aureus
TKASGQNVDKAAVEQA

SEQ ID NO: 1707905 - protein, 18 aa, Staphylococcus aureus
TKDKKGYTHDKDKKYPVK

SEQ ID NO: 1707906 - protein, 25 aa, Staphylococcus aureus
TKLEKESIQDVKNTKKYKNVERSKS

SEQ ID NO: 1707907 - protein, 7 aa, Staphylococcus aureus
TKNYQGV

SEQ ID NO: 1707908 - protein, 9 aa, Staphylococcus aureus
TKPIPDDKL

SEQ ID NO: 1707909 - protein, 36 aa, Staphylococcus aureus; identical to SEQ ID NO: 1566968

SEQ ID NO: 1707910 - protein, 40 aa, Staphylococcus aureus; identical to SEQ ID NO: 1627968

SEQ ID NO: 1707911 - protein, 5 aa, Staphylococcus aureus
TPRDY

SEQ ID NO: 1707912 - protein, 32 aa, Staphylococcus aureus; identical to SEQ ID NO: 1624077

SEQ ID NO: 1707913 - protein, 14 aa, Staphylococcus aureus
TSEKTIDRTSNESL

SEQ ID NO: 1707914 - protein, 36 aa, Staphylococcus aureus; identical to SEQ ID NO: 1564728

SEQ ID NO: 1707915 - protein, 22 aa, Staphylococcus aureus
TTIASTADASEGYGPREKKPVS

SEQ ID NO: 1707916 - protein, 98 aa, Staphylococcus aureus
TTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPK

SEQ ID NO: 1707917 - protein, 12 aa, Staphylococcus aureus
TVKQSTKNYPPT

SEQ ID NO: 1707918 - protein, 11 aa, Staphylococcus aureus
TVRDNAQTLNT

SEQ ID NO: 1707919 - protein, 15 aa, Staphylococcus aureus
VDDEDDNSENQINPE

SEQ ID NO: 1707920 - protein, 11 aa, Staphylococcus aureus
VDPKLTTKEGK

SEQ ID NO: 1707921 - protein, 10 aa, Staphylococcus aureus
VGKEGADKRI

SEQ ID NO: 1707922 - protein, 11 aa, Staphylococcus aureus
VKDKNSPESHR

SEQ ID NO: 1707923 - protein, 11 aa, Staphylococcus aureus
VKQNAQNLNNA

SEQ ID NO: 1707924 - protein, 9 aa, Staphylococcus aureus
VKSEDYYGS

SEQ ID NO: 1707925 - protein, 13 aa, Staphylococcus aureus
VNASEHEAKYENV

SEQ ID NO: 1707926 - protein, 7 aa, Staphylococcus aureus
VNRKETW

SEQ ID NO: 1707927 - protein, 10 aa, Staphylococcus aureus
VSQNPNDPHL

SEQ ID NO: 1707928 - protein, 15 aa, Staphylococcus aureus
VTDKTTQNKKDTREV

SEQ ID NO: 1707929 - protein, 10 aa, Staphylococcus aureus
YDIPTKKAPE

SEQ ID NO: 1707930 - protein, 22 aa, Staphylococcus aureus
YGARPQFNKPAAKTDATIKKEQ

SEQ ID NO: 1707931 - protein, 4 aa, Staphylococcus aureus
YKTY

SEQ ID NO: 1707932 - protein, 8 aa, Staphylococcus aureus
YNIPTEKA

SEQ ID NO: 1707933 - protein, 4 aa, Staphylococcus aureus
AAEG

SEQ ID NO: 1707934 - protein, 8 aa, Staphylococcus aureus
AAVTAANT

SEQ ID NO: 1707935 - protein, 10 aa, Staphylococcus aureus
ADKNNKIVPA

SEQ ID NO: 1707936 - protein, 113 aa, Staphylococcus aureus
AGANSATTQAANTRQERTPKLEKAPNTNEEKTSASKIEKISQPKQEEQKSLNISATPAPKQEQSQTTTESTTPKTKVTTPPSTNTPQPMQSTKSDTPQSPTIKQAQTDMTPKY

SEQ ID NO: 1707937 - protein, 15 aa, Staphylococcus aureus
AKAANDTEDIGKGND

SEQ ID NO: 1707938 - protein, 10 aa, Staphylococcus aureus
AKDNANTAID

SEQ ID NO: 1707939 - protein, 7 aa, Staphylococcus aureus
AKINDQE

SEQ ID NO: 1707940 - protein, 8 aa, Staphylococcus aureus
AKQLGGLN

SEQ ID NO: 1707941 - protein, 10 aa, Staphylococcus aureus
AKSNKPGVLD

SEQ ID NO: 1707942 - protein, 12 aa, Staphylococcus aureus
AKSNKQGGLSNE

SEQ ID NO: 1707943 - protein, 14 aa, Staphylococcus aureus
ALPNGEIKARSSIS

SEQ ID NO: 1707944 - protein, 18 aa, Staphylococcus aureus
ALPSHEASADSNNGYKEL

SEQ ID NO: 1707945 - protein, 12 aa, Staphylococcus aureus
AMDDSTKAKYKQ

SEQ ID NO: 1707946 - protein, 27 aa, Staphylococcus aureus
AMNNESKKDTNTETNTETKSVPEEMEA

SEQ ID NO: 1707947 - protein, 23 aa, Staphylococcus aureus
ANDLNQAQKDALKQQVDAAQTVA

SEQ ID NO: 1707948 - protein, 41 aa, Staphylococcus aureus; identical to SEQ ID NO: 1567320

SEQ ID NO: 1707949 - protein, 11 aa, Staphylococcus aureus
AQDKQTAGNSL

SEQ ID NO: 1707950 - protein, 5 aa, Staphylococcus aureus
AQKHM

SEQ ID NO: 1707951 - protein, 6 aa, Staphylococcus aureus
ATKVKS

SEQ ID NO: 1707952 - protein, 5 aa, Staphylococcus aureus
ATLGK

SEQ ID NO: 1707953 - protein, 15 aa, Staphylococcus aureus
AVTNNDVKRVETNGI

SEQ ID NO: 1707954 - protein, 86 aa, Staphylococcus aureus
CGEKEKPKKEENKKSQTQKHKDSKPKTQQEKMKKVEDKNPPNNSIQNNSNNQNQSQNNQLNNNSDPSNNTPANINENDSQNTNLND

SEQ ID NO: 1707955 - protein, 18 aa, Staphylococcus aureus
CGGGNKITGDSKETQIKK

SEQ ID NO: 1707956 - protein, 20 aa, Staphylococcus aureus
CSTTNNESNKETKSVPEEME

SEQ ID NO: 1707957 - protein, 19 aa, Staphylococcus aureus
DADEQKRNAYNQAVSNAET

SEQ ID NO: 1707958 - protein, 11 aa, Staphylococcus aureus
DAQKQSFESQI

SEQ ID NO: 1707959 - protein, 17 aa, Staphylococcus aureus
DDVEAPSDFEKIRAEVS

SEQ ID NO: 1707960 - protein, 22 aa, Staphylococcus aureus
DFKNGTTKDGVKKFDGTGPFKL

SEQ ID NO: 1707961 - protein, 8 aa, Staphylococcus aureus
DITKDSSI

SEQ ID NO: 1707962 - protein, 18 aa, Staphylococcus aureus
DKEGYRDDEFKKGDKGTW

SEQ ID NO: 1707963 - protein, 17 aa, Staphylococcus aureus
DKEGYRDGEFKKGDKGT

SEQ ID NO: 1707964 - protein, 12 aa, Staphylococcus aureus
DKEKYKEGIEGK

SEQ ID NO: 1707965 - protein, 5 aa, Staphylococcus aureus
DKMSG

SEQ ID NO: 1707966 - protein, 8 aa, Staphylococcus aureus
DKTTTLAS

SEQ ID NO: 1707967 - protein, 18 aa, Staphylococcus aureus
DNKTVDSTQFHLDVEISK

SEQ ID NO: 1707968 - protein, 16 aa, Staphylococcus aureus
DSNSSLRSEDKGDDMS

SEQ ID NO: 1707969 - protein, 17 aa, Staphylococcus aureus
DSNSSLRSEDKGDDMST

SEQ ID NO: 1707970 - protein, 16 aa, Staphylococcus aureus
DTNKDGIQDANEPGIK

SEQ ID NO: 1707971 - protein, 18 aa, Staphylococcus aureus
DTNKDGKQDSTEKGISGV

SEQ ID NO: 1707972 - protein, 18 aa, Staphylococcus aureus
DTNKNGVQDKDEKGISGV

SEQ ID NO: 1707973 - protein, 17 aa, Staphylococcus aureus
DTNKNGVQELGEKGVGN

SEQ ID NO: 1707974 - protein, 4 aa, Staphylococcus aureus
EDKD

SEQ ID NO: 1707975 - protein, 8 aa, Staphylococcus aureus
EDQKLKER

SEQ ID NO: 1707976 - protein, 10 aa, Staphylococcus aureus
EHQNSKSVQW

SEQ ID NO: 1707977 - protein, 4 aa, Staphylococcus aureus
EHRM

SEQ ID NO: 1707978 - protein, 10 aa, Staphylococcus aureus
EKIERTKDMP

SEQ ID NO: 1707979 - protein, 10 aa, Staphylococcus aureus
ELPNTGSEEM

SEQ ID NO: 1707980 - protein, 9 aa, Staphylococcus aureus
ENEKQYQYT

SEQ ID NO: 1707981 - protein, 39 aa, Staphylococcus aureus
ENKHEKENTHNINNNGSEANENFNNNKNRIENIEDKQKA

SEQ ID NO: 1707982 - protein, 7 aa, Staphylococcus aureus
EQTHQSH

SEQ ID NO: 1707983 - protein, 31 aa, Staphylococcus aureus; identical to SEQ ID NO: 1563238

SEQ ID NO: 1707984 - protein, 8 aa, Staphylococcus aureus
ETKLSDNA

SEQ ID NO: 1707985 - protein, 18 aa, Staphylococcus aureus
ETSNDTLKKTEDKEKRYP

SEQ ID NO: 1707986 - protein, 46 aa, Staphylococcus aureus
EVSSSSPDLGDDEEDEEVEESSTEKAGAEEESTDAKATYTTPRYEK

SEQ ID NO: 1707987 - protein, 17 aa, Staphylococcus aureus
FKNSPKVNVSNLTDNKN

SEQ ID NO: 1707988 - protein, 21 aa, Staphylococcus aureus
FTDADEAKRNAYTNAVTQAEQ

SEQ ID NO: 1707989 - protein, 13 aa, Staphylococcus aureus
FTPDTSKLKDVTG

SEQ ID NO: 1707990 - protein, 18 aa, Staphylococcus aureus
GGNKGLEEKKENKQLTYT

SEQ ID NO: 1707991 - protein, 33 aa, Staphylococcus aureus
GKIGSTWGNASNWANAAARAGYTVNNTPKAGAI

SEQ ID NO: 1707992 - protein, 7 aa, Staphylococcus aureus
GNDTYSK

SEQ ID NO: 1707993 - protein, 10 aa, Staphylococcus aureus
GTFDKATKQI

SEQ ID NO: 1707994 - protein, 9 aa, Staphylococcus aureus
GVDKNDIEI

SEQ ID NO: 1707995 - protein, 10 aa, Staphylococcus aureus
GVDSKGNELL

SEQ ID NO: 1707996 - protein, 6 aa, Staphylococcus aureus
HDQKAA

SEQ ID NO: 1707997 - protein, 120 aa, Staphylococcus aureus; identical to SEQ ID NO: 1565683

SEQ ID NO: 1707998 - protein, 15 aa, Staphylococcus aureus
HNDTGKGKEYGTSSK

SEQ ID NO: 1707999 - protein, 130 aa, Staphylococcus aureus
HSTSSNHNNEQDNKATHQKKDTEVNHQKDENTNNTNENQNSNNGVTNGNQSSTPSTVQNNGSTAPANTQPSNPNQSNSNQSNSNQGGSSQPSTNNQNHKQQNTPAPNKSNNANTNESSKQASPSQPQSSK

SEQ ID NO: 1708000 - protein, 12 aa, Staphylococcus aureus
HTAQSNANTLDQ

SEQ ID NO: 1708001 - protein, 10 aa, Staphylococcus aureus
HVNKTTGNTE

SEQ ID NO: 1708002 - protein, 12 aa, Staphylococcus aureus
HVSETNIKSQEK

SEQ ID NO: 1708003 - protein, 7 aa, Staphylococcus aureus
IASSVPR

SEQ ID NO: 1708004 - protein, 22 aa, Staphylococcus aureus
IEETPEQKADREFDEKLENTPA

SEQ ID NO: 1708005 - protein, 4 aa, Staphylococcus aureus
IKFD

SEQ ID NO: 1708006 - protein, 12 aa, Staphylococcus aureus
IKQNADALNNAM

SEQ ID NO: 1708007 - protein, 11 aa, Staphylococcus aureus
INNDKNNAIAE

SEQ ID NO: 1708008 - protein, 13 aa, Staphylococcus aureus
INSNDAGVNFELT

SEQ ID NO: 1708009 - protein, 21 aa, Staphylococcus aureus
IPSDLTDKNDPIDITDPSGEV

SEQ ID NO: 1708010 - protein, 61 aa, Staphylococcus aureus; identical to SEQ ID NO: 1638493

SEQ ID NO: 1708011 - protein, 20 aa, Staphylococcus aureus
ITNEDENFVKDDQRAGVDAN

SEQ ID NO: 1708012 - protein, 16 aa, Staphylococcus aureus
ITRPKEITKRFVQVME

SEQ ID NO: 1708013 - protein, 4 aa, Staphylococcus aureus
IVEK

SEQ ID NO: 1708014 - protein, 7 aa, Staphylococcus aureus
KDDKTYE

SEQ ID NO: 1708015 - protein, 6 aa, Staphylococcus aureus
KEPKYN

SEQ ID NO: 1708016 - protein, 25 aa, Staphylococcus aureus
KGDIDVTNDATGAMAKDAKSSNAGL

SEQ ID NO: 1708017 - protein, 7 aa, Staphylococcus aureus
KGQSFSI

SEQ ID NO: 1708018 - protein, 9 aa, Staphylococcus aureus
KHDAFKNRN

SEQ ID NO: 1708019 - protein, 11 aa, Staphylococcus aureus
KHEGNHFDNGN

SEQ ID NO: 1708020 - protein, 36 aa, Staphylococcus aureus
KKAPKVNVSNLADNKNFVASEDKLNKIADPSAASKI

SEQ ID NO: 1708021 - protein, 16 aa, Staphylococcus aureus
KKYNNGDVSINENVPS

SEQ ID NO: 1708022 - protein, 23 aa, Staphylococcus aureus
KLEKERMGESIDGRQIQKILVEM

SEQ ID NO: 1708023 - protein, 21 aa, Staphylococcus aureus
KNENGEVLQTTKTDKDGKYQF

SEQ ID NO: 1708024 - protein, 10 aa, Staphylococcus aureus
KNFKTRTFKS

SEQ ID NO: 1708025 - protein, 4 aa, Staphylococcus aureus
KNYE

SEQ ID NO: 1708026 - protein, 7 aa, Staphylococcus aureus
KPTINTK

SEQ ID NO: 1708027 - protein, 4 aa, Staphylococcus aureus
KPTY

SEQ ID NO: 1708028 - protein, 15 aa, Staphylococcus aureus
KQLQPYGQYHGGGAH

SEQ ID NO: 1708029 - protein, 14 aa, Staphylococcus aureus
KQTTNPTMDPNTIQ

SEQ ID NO: 1708030 - protein, 10 aa, Staphylococcus aureus
KSKDLNIESS

SEQ ID NO: 1708031 - protein, 8 aa, Staphylococcus aureus
KSLSNDNY

SEQ ID NO: 1708032 - protein, 9 aa, Staphylococcus aureus
KSNNNSELS

SEQ ID NO: 1708033 - protein, 16 aa, Staphylococcus aureus
KSSVESDSSYKQNDYL

SEQ ID NO: 1708034 - protein, 7 aa, Staphylococcus aureus
KSYRDAL

SEQ ID NO: 1708035 - protein, 14 aa, Staphylococcus aureus
KTAGGNTPKADVER

SEQ ID NO: 1708036 - protein, 14 aa, Staphylococcus aureus
KTQGANTPKQDVEA

SEQ ID NO: 1708037 - protein, 6 aa, Staphylococcus aureus
KTTNDT

SEQ ID NO: 1708038 - protein, 7 aa, Staphylococcus aureus
KYEYGDN

SEQ ID NO: 1708039 - protein, 16 aa, Staphylococcus aureus
KYNTSVESIKQNNQLD

SEQ ID NO: 1708040 - protein, 6 aa, Staphylococcus aureus
LENGTY

SEQ ID NO: 1708041 - protein, 32 aa, Staphylococcus aureus; identical to SEQ ID NO: 1565715

SEQ ID NO: 1708042 - protein, 14 aa, Staphylococcus aureus
LGPDYTDLTEQNTH

SEQ ID NO: 1708043 - protein, 8 aa, Staphylococcus aureus
LKDENDKV

SEQ ID NO: 1708044 - protein, 22 aa, Staphylococcus aureus
LKDSTGKVIGTTTTDASGKYKF

SEQ ID NO: 1708045 - protein, 15 aa, Staphylococcus aureus
LNNGGESSITGTADL

SEQ ID NO: 1708046 - protein, 9 aa, Staphylococcus aureus
LNQPQRDAL

SEQ ID NO: 1708047 - protein, 7 aa, Staphylococcus aureus
LRKDAVN

SEQ ID NO: 1708048 - protein, 8 aa, Staphylococcus aureus
LTAARNKI

SEQ ID NO: 1708049 - protein, 21 aa, Staphylococcus aureus
LTPAQQQALENQINNATTRDK

SEQ ID NO: 1708050 - protein, 49 aa, Staphylococcus aureus
LVKSDTNDAVATNDQSSSDASNQTNTNTSNQNTSTTNNTNDQPQATNNM

SEQ ID NO: 1708051 - protein, 5 aa, Staphylococcus aureus
MSESR

SEQ ID NO: 1708052 - protein, 18 aa, Staphylococcus aureus
NADTNDTIAEKTVEGGPT

SEQ ID NO: 1708053 - protein, 33 aa, Staphylococcus aureus; identical to SEQ ID NO: 1565724

SEQ ID NO: 1708054 - protein, 10 aa, Staphylococcus aureus
NAYKNEKTKE

SEQ ID NO: 1708055 - protein, 25 aa, Staphylococcus aureus
NDKEFKEGMQRARKELNYTANTNTV

SEQ ID NO: 1708056 - protein, 8 aa, Staphylococcus aureus
NDPNLKER

SEQ ID NO: 1708057 - protein, 12 aa, Staphylococcus aureus
NERFDNPEYKEA

SEQ ID NO: 1708058 - protein, 9 aa, Staphylococcus aureus
NGKDNLSAD

SEQ ID NO: 1708059 - protein, 8 aa, Staphylococcus aureus
NGNTVTEI

SEQ ID NO: 1708060 - protein, 10 aa, Staphylococcus aureus
NGQSSSDKQY

SEQ ID NO: 1708061 - protein, 11 aa, Staphylococcus aureus
NHAKASVTESV

SEQ ID NO: 1708062 - protein, 11 aa, Staphylococcus aureus
NIVNGSPNVIT

SEQ ID NO: 1708063 - protein, 15 aa, Staphylococcus aureus
NKQTGQNANQTEVEQ

SEQ ID NO: 1708064 - protein, 6 aa, Staphylococcus aureus
NKRNTI

SEQ ID NO: 1708065 - protein, 16 aa, Staphylococcus aureus
NLNQAQRDEYSKQITQ

SEQ ID NO: 1708066 - protein, 66 aa, Staphylococcus aureus
NNGSIVNQATPTSVQSSTPSAQNNNHTDGNTTATETVSNANNNDVVSNNTALNVPTKTNENGSGGH

SEQ ID NO: 1708067 - protein, 5 aa, Staphylococcus aureus
NNGTY

SEQ ID NO: 1708068 - protein, 10 aa, Staphylococcus aureus
NNKPINTDSV

SEQ ID NO: 1708069 - protein, 6 aa, Staphylococcus aureus
NNPKGS

SEQ ID NO: 1708070 - protein, 17 aa, Staphylococcus aureus
NNTNTKVGEAVTKEDGS

SEQ ID NO: 1708071 - protein, 7 aa, Staphylococcus aureus
NPEDIKN

SEQ ID NO: 1708072 - protein, 6 aa, Staphylococcus aureus
NQINQA

SEQ ID NO: 1708073 - protein, 32 aa, Staphylococcus aureus
NQTSDQYEEDSNIDPEKFEKDNKPVYEENNMK

SEQ ID NO: 1708074 - protein, 13 aa, Staphylococcus aureus
NQVNTTKAALNGV

SEQ ID NO: 1708075 - protein, 16 aa, Staphylococcus aureus
NSDLKDFNNTEQHNAD

SEQ ID NO: 1708076 - protein, 34 aa, Staphylococcus aureus; identical to SEQ ID NO: 1566671

SEQ ID NO: 1708077 - protein, 13 aa, Staphylococcus aureus
NSTNRPNNARERN

SEQ ID NO: 1708078 - protein, 10 aa, Staphylococcus aureus
NVKQTAQELN

SEQ ID NO: 1708079 - protein, 19 aa, Staphylococcus aureus
NVQSVQAKAEVKQQSESEL

SEQ ID NO: 1708080 - protein, 10 aa, Staphylococcus aureus
NYINNEDLSR

SEQ ID NO: 1708081 - protein, 4 aa, Staphylococcus aureus
PAAL

SEQ ID NO: 1708082 - protein, 14 aa, Staphylococcus aureus
PIQASTDVKTNARA

SEQ ID NO: 1708083 - protein, 33 aa, Staphylococcus aureus
PTTFKAGSYGSEKGADPQPNTPDDHTPPNQNEK

SEQ ID NO: 1708084 - protein, 27 aa, Staphylococcus aureus
QAATTKKSDAKAEIAQKASERKTAIEA

SEQ ID NO: 1708085 - protein, 14 aa, Staphylococcus aureus
QFDKDGEDKATKEV

SEQ ID NO: 1708086 - protein, 34 aa, Staphylococcus aureus; identical to SEQ ID NO: 1563333

SEQ ID NO: 1708087 - protein, 46 aa, Staphylococcus aureus; identical to SEQ ID NO: 1642280

SEQ ID NO: 1708088 - protein, 31 aa, Staphylococcus aureus
QKQYGGKDKFEKALQQQGLTADKYKENLRTA

SEQ ID NO: 1708089 - protein, 8 aa, Staphylococcus aureus
QKSDAVKA

SEQ ID NO: 1708090 - protein, 31 aa, Staphylococcus aureus
QLTTDETDAIDNVTNATTNADVEQVKTNAIQ

SEQ ID NO: 1708091 - protein, 7 aa, Staphylococcus aureus
QMKKEGF

SEQ ID NO: 1708092 - protein, 9 aa, Staphylococcus aureus
QPKKTYTKE

SEQ ID NO: 1708093 - protein, 13 aa, Staphylococcus aureus
QQIQANSQVPQSV

SEQ ID NO: 1708094 - protein, 16 aa, Staphylococcus aureus
QREYQGNGEVKDVPAS

SEQ ID NO: 1708095 - protein, 17 aa, Staphylococcus aureus
QREYQGNGEVKDVPASM

SEQ ID NO: 1708096 - protein, 26 aa, Staphylococcus aureus
QSVTSAKNALNGDQNVTNAKNAAKHA

SEQ ID NO: 1708097 - protein, 7 aa, Staphylococcus aureus
REHRRKG

SEQ ID NO: 1708098 - protein, 4 aa, Staphylococcus aureus
RGKI

SEQ ID NO: 1708099 - protein, 6 aa, Staphylococcus aureus
RKEFEK

SEQ ID NO: 1708100 - protein, 13 aa, Staphylococcus aureus
RKQNAAKKSKITV

SEQ ID NO: 1708101 - protein, 12 aa, Staphylococcus aureus
RKSKYATGRTPR

SEQ ID NO: 1708102 - protein, 19 aa, Staphylococcus aureus
RNGSREEIEYQKKHSGEIS

SEQ ID NO: 1708103 - protein, 5 aa, Staphylococcus aureus
RRIQQ

SEQ ID NO: 1708104 - protein, 17 aa, Staphylococcus aureus
SEEGANKSGLAWPSAFK

SEQ ID NO: 1708105 - protein, 13 aa, Staphylococcus aureus
SEKTIDRTSNESL

SEQ ID NO: 1708106 - protein, 23 aa, Staphylococcus aureus
SINNAQKRDLTTKIDQATTVSGV

SEQ ID NO: 1708107 - protein, 15 aa, Staphylococcus aureus
SKANGGNATQTEVEQ

SEQ ID NO: 1708108 - protein, 16 aa, Staphylococcus aureus
SLNDPQKTALKDQVTA

SEQ ID NO: 1708109 - protein, 10 aa, Staphylococcus aureus
SNKDENVKQL

SEQ ID NO: 1708110 - protein, 23 aa, Staphylococcus aureus
SQSDTAENPKEGSKEAQIKKSFS

SEQ ID NO: 1708111 - protein, 19 aa, Staphylococcus aureus
SSATRVSSVDTVKQNAQHL

SEQ ID NO: 1708112 - protein, 21 aa, Staphylococcus aureus
SSSDTGEKAKEDSKEEQIKKS

SEQ ID NO: 1708113 - protein, 29 aa, Staphylococcus aureus
STPAGYTPTTANAGTDDAVDSDGLTTTGV

SEQ ID NO: 1708114 - protein, 6 aa, Staphylococcus aureus
SYYTKS

SEQ ID NO: 1708115 - protein, 5 aa, Staphylococcus aureus
TEKEN

SEQ ID NO: 1708116 - protein, 10 aa, Staphylococcus aureus
TGDPRVGYKD

SEQ ID NO: 1708117 - protein, 6 aa, Staphylococcus aureus
TGVGTT

SEQ ID NO: 1708118 - protein, 7 aa, Staphylococcus aureus
TIPVSKN

SEQ ID NO: 1708119 - protein, 24 aa, Staphylococcus aureus
TTAQPVKASEQSRLSVTSNDTQEL

SEQ ID NO: 1708120 - protein, 16 aa, Staphylococcus aureus
TVEQTKQNAQNVNTAM

SEQ ID NO: 1708121 - protein, 12 aa, Staphylococcus aureus
TVTTDENGKYQF

SEQ ID NO: 1708122 - protein, 4 aa, Staphylococcus aureus
VANH

SEQ ID NO: 1708123 - protein, 17 aa, Staphylococcus aureus
VKDYDGQYIGEHKKRNE

SEQ ID NO: 1708124 - protein, 12 aa, Staphylococcus aureus
VKTAKNALNGDA

SEQ ID NO: 1708125 - protein, 13 aa, Staphylococcus aureus
VKTGSKAKADSYV

SEQ ID NO: 1708126 - protein, 19 aa, Staphylococcus aureus
VQNKKQGTHLYITGRMIKL

SEQ ID NO: 1708127 - protein, 7 aa, Staphylococcus aureus
VRNEKVY

SEQ ID NO: 1708128 - protein, 32 aa, Staphylococcus aureus; identical to SEQ ID NO: 1566984

SEQ ID NO: 1708129 - protein, 12 aa, Staphylococcus aureus
VSKESGNLAKSY

SEQ ID NO: 1708130 - protein, 14 aa, Staphylococcus aureus
VTAAQNTANELNTA

SEQ ID NO: 1708131 - protein, 6 aa, Staphylococcus aureus
VTAGPT

SEQ ID NO: 1708132 - protein, 13 aa, Staphylococcus aureus
VTKAENNKLDSPR

SEQ ID NO: 1708133 - protein, 18 aa, Staphylococcus aureus
YDKEGYRDGEFEKGDKGT

SEQ ID NO: 1708134 - protein, 19 aa, Staphylococcus aureus
YDKEGYRDSEFKKSDKGTW

SEQ ID NO: 1708135 - protein, 8 aa, Staphylococcus aureus
YDKENGMH

SEQ ID NO: 1708136 - protein, 5 aa, Staphylococcus aureus
YDNQA

SEQ ID NO: 1708137 - protein, 11 aa, Staphylococcus aureus
YDSKTNTTTYT

SEQ ID NO: 1708138 - protein, 10 aa, Staphylococcus aureus
YGNQKGQQLI

SEQ ID NO: 1708139 - protein, 10 aa, Staphylococcus aureus
YGSNSRTIYG

SEQ ID NO: 1708140 - protein, 15 aa, Staphylococcus aureus
YNNEEQTKADTELNT

SEQ ID NO: 1708141 - protein, 18 aa, Staphylococcus aureus
YPDGTTKSVRTDANGHYE

SEQ ID NO: 1708142 - protein, 5 aa, Staphylococcus aureus
YSGFD

SEQ ID NO: 1708143 - protein, 9 aa, Staphylococcus aureus
YYSGPSYEL

SEQ ID NO: 1708144 - protein, 5 aa, Staphylococcus aureus
ADNMT

SEQ ID NO: 1708145 - protein, 14 aa, Staphylococcus aureus
AFAARDISSTNVTD

SEQ ID NO: 1708146 - protein, 4 aa, Staphylococcus aureus
AGLT

SEQ ID NO: 1708147 - protein, 34 aa, Staphylococcus aureus; identical to SEQ ID NO: 1563286

SEQ ID NO: 1708148 - protein, 12 aa, Staphylococcus aureus
AIQTAQELNTAM

SEQ ID NO: 1708149 - protein, 6 aa, Staphylococcus aureus
AKGPEV

SEQ ID NO: 1708150 - protein, 12 aa, Staphylococcus aureus
AKSNKSDELDDE

SEQ ID NO: 1708151 - protein, 9 aa, Staphylococcus aureus
AKTNATQAI

SEQ ID NO: 1708152 - protein, 7 aa, Staphylococcus aureus
AMNKPNV

SEQ ID NO: 1708153 - protein, 10 aa, Staphylococcus aureus
ANNAKALKDH

SEQ ID NO: 1708154 - protein, 32 aa, Staphylococcus aureus
APWGTQSTTTPTTPSKPSTPSKPSTPSTGKLT

SEQ ID NO: 1708155 - protein, 14 aa, Staphylococcus aureus
AQAKTNATNTINNA

SEQ ID NO: 1708156 - protein, 12 aa, Staphylococcus aureus
AQDQYDATQEIS

SEQ ID NO: 1708157 - protein, 7 aa, Staphylococcus aureus
ARKNPGL

SEQ ID NO: 1708158 - protein, 10 aa, Staphylococcus aureus
ATAEKSQTKL

SEQ ID NO: 1708159 - protein, 17 aa, Staphylococcus aureus
AVSETVDKIKSNGDKAK

SEQ ID NO: 1708160 - protein, 10 aa, Staphylococcus aureus
AVSNTGTQLN

SEQ ID NO: 1708161 - protein, 27 aa, Staphylococcus aureus
AVTRAKAALNGADNLRNAKTSATNTIN

SEQ ID NO: 1708162 - protein, 12 aa, Staphylococcus aureus
CSNKGEKYQKDI

SEQ ID NO: 1708163 - protein, 13 aa, Staphylococcus aureus
DADEQKRNAYNQA

SEQ ID NO: 1708164 - protein, 19 aa, Staphylococcus aureus
DADEQKRNAYNQAVSAAET

SEQ ID NO: 1708165 - protein, 14 aa, Staphylococcus aureus
DAENAVNQKADQME

SEQ ID NO: 1708166 - protein, 18 aa, Staphylococcus aureus
DAQKANLTSQIERGTTVA

SEQ ID NO: 1708167 - protein, 48 aa, Staphylococcus aureus; identical to SEQ ID NO: 1618404

SEQ ID NO: 1708168 - protein, 7 aa, Staphylococcus aureus
DDVEVPS

SEQ ID NO: 1708169 - protein, 10 aa, Staphylococcus aureus
DEESTKGIVT

SEQ ID NO: 1708170 - protein, 13 aa, Staphylococcus aureus
DGDLKGSSIGSKD

SEQ ID NO: 1708171 - protein, 17 aa, Staphylococcus aureus
DGTFKYQSRPKFNSTPK

SEQ ID NO: 1708172 - protein, 4 aa, Staphylococcus aureus
DGTV

SEQ ID NO: 1708173 - protein, 9 aa, Staphylococcus aureus
DIPTSSSVN

SEQ ID NO: 1708174 - protein, 15 aa, Staphylococcus aureus
DKTAGTNDNKAAVEQ

SEQ ID NO: 1708175 - protein, 12 aa, Staphylococcus aureus
DLAPKATNNKEF

SEQ ID NO: 1708176 - protein, 27 aa, Staphylococcus aureus
DLAPKATNNKEYTINTEIGNNGNFGAS

SEQ ID NO: 1708177 - protein, 9 aa, Staphylococcus aureus
DNGASDKLL

SEQ ID NO: 1708178 - protein, 28 aa, Staphylococcus aureus
DNLKHQVEQAQNVAGVNGVKDKGNTLNT

SEQ ID NO: 1708179 - protein, 75 aa, Staphylococcus aureus; identical to SEQ ID NO: 1568736

SEQ ID NO: 1708180 - protein, 7 aa, Staphylococcus aureus
DPIGYGD

SEQ ID NO: 1708181 - protein, 9 aa, Staphylococcus aureus
DPNTNTNGI

SEQ ID NO: 1708182 - protein, 22 aa, Staphylococcus aureus
DSSSDTAEKAKEDSKEEQIKKS

SEQ ID NO: 1708183 - protein, 5 aa, Staphylococcus aureus
DTIDQ

SEQ ID NO: 1708184 - protein, 4 aa, Staphylococcus aureus
DVES

SEQ ID NO: 1708185 - protein, 7 aa, Staphylococcus aureus
EDTNLKK

SEQ ID NO: 1708186 - protein, 17 aa, Staphylococcus aureus
EDVTSQFDNKKSFSNNV

SEQ ID NO: 1708187 - protein, 6 aa, Staphylococcus aureus
EKNGKN

SEQ ID NO: 1708188 - protein, 8 aa, Staphylococcus aureus
EKNKEGQR

SEQ ID NO: 1708189 - protein, 15 aa, Staphylococcus aureus
EKPKKSKKPSKQRKV

SEQ ID NO: 1708190 - protein, 4 aa, Staphylococcus aureus
ENAN

SEQ ID NO: 1708191 - protein, 19 aa, Staphylococcus aureus
ENIQGAKDYHEGKADHISG

SEQ ID NO: 1708192 - protein, 8 aa, Staphylococcus aureus
EQNANTLN

SEQ ID NO: 1708193 - protein, 36 aa, Staphylococcus aureus; identical to SEQ ID NO: 1566803

SEQ ID NO: 1708194 - protein, 44 aa, Staphylococcus aureus
ERKRTKKKQLEKEKANTLNQNTNDTESSNQEPSLQQAKEQKDDK

SEQ ID NO: 1708195 - protein, 32 aa, Staphylococcus aureus
ESGGTAEDVMQSSESLGLPPNSLSTEESIKQG

SEQ ID NO: 1708196 - protein, 4 aa, Staphylococcus aureus
ETEF

SEQ ID NO: 1708197 - protein, 28 aa, Staphylococcus aureus
ETPSGYTPTSVTSGNDTEKDSNGLTTTG

SEQ ID NO: 1708198 - protein, 10 aa, Staphylococcus aureus
FAPDNQLPPL

SEQ ID NO: 1708199 - protein, 16 aa, Staphylococcus aureus
FSKEKSGGQKADYPNP

SEQ ID NO: 1708200 - protein, 10 aa, Staphylococcus aureus
FSKGGKSDLS

SEQ ID NO: 1708201 - protein, 7 aa, Staphylococcus aureus
FSKPYTF

SEQ ID NO: 1708202 - protein, 20 aa, Staphylococcus aureus
FTDADEAKRNAYTNAVTQAE

SEQ ID NO: 1708203 - protein, 18 aa, Staphylococcus aureus
FTDADPEKQTAYNNAVTA

SEQ ID NO: 1708204 - protein, 9 aa, Staphylococcus aureus
GASPTTSFD

SEQ ID NO: 1708205 - protein, 9 aa, Staphylococcus aureus
GDGSKSYIQ

SEQ ID NO: 1708206 - protein, 5 aa, Staphylococcus aureus
GETYG

SEQ ID NO: 1708207 - protein, 16 aa, Staphylococcus aureus
GEVIGTTKTDENGKYR

SEQ ID NO: 1708208 - protein, 4 aa, Staphylococcus aureus
GGKR

SEQ ID NO: 1708209 - protein, 14 aa, Staphylococcus aureus
GGNGPGNKSTKGYG

SEQ ID NO: 1708210 - protein, 11 aa, Staphylococcus aureus
GINPDREKKYK

SEQ ID NO: 1708211 - protein, 11 aa, Staphylococcus aureus
GIQANAGTLNE

SEQ ID NO: 1708212 - protein, 8 aa, Staphylococcus aureus
GKFPDRKN

SEQ ID NO: 1708213 - protein, 18 aa, Staphylococcus aureus
GNRMVDEDATLNDIKKDT

SEQ ID NO: 1708214 - protein, 51 aa, Staphylococcus aureus
GNSNSQDQGNKTEQKTKSEDSNVKTDKTKHLTGTFSSKNGETVEGKAEIKN

SEQ ID NO: 1708215 - protein, 15 aa, Staphylococcus aureus
GQDFPAGNGSSASDY

SEQ ID NO: 1708216 - protein, 24 aa, Staphylococcus aureus
GRSQSGWDKTEGSYSSTVAEDGGV

SEQ ID NO: 1708217 - protein, 8 aa, Staphylococcus aureus
GRVDYGAA

SEQ ID NO: 1708218 - protein, 6 aa, Staphylococcus aureus
GSDDTL

SEQ ID NO: 1708219 - protein, 5 aa, Staphylococcus aureus
GTIGS

SEQ ID NO: 1708220 - protein, 9 aa, Staphylococcus aureus
GVEHTATEL

SEQ ID NO: 1708221 - protein, 35 aa, Staphylococcus aureus; identical to SEQ ID NO: 1566602

SEQ ID NO: 1708222 - protein, 11 aa, Staphylococcus aureus
HDLNTDKITVD

SEQ ID NO: 1708223 - protein, 34 aa, Staphylococcus aureus; identical to SEQ ID NO: 1566834

SEQ ID NO: 1708224 - protein, 33 aa, Staphylococcus aureus; identical to SEQ ID NO: 1566836

SEQ ID NO: 1708225 - protein, 27 aa, Staphylococcus aureus
IANKDQTKASENYIDADPTKKTAFDNA

SEQ ID NO: 1708226 - protein, 24 aa, Staphylococcus aureus
IANKDQTKASENYIDADPTNKTAF

SEQ ID NO: 1708227 - protein, 5 aa, Staphylococcus aureus
IKDEN

SEQ ID NO: 1708228 - protein, 17 aa, Staphylococcus aureus
INQNQTNDQVDTTTNQA

SEQ ID NO: 1708229 - protein, 17 aa, Staphylococcus aureus
INQTGNPTLDKSQVEQL

SEQ ID NO: 1708230 - protein, 47 aa, Staphylococcus aureus; identical to SEQ ID NO: 1565398

SEQ ID NO: 1708231 - protein, 47 aa, Staphylococcus aureus; identical to SEQ ID NO: 1566614

SEQ ID NO: 1708232 - protein, 11 aa, Staphylococcus aureus
IQTAQELNTAM

SEQ ID NO: 1708233 - protein, 15 aa, Staphylococcus aureus
ISGTPNANVDPQQVA

SEQ ID NO: 1708234 - protein, 4 aa, Staphylococcus aureus
ISLP

SEQ ID NO: 1708235 - protein, 12 aa, Staphylococcus aureus
ITEDKDKETISS

SEQ ID NO: 1708236 - protein, 14 aa, Staphylococcus aureus
ITNKNTSTSNESGV

SEQ ID NO: 1708237 - protein, 5 aa, Staphylococcus aureus
ITSQK

SEQ ID NO: 1708238 - protein, 12 aa, Staphylococcus aureus
ITVDDKVKSGDY

SEQ ID NO: 1708239 - protein, 21 aa, Staphylococcus aureus
KAQETASSIKNTITGLFNSFW

SEQ ID NO: 1708240 - protein, 7 aa, Staphylococcus aureus
KDGETYT

SEQ ID NO: 1708241 - protein, 9 aa, Staphylococcus aureus
KDHKQPKQL

SEQ ID NO: 1708242 - protein, 13 aa, Staphylococcus aureus
KDKFSDRKNYKVE

SEQ ID NO: 1708243 - protein, 9 aa, Staphylococcus aureus
KDLADKYKD

SEQ ID NO: 1708244 - protein, 10 aa, Staphylococcus aureus
KDVEQKQKEL

SEQ ID NO: 1708245 - protein, 30 aa, Staphylococcus aureus
KDYKNGDISYNPNVPSYSAKYQLSNDDYNI

SEQ ID NO: 1708246 - protein, 15 aa, Staphylococcus aureus
KETELIRTNKKNVTL

SEQ ID NO: 1708247 - protein, 7 aa, Staphylococcus aureus
KEYPYQT

SEQ ID NO: 1708248 - protein, 32 aa, Staphylococcus aureus; identical to SEQ ID NO: 1639018

SEQ ID NO: 1708249 - protein, 8 aa, Staphylococcus aureus
KGENRETV

SEQ ID NO: 1708250 - protein, 19 aa, Staphylococcus aureus
KGYVDTTIKKSSNGGPRRK

SEQ ID NO: 1708251 - protein, 5 aa, Staphylococcus aureus
KHMYN

SEQ ID NO: 1708252 - protein, 9 aa, Staphylococcus aureus
KKNETTDKY

SEQ ID NO: 1708253 - protein, 8 aa, Staphylococcus aureus
KKQAIEAN

SEQ ID NO: 1708254 - protein, 12 aa, Staphylococcus aureus
KNFTNDNTEDDV

SEQ ID NO: 1708255 - protein, 8 aa, Staphylococcus aureus
KNIPKDET

SEQ ID NO: 1708256 - protein, 18 aa, Staphylococcus aureus
KNYNNGDVSINENVPSYD

SEQ ID NO: 1708257 - protein, 19 aa, Staphylococcus aureus
KQEVSPQTVKITGGEEQLN

SEQ ID NO: 1708258 - protein, 9 aa, Staphylococcus aureus
KQPKGKVMK

SEQ ID NO: 1708259 - protein, 10 aa, Staphylococcus aureus
KQPKGKVMKT

SEQ ID NO: 1708260 - protein, 24 aa, Staphylococcus aureus
KRATEEMENNPDKNQHAGGGPGMS

SEQ ID NO: 1708261 - protein, 13 aa, Staphylococcus aureus
KSGYGADTSGIQW

SEQ ID NO: 1708262 - protein, 17 aa, Staphylococcus aureus
KSSVESDSSYKQNDYLN

SEQ ID NO: 1708263 - protein, 15 aa, Staphylococcus aureus
KTNDINSHQTDKRKT

SEQ ID NO: 1708264 - protein, 6 aa, Staphylococcus aureus
KTNDKY

SEQ ID NO: 1708265 - protein, 28 aa, Staphylococcus aureus
KVNDTNQALNGNQKLADAKQAAKTNLGT

SEQ ID NO: 1708266 - protein, 24 aa, Staphylococcus aureus
KYTPTSDGELDIAQGTSMRTTDKY

SEQ ID NO: 1708267 - protein, 14 aa, Staphylococcus aureus
LADQAKKDNERATK

SEQ ID NO: 1708268 - protein, 4 aa, Staphylococcus aureus
LDDE

SEQ ID NO: 1708269 - protein, 12 aa, Staphylococcus aureus
LSKDELKGFNKQ

SEQ ID NO: 1708270 - protein, 5 aa, Staphylococcus aureus
LYPGN

SEQ ID NO: 1708271 - protein, 6 aa, Staphylococcus aureus
MEEAQA

SEQ ID NO: 1708272 - protein, 11 aa, Staphylococcus aureus
NALQDKTETLN

SEQ ID NO: 1708273 - protein, 33 aa, Staphylococcus aureus; identical to SEQ ID NO: 1565578

SEQ ID NO: 1708274 - protein, 33 aa, Staphylococcus aureus; identical to SEQ ID NO: 1565725

SEQ ID NO: 1708275 - protein, 20 aa, Staphylococcus aureus
NATQVTGVQSVKDNATNLDN

SEQ ID NO: 1708276 - protein, 10 aa, Staphylococcus aureus
NDGSTYQSDL

SEQ ID NO: 1708277 - protein, 11 aa, Staphylococcus aureus
NDGSTYQSDLS

SEQ ID NO: 1708278 - protein, 5 aa, Staphylococcus aureus
NEDAL

SEQ ID NO: 1708279 - protein, 19 aa, Staphylococcus aureus
NFTDADPEKQTAYNNAVTA

SEQ ID NO: 1708280 - protein, 10 aa, Staphylococcus aureus
NGQPIPSGTF

SEQ ID NO: 1708281 - protein, 16 aa, Staphylococcus aureus
NHDDLKNNFSTDSKNL

SEQ ID NO: 1708282 - protein, 10 aa, Staphylococcus aureus
NIVNGSPNVI

SEQ ID NO: 1708283 - protein, 12 aa, Staphylococcus aureus
NKQSGTNEVQAQ

SEQ ID NO: 1708284 - protein, 15 aa, Staphylococcus aureus
NKSTGTNVPKDQVEA

SEQ ID NO: 1708285 - protein, 15 aa, Staphylococcus aureus
NKSTGTNVSKDQVEA

SEQ ID NO: 1708286 - protein, 15 aa, Staphylococcus aureus
NKTSGGNTPKADVER

SEQ ID NO: 1708287 - protein, 9 aa, Staphylococcus aureus
NKTTDPTLA

SEQ ID NO: 1708288 - protein, 8 aa, Staphylococcus aureus
NKTVDSKS

SEQ ID NO: 1708289 - protein, 8 aa, Staphylococcus aureus
NKYEYGDN

SEQ ID NO: 1708290 - protein, 4 aa, Staphylococcus aureus
NLID

SEQ ID NO: 1708291 - protein, 9 aa, Staphylococcus aureus
NLKGSSVGY

SEQ ID NO: 1708292 - protein, 33 aa, Staphylococcus aureus; identical to SEQ ID NO: 1566666

SEQ ID NO: 1708293 - protein, 31 aa, Staphylococcus aureus; identical to SEQ ID NO: 1563980

SEQ ID NO: 1708294 - protein, 9 aa, Staphylococcus aureus
NQEFPEISE

SEQ ID NO: 1708295 - protein, 7 aa, Staphylococcus aureus
NRNNVPL

SEQ ID NO: 1708296 - protein, 12 aa, Staphylococcus aureus
NRQQPNNQQAGV

SEQ ID NO: 1708297 - protein, 73 aa, Staphylococcus aureus; identical to SEQ ID NO: 1567178

SEQ ID NO: 1708298 - protein, 23 aa, Staphylococcus aureus
NSERKSMSESSFKKPEKSNSDFK

SEQ ID NO: 1708299 - protein, 47 aa, Staphylococcus aureus; identical to SEQ ID NO: 1566905

SEQ ID NO: 1708300 - protein, 47 aa, Staphylococcus aureus; identical to SEQ ID NO: 1565139

SEQ ID NO: 1708301 - protein, 8 aa, Staphylococcus aureus
NSNIDETN

SEQ ID NO: 1708302 - protein, 13 aa, Staphylococcus aureus
NTKSGKEVKFNSD

SEQ ID NO: 1708303 - protein, 34 aa, Staphylococcus aureus; identical to SEQ ID NO: 1566909

SEQ ID NO: 1708304 - protein, 23 aa, Staphylococcus aureus
NVQPTNEENKKVDAKTESTTLNV

SEQ ID NO: 1708305 - protein, 28 aa, Staphylococcus aureus
NVQRAKNDLNGNQNVANAKTTAKNALNN

SEQ ID NO: 1708306 - protein, 9 aa, Staphylococcus aureus
NYKNQNTVT

SEQ ID NO: 1708307 - protein, 61 aa, Staphylococcus aureus
NYNYNNYNNGYSYNNYSRYNNYSNNNQSYNYNNYNSYNTNSYRTGGLGASYSTSSNNVQVT

SEQ ID NO: 1708308 - protein, 8 aa, Staphylococcus aureus
NYPGKEDV

SEQ ID NO: 1708309 - protein, 22 aa, Staphylococcus aureus
PKGYEVTPSKQGNNEELDSNGL

SEQ ID NO: 1708310 - protein, 345 aa, Staphylococcus aureus; identical to SEQ ID NO: 1627578

SEQ ID NO: 1708311 - protein, 9 aa, Staphylococcus aureus
QAATTLNDA

SEQ ID NO: 1708312 - protein, 32 aa, Staphylococcus aureus; identical to SEQ ID NO: 1566255

SEQ ID NO: 1708313 - protein, 90 aa, Staphylococcus aureus
QKVTTSPSTKVKATQPTPSVTTTTPPSPNVQPQSPQPTPSVTTPPSPNVQPQSPQPTPNPTTPHSSNVETKQPQSPTTKQAQKEINPKYK

SEQ ID NO: 1708314 - protein, 8 aa, Staphylococcus aureus
QLQATTEG

SEQ ID NO: 1708315 - protein, 5 aa, Staphylococcus aureus
QLTKD

SEQ ID NO: 1708316 - protein, 9 aa, Staphylococcus aureus
QLTNDDYNV

SEQ ID NO: 1708317 - protein, 35 aa, Staphylococcus aureus; identical to SEQ ID NO: 1566682

SEQ ID NO: 1708318 - protein, 4 aa, Staphylococcus aureus
QQHS

SEQ ID NO: 1708319 - protein, 13 aa, Staphylococcus aureus
QSQEAIDKRNEKL

SEQ ID NO: 1708320 - protein, 11 aa, Staphylococcus aureus
QTNKKKVTAQE

SEQ ID NO: 1708321 - protein, 11 aa, Staphylococcus aureus
QVKTKAEQLDQ

SEQ ID NO: 1708322 - protein, 12 aa, Staphylococcus aureus
QVSATASELNTA

SEQ ID NO: 1708323 - protein, 62 aa, Staphylococcus aureus
QYSEDAKKAQKDYASQSKKDKNEKSNTKNPQLPTQDELKHKSKPAQSFNNDVNQKDTRATSL

SEQ ID NO: 1708324 - protein, 10 aa, Staphylococcus aureus
QYTNSESPTL

SEQ ID NO: 1708325 - protein, 32 aa, Staphylococcus aureus; identical to SEQ ID NO: 1566928

SEQ ID NO: 1708326 - protein, 12 aa, Staphylococcus aureus
RDTTGTNDANWS

SEQ ID NO: 1708327 - protein, 5 aa, Staphylococcus aureus
RKTEI

SEQ ID NO: 1708328 - protein, 39 aa, Staphylococcus aureus
RTEHRESEPQVTELTSANKVSALSNPKDGFLKKFLYHLK

SEQ ID NO: 1708329 - protein, 8 aa, Staphylococcus aureus
RVESRNGM

SEQ ID NO: 1708330 - protein, 11 aa, Staphylococcus aureus
RVSQADIDTLT

SEQ ID NO: 1708331 - protein, 8 aa, Staphylococcus aureus
SAEQQGVD

SEQ ID NO: 1708332 - protein, 7 aa, Staphylococcus aureus
SAHLPSV

SEQ ID NO: 1708333 - protein, 37 aa, Staphylococcus aureus
SAPQTTNSTAFAKSSAEVQQTQQASIPASQKVNLGNQ

SEQ ID NO: 1708334 - protein, 9 aa, Staphylococcus aureus
SDAQKQSIT

SEQ ID NO: 1708335 - protein, 33 aa, Staphylococcus aureus; identical to SEQ ID NO: 1565760

SEQ ID NO: 1708336 - protein, 16 aa, Staphylococcus aureus
SDHTTVEDTKEYTTES

SEQ ID NO: 1708337 - protein, 24 aa, Staphylococcus aureus
SDLKNNQKSPVEPTKDNDKKNGLN

SEQ ID NO: 1708338 - protein, 10 aa, Staphylococcus aureus
SELGEGQEFP

SEQ ID NO: 1708339 - protein, 16 aa, Staphylococcus aureus
SEVTQAQNNADALNTA

SEQ ID NO: 1708340 - protein, 15 aa, Staphylococcus aureus
SLKNNGNSGASLDTD

SEQ ID NO: 1708341 - protein, 17 aa, Staphylococcus aureus
SNDTGGGDGTVKPEEKL

SEQ ID NO: 1708342 - protein, 4 aa, Staphylococcus aureus
SNTT

SEQ ID NO: 1708343 - protein, 5 aa, Staphylococcus aureus
SSYIK

SEQ ID NO: 1708344 - protein, 19 aa, Staphylococcus aureus
TAKSPVNVNQSYSIKPGTK

SEQ ID NO: 1708345 - protein, 11 aa, Staphylococcus aureus
TANAEGKITPV

SEQ ID NO: 1708346 - protein, 6 aa, Staphylococcus aureus
TATEKE

SEQ ID NO: 1708347 - protein, 5 aa, Staphylococcus aureus
TDSGL

SEQ ID NO: 1708348 - protein, 11 aa, Staphylococcus aureus
TDTSPTEFDDE

SEQ ID NO: 1708349 - protein, 7 aa, Staphylococcus aureus
TEKPKPW

SEQ ID NO: 1708350 - protein, 4 aa, Staphylococcus aureus
TGKI

SEQ ID NO: 1708351 - protein, 25 aa, Staphylococcus aureus
THPNQSYDSFRKEVGKARSEAIVVQ

SEQ ID NO: 1708352 - protein, 7 aa, Staphylococcus aureus
TKLGNYD

SEQ ID NO: 1708353 - protein, 8 aa, Staphylococcus aureus
TNAQKEAL

SEQ ID NO: 1708354 - protein, 48 aa, Staphylococcus aureus; identical to SEQ ID NO: 1563536

SEQ ID NO: 1708355 - protein, 36 aa, Staphylococcus aureus; identical to SEQ ID NO: 1566728

SEQ ID NO: 1708356 - protein, 16 aa, Staphylococcus aureus
TSLDGIKRDTKRWKNE

SEQ ID NO: 1708357 - protein, 23 aa, Staphylococcus aureus
TTTIASTADASEGYGPREKKPVS

SEQ ID NO: 1708358 - protein, 10 aa, Staphylococcus aureus
TVKPKANQAI

SEQ ID NO: 1708359 - protein, 33 aa, Staphylococcus aureus; identical to SEQ ID NO: 1566974

SEQ ID NO: 1708360 - protein, 10 aa, Staphylococcus aureus
VASNDTKAWE

SEQ ID NO: 1708361 - protein, 8 aa, Staphylococcus aureus
VEKNLPGV

SEQ ID NO: 1708362 - protein, 4 aa, Staphylococcus aureus
VEPI

SEQ ID NO: 1708363 - protein, 5 aa, Staphylococcus aureus
VKLDK

SEQ ID NO: 1708364 - protein, 24 aa, Staphylococcus aureus
VKTSDTSLKLDNKSAISNGNEINQ

SEQ ID NO: 1708365 - protein, 25 aa, Staphylococcus aureus
VNAAKQALNGNANVQHAKDEATALI

SEQ ID NO: 1708366 - protein, 14 aa, Staphylococcus aureus
VNADATTEEKEAFT

SEQ ID NO: 1708367 - protein, 16 aa, Staphylococcus aureus
VNADSTKQNVYTTKVT

SEQ ID NO: 1708368 - protein, 27 aa, Staphylococcus aureus
VNEAKQALNGNDNVQRAKDAAKQVITN

SEQ ID NO: 1708369 - protein, 4 aa, Staphylococcus aureus
VNEN

SEQ ID NO: 1708370 - protein, 8 aa, Staphylococcus aureus
VNGKSGWV

SEQ ID NO: 1708371 - protein, 25 aa, Staphylococcus aureus
VNTAKTALNGDARLNQAKNTAKQQL

SEQ ID NO: 1708372 - protein, 19 aa, Staphylococcus aureus
VPAAPKKAVAQPKTAVKAY

SEQ ID NO: 1708373 - protein, 15 aa, Staphylococcus aureus
VQGPNTAKDNVESAL

SEQ ID NO: 1708374 - protein, 19 aa, Staphylococcus aureus
VTAANAAKSALDQARNGLT

SEQ ID NO: 1708375 - protein, 27 aa, Staphylococcus aureus
WDNAAAADGYTIDNRPTVGSIAQTDVG

SEQ ID NO: 1708376 - protein, 8 aa, Staphylococcus aureus
YAKPATSL

SEQ ID NO: 1708377 - protein, 18 aa, Staphylococcus aureus
YDKEGYRDDEFDKNDKGT

SEQ ID NO: 1708378 - protein, 12 aa, Staphylococcus aureus
YDKYDENNPDMK

SEQ ID NO: 1708379 - protein, 11 aa, Staphylococcus aureus
YDSTTNTTTYT

SEQ ID NO: 1708380 - protein, 16 aa, Staphylococcus aureus
YEEDTNPGGGQVTTES

SEQ ID NO: 1708381 - protein, 9 aa, Staphylococcus aureus
YKNQNTVTF

SEQ ID NO: 1708382 - protein, 11 aa, Staphylococcus aureus
YKTEPKDSKIK

SEQ ID NO: 1708383 - protein, 7 aa, Staphylococcus aureus
YKTPKYN

SEQ ID NO: 1708384 - protein, 16 aa, Staphylococcus aureus
YNNEEQTKADTELNTL

SEQ ID NO: 1708385 - protein, 4 aa, Staphylococcus aureus
YSYG

SEQ ID NO: 1708386 - protein, 11 aa, Staphylococcus aureus
AAINPGNSGGA

SEQ ID NO: 1708387 - protein, 7 aa, Staphylococcus aureus
ADSDIDL

SEQ ID NO: 1708388 - protein, 10 aa, Staphylococcus aureus
AEENANQEHF

SEQ ID NO: 1708389 - protein, 6 aa, Staphylococcus aureus
AEIGKG

SEQ ID NO: 1708390 - protein, 18 aa, Staphylococcus aureus
AESQPDPKPDELHKSSKF

SEQ ID NO: 1708391 - protein, 19 aa, Staphylococcus aureus
AGESHAQTKVEKYNEYQTN

SEQ ID NO: 1708392 - protein, 11 aa, Staphylococcus aureus
AGSNRTYQAQG

SEQ ID NO: 1708393 - protein, 9 aa, Staphylococcus aureus
AKEKEKALA

SEQ ID NO: 1708394 - protein, 24 aa, Staphylococcus aureus
ANENIDSVKEKELHKKSELSSTAL

SEQ ID NO: 1708395 - protein, 27 aa, Staphylococcus aureus
ANKRTATIKNGTAMPTNLAGGSTTTIP

SEQ ID NO: 1708396 - protein, 6 aa, Staphylococcus aureus
AQGDID

SEQ ID NO: 1708397 - protein, 7 aa, Staphylococcus aureus
AQHKTEA

SEQ ID NO: 1708398 - protein, 17 aa, Staphylococcus aureus
ASERTIDAETTGGNTKV

SEQ ID NO: 1708399 - protein, 15 aa, Staphylococcus aureus
ATGAKSHLNELDQDD

SEQ ID NO: 1708400 - protein, 72 aa, Staphylococcus aureus
ATGANGADMSAQAPATNNVAPSADQANQVQSQEVEAPQNAQTQQPQASTSNNSQVTATPTESKASEGSSVNV

SEQ ID NO: 1708401 - protein, 4 aa, Staphylococcus aureus
ATIN

SEQ ID NO: 1708402 - protein, 20 aa, Staphylococcus aureus
ATQVKTDARNVVNDKAREAI

SEQ ID NO: 1708403 - protein, 62 aa, Staphylococcus aureus
ATTQANSAHKDSQDQNKKEHVDKSQQKEKRNVTNKDKNSTVPDDIGKNGKITKRTETVYDEK

SEQ ID NO: 1708404 - protein, 28 aa, Staphylococcus aureus
AVTRAKAALNGAENLRNAKTSATNTING

SEQ ID NO: 1708405 - protein, 19 aa, Staphylococcus aureus
CGKSDETKEDSKEEQIKKS

SEQ ID NO: 1708406 - protein, 95 aa, Staphylococcus aureus
CGSNDGDKKEESKKTETKKENKDKKKETKEKAEAKKENANQNDNNNQVNNENNTNINNNQQTNNTSKQQVQKNLPATNNGQQAQPRDPNEPSYEE

SEQ ID NO: 1708407 - protein, 14 aa, Staphylococcus aureus
CQSSSSQESTKSGE

SEQ ID NO: 1708408 - protein, 17 aa, Staphylococcus aureus
DAAHTNAEVEAAKNAEI

SEQ ID NO: 1708409 - protein, 21 aa, Staphylococcus aureus
DAKAQEKVTAAQQSKKVTQDE

SEQ ID NO: 1708410 - protein, 8 aa, Staphylococcus aureus
DAYGNSET

SEQ ID NO: 1708411 - protein, 5 aa, Staphylococcus aureus
DDAVN

SEQ ID NO: 1708412 - protein, 4 aa, Staphylococcus aureus
DDIN

SEQ ID NO: 1708413 - protein, 10 aa, Staphylococcus aureus
DDVEAPSDFA

SEQ ID NO: 1708414 - protein, 8 aa, Staphylococcus aureus
DENKQTIE

SEQ ID NO: 1708415 - protein, 7 aa, Staphylococcus aureus
DGEVSEV

SEQ ID NO: 1708416 - protein, 8 aa, Staphylococcus aureus
DGKTKEVK

SEQ ID NO: 1708417 - protein, 8 aa, Staphylococcus aureus
DKDGNFKY

SEQ ID NO: 1708418 - protein, 16 aa, Staphylococcus aureus
DKEGYRDGEFKKGDKG

SEQ ID NO: 1708419 - protein, 18 aa, Staphylococcus aureus
DKEGYRDGEFKKGDKGTW

SEQ ID NO: 1708420 - protein, 11 aa, Staphylococcus aureus
DKEKYKEGIEG

SEQ ID NO: 1708421 - protein, 8 aa, Staphylococcus aureus
DKINSSND

SEQ ID NO: 1708422 - protein, 9 aa, Staphylococcus aureus
DKTANETVG

SEQ ID NO: 1708423 - protein, 20 aa, Staphylococcus aureus
DKVTEANQAKDQLNTARQGL

SEQ ID NO: 1708424 - protein, 7 aa, Staphylococcus aureus
DLDNSND

SEQ ID NO: 1708425 - protein, 18 aa, Staphylococcus aureus
DLTNAQKDAAKRQIEGAT

SEQ ID NO: 1708426 - protein, 19 aa, Staphylococcus aureus
DLTNAQKDAAKRQIEGATH

SEQ ID NO: 1708427 - protein, 18 aa, Staphylococcus aureus
DNKTIDASSVKIEVHLTT

SEQ ID NO: 1708428 - protein, 5 aa, Staphylococcus aureus
DNNNS

SEQ ID NO: 1708429 - protein, 14 aa, Staphylococcus aureus
DNSTNTSDGKFHGQ

SEQ ID NO: 1708430 - protein, 9 aa, Staphylococcus aureus
DQETKATQI

SEQ ID NO: 1708431 - protein, 8 aa, Staphylococcus aureus
DQIQGGQQ

SEQ ID NO: 1708432 - protein, 11 aa, Staphylococcus aureus
DQTTSPTLDPT

SEQ ID NO: 1708433 - protein, 35 aa, Staphylococcus aureus; identical to SEQ ID NO: 1567366

SEQ ID NO: 1708434 - protein, 21 aa, Staphylococcus aureus
DSKNETIKEKNLHKKSELSSI

SEQ ID NO: 1708435 - protein, 21 aa, Staphylococcus aureus
DTDSGENNKDSSIPQGGVTVS

SEQ ID NO: 1708436 - protein, 14 aa, Staphylococcus aureus
DTKSGKEVKFNSDK

SEQ ID NO: 1708437 - protein, 22 aa, Staphylococcus aureus
DVNSAASQVNAAKTALNGDNNL

SEQ ID NO: 1708438 - protein, 13 aa, Staphylococcus aureus
DVPEIGQPMEPNV

SEQ ID NO: 1708439 - protein, 7 aa, Staphylococcus aureus
EADGNQF

SEQ ID NO: 1708440 - protein, 18 aa, Staphylococcus aureus
EASAATVAGIAGTNNGIT

SEQ ID NO: 1708441 - protein, 11 aa, Staphylococcus aureus
EDKDITKNSID

SEQ ID NO: 1708442 - protein, 43 aa, Staphylococcus aureus; identical to SEQ ID NO: 1566347

SEQ ID NO: 1708443 - protein, 11 aa, Staphylococcus aureus
EDNKTLKSDDI

SEQ ID NO: 1708444 - protein, 16 aa, Staphylococcus aureus
EEKKIKNADISRKSNN

SEQ ID NO: 1708445 - protein, 18 aa, Staphylococcus aureus
EESEESFEDIAEDLIDFD

SEQ ID NO: 1708446 - protein, 6 aa, Staphylococcus aureus
EFEPSD

SEQ ID NO: 1708447 - protein, 5 aa, Staphylococcus aureus
EGIKA

SEQ ID NO: 1708448 - protein, 10 aa, Staphylococcus aureus
EGSGKHADNI

SEQ ID NO: 1708449 - protein, 9 aa, Staphylococcus aureus
EHQNSKSVQ

SEQ ID NO: 1708450 - protein, 9 aa, Staphylococcus aureus
EIKNSTEDK

SEQ ID NO: 1708451 - protein, 6 aa, Staphylococcus aureus
EKAIGT

SEQ ID NO: 1708452 - protein, 15 aa, Staphylococcus aureus
EKDPIRVTNQRTEKE

SEQ ID NO: 1708453 - protein, 9 aa, Staphylococcus aureus
EKNSIGSAF

SEQ ID NO: 1708454 - protein, 42 aa, Staphylococcus aureus
EKYGYSREKYDAIQKEASKLQQQKENGEITAEEFTNRYIELY

SEQ ID NO: 1708455 - protein, 11 aa, Staphylococcus aureus
EKYPITTKQSP

SEQ ID NO: 1708456 - protein, 9 aa, Staphylococcus aureus
EMKTESDRK

SEQ ID NO: 1708457 - protein, 10 aa, Staphylococcus aureus
EPVKGRQYSI

SEQ ID NO: 1708458 - protein, 48 aa, Staphylococcus aureus; identical to SEQ ID NO: 1565664

SEQ ID NO: 1708459 - protein, 30 aa, Staphylococcus aureus; identical to SEQ ID NO: 1565841

SEQ ID NO: 1708460 - protein, 5 aa, Staphylococcus aureus
ESMQH

SEQ ID NO: 1708461 - protein, 33 aa, Staphylococcus aureus; identical to SEQ ID NO: 1567061

SEQ ID NO: 1708462 - protein, 12 aa, Staphylococcus aureus
EVSEQDLPNCST

SEQ ID NO: 1708463 - protein, 5 aa, Staphylococcus aureus
EWAPK

SEQ ID NO: 1708464 - protein, 4 aa, Staphylococcus aureus
EYKE

SEQ ID NO: 1708465 - protein, 14 aa, Staphylococcus aureus
EYKRNNSDGNVKKL

SEQ ID NO: 1708466 - protein, 4 aa, Staphylococcus aureus
EYTG

SEQ ID NO: 1708467 - protein, 12 aa, Staphylococcus aureus
FAARDISSTNVT

SEQ ID NO: 1708468 - protein, 13 aa, Staphylococcus aureus
FAARDISSTNVTD

SEQ ID NO: 1708469 - protein, 13 aa, Staphylococcus aureus
FDSGDNKNYQAQG

SEQ ID NO: 1708470 - protein, 19 aa, Staphylococcus aureus
FHESKADNNIENIGDGAEV

SEQ ID NO: 1708471 - protein, 17 aa, Staphylococcus aureus
FNSDKKNSDISDAEMKQ

SEQ ID NO: 1708472 - protein, 9 aa, Staphylococcus aureus
FSEYKKDAL

SEQ ID NO: 1708473 - protein, 16 aa, Staphylococcus aureus
FYDDNDPIEYGVYRKD

SEQ ID NO: 1708474 - protein, 16 aa, Staphylococcus aureus
FYDDNRPIEYGVHSKG

SEQ ID NO: 1708475 - protein, 42 aa, Staphylococcus aureus
GANQHKENNSKSNDTTKKTQETDNTTQSNTEKQMTPQEAEDI

SEQ ID NO: 1708476 - protein, 4 aa, Staphylococcus aureus
GEID

SEQ ID NO: 1708477 - protein, 6 aa, Staphylococcus aureus
GERYDV

SEQ ID NO: 1708478 - protein, 9 aa, Staphylococcus aureus
GEYDQNAKD

SEQ ID NO: 1708479 - protein, 5 aa, Staphylococcus aureus
GGEFR

SEQ ID NO: 1708480 - protein, 15 aa, Staphylococcus aureus
GGISKTNSKEFKERE

SEQ ID NO: 1708481 - protein, 11 aa, Staphylococcus aureus
GGVTKKNQGAY

SEQ ID NO: 1708482 - protein, 15 aa, Staphylococcus aureus
GITKTNKNQYKDPVQ

SEQ ID NO: 1708483 - protein, 11 aa, Staphylococcus aureus
GKAELAKGGNL

SEQ ID NO: 1708484 - protein, 5 aa, Staphylococcus aureus
GKDAV

SEQ ID NO: 1708485 - protein, 8 aa, Staphylococcus aureus
GKEDKVKA

SEQ ID NO: 1708486 - protein, 8 aa, Staphylococcus aureus
GKKIKDDV

SEQ ID NO: 1708487 - protein, 9 aa, Staphylococcus aureus
GKLSKKNKN

SEQ ID NO: 1708488 - protein, 14 aa, Staphylococcus aureus
GKPTSYKTLPNRYK

SEQ ID NO: 1708489 - protein, 10 aa, Staphylococcus aureus
GMQKSITQLG

SEQ ID NO: 1708490 - protein, 7 aa, Staphylococcus aureus
GNAEEYL

SEQ ID NO: 1708491 - protein, 10 aa, Staphylococcus aureus
GNKKAQPLIS

SEQ ID NO: 1708492 - protein, 4 aa, Staphylococcus aureus
GNNL

SEQ ID NO: 1708493 - protein, 5 aa, Staphylococcus aureus
GNTHH

SEQ ID NO: 1708494 - protein, 7 aa, Staphylococcus aureus
GQKYDKE

SEQ ID NO: 1708495 - protein, 8 aa, Staphylococcus aureus
GSDELAES

SEQ ID NO: 1708496 - protein, 80 aa, Staphylococcus aureus
GSHDGDKKEESKKTETKKDNKDKKKETKEKAEAKKENANQNDNNNQVNNENNTNVNNDQQTNRPLTKDEISQRVKNGHNV

SEQ ID NO: 1708497 - protein, 8 aa, Staphylococcus aureus
GTHPNSKF

SEQ ID NO: 1708498 - protein, 7 aa, Staphylococcus aureus
GVPSYEQ

SEQ ID NO: 1708499 - protein, 15 aa, Staphylococcus aureus
GVTPHEGNKLKERKK

SEQ ID NO: 1708500 - protein, 5 aa, Staphylococcus aureus
GYKYG

SEQ ID NO: 1708501 - protein, 11 aa, Staphylococcus aureus
HDGTPFDADAV

SEQ ID NO: 1708502 - protein, 5 aa, Staphylococcus aureus
HFEGY

SEQ ID NO: 1708503 - protein, 6 aa, Staphylococcus aureus
HGKKYT

SEQ ID NO: 1708504 - protein, 6 aa, Staphylococcus aureus
HKDPHE

SEQ ID NO: 1708505 - protein, 6 aa, Staphylococcus aureus
HRKEFE

SEQ ID NO: 1708506 - protein, 6 aa, Staphylococcus aureus
HSEKQQ

SEQ ID NO: 1708507 - protein, 59 aa, Staphylococcus aureus; identical to SEQ ID NO: 1562452

SEQ ID NO: 1708508 - protein, 130 aa, Staphylococcus aureus
HSTSSNHNNEQDNKATHQKKDTEVNHQKDENTNNTNENQNNNNGVTNGNQSSTPSTVQNNGSTAPANTQPSNPNQSNSNQSNSNHGGSSQPSTNNQNHKQQNTPAPNKSNNANTNESSKQVSPSQPQSSK

SEQ ID NO: 1708509 - protein, 20 aa, Staphylococcus aureus
HSYADKNPIIGENKSTGDQF

SEQ ID NO: 1708510 - protein, 32 aa, Staphylococcus aureus; identical to SEQ ID NO: 1565245

SEQ ID NO: 1708511 - protein, 11 aa, Staphylococcus aureus
IDAATTNAQVE

SEQ ID NO: 1708512 - protein, 21 aa, Staphylococcus aureus
IEDGDSRNSAVQSGSVDISGG

SEQ ID NO: 1708513 - protein, 13 aa, Staphylococcus aureus
IGTATAEFNPTKH

SEQ ID NO: 1708514 - protein, 10 aa, Staphylococcus aureus
IKKDKEIPNG

SEQ ID NO: 1708515 - protein, 17 aa, Staphylococcus aureus
IKTEKYEVAQDNQKKYP

SEQ ID NO: 1708516 - protein, 31 aa, Staphylococcus aureus; identical to SEQ ID NO: 1622825

SEQ ID NO: 1708517 - protein, 9 aa, Staphylococcus aureus
INGKDDMSL

SEQ ID NO: 1708518 - protein, 16 aa, Staphylococcus aureus
IPEEEREQLHTDREDG

SEQ ID NO: 1708519 - protein, 7 aa, Staphylococcus aureus
IQMQDGD

SEQ ID NO: 1708520 - protein, 5 aa, Staphylococcus aureus
IRPKA

SEQ ID NO: 1708521 - protein, 97 aa, Staphylococcus aureus
ISDYEQPRNGEKSTNDSNKNSDNSIKNDTDTQSSKQDKADNQKAPKSNNTKPSTSNKQPNSTKPTQPNQSNSQPASDDKANQKSSSKDNQSMSDSAL

SEQ ID NO: 1708522 - protein, 4 aa, Staphylococcus aureus
ISEK

SEQ ID NO: 1708523 - protein, 14 aa, Staphylococcus aureus
ISGTDASNHGDFNG

SEQ ID NO: 1708524 - protein, 11 aa, Staphylococcus aureus
ISKNQNEKKYR

SEQ ID NO: 1708525 - protein, 11 aa, Staphylococcus aureus
IVDSSAASKIV

SEQ ID NO: 1708526 - protein, 29 aa, Staphylococcus aureus
KAGSYGSEKGADPQPNTPDDHTPPNQNEK

SEQ ID NO: 1708527 - protein, 8 aa, Staphylococcus aureus
KASDSKEI

SEQ ID NO: 1708528 - protein, 8 aa, Staphylococcus aureus
KASEITDR

SEQ ID NO: 1708529 - protein, 7 aa, Staphylococcus aureus
KASSVDD

SEQ ID NO: 1708530 - protein, 17 aa, Staphylococcus aureus
KAVENELKNKGFDPSEY

SEQ ID NO: 1708531 - protein, 12 aa, Staphylococcus aureus
KAYKAQGLGAWG

SEQ ID NO: 1708532 - protein, 12 aa, Staphylococcus aureus
KAYKAQGLSAWG

SEQ ID NO: 1708533 - protein, 5 aa, Staphylococcus aureus
KDATL

SEQ ID NO: 1708534 - protein, 8 aa, Staphylococcus aureus
KDSIENRR

SEQ ID NO: 1708535 - protein, 14 aa, Staphylococcus aureus
KEAINKTQNSGYEN

SEQ ID NO: 1708536 - protein, 11 aa, Staphylococcus aureus
KEAPIKNPKKA

SEQ ID NO: 1708537 - protein, 16 aa, Staphylococcus aureus
KEGFRDQEFEKGDKGT

SEQ ID NO: 1708538 - protein, 8 aa, Staphylococcus aureus
KEIEGYTN

SEQ ID NO: 1708539 - protein, 5 aa, Staphylococcus aureus
KEKYE

SEQ ID NO: 1708540 - protein, 13 aa, Staphylococcus aureus
KELPKSENVKNHY

SEQ ID NO: 1708541 - protein, 6 aa, Staphylococcus aureus
KENDFV

SEQ ID NO: 1708542 - protein, 4 aa, Staphylococcus aureus
KEPL

SEQ ID NO: 1708543 - protein, 11 aa, Staphylococcus aureus
KFSDGSALDAK

SEQ ID NO: 1708544 - protein, 14 aa, Staphylococcus aureus
KGKSSKPSEAGVGS

SEQ ID NO: 1708545 - protein, 6 aa, Staphylococcus aureus
KGNKPV

SEQ ID NO: 1708546 - protein, 6 aa, Staphylococcus aureus
KGQDYN

SEQ ID NO: 1708547 - protein, 21 aa, Staphylococcus aureus
KGYTLNKGYDVNTKELTDVTN

SEQ ID NO: 1708548 - protein, 11 aa, Staphylococcus aureus
KHKDKIAKRGE

SEQ ID NO: 1708549 - protein, 18 aa, Staphylococcus aureus
KHKDTKLKIDENKKKVKD

SEQ ID NO: 1708550 - protein, 7 aa, Staphylococcus aureus
KIDRPSI

SEQ ID NO: 1708551 - protein, 11 aa, Staphylococcus aureus
KKNIDAVQQNK

SEQ ID NO: 1708552 - protein, 6 aa, Staphylococcus aureus
KKPSNM

SEQ ID NO: 1708553 - protein, 8 aa, Staphylococcus aureus
KKQVKAKL

SEQ ID NO: 1708554 - protein, 8 aa, Staphylococcus aureus
KLKNYDKV

SEQ ID NO: 1708555 - protein, 10 aa, Staphylococcus aureus
KMSKGYGYQD

SEQ ID NO: 1708556 - protein, 12 aa, Staphylococcus aureus
KNADQATKDNLR

SEQ ID NO: 1708557 - protein, 25 aa, Staphylococcus aureus
KNDKEFKEGMERARKEVNYAADTDA

SEQ ID NO: 1708558 - protein, 7 aa, Staphylococcus aureus
KNESREE

SEQ ID NO: 1708559 - protein, 113 aa, Staphylococcus aureus
KNLHNDKTISEENHRKTDDLNKDQLKDGKKSSLNNKNIQRDTTKNNNANPSDVNQGLEQAINDGKQSKVASQQQSKEADNSQDSNANNNLPSQSRTKEAPPLNKSDQTSQREI

SEQ ID NO: 1708560 - protein, 18 aa, Staphylococcus aureus
KNQKSDDKKSDDKKSEDK

SEQ ID NO: 1708561 - protein, 7 aa, Staphylococcus aureus
KNQNISY

SEQ ID NO: 1708562 - protein, 15 aa, Staphylococcus aureus
KQKIENKAAKQKKHP

SEQ ID NO: 1708563 - protein, 26 aa, Staphylococcus aureus
KQQKEQPKRQSRSERQSPGQGDRDFF

SEQ ID NO: 1708564 - protein, 6 aa, Staphylococcus aureus
KRAQTI

SEQ ID NO: 1708565 - protein, 8 aa, Staphylococcus aureus
KRNPKTEI

SEQ ID NO: 1708566 - protein, 9 aa, Staphylococcus aureus
KSEPPVEKH

SEQ ID NO: 1708567 - protein, 7 aa, Staphylococcus aureus
KSPSNQV

SEQ ID NO: 1708568 - protein, 14 aa, Staphylococcus aureus
KSTGGGTTNSPARL

SEQ ID NO: 1708569 - protein, 4 aa, Staphylococcus aureus
KSYI

SEQ ID NO: 1708570 - protein, 12 aa, Staphylococcus aureus
KTKKGQEYGYQS

SEQ ID NO: 1708571 - protein, 8 aa, Staphylococcus aureus
KTNTIKKV

SEQ ID NO: 1708572 - protein, 62 aa, Staphylococcus aureus; identical to SEQ ID NO: 1567555

SEQ ID NO: 1708573 - protein, 9 aa, Staphylococcus aureus
KVKKGDTMT

SEQ ID NO: 1708574 - protein, 7 aa, Staphylococcus aureus
KVQASED

SEQ ID NO: 1708575 - protein, 13 aa, Staphylococcus aureus
KVSNRNKADALKA

SEQ ID NO: 1708576 - protein, 13 aa, Staphylococcus aureus
KVTKYSSSSSKYT

SEQ ID NO: 1708577 - protein, 5 aa, Staphylococcus aureus
KYYGK

SEQ ID NO: 1708578 - protein, 6 aa, Staphylococcus aureus
LAQQQF

SEQ ID NO: 1708579 - protein, 9 aa, Staphylococcus aureus
LDKQGRINI

SEQ ID NO: 1708580 - protein, 6 aa, Staphylococcus aureus
LDSQSY

SEQ ID NO: 1708581 - protein, 9 aa, Staphylococcus aureus
LKQQADTIL

SEQ ID NO: 1708582 - protein, 10 aa, Staphylococcus aureus
LLTSDNPVIA

SEQ ID NO: 1708583 - protein, 17 aa, Staphylococcus aureus
LNADPDKQNAYKQAVAK

SEQ ID NO: 1708584 - protein, 8 aa, Staphylococcus aureus
LNEEQRNG

SEQ ID NO: 1708585 - protein, 17 aa, Staphylococcus aureus
LNNAQRQNLQSQINGAH

SEQ ID NO: 1708586 - protein, 65 aa, Staphylococcus aureus; identical to SEQ ID NO: 1568234

SEQ ID NO: 1708587 - protein, 7 aa, Staphylococcus aureus
LPAEKDA

SEQ ID NO: 1708588 - protein, 14 aa, Staphylococcus aureus
LPKYDEGKKIEYTV

SEQ ID NO: 1708589 - protein, 13 aa, Staphylococcus aureus
LQNDKDHAKQTVS

SEQ ID NO: 1708590 - protein, 31 aa, Staphylococcus aureus
LSKYKDGDISYNPEVPSYSAKYQLTNDDYNV

SEQ ID NO: 1708591 - protein, 7 aa, Staphylococcus aureus
LSPYTRQ

SEQ ID NO: 1708592 - protein, 41 aa, Staphylococcus aureus
LTDKLKEKQIVKNGDTVTIHSKDKNDPPISAKVGENYNGNK

SEQ ID NO: 1708593 - protein, 15 aa, Staphylococcus aureus
LTGTIEESNDSKPID

SEQ ID NO: 1708594 - protein, 12 aa, Staphylococcus aureus
MGKEAEIKKSFE

SEQ ID NO: 1708595 - protein, 26 aa, Staphylococcus aureus
MKDEQKKEEQTNKTDSKEEQIKKSFE

SEQ ID NO: 1708596 - protein, 20 aa, Staphylococcus aureus
MNEKEYQSNHKPVYEENNMK

SEQ ID NO: 1708597 - protein, 9 aa, Staphylococcus aureus
NAAPTRTEV

SEQ ID NO: 1708598 - protein, 4 aa, Staphylococcus aureus
NADS

SEQ ID NO: 1708599 - protein, 4 aa, Staphylococcus aureus
NAGT

SEQ ID NO: 1708600 - protein, 16 aa, Staphylococcus aureus
NAKAANDTEDIGKGSD

SEQ ID NO: 1708601 - protein, 33 aa, Staphylococcus aureus; identical to SEQ ID NO: 1565432

SEQ ID NO: 1708602 - protein, 9 aa, Staphylococcus aureus
NAYHKDSED

SEQ ID NO: 1708603 - protein, 7 aa, Staphylococcus aureus
NDPHRSH

SEQ ID NO: 1708604 - protein, 14 aa, Staphylococcus aureus
NDTKQAQFLAWLDK

SEQ ID NO: 1708605 - protein, 7 aa, Staphylococcus aureus
NDVQPME

SEQ ID NO: 1708606 - protein, 9 aa, Staphylococcus aureus
NEKKYQYKG

SEQ ID NO: 1708607 - protein, 16 aa, Staphylococcus aureus
NGEKVETVDVTSETNW

SEQ ID NO: 1708608 - protein, 18 aa, Staphylococcus aureus
NGEKVETVDVTSETNWKY

SEQ ID NO: 1708609 - protein, 6 aa, Staphylococcus aureus
NGPCKS

SEQ ID NO: 1708610 - protein, 15 aa, Staphylococcus aureus
NGQARNTGERVSAED

SEQ ID NO: 1708611 - protein, 7 aa, Staphylococcus aureus
NIQEKEF

SEQ ID NO: 1708612 - protein, 15 aa, Staphylococcus aureus
NKDHGTNKDKQAVEQ

SEQ ID NO: 1708613 - protein, 8 aa, Staphylococcus aureus
NKKDLTAE

SEQ ID NO: 1708614 - protein, 8 aa, Staphylococcus aureus
NKKPGESV

SEQ ID NO: 1708615 - protein, 11 aa, Staphylococcus aureus
NKKTADKFKDK

SEQ ID NO: 1708616 - protein, 8 aa, Staphylococcus aureus
NKNGDTLI

SEQ ID NO: 1708617 - protein, 4 aa, Staphylococcus aureus
NKQQ

SEQ ID NO: 1708618 - protein, 7 aa, Staphylococcus aureus
NKTRYVN

SEQ ID NO: 1708619 - protein, 23 aa, Staphylococcus aureus
NKVKQTKAVKTPVRKASQAKKVV

SEQ ID NO: 1708620 - protein, 15 aa, Staphylococcus aureus
NLNQPQKTALKDQVS

SEQ ID NO: 1708621 - protein, 33 aa, Staphylococcus aureus; identical to SEQ ID NO: 1565587

SEQ ID NO: 1708622 - protein, 21 aa, Staphylococcus aureus
NNAQKQDLNTQVTNAPNISTV

SEQ ID NO: 1708623 - protein, 16 aa, Staphylococcus aureus
NNAQRQNLQSQINGAH

SEQ ID NO: 1708624 - protein, 10 aa, Staphylococcus aureus
NNASAQGDIG

SEQ ID NO: 1708625 - protein, 16 aa, Staphylococcus aureus
NNDRHQITDTTNGHYA

SEQ ID NO: 1708626 - protein, 12 aa, Staphylococcus aureus
NNHQSNTTGADG

SEQ ID NO: 1708627 - protein, 16 aa, Staphylococcus aureus
NNYKASDKAKDKLRKN

SEQ ID NO: 1708628 - protein, 10 aa, Staphylococcus aureus
NPSENSLTNA

SEQ ID NO: 1708629 - protein, 6 aa, Staphylococcus aureus
NPSLQV

SEQ ID NO: 1708630 - protein, 9 aa, Staphylococcus aureus
NPSTFDGKI

SEQ ID NO: 1708631 - protein, 6 aa, Staphylococcus aureus
NQLYDT

SEQ ID NO: 1708632 - protein, 14 aa, Staphylococcus aureus
NQTTNPTLNPDDIT

SEQ ID NO: 1708633 - protein, 20 aa, Staphylococcus aureus
NRNPNLPMNPEAQQRIGGTK

SEQ ID NO: 1708634 - protein, 74 aa, Staphylococcus aureus
NSALRTAKTKLDEEINKSVTTDGMTQSSIQAYENAKRAGQTESTNAQNVINNGDATDQQIAAEKTKVEEKYNGL

SEQ ID NO: 1708635 - protein, 7 aa, Staphylococcus aureus
NSPYETG

SEQ ID NO: 1708636 - protein, 26 aa, Staphylococcus aureus
NSSNDLNQAQKDALKQQVQNATTVAG

SEQ ID NO: 1708637 - protein, 5 aa, Staphylococcus aureus
NTKGI

SEQ ID NO: 1708638 - protein, 9 aa, Staphylococcus aureus
NTNVGGRMN

SEQ ID NO: 1708639 - protein, 7 aa, Staphylococcus aureus
NVETHGI

SEQ ID NO: 1708640 - protein, 28 aa, Staphylococcus aureus
NYKDTQSADARMKAKQKVNTLSKPHQNY

SEQ ID NO: 1708641 - protein, 29 aa, Staphylococcus aureus
NYNYNTTQTTTTTTTTTTTSSISHSGNLY

SEQ ID NO: 1708642 - protein, 7 aa, Staphylococcus aureus
NYSDSTQ

SEQ ID NO: 1708643 - protein, 24 aa, Staphylococcus aureus
PAGLTQTVTNTTEDDKDADGGEVD

SEQ ID NO: 1708644 - protein, 7 aa, Staphylococcus aureus
PEARNED

SEQ ID NO: 1708645 - protein, 12 aa, Staphylococcus aureus
PELKTGSGIDWS

SEQ ID NO: 1708646 - protein, 15 aa, Staphylococcus aureus
PEYQTVNAAKTATVT

SEQ ID NO: 1708647 - protein, 5 aa, Staphylococcus aureus
PKEGS

SEQ ID NO: 1708648 - protein, 28 aa, Staphylococcus aureus
PLVNGSEKSEEINEKDLRKKSELQGAAL

SEQ ID NO: 1708649 - protein, 28 aa, Staphylococcus aureus
PNNQSLSSVTVTGQVTSGYKQNANKPTV

SEQ ID NO: 1708650 - protein, 10 aa, Staphylococcus aureus
PTKNGQGATN

SEQ ID NO: 1708651 - protein, 29 aa, Staphylococcus aureus
PTMSKKPQKSDYQPKQLESDHTVDTETMD

SEQ ID NO: 1708652 - protein, 5 aa, Staphylococcus aureus
PVPLS

SEQ ID NO: 1708653 - protein, 4 aa, Staphylococcus aureus
QALP

SEQ ID NO: 1708654 - protein, 7 aa, Staphylococcus aureus
QAVEQRG

SEQ ID NO: 1708655 - protein, 8 aa, Staphylococcus aureus
QAVPNETS

SEQ ID NO: 1708656 - protein, 11 aa, Staphylococcus aureus
QDFQPPAEKDA

SEQ ID NO: 1708657 - protein, 77 aa, Staphylococcus aureus
QEKEAAASEQNNTTVEESGSSATESKASETQTTTNNVNTIDETQSYSATSTEQPSQSTQVTTEEAPTTVQAPKVETE

SEQ ID NO: 1708658 - protein, 14 aa, Staphylococcus aureus
QGAINDKDATLRNQ

SEQ ID NO: 1708659 - protein, 9 aa, Staphylococcus aureus
QGEAPIKET

SEQ ID NO: 1708660 - protein, 16 aa, Staphylococcus aureus
QHPFNQAYTNATDKIQ

SEQ ID NO: 1708661 - protein, 21 aa, Staphylococcus aureus
QKAYGKDLKKENNETKESDSG

SEQ ID NO: 1708662 - protein, 9 aa, Staphylococcus aureus
QKFKNKSVD

SEQ ID NO: 1708663 - protein, 9 aa, Staphylococcus aureus
QKHSNTDSK

SEQ ID NO: 1708664 - protein, 36 aa, Staphylococcus aureus; identical to SEQ ID NO: 1565940

SEQ ID NO: 1708665 - protein, 29 aa, Staphylococcus aureus
QNVSSAKNALNGDQNVTNAKNAAKNALNN

SEQ ID NO: 1708666 - protein, 5 aa, Staphylococcus aureus
QTATE

SEQ ID NO: 1708667 - protein, 10 aa, Staphylococcus aureus
QTKDIPKTVS

SEQ ID NO: 1708668 - protein, 12 aa, Staphylococcus aureus
QTVRDNAQTLNT

SEQ ID NO: 1708669 - protein, 27 aa, Staphylococcus aureus
QVTDAKNGLNGEAKLATEKQNAKDAVN

SEQ ID NO: 1708670 - protein, 14 aa, Staphylococcus aureus
QVTQAKGDLNGNHN

SEQ ID NO: 1708671 - protein, 18 aa, Staphylococcus aureus
RESNGQVNAYNPSGASGL

SEQ ID NO: 1708672 - protein, 7 aa, Staphylococcus aureus
RGSQREL

SEQ ID NO: 1708673 - protein, 5 aa, Staphylococcus aureus
RITVP

SEQ ID NO: 1708674 - protein, 9 aa, Staphylococcus aureus
RKASAREQL

SEQ ID NO: 1708675 - protein, 28 aa, Staphylococcus aureus
RKERKARKLEKQIEKYGYEGAELRRKDK

SEQ ID NO: 1708676 - protein, 19 aa, Staphylococcus aureus
RNGNREEIEYQKKHGGEIS

SEQ ID NO: 1708677 - protein, 9 aa, Staphylococcus aureus
RQYISSNTE

SEQ ID NO: 1708678 - protein, 12 aa, Staphylococcus aureus
SAKPDPRPGELN

SEQ ID NO: 1708679 - protein, 6 aa, Staphylococcus aureus
SAYETG

SEQ ID NO: 1708680 - protein, 7 aa, Staphylococcus aureus
SDLKGKN

SEQ ID NO: 1708681 - protein, 6 aa, Staphylococcus aureus
SEQQID

SEQ ID NO: 1708682 - protein, 9 aa, Staphylococcus aureus
SFDGDYKQN

SEQ ID NO: 1708683 - protein, 9 aa, Staphylococcus aureus
SGGKPNKTA

SEQ ID NO: 1708684 - protein, 12 aa, Staphylococcus aureus
SGLGTENGHGNY

SEQ ID NO: 1708685 - protein, 7 aa, Staphylococcus aureus
SGYREGN

SEQ ID NO: 1708686 - protein, 34 aa, Staphylococcus aureus; identical to SEQ ID NO: 1565318

SEQ ID NO: 1708687 - protein, 34 aa, Staphylococcus aureus; identical to SEQ ID NO: 1566942

SEQ ID NO: 1708688 - protein, 9 aa, Staphylococcus aureus
SKDYKVGDR

SEQ ID NO: 1708689 - protein, 12 aa, Staphylococcus aureus
SKETVNKFKGKQ

SEQ ID NO: 1708690 - protein, 6 aa, Staphylococcus aureus
SKGENI

SEQ ID NO: 1708691 - protein, 13 aa, Staphylococcus aureus
SKIWTSDDNAAYD

SEQ ID NO: 1708692 - protein, 14 aa, Staphylococcus aureus
SKNVARYESINNEN

SEQ ID NO: 1708693 - protein, 19 aa, Staphylococcus aureus
SKYKEGDISYNPEVPSYSA

SEQ ID NO: 1708694 - protein, 15 aa, Staphylococcus aureus
SMDKTEKQAGQGYRG

SEQ ID NO: 1708695 - protein, 5 aa, Staphylococcus aureus
SMEGS

SEQ ID NO: 1708696 - protein, 5 aa, Staphylococcus aureus
SMPYP

SEQ ID NO: 1708697 - protein, 13 aa, Staphylococcus aureus
SNATGKERNGFYK

SEQ ID NO: 1708698 - protein, 12 aa, Staphylococcus aureus
SNHANASTESVD

SEQ ID NO: 1708699 - protein, 24 aa, Staphylococcus aureus
SNNAQGDGKDKPNDPIIDKSEPIE

SEQ ID NO: 1708700 - protein, 58 aa, Staphylococcus aureus; identical to SEQ ID NO: 1567739

SEQ ID NO: 1708701 - protein, 21 aa, Staphylococcus aureus
SRASDYFSEAGATPATKAFGR

SEQ ID NO: 1708702 - protein, 9 aa, Staphylococcus aureus
SSKVQTGDS

SEQ ID NO: 1708703 - protein, 7 aa, Staphylococcus aureus
STADSIS

SEQ ID NO: 1708704 - protein, 4 aa, Staphylococcus aureus
STSD

SEQ ID NO: 1708705 - protein, 9 aa, Staphylococcus aureus
SYTSNGGYT

SEQ ID NO: 1708706 - protein, 13 aa, Staphylococcus aureus
TAGKETSQNVSVD

SEQ ID NO: 1708707 - protein, 14 aa, Staphylococcus aureus
TDKERFKDDEDYEG

SEQ ID NO: 1708708 - protein, 15 aa, Staphylococcus aureus
TEDSKGYSRSKEKNI

SEQ ID NO: 1708709 - protein, 13 aa, Staphylococcus aureus
TFAPDSDKILSSV

SEQ ID NO: 1708710 - protein, 8 aa, Staphylococcus aureus
TFAPESDK

SEQ ID NO: 1708711 - protein, 10 aa, Staphylococcus aureus
TFAPKSDEIL

SEQ ID NO: 1708712 - protein, 9 aa, Staphylococcus aureus
TGAATLGGV

SEQ ID NO: 1708713 - protein, 16 aa, Staphylococcus aureus
TGKMRAEYAGKTWETS

SEQ ID NO: 1708714 - protein, 15 aa, Staphylococcus aureus
TKASGQNVDKAAVEQ

SEQ ID NO: 1708715 - protein, 22 aa, Staphylococcus aureus
TKDYSGKSQVNAGSKNGKQIAD

SEQ ID NO: 1708716 - protein, 7 aa, Staphylococcus aureus
TNAQKEA

SEQ ID NO: 1708717 - protein, 8 aa, Staphylococcus aureus
TNEPRVNE

SEQ ID NO: 1708718 - protein, 8 aa, Staphylococcus aureus
TNKKKVTI

SEQ ID NO: 1708719 - protein, 8 aa, Staphylococcus aureus
TNKKTVTV

SEQ ID NO: 1708720 - protein, 15 aa, Staphylococcus aureus
TNKSGFSEKSKVDGI

SEQ ID NO: 1708721 - protein, 4 aa, Staphylococcus aureus
TNQV

SEQ ID NO: 1708722 - protein, 10 aa, Staphylococcus aureus
TNVVGKDDGI

SEQ ID NO: 1708723 - protein, 26 aa, Staphylococcus aureus
TPAGYTPTVKNTTAEDKDSNGLTTTG

SEQ ID NO: 1708724 - protein, 16 aa, Staphylococcus aureus
TQGSGETVSDEQRSDD

SEQ ID NO: 1708725 - protein, 27 aa, Staphylococcus aureus
TQQEAEAAENNIENPTTLKDNVQSKEV

SEQ ID NO: 1708726 - protein, 17 aa, Staphylococcus aureus
TRNESVDSNDSATVTVT

SEQ ID NO: 1708727 - protein, 10 aa, Staphylococcus aureus
TRRNNTSPWV

SEQ ID NO: 1708728 - protein, 20 aa, Staphylococcus aureus
TRRNNTSPWVKEASADNVTG

SEQ ID NO: 1708729 - protein, 5 aa, Staphylococcus aureus
TSKDL

SEQ ID NO: 1708730 - protein, 21 aa, Staphylococcus aureus
TSVKSDSSYGQNDTLSSYSDI

SEQ ID NO: 1708731 - protein, 40 aa, Staphylococcus aureus
TSYAKINSEIKAVSEKNLDGDTKMYTRTATTSDSQKNITQ

SEQ ID NO: 1708732 - protein, 23 aa, Staphylococcus aureus
TTIASTADASEGYGPREKKPVSI

SEQ ID NO: 1708733 - protein, 13 aa, Staphylococcus aureus
TTVTKQGKQKVEV

SEQ ID NO: 1708734 - protein, 7 aa, Staphylococcus aureus
TYGDNNS

SEQ ID NO: 1708735 - protein, 10 aa, Staphylococcus aureus
TYKPRKKPID

SEQ ID NO: 1708736 - protein, 33 aa, Staphylococcus aureus; identical to SEQ ID NO: 1566733

SEQ ID NO: 1708737 - protein, 18 aa, Staphylococcus aureus
VASTIKDKDKKRSLEDKL

SEQ ID NO: 1708738 - protein, 6 aa, Staphylococcus aureus
VDADKA

SEQ ID NO: 1708739 - protein, 9 aa, Staphylococcus aureus
VDSSAASKI

SEQ ID NO: 1708740 - protein, 4 aa, Staphylococcus aureus
VEVK

SEQ ID NO: 1708741 - protein, 9 aa, Staphylococcus aureus
VGDASNGNV

SEQ ID NO: 1708742 - protein, 8 aa, Staphylococcus aureus
VGNESNGL

SEQ ID NO: 1708743 - protein, 10 aa, Staphylococcus aureus
VGNKENPGYY

SEQ ID NO: 1708744 - protein, 14 aa, Staphylococcus aureus
VGQGFQPPAEKDAV

SEQ ID NO: 1708745 - protein, 14 aa, Staphylococcus aureus
VKRTEDTSSDKWGV

SEQ ID NO: 1708746 - protein, 8 aa, Staphylococcus aureus
VNKGTPEF

SEQ ID NO: 1708747 - protein, 6 aa, Staphylococcus aureus
VNMGQG

SEQ ID NO: 1708748 - protein, 31 aa, Staphylococcus aureus; identical to SEQ ID NO: 1569641

SEQ ID NO: 1708749 - protein, 31 aa, Staphylococcus aureus; identical to SEQ ID NO: 1566980

SEQ ID NO: 1708750 - protein, 15 aa, Staphylococcus aureus
VQQTAKAENNVTKVK

SEQ ID NO: 1708751 - protein, 27 aa, Staphylococcus aureus
VQRAKNELNGNQNVANAKTTAKNALNN

SEQ ID NO: 1708752 - protein, 13 aa, Staphylococcus aureus
VSDYKKNKGTMGN

SEQ ID NO: 1708753 - protein, 8 aa, Staphylococcus aureus
VTNTTGQS

SEQ ID NO: 1708754 - protein, 17 aa, Staphylococcus aureus
VTPQQQEQINEANYKEM

SEQ ID NO: 1708755 - protein, 5 aa, Staphylococcus aureus
VTSGI

SEQ ID NO: 1708756 - protein, 27 aa, Staphylococcus aureus
VTTHANGQVSYGARLTQKKPSETNAYN

SEQ ID NO: 1708757 - protein, 10 aa, Staphylococcus aureus
VYQSSDGGNL

SEQ ID NO: 1708758 - protein, 21 aa, Staphylococcus aureus
YDKEGYRDDEFDKNDKGTWTI

SEQ ID NO: 1708759 - protein, 9 aa, Staphylococcus aureus
YEGAADKGR

SEQ ID NO: 1708760 - protein, 17 aa, Staphylococcus aureus
YEPEKLQGVSSGNFSTS

SEQ ID NO: 1708761 - protein, 4 aa, Staphylococcus aureus
YGST

SEQ ID NO: 1708762 - protein, 10 aa, Staphylococcus aureus
YKKENPNTQV

SEQ ID NO: 1708763 - protein, 7 aa, Staphylococcus aureus
YKNNQVG

SEQ ID NO: 1708764 - protein, 5 aa, Staphylococcus aureus
YPIED

SEQ ID NO: 1708765 - protein, 6 aa, Staphylococcus aureus
YPPSYS

SEQ ID NO: 1708766 - protein, 10 aa, Staphylococcus aureus
YTKPDGTQCT

SEQ ID NO: 1708767 - protein, 55 aa, Staphylococcus aureus
AAANADVDNAVTQANSNIEAANSQNDVDQAKTTGETSIDQVTPTVNKKATARNEI

SEQ ID NO: 1708768 - protein, 10 aa, Staphylococcus aureus
AADGLSKGLY

SEQ ID NO: 1708769 - protein, 32 aa, Staphylococcus aureus; identical to SEQ ID NO: 1565803

SEQ ID NO: 1708770 - protein, 32 aa, Staphylococcus aureus; identical to SEQ ID NO: 1565804

SEQ ID NO: 1708771 - protein, 8 aa, Staphylococcus aureus
AAKDDSDV

SEQ ID NO: 1708772 - protein, 12 aa, Staphylococcus aureus
AANGQTAGFSNV

SEQ ID NO: 1708773 - protein, 11 aa, Staphylococcus aureus
AARDAVSHDAQ

SEQ ID NO: 1708774 - protein, 19 aa, Staphylococcus aureus
AATTNAQVDEAKTNAEAAI

SEQ ID NO: 1708775 - protein, 16 aa, Staphylococcus aureus
AAVNGHKQTAESLNTA

SEQ ID NO: 1708776 - protein, 15 aa, Staphylococcus aureus
ADGNTWYQAQGAGDV

SEQ ID NO: 1708777 - protein, 13 aa, Staphylococcus aureus
ADGQTVKKGDKVN

SEQ ID NO: 1708778 - protein, 25 aa, Staphylococcus aureus
ADHSTGGLTIGKDKGYEWNPQPIKS

SEQ ID NO: 1708779 - protein, 19 aa, Staphylococcus aureus
ADQKKNNISADTNATQDEK

SEQ ID NO: 1708780 - protein, 10 aa, Staphylococcus aureus
AEHKQGPPFP

SEQ ID NO: 1708781 - protein, 12 aa, Staphylococcus aureus
AESQPDPMPDDL

SEQ ID NO: 1708782 - protein, 66 aa, Staphylococcus aureus
AGADYTTSYNQGSDVQSVSYNAQSSNSNVEAVSAPTYHNYSTSTTSSSVRLSNGNTAGATGSSAAQ

SEQ ID NO: 1708783 - protein, 26 aa, Staphylococcus aureus
AGSPTVEQINTNTSTANQAKSDLDHA

SEQ ID NO: 1708784 - protein, 18 aa, Staphylococcus aureus
AIAGDNNDYTASQSQQHI

SEQ ID NO: 1708785 - protein, 20 aa, Staphylococcus aureus
AINDINQTAPATTAKAAALE

SEQ ID NO: 1708786 - protein, 42 aa, Staphylococcus aureus; identical to SEQ ID NO: 1566144

SEQ ID NO: 1708787 - protein, 6 aa, Staphylococcus aureus
AINGNE

SEQ ID NO: 1708788 - protein, 8 aa, Staphylococcus aureus
AITSNPKH

SEQ ID NO: 1708789 - protein, 9 aa, Staphylococcus aureus
AKAAEFNPK

SEQ ID NO: 1708790 - protein, 7 aa, Staphylococcus aureus
AKAALKK

SEQ ID NO: 1708791 - protein, 10 aa, Staphylococcus aureus
AKAEQTTDNA

SEQ ID NO: 1708792 - protein, 10 aa, Staphylococcus aureus
AKAEQTTDNE

SEQ ID NO: 1708793 - protein, 5 aa, Staphylococcus aureus
AKHGF

SEQ ID NO: 1708794 - protein, 9 aa, Staphylococcus aureus
AKTEATQAI

SEQ ID NO: 1708795 - protein, 36 aa, Staphylococcus aureus
AKYFGKSNGNLDKKFKNDGYDLATNSKELSKSDKDK

SEQ ID NO: 1708796 - protein, 10 aa, Staphylococcus aureus
ALGQSPKEQL

SEQ ID NO: 1708797 - protein, 9 aa, Staphylococcus aureus
ALPDPKIDE

SEQ ID NO: 1708798 - protein, 79 aa, Staphylococcus aureus; identical to SEQ ID NO: 1566761

SEQ ID NO: 1708799 - protein, 12 aa, Staphylococcus aureus
ANGQNAQIKDTF

SEQ ID NO: 1708800 - protein, 4 aa, Staphylococcus aureus
ANNK

SEQ ID NO: 1708801 - protein, 7 aa, Staphylococcus aureus
ANQFKGK

SEQ ID NO: 1708802 - protein, 41 aa, Staphylococcus aureus
ANQHKENNSKSNDTNKKTQQTDNTTQSNTDKQMTPQEAEDI

SEQ ID NO: 1708803 - protein, 30 aa, Staphylococcus aureus
ANQHKENSSKSNDTNKKTQQTDNTTQSNTE

SEQ ID NO: 1708804 - protein, 14 aa, Staphylococcus aureus
ANRQQPNNQQAGVQ

SEQ ID NO: 1708805 - protein, 42 aa, Staphylococcus aureus; identical to SEQ ID NO: 1567319

SEQ ID NO: 1708806 - protein, 9 aa, Staphylococcus aureus
APKNQNEEF

SEQ ID NO: 1708807 - protein, 8 aa, Staphylococcus aureus
AQGQNSNT

SEQ ID NO: 1708808 - protein, 47 aa, Staphylococcus aureus
AQKDAEKKVAPKVEAPQIQSPQIEKPKVESPKVEVPQIQSPKVEVPQ

SEQ ID NO: 1708809 - protein, 5 aa, Staphylococcus aureus
AQQQF

SEQ ID NO: 1708810 - protein, 18 aa, Staphylococcus aureus
AQTTNDVTQIKDQAVTDI

SEQ ID NO: 1708811 - protein, 7 aa, Staphylococcus aureus
ASTNGRK

SEQ ID NO: 1708812 - protein, 14 aa, Staphylococcus aureus
ATDDQRVPSSKGVI

SEQ ID NO: 1708813 - protein, 6 aa, Staphylococcus aureus
ATETPK

SEQ ID NO: 1708814 - protein, 11 aa, Staphylococcus aureus
ATNEYLDKPRN

SEQ ID NO: 1708815 - protein, 7 aa, Staphylococcus aureus
ATQLNQS

SEQ ID NO: 1708816 - protein, 11 aa, Staphylococcus aureus
ATVKPKANQAI

SEQ ID NO: 1708817 - protein, 24 aa, Staphylococcus aureus
AVNQAKDNLHGDQKLADDKQHAVT

SEQ ID NO: 1708818 - protein, 10 aa, Staphylococcus aureus
AVRDGKAKIN

SEQ ID NO: 1708819 - protein, 19 aa, Staphylococcus aureus
AVSTLDGNKADASSHDNYL

SEQ ID NO: 1708820 - protein, 73 aa, Staphylococcus aureus
AVTDAKNNITAATDDNGVDQAKDAGKNSIQSTQPATSVKSNAKNDVDQAVTTQNQAIDNTTGATTEEKNAAKD

SEQ ID NO: 1708821 - protein, 10 aa, Staphylococcus aureus
AYASTSKAIN

SEQ ID NO: 1708822 - protein, 86 aa, Staphylococcus aureus
CGEKEKPKKEENKKSQTQNHKDSKPKTQQEKMKKVEDKNPPNNSIQNNSNNQNQSQNNQLNNNSDPSNNTPANINENDSQNTNLND

SEQ ID NO: 1708823 - protein, 15 aa, Staphylococcus aureus
CGNDDGKDKDGKVTI

SEQ ID NO: 1708824 - protein, 38 aa, Staphylococcus aureus
CSTTNNESNKETKSVPEEMDASKYVGQGFQPPAEKDAI

SEQ ID NO: 1708825 - protein, 22 aa, Staphylococcus aureus
CSTTNNESNKETKSVPEEMEAS

SEQ ID NO: 1708826 - protein, 8 aa, Staphylococcus aureus
DDETLTKQ

SEQ ID NO: 1708827 - protein, 14 aa, Staphylococcus aureus
DDVEARRVITSFER

SEQ ID NO: 1708828 - protein, 7 aa, Staphylococcus aureus
DEVNEQD

SEQ ID NO: 1708829 - protein, 10 aa, Staphylococcus aureus
DEYKDYYDKK

SEQ ID NO: 1708830 - protein, 18 aa, Staphylococcus aureus
DGDNKITGDSKEEQIKKS

SEQ ID NO: 1708831 - protein, 6 aa, Staphylococcus aureus
DGVQQE

SEQ ID NO: 1708832 - protein, 20 aa, Staphylococcus aureus
DHEMTNDTSRQLSDNKDDDK

SEQ ID NO: 1708833 - protein, 21 aa, Staphylococcus aureus
DIAQNKTNAEVDRTETDGNDN

SEQ ID NO: 1708834 - protein, 14 aa, Staphylococcus aureus
DISSDEKKKYTAPI

SEQ ID NO: 1708835 - protein, 11 aa, Staphylococcus aureus
DKAEETTQPVA

SEQ ID NO: 1708836 - protein, 11 aa, Staphylococcus aureus
DKDKGIKAGLA

SEQ ID NO: 1708837 - protein, 7 aa, Staphylococcus aureus
DKDKTSA

SEQ ID NO: 1708838 - protein, 12 aa, Staphylococcus aureus
DKEEYKEGIEGK

SEQ ID NO: 1708839 - protein, 17 aa, Staphylococcus aureus
DKEGYRDGEFEKGDKGT

SEQ ID NO: 1708840 - protein, 17 aa, Staphylococcus aureus
DKEGYRDGEFKKDDKGT

SEQ ID NO: 1708841 - protein, 4 aa, Staphylococcus aureus
DKKD

SEQ ID NO: 1708842 - protein, 5 aa, Staphylococcus aureus
DKNAR

SEQ ID NO: 1708843 - protein, 8 aa, Staphylococcus aureus
DKSIPTEV

SEQ ID NO: 1708844 - protein, 12 aa, Staphylococcus aureus
DKTAGSNDNKVA

SEQ ID NO: 1708845 - protein, 7 aa, Staphylococcus aureus
DKTPEVG

SEQ ID NO: 1708846 - protein, 10 aa, Staphylococcus aureus
DLAKSDKIRK

SEQ ID NO: 1708847 - protein, 11 aa, Staphylococcus aureus
DLKQHSRQYAK

SEQ ID NO: 1708848 - protein, 14 aa, Staphylococcus aureus
DMKEEKKEKEWSGY

SEQ ID NO: 1708849 - protein, 8 aa, Staphylococcus aureus
DNKTIDTE

SEQ ID NO: 1708850 - protein, 38 aa, Staphylococcus aureus; identical to SEQ ID NO: 1566012

SEQ ID NO: 1708851 - protein, 99 aa, Staphylococcus aureus
DNLQKENKELKDKKEKLQQEKEKLADKQKDLEKEVKDLKPSKEDNKDDKKDEDKNKDKDKDKEASQDKQSKDQTKSSDKDNHKKPTSADKDQKANDKHQ

SEQ ID NO: 1708852 - protein, 25 aa, Staphylococcus aureus
DPNGRLSTVGGVTKKNNQSSETNTP

SEQ ID NO: 1708853 - protein, 32 aa, Staphylococcus aureus; identical to SEQ ID NO: 1565072

SEQ ID NO: 1708854 - protein, 9 aa, Staphylococcus aureus
DQEETNVSE

SEQ ID NO: 1708855 - protein, 5 aa, Staphylococcus aureus
DRGIN

SEQ ID NO: 1708856 - protein, 9 aa, Staphylococcus aureus
DSETTRTAV

SEQ ID NO: 1708857 - protein, 15 aa, Staphylococcus aureus
DSETTRTAVKQDLTE

SEQ ID NO: 1708858 - protein, 4 aa, Staphylococcus aureus
DSGK

SEQ ID NO: 1708859 - protein, 14 aa, Staphylococcus aureus
DTIDSRNIKKIEVN

SEQ ID NO: 1708860 - protein, 10 aa, Staphylococcus aureus
DTKSGKEVKF

SEQ ID NO: 1708861 - protein, 10 aa, Staphylococcus aureus
DTLNKADGKF

SEQ ID NO: 1708862 - protein, 7 aa, Staphylococcus aureus
DVDNDDE

SEQ ID NO: 1708863 - protein, 11 aa, Staphylococcus aureus
DVKNDDNRNAY

SEQ ID NO: 1708864 - protein, 22 aa, Staphylococcus aureus
DVNSATSQVNAAKTALNGDNNL

SEQ ID NO: 1708865 - protein, 5 aa, Staphylococcus aureus
EARNE

SEQ ID NO: 1708866 - protein, 20 aa, Staphylococcus aureus
EDKTRKDKKEIQSKIGQATA

SEQ ID NO: 1708867 - protein, 12 aa, Staphylococcus aureus
EDNKTLKSDDIS

SEQ ID NO: 1708868 - protein, 11 aa, Staphylococcus aureus
EDSKKFKSDVY

SEQ ID NO: 1708869 - protein, 35 aa, Staphylococcus aureus
EEASNRPKKRSRRAAPADPNATPADPAAGNGGAPV

SEQ ID NO: 1708870 - protein, 4 aa, Staphylococcus aureus
EEIP

SEQ ID NO: 1708871 - protein, 5 aa, Staphylococcus aureus
EENSH

SEQ ID NO: 1708872 - protein, 10 aa, Staphylococcus aureus
EESFEPTNIS

SEQ ID NO: 1708873 - protein, 21 aa, Staphylococcus aureus
EGNGRQADNHSIGGITKTNRG

SEQ ID NO: 1708874 - protein, 11 aa, Staphylococcus aureus
EIGNNGNFGAS

SEQ ID NO: 1708875 - protein, 28 aa, Staphylococcus aureus
EIQATPDATDEEKQAADAEANTENGKAI

SEQ ID NO: 1708876 - protein, 17 aa, Staphylococcus aureus
EITVDKDGKPSRMNQPY

SEQ ID NO: 1708877 - protein, 7 aa, Staphylococcus aureus
EKEDETF

SEQ ID NO: 1708878 - protein, 26 aa, Staphylococcus aureus
EKRNATIKNGTAMPTNLAGGSTTTIP

SEQ ID NO: 1708879 - protein, 5 aa, Staphylococcus aureus
ELEDE

SEQ ID NO: 1708880 - protein, 7 aa, Staphylococcus aureus
ENPMDGY

SEQ ID NO: 1708881 - protein, 7 aa, Staphylococcus aureus
ENQRESF

SEQ ID NO: 1708882 - protein, 13 aa, Staphylococcus aureus
ENQSVNAKGKYEK

SEQ ID NO: 1708883 - protein, 18 aa, Staphylococcus aureus
ENRNKGKLKITGGGNDYT

SEQ ID NO: 1708884 - protein, 15 aa, Staphylococcus aureus
ENSAPTSKQAQAAIT

SEQ ID NO: 1708885 - protein, 16 aa, Staphylococcus aureus
ENYKDGEVTYNPEAPI

SEQ ID NO: 1708886 - protein, 4 aa, Staphylococcus aureus
EPFG

SEQ ID NO: 1708887 - protein, 13 aa, Staphylococcus aureus
EPTATNNKEFTVT

SEQ ID NO: 1708888 - protein, 12 aa, Staphylococcus aureus
EQADKFTKEKGY

SEQ ID NO: 1708889 - protein, 21 aa, Staphylococcus aureus
EQIKQDKKNKNLTIEDRPSTV

SEQ ID NO: 1708890 - protein, 6 aa, Staphylococcus aureus
ESMQHK

SEQ ID NO: 1708891 - protein, 21 aa, Staphylococcus aureus
ESPEEKKEREFEEKLENTPAY

SEQ ID NO: 1708892 - protein, 10 aa, Staphylococcus aureus
ESTHENSKHH

SEQ ID NO: 1708893 - protein, 4 aa, Staphylococcus aureus
ESVE

SEQ ID NO: 1708894 - protein, 7 aa, Staphylococcus aureus
ETAPTDY

SEQ ID NO: 1708895 - protein, 4 aa, Staphylococcus aureus
ETIY

SEQ ID NO: 1708896 - protein, 50 aa, Staphylococcus aureus
ETREAVAKADESWKNKTVKKYEETVTKSPVVKEEKKVEEPQSPKFDNQQE

SEQ ID NO: 1708897 - protein, 4 aa, Staphylococcus aureus
ETSF

SEQ ID NO: 1708898 - protein, 45 aa, Staphylococcus aureus; identical to SEQ ID NO: 1565520

SEQ ID NO: 1708899 - protein, 9 aa, Staphylococcus aureus
EVSEQDLPN

SEQ ID NO: 1708900 - protein, 15 aa, Staphylococcus aureus
EVTQAQNNADALNTA

SEQ ID NO: 1708901 - protein, 4 aa, Staphylococcus aureus
EVYT

SEQ ID NO: 1708902 - protein, 13 aa, Staphylococcus aureus
FAEGGNSGSPVFN

SEQ ID NO: 1708903 - protein, 13 aa, Staphylococcus aureus
FAKSNKPGEMDSE

SEQ ID NO: 1708904 - protein, 5 aa, Staphylococcus aureus
FEDVT

SEQ ID NO: 1708905 - protein, 40 aa, Staphylococcus aureus
FGGNHKLSSKKSEESKQETVKKESEEEKDPKVAHYKKIRK

SEQ ID NO: 1708906 - protein, 16 aa, Staphylococcus aureus
FKNSPKVNVSNLTDNK

SEQ ID NO: 1708907 - protein, 37 aa, Staphylococcus aureus
FKNSPKVNVSNLTDNKNFVASEDKLNKIADSSAASKI

SEQ ID NO: 1708908 - protein, 10 aa, Staphylococcus aureus
FNSTGDRKVT

SEQ ID NO: 1708909 - protein, 11 aa, Staphylococcus aureus
FPEKSKGGKTL

SEQ ID NO: 1708910 - protein, 13 aa, Staphylococcus aureus
FSDQSDLMRAEVS

SEQ ID NO: 1708911 - protein, 13 aa, Staphylococcus aureus
FSNDEKKKYTAPI

SEQ ID NO: 1708912 - protein, 6 aa, Staphylococcus aureus
FSSSAI

SEQ ID NO: 1708913 - protein, 15 aa, Staphylococcus aureus
FTGDSRVSYSDITKK

SEQ ID NO: 1708914 - protein, 16 aa, Staphylococcus aureus
FTGGVTPAATSSDKHY

SEQ ID NO: 1708915 - protein, 6 aa, Staphylococcus aureus
GADNMT

SEQ ID NO: 1708916 - protein, 7 aa, Staphylococcus aureus
GDKTIEK

SEQ ID NO: 1708917 - protein, 44 aa, Staphylococcus aureus
GEAEASEGSQTVKNPKVNATEEIKVGSQPVQNNQEVSSEQTKKN

SEQ ID NO: 1708918 - protein, 14 aa, Staphylococcus aureus
GENDVEKVAKAKPD

SEQ ID NO: 1708919 - protein, 14 aa, Staphylococcus aureus
GEVIGTTKTDENGK

SEQ ID NO: 1708920 - protein, 6 aa, Staphylococcus aureus
GEVYND

SEQ ID NO: 1708921 - protein, 4 aa, Staphylococcus aureus
GGEN

SEQ ID NO: 1708922 - protein, 16 aa, Staphylococcus aureus
GGITKTNGTQHKDTVQ

SEQ ID NO: 1708923 - protein, 6 aa, Staphylococcus aureus
GGNLDA

SEQ ID NO: 1708924 - protein, 16 aa, Staphylococcus aureus
GGVTPHENNKLNEPKE

SEQ ID NO: 1708925 - protein, 11 aa, Staphylococcus aureus
GIQANAGTLDQ

SEQ ID NO: 1708926 - protein, 11 aa, Staphylococcus aureus
GIQANAGTLNQ

SEQ ID NO: 1708927 - protein, 14 aa, Staphylococcus aureus
GKDKDKYKEGLEGQ

SEQ ID NO: 1708928 - protein, 9 aa, Staphylococcus aureus
GKENQRGLD

SEQ ID NO: 1708929 - protein, 9 aa, Staphylococcus aureus
GKMTREKNY

SEQ ID NO: 1708930 - protein, 13 aa, Staphylococcus aureus
GKSADSVDGGNSD

SEQ ID NO: 1708931 - protein, 6 aa, Staphylococcus aureus
GKTQVV

SEQ ID NO: 1708932 - protein, 11 aa, Staphylococcus aureus
GLTQEEAINEQ

SEQ ID NO: 1708933 - protein, 19 aa, Staphylococcus aureus
GNAGHEAHASEADLNKASL

SEQ ID NO: 1708934 - protein, 12 aa, Staphylococcus aureus
GNDTTKTTANIQ

SEQ ID NO: 1708935 - protein, 11 aa, Staphylococcus aureus
GNGQKEDKDVT

SEQ ID NO: 1708936 - protein, 12 aa, Staphylococcus aureus
GNTTTKTTANIQ

SEQ ID NO: 1708937 - protein, 38 aa, Staphylococcus aureus
GQAEASEANEKPSTNQESKVVSQTEQNSKETKTVESNK

SEQ ID NO: 1708938 - protein, 9 aa, Staphylococcus aureus
GQAIPSGTF

SEQ ID NO: 1708939 - protein, 88 aa, Staphylococcus aureus
GQDSDQQKDGNKEKDDKAKTEQQDKKTNDSSKDKKDNKDDSKDVNKDNKDNSANDNQQQSNSNATNNDQNQTNNNQANNNQKSSYVAP

SEQ ID NO: 1708940 - protein, 8 aa, Staphylococcus aureus
GQNDQLEN

SEQ ID NO: 1708941 - protein, 14 aa, Staphylococcus aureus
GQSHTTTNNPIREE

SEQ ID NO: 1708942 - protein, 6 aa, Staphylococcus aureus
GSESAE

SEQ ID NO: 1708943 - protein, 18 aa, Staphylococcus aureus
GSNDGDKKEESKSYTTND

SEQ ID NO: 1708944 - protein, 14 aa, Staphylococcus aureus
GTSISGDLGDAHNW

SEQ ID NO: 1708945 - protein, 7 aa, Staphylococcus aureus
GVDRNDI

SEQ ID NO: 1708946 - protein, 11 aa, Staphylococcus aureus
GVKDKGNTLNT

SEQ ID NO: 1708947 - protein, 7 aa, Staphylococcus aureus
GVTKKNV

SEQ ID NO: 1708948 - protein, 5 aa, Staphylococcus aureus
GYESC

SEQ ID NO: 1708949 - protein, 8 aa, Staphylococcus aureus
GYSYNSTG

SEQ ID NO: 1708950 - protein, 14 aa, Staphylococcus aureus
HAQQHGTQVKTPVQ

SEQ ID NO: 1708951 - protein, 7 aa, Staphylococcus aureus
HDAFKNR

SEQ ID NO: 1708952 - protein, 13 aa, Staphylococcus aureus
HDEKEQYYNEQKE

SEQ ID NO: 1708953 - protein, 7 aa, Staphylococcus aureus
HDSPDTW

SEQ ID NO: 1708954 - protein, 62 aa, Staphylococcus aureus
HEAQASEKTPTNAAVQKETLNQPGEQGNAITSHQMQSGKQLDDMHKENGKSGTVTEGKDTLQ

SEQ ID NO: 1708955 - protein, 142 aa, Staphylococcus aureus
HEAQASEKTSTNAAAQKETLNQPGEQGNAITSHQMQSGKQLDDMHKENGKSGTVTEGKDTLQSSKHQSTQNSKTIRMQNDNQVKQDSERQGSKQSHQNNATNNTERQNDQVQNTHHAERNGSQSTTSQSNDVDKSQPSIPAQ

SEQ ID NO: 1708956 - protein, 10 aa, Staphylococcus aureus
HKSSEFTGTM

SEQ ID NO: 1708957 - protein, 44 aa, Staphylococcus aureus
HNKRNHGSTAVGKYSSFSGVARPGVQSKASAPKAWGGNKTFYSL

SEQ ID NO: 1708958 - protein, 67 aa, Staphylococcus aureus
HNNGSIVNQATPTSVQSSTPSAQNNNHTDGNTTATETVSNANNNDVVSNNTALNVPTKTNENGSGGH

SEQ ID NO: 1708959 - protein, 13 aa, Staphylococcus aureus
HRQDGAKKSKITV

SEQ ID NO: 1708960 - protein, 4 aa, Staphylococcus aureus
HSKV

SEQ ID NO: 1708961 - protein, 125 aa, Staphylococcus aureus
HSTSSSNNQEQENKATHKKTETEENDQQDDSADKADKNQNNGNNVTNDNQPSSQSNVPNNHSTAPSNTQPAQPKDSNSNKNNTHDGGSQSSTNNQNNQQQNTPPANKSNNTNTSSKQTPQAQSPK

SEQ ID NO: 1708962 - protein, 125 aa, Staphylococcus aureus
HSTSSSNNQEQENKSTHKKTETEENDQQDDSADKTDKNQNNGNNDTNDNQPSSPSNVPNNHSTVPSNTQPAQPNDSNSNKNNTHGGGSQSSTNNQNNQQQNTPPANKSNNTNTPSKQTPQAQSPK

SEQ ID NO: 1708963 - protein, 5 aa, Staphylococcus aureus
HTHSK

SEQ ID NO: 1708964 - protein, 21 aa, Staphylococcus aureus
HTQSEDSRCGAGHDRKIRAEQ

SEQ ID NO: 1708965 - protein, 10 aa, Staphylococcus aureus
HVNSTTGKTE

SEQ ID NO: 1708966 - protein, 8 aa, Staphylococcus aureus
IAAPGGSF

SEQ ID NO: 1708967 - protein, 32 aa, Staphylococcus aureus
IADDGSSKNITKSVRDKIGAYESVGSRPQPNM

SEQ ID NO: 1708968 - protein, 30 aa, Staphylococcus aureus; identical to SEQ ID NO: 1565862

SEQ ID NO: 1708969 - protein, 17 aa, Staphylococcus aureus
IATHDSDFAKNEDGTYY

SEQ ID NO: 1708970 - protein, 16 aa, Staphylococcus aureus
IATIEGNKADASSLDK

SEQ ID NO: 1708971 - protein, 5 aa, Staphylococcus aureus
IDDAT

SEQ ID NO: 1708972 - protein, 10 aa, Staphylococcus aureus
IDKTDNENVK

SEQ ID NO: 1708973 - protein, 12 aa, Staphylococcus aureus
IDSNNKPANSDI

SEQ ID NO: 1708974 - protein, 5 aa, Staphylococcus aureus
IEGAQ

SEQ ID NO: 1708975 - protein, 15 aa, Staphylococcus aureus
IENGKTLKVPEKPKR

SEQ ID NO: 1708976 - protein, 10 aa, Staphylococcus aureus
IENKESNDQF

SEQ ID NO: 1708977 - protein, 47 aa, Staphylococcus aureus
IGDQTTDDGVTRIKDQGIQTLSGDTATPVVKPNAKKAIRDKATKQRE

SEQ ID NO: 1708978 - protein, 40 aa, Staphylococcus aureus; identical to SEQ ID NO: 1567462

SEQ ID NO: 1708979 - protein, 9 aa, Staphylococcus aureus
IGQTTSPSM

SEQ ID NO: 1708980 - protein, 4 aa, Staphylococcus aureus
IKKN

SEQ ID NO: 1708981 - protein, 18 aa, Staphylococcus aureus
IKKPDAGKRLMMILHASL

SEQ ID NO: 1708982 - protein, 22 aa, Staphylococcus aureus
IKVGDGKDNVAAAHDGKDIEYD

SEQ ID NO: 1708983 - protein, 15 aa, Staphylococcus aureus
INATPDATDDEKNAA

SEQ ID NO: 1708984 - protein, 31 aa, Staphylococcus aureus; identical to SEQ ID NO: 1618676

SEQ ID NO: 1708985 - protein, 32 aa, Staphylococcus aureus
INDYKDGDISYNPNVPSYSAKYQLNNDDYNVQ

SEQ ID NO: 1708986 - protein, 13 aa, Staphylococcus aureus
INPKDINEIQITK

SEQ ID NO: 1708987 - protein, 14 aa, Staphylococcus aureus
IPTKEIKDENIKTE

SEQ ID NO: 1708988 - protein, 10 aa, Staphylococcus aureus
IQKNPTDLGV

SEQ ID NO: 1708989 - protein, 12 aa, Staphylococcus aureus
IQNGKERSGAYK

SEQ ID NO: 1708990 - protein, 23 aa, Staphylococcus aureus
IQQTAKAENTVKQITNTNVAPYS

SEQ ID NO: 1708991 - protein, 73 aa, Staphylococcus aureus
IQTQAKVKPAADTEVENAYNTRKQEIQNSNASTTEEKQAAYTELDTKKQEARTNLDAANTNSAVTTAKDNGIA

SEQ ID NO: 1708992 - protein, 6 aa, Staphylococcus aureus
IRPKSY

SEQ ID NO: 1708993 - protein, 10 aa, Staphylococcus aureus
ISDGQFAKGS

SEQ ID NO: 1708994 - protein, 24 aa, Staphylococcus aureus
ITADTTIKDVAKGELTAKANEQKA

SEQ ID NO: 1708995 - protein, 14 aa, Staphylococcus aureus
ITAHPDGDKGNGGI

SEQ ID NO: 1708996 - protein, 13 aa, Staphylococcus aureus
ITNKKEKNSDYSM

SEQ ID NO: 1708997 - protein, 40 aa, Staphylococcus aureus
ITPDANVKPAAKQAIADKVQAQETAIDGNNGSTTEEKAAA

SEQ ID NO: 1708998 - protein, 55 aa, Staphylococcus aureus
ITPDANVKPQAKQAIADKVQAQEKAIDANNGSTTEEKAAAKQQVQTEKTTADAAI

SEQ ID NO: 1708999 - protein, 18 aa, Staphylococcus aureus
ITRKNSNYPNIDANNTWK

SEQ ID NO: 1709000 - protein, 7 aa, Staphylococcus aureus
KAEIEER

SEQ ID NO: 1709001 - protein, 13 aa, Staphylococcus aureus
KAIKEGQKEFDGD

SEQ ID NO: 1709002 - protein, 13 aa, Staphylococcus aureus
KAIKGNAEQSRSA

SEQ ID NO: 1709003 - protein, 13 aa, Staphylococcus aureus
KAINKTQNNGYEN

SEQ ID NO: 1709004 - protein, 8 aa, Staphylococcus aureus
KAIQKYGK

SEQ ID NO: 1709005 - protein, 12 aa, Staphylococcus aureus
KANGQNMTKAQV

SEQ ID NO: 1709006 - protein, 15 aa, Staphylococcus aureus
KAQGPNTAKDGVETA

SEQ ID NO: 1709007 - protein, 15 aa, Staphylococcus aureus
KDDFNTKKDKVTVVK

SEQ ID NO: 1709008 - protein, 8 aa, Staphylococcus aureus
KDGGKNGY

SEQ ID NO: 1709009 - protein, 18 aa, Staphylococcus aureus
KDGSKKEVDLKKDSYTAN

SEQ ID NO: 1709010 - protein, 23 aa, Staphylococcus aureus
KDNKSDKPNDKLISETAKNVINK

SEQ ID NO: 1709011 - protein, 8 aa, Staphylococcus aureus
KDRDIKSV

SEQ ID NO: 1709012 - protein, 15 aa, Staphylococcus aureus
KEADEKNEHYKGKTV

SEQ ID NO: 1709013 - protein, 15 aa, Staphylococcus aureus
KEIKNYSVSQSQFES

SEQ ID NO: 1709014 - protein, 9 aa, Staphylococcus aureus
KEKNRETVK

SEQ ID NO: 1709015 - protein, 7 aa, Staphylococcus aureus
KELEDEG

SEQ ID NO: 1709016 - protein, 6 aa, Staphylococcus aureus
KEMTRE

SEQ ID NO: 1709017 - protein, 10 aa, Staphylococcus aureus
KETKLSDNEK

SEQ ID NO: 1709018 - protein, 6 aa, Staphylococcus aureus
KEVKDD

SEQ ID NO: 1709019 - protein, 42 aa, Staphylococcus aureus; identical to SEQ ID NO: 1567118

SEQ ID NO: 1709020 - protein, 5 aa, Staphylococcus aureus
KEYGI

SEQ ID NO: 1709021 - protein, 25 aa, Staphylococcus aureus
KGKTTYQFASAPKDKNIKLYRIDLE

SEQ ID NO: 1709022 - protein, 17 aa, Staphylococcus aureus
KGPEYPTMENKTVQGEI

SEQ ID NO: 1709023 - protein, 9 aa, Staphylococcus aureus
KGQTSSNKQ

SEQ ID NO: 1709024 - protein, 18 aa, Staphylococcus aureus
KGYGAKDIPYANNFNSEA

SEQ ID NO: 1709025 - protein, 18 aa, Staphylococcus aureus
KHKDTKLKTDENKKKVKD

SEQ ID NO: 1709026 - protein, 8 aa, Staphylococcus aureus
KHQVEQAQ

SEQ ID NO: 1709027 - protein, 7 aa, Staphylococcus aureus
KIAPTVP

SEQ ID NO: 1709028 - protein, 9 aa, Staphylococcus aureus
KIDEGTDVN

SEQ ID NO: 1709029 - protein, 23 aa, Staphylococcus aureus
KIESENPDLKPYSESEERTAYGK

SEQ ID NO: 1709030 - protein, 11 aa, Staphylococcus aureus
KITGGGNNYTI

SEQ ID NO: 1709031 - protein, 10 aa, Staphylococcus aureus
KITGGSNNYT

SEQ ID NO: 1709032 - protein, 14 aa, Staphylococcus aureus
KKADDETVQKFNDG

SEQ ID NO: 1709033 - protein, 73 aa, Staphylococcus aureus; identical to SEQ ID NO: 1565553

SEQ ID NO: 1709034 - protein, 16 aa, Staphylococcus aureus
KKDGAINKGEYNNSNV

SEQ ID NO: 1709035 - protein, 24 aa, Staphylococcus aureus
KKEETHESRKVEKELPNTGSEEMD

SEQ ID NO: 1709036 - protein, 17 aa, Staphylococcus aureus
KKEKDEKSAKVETQTKA

SEQ ID NO: 1709037 - protein, 18 aa, Staphylococcus aureus
KKIDNDMKQVTKDKQGNA

SEQ ID NO: 1709038 - protein, 14 aa, Staphylococcus aureus
KKKNYTKKSNSENV

SEQ ID NO: 1709039 - protein, 9 aa, Staphylococcus aureus
KKKSDIDSS

SEQ ID NO: 1709040 - protein, 9 aa, Staphylococcus aureus
KKLKNYDKV

SEQ ID NO: 1709041 - protein, 20 aa, Staphylococcus aureus
KKTATNTKVDIAGSQVDDYG

SEQ ID NO: 1709042 - protein, 14 aa, Staphylococcus aureus
KKYKSLKELPKGAT

SEQ ID NO: 1709043 - protein, 6 aa, Staphylococcus aureus
KKYYGK

SEQ ID NO: 1709044 - protein, 13 aa, Staphylococcus aureus
KNANANGSGQTYV

SEQ ID NO: 1709045 - protein, 21 aa, Staphylococcus aureus
KNDSSGNSQMVGENIDKSKTN

SEQ ID NO: 1709046 - protein, 6 aa, Staphylococcus aureus
KNDVLN

SEQ ID NO: 1709047 - protein, 24 aa, Staphylococcus aureus
KNKKVINKKTEKEDTMNENDNFKY

SEQ ID NO: 1709048 - protein, 10 aa, Staphylococcus aureus
KNNDGQPGVL

SEQ ID NO: 1709049 - protein, 9 aa, Staphylococcus aureus
KNNQQPHDY

SEQ ID NO: 1709050 - protein, 7 aa, Staphylococcus aureus
KNPSLVT

SEQ ID NO: 1709051 - protein, 6 aa, Staphylococcus aureus
KNQSEP

SEQ ID NO: 1709052 - protein, 7 aa, Staphylococcus aureus
KNTKGSV

SEQ ID NO: 1709053 - protein, 9 aa, Staphylococcus aureus
KNYKNGRIS

SEQ ID NO: 1709054 - protein, 24 aa, Staphylococcus aureus
KPKVRRKRAALDSIEENNKNQLDA

SEQ ID NO: 1709055 - protein, 12 aa, Staphylococcus aureus
KQNDTKKSKIKV

SEQ ID NO: 1709056 - protein, 21 aa, Staphylococcus aureus
KQNTISTDEVSTQKKEVTAQE

SEQ ID NO: 1709057 - protein, 8 aa, Staphylococcus aureus
KQYPDFKN

SEQ ID NO: 1709058 - protein, 6 aa, Staphylococcus aureus
KRENSH

SEQ ID NO: 1709059 - protein, 70 aa, Staphylococcus aureus
KRSPKYNPGMSDHDETDGESEDIQHHDNDNNKAIQNDIPDQKVDDKSDKNAVNKEEKHDNGTNNSEETKV

SEQ ID NO: 1709060 - protein, 8 aa, Staphylococcus aureus
KSEAGTSS

SEQ ID NO: 1709061 - protein, 9 aa, Staphylococcus aureus
KSTAPKRLN

SEQ ID NO: 1709062 - protein, 19 aa, Staphylococcus aureus
KTGKEKTTMKPNKYFDNGH

SEQ ID NO: 1709063 - protein, 20 aa, Staphylococcus aureus
KTKKGQEYGYKSKFNSGFNK

SEQ ID NO: 1709064 - protein, 13 aa, Staphylococcus aureus
KTKKGQEYGYQSK

SEQ ID NO: 1709065 - protein, 11 aa, Staphylococcus aureus
KVDDKVKSGDY

SEQ ID NO: 1709066 - protein, 13 aa, Staphylococcus aureus
KVGEDKSNVSNRY

SEQ ID NO: 1709067 - protein, 6 aa, Staphylococcus aureus
KVIQPA

SEQ ID NO: 1709068 - protein, 6 aa, Staphylococcus aureus
KVNGDI

SEQ ID NO: 1709069 - protein, 23 aa, Staphylococcus aureus
KVTQAKNDLNGNTNLATAKQNVQ

SEQ ID NO: 1709070 - protein, 23 aa, Staphylococcus aureus
KVTQAKNDLNGNTNLATTKQNVQ

SEQ ID NO: 1709071 - protein, 7 aa, Staphylococcus aureus
KYHNPNT

SEQ ID NO: 1709072 - protein, 13 aa, Staphylococcus aureus
KYKSSKDYKNLDQ

SEQ ID NO: 1709073 - protein, 78 aa, Staphylococcus aureus
KYQSTQNSKTIRTQNDNQVKQDSERQGSKQSHQNNATNNTERQNDQVQNTHHAERNGSQSTTSQSNDVDKSQPSIPAQ

SEQ ID NO: 1709074 - protein, 41 aa, Staphylococcus aureus
LADNKSEAANLTTKLEHNNKALRDTAKKNLDDSKENEVKGA

SEQ ID NO: 1709075 - protein, 41 aa, Staphylococcus aureus
LADNKSEATNLTTKLEHNNKALRDTAKKNLDDSKENEVKGA

SEQ ID NO: 1709076 - protein, 14 aa, Staphylococcus aureus
LADQAKKDDERADK

SEQ ID NO: 1709077 - protein, 11 aa, Staphylococcus aureus
LAQSKTDAARA

SEQ ID NO: 1709078 - protein, 57 aa, Staphylococcus aureus
LEGSSSKLEIKPQGTESTLKGTQGESSDIEVKPQASETTEASHYPARPQFNKTPKYV

SEQ ID NO: 1709079 - protein, 14 aa, Staphylococcus aureus
LGDALDGKIGTLIK

SEQ ID NO: 1709080 - protein, 11 aa, Staphylococcus aureus
LGNGSTIIDQN

SEQ ID NO: 1709081 - protein, 4 aa, Staphylococcus aureus
LKEK

SEQ ID NO: 1709082 - protein, 26 aa, Staphylococcus aureus
LKHQVEQAQNVAGVNGVKDKGNTLNT

SEQ ID NO: 1709083 - protein, 12 aa, Staphylococcus aureus
LKKLGDKVTNPV

SEQ ID NO: 1709084 - protein, 11 aa, Staphylococcus aureus
LKNKPDKSTIT

SEQ ID NO: 1709085 - protein, 12 aa, Staphylococcus aureus
LKQNANKQQVDQ

SEQ ID NO: 1709086 - protein, 51 aa, Staphylococcus aureus; identical to SEQ ID NO: 1566423

SEQ ID NO: 1709087 - protein, 27 aa, Staphylococcus aureus
LNTKKNPDKTQIDYQTDTNQNSIISEK

SEQ ID NO: 1709088 - protein, 7 aa, Staphylococcus aureus
LQEDPTW

SEQ ID NO: 1709089 - protein, 6 aa, Staphylococcus aureus
LQNGET

SEQ ID NO: 1709090 - protein, 11 aa, Staphylococcus aureus
LQPNERYENLK

SEQ ID NO: 1709091 - protein, 7 aa, Staphylococcus aureus
LSAAKVS

SEQ ID NO: 1709092 - protein, 6 aa, Staphylococcus aureus
LSSQEF

SEQ ID NO: 1709093 - protein, 14 aa, Staphylococcus aureus
LSSTGNKSVSTGNA

SEQ ID NO: 1709094 - protein, 10 aa, Staphylococcus aureus
LSTDPKDETV

SEQ ID NO: 1709095 - protein, 32 aa, Staphylococcus aureus
LTDKLKEKQIVKDGDTVTIHSKDEKDPKISAK

SEQ ID NO: 1709096 - protein, 16 aa, Staphylococcus aureus
LTKNNKSKLMKASEAT

SEQ ID NO: 1709097 - protein, 10 aa, Staphylococcus aureus
LTSAKNSANA

SEQ ID NO: 1709098 - protein, 9 aa, Staphylococcus aureus
LTSNGKSFI

SEQ ID NO: 1709099 - protein, 4 aa, Staphylococcus aureus
LTSQ

SEQ ID NO: 1709100 - protein, 12 aa, Staphylococcus aureus
MAEDLEKIAEKA

SEQ ID NO: 1709101 - protein, 10 aa, Staphylococcus aureus
MATQNKGEAL

SEQ ID NO: 1709102 - protein, 11 aa, Staphylococcus aureus
MDTKRLAQDPA

SEQ ID NO: 1709103 - protein, 6 aa, Staphylococcus aureus
MGKGNT

SEQ ID NO: 1709104 - protein, 6 aa, Staphylococcus aureus
MKNGGY

SEQ ID NO: 1709105 - protein, 18 aa, Staphylococcus aureus
MNDSTTEEQQAAKEKVDQ

SEQ ID NO: 1709106 - protein, 9 aa, Staphylococcus aureus
MRNGGPKDF

SEQ ID NO: 1709107 - protein, 11 aa, Staphylococcus aureus
MSEKDKEEFEA

SEQ ID NO: 1709108 - protein, 13 aa, Staphylococcus aureus
MTSGNKERLLLKL

SEQ ID NO: 1709109 - protein, 5 aa, Staphylococcus aureus
MVDSK

SEQ ID NO: 1709110 - protein, 23 aa, Staphylococcus aureus
NADIDNAAANTDVDNAKTTNEAT

SEQ ID NO: 1709111 - protein, 15 aa, Staphylococcus aureus
NADTDKQTAYNTAVN

SEQ ID NO: 1709112 - protein, 21 aa, Staphylococcus aureus
NAETLNKASRAINRATKLDNA

SEQ ID NO: 1709113 - protein, 16 aa, Staphylococcus aureus
NANTNADVEQVKTNAI

SEQ ID NO: 1709114 - protein, 18 aa, Staphylococcus aureus
NAQKANLTEQIERGTTVA

SEQ ID NO: 1709115 - protein, 4 aa, Staphylococcus aureus
NAQR

SEQ ID NO: 1709116 - protein, 51 aa, Staphylococcus aureus
NDDHPNNPDNPDNPNNPDNPNNPDNPNNPDQPNNPNNPDNGDNNNSDNPDA

SEQ ID NO: 1709117 - protein, 25 aa, Staphylococcus aureus
NDDVEAPSDFAKLSDQSDLMRAEVT

SEQ ID NO: 1709118 - protein, 4 aa, Staphylococcus aureus
NDPV

SEQ ID NO: 1709119 - protein, 5 aa, Staphylococcus aureus
NELTK

SEQ ID NO: 1709120 - protein, 11 aa, Staphylococcus aureus
NEQTATLDNNA

SEQ ID NO: 1709121 - protein, 4 aa, Staphylococcus aureus
NFNP

SEQ ID NO: 1709122 - protein, 9 aa, Staphylococcus aureus
NFSNHNSAD

SEQ ID NO: 1709123 - protein, 4 aa, Staphylococcus aureus
NGDH

SEQ ID NO: 1709124 - protein, 13 aa, Staphylococcus aureus
NGIRPSTNRSVPT

SEQ ID NO: 1709125 - protein, 6 aa, Staphylococcus aureus
NHQNTI

SEQ ID NO: 1709126 - protein, 53 aa, Staphylococcus aureus
NITDSTQTKMDAYNEVKQAATARKAQNATVSNATNEEVAEADAAVEAAQKQGL

SEQ ID NO: 1709127 - protein, 27 aa, Staphylococcus aureus
NKDGSTVQTTNNKGGNQLDGQSKKFGT

SEQ ID NO: 1709128 - protein, 22 aa, Staphylococcus aureus
NKKVINKKTEKEDTVNENDNFK

SEQ ID NO: 1709129 - protein, 32 aa, Staphylococcus aureus
NKVKQTKAVKSPVRKASQAKKVVKQPVQQASK

SEQ ID NO: 1709130 - protein, 9 aa, Staphylococcus aureus
NKVNEQKTF

SEQ ID NO: 1709131 - protein, 11 aa, Staphylococcus aureus
NLIDAAKKHDV

SEQ ID NO: 1709132 - protein, 11 aa, Staphylococcus aureus
NLTNNEDKAKK

SEQ ID NO: 1709133 - protein, 4 aa, Staphylococcus aureus
NMGQ

SEQ ID NO: 1709134 - protein, 34 aa, Staphylococcus aureus; identical to SEQ ID NO: 1566895

SEQ ID NO: 1709135 - protein, 19 aa, Staphylococcus aureus
NNAQQDGFKGRIDQSNDLN

SEQ ID NO: 1709136 - protein, 27 aa, Staphylococcus aureus
NNPTINKGNVSSATQAVISSKNALDGV

SEQ ID NO: 1709137 - protein, 27 aa, Staphylococcus aureus
NNPTINKGNVTSATQAVTSSKNALDGV

SEQ ID NO: 1709138 - protein, 8 aa, Staphylococcus aureus
NNRAQYRD

SEQ ID NO: 1709139 - protein, 10 aa, Staphylococcus aureus
NNSRERDTRP

SEQ ID NO: 1709140 - protein, 13 aa, Staphylococcus aureus
NNTPDATQDEIQD

SEQ ID NO: 1709141 - protein, 24 aa, Staphylococcus aureus
NNVNNAKHALNGTQNLNNAKQAAI

SEQ ID NO: 1709142 - protein, 25 aa, Staphylococcus aureus
NNVNSAKHALNGTQNLNNAKQAAIT

SEQ ID NO: 1709143 - protein, 11 aa, Staphylococcus aureus
NPNQQLPQSNR

SEQ ID NO: 1709144 - protein, 160 aa, Staphylococcus aureus
NPTTASAAEQNQPAQNQPAQPADANAQPNANAGAQANPAAQPAAPANQGQPAAQPANQGGQANPAGGAAQPVGGAAQPAAGTAQPAGQGNQADPNNAAQAQPGNQAAPANQAGQGNNQATPANQTQPANAPAAQPAAPVAANAQTQDPNASNTGEGSINT

SEQ ID NO: 1709145 - protein, 103 aa, Staphylococcus aureus; identical to SEQ ID NO: 1565589

SEQ ID NO: 1709146 - protein, 5 aa, Staphylococcus aureus
NQQED

SEQ ID NO: 1709147 - protein, 11 aa, Staphylococcus aureus
NQSLNLKDKEQ

SEQ ID NO: 1709148 - protein, 23 aa, Staphylococcus aureus
NQTTSPTMNPDDVNGATTQVNNT

SEQ ID NO: 1709149 - protein, 67 aa, Staphylococcus aureus; identical to SEQ ID NO: 1565918

SEQ ID NO: 1709150 - protein, 6 aa, Staphylococcus aureus
NQYKDQ

SEQ ID NO: 1709151 - protein, 27 aa, Staphylococcus aureus
NRGGLTGNITKESNYSETISYQQPSYR

SEQ ID NO: 1709152 - protein, 8 aa, Staphylococcus aureus
NRGKAKNV

SEQ ID NO: 1709153 - protein, 10 aa, Staphylococcus aureus
NSASAQGDIG

SEQ ID NO: 1709154 - protein, 21 aa, Staphylococcus aureus
NSDDLKQTKKYYDELGKESAA

SEQ ID NO: 1709155 - protein, 34 aa, Staphylococcus aureus; identical to SEQ ID NO: 1565446

SEQ ID NO: 1709156 - protein, 13 aa, Staphylococcus aureus
NSIRPSTNRSVPS

SEQ ID NO: 1709157 - protein, 12 aa, Staphylococcus aureus
NSQNVEKDLTKS

SEQ ID NO: 1709158 - protein, 20 aa, Staphylococcus aureus
NSTSSHAKELNNLEKKYNAN

SEQ ID NO: 1709159 - protein, 23 aa, Staphylococcus aureus
NSTWDPQSNSIAKYNYPNGKPEH

SEQ ID NO: 1709160 - protein, 20 aa, Staphylococcus aureus
NTTRPNYSKKDVIEVGVFNH

SEQ ID NO: 1709161 - protein, 7 aa, Staphylococcus aureus
NVKNTRQ

SEQ ID NO: 1709162 - protein, 19 aa, Staphylococcus aureus
NVQSVQAKTEVKQQSESEL

SEQ ID NO: 1709163 - protein, 28 aa, Staphylococcus aureus
NVTSAKNALNGDQNVTNAKNAAKNALNN

SEQ ID NO: 1709164 - protein, 17 aa, Staphylococcus aureus
NYINADDNLKANYDNAI

SEQ ID NO: 1709165 - protein, 17 aa, Staphylococcus aureus
PEEHGQAQGPVEEITEN

SEQ ID NO: 1709166 - protein, 39 aa, Staphylococcus aureus
PETKVKPAAREKINQKANELRAQINQDKEATAEERQAAL

SEQ ID NO: 1709167 - protein, 6 aa, Staphylococcus aureus
PIEQQL

SEQ ID NO: 1709168 - protein, 5 aa, Staphylococcus aureus
PLEEH

SEQ ID NO: 1709169 - protein, 6 aa, Staphylococcus aureus
PLSNDE

SEQ ID NO: 1709170 - protein, 6 aa, Staphylococcus aureus
PMKTDE

SEQ ID NO: 1709171 - protein, 10 aa, Staphylococcus aureus
PNDASNQARA

SEQ ID NO: 1709172 - protein, 6 aa, Staphylococcus aureus
PNGTIH

SEQ ID NO: 1709173 - protein, 4 aa, Staphylococcus aureus
PNIS

SEQ ID NO: 1709174 - protein, 15 aa, Staphylococcus aureus
PNWKDKAEKVQRQLK

SEQ ID NO: 1709175 - protein, 6 aa, Staphylococcus aureus
PQGGYT

SEQ ID NO: 1709176 - protein, 23 aa, Staphylococcus aureus
PQGYEVTPSKQGNNEELDSNGVS

SEQ ID NO: 1709177 - protein, 19 aa, Staphylococcus aureus
PSAINQDNYPNGGFTAEQI

SEQ ID NO: 1709178 - protein, 46 aa, Staphylococcus aureus
QAAETTQDQTTNKNVLDSNKVKATTEQAKAEVKNPTQNISGTQVYQ

SEQ ID NO: 1709179 - protein, 12 aa, Staphylococcus aureus
QAGASLYDTESV

SEQ ID NO: 1709180 - protein, 14 aa, Staphylococcus aureus
QAGASLYDTESVDD

SEQ ID NO: 1709181 - protein, 9 aa, Staphylococcus aureus
QAINDKDQI

SEQ ID NO: 1709182 - protein, 8 aa, Staphylococcus aureus
QALNGDER

SEQ ID NO: 1709183 - protein, 26 aa, Staphylococcus aureus
QAVTTAKDNLHGDQKLARDQQQAVTT

SEQ ID NO: 1709184 - protein, 17 aa, Staphylococcus aureus
QEVSPQTVKITGGEEQL

SEQ ID NO: 1709185 - protein, 13 aa, Staphylococcus aureus
QFNRKAQAKELND

SEQ ID NO: 1709186 - protein, 16 aa, Staphylococcus aureus
QIATAKQNIDQATKLQ

SEQ ID NO: 1709187 - protein, 36 aa, Staphylococcus aureus; identical to SEQ ID NO: 1642279

SEQ ID NO: 1709188 - protein, 9 aa, Staphylococcus aureus
QKDIEDLGG

SEQ ID NO: 1709189 - protein, 5 aa, Staphylococcus aureus
QKFKN

SEQ ID NO: 1709190 - protein, 36 aa, Staphylococcus aureus; identical to SEQ ID NO: 1565938

SEQ ID NO: 1709191 - protein, 30 aa, Staphylococcus aureus
QLTTDETDAIDNVTNATTNADVEQVKTNAI

SEQ ID NO: 1709192 - protein, 12 aa, Staphylococcus aureus
QNKPYNTKGVVI

SEQ ID NO: 1709193 - protein, 15 aa, Staphylococcus aureus
QPEQQKLTAKAGWAE

SEQ ID NO: 1709194 - protein, 11 aa, Staphylococcus aureus
QQVGGKKAATI

SEQ ID NO: 1709195 - protein, 9 aa, Staphylococcus aureus
QRIDNENDK

SEQ ID NO: 1709196 - protein, 14 aa, Staphylococcus aureus
QRLKGLGDKVTNPV

SEQ ID NO: 1709197 - protein, 34 aa, Staphylococcus aureus; identical to SEQ ID NO: 1565459

SEQ ID NO: 1709198 - protein, 35 aa, Staphylococcus aureus; identical to SEQ ID NO: 1569387

SEQ ID NO: 1709199 - protein, 35 aa, Staphylococcus aureus; identical to SEQ ID NO: 1569388

SEQ ID NO: 1709200 - protein, 15 aa, Staphylococcus aureus
QSVTSTENALNGDAN

SEQ ID NO: 1709201 - protein, 11 aa, Staphylococcus aureus
QTVQTNGQALN

SEQ ID NO: 1709202 - protein, 27 aa, Staphylococcus aureus
QVANAKGALNGNHNLEQAKSNANTTIN

SEQ ID NO: 1709203 - protein, 26 aa, Staphylococcus aureus
QVTSTKDALNGDAKLAEAKAAARQNL

SEQ ID NO: 1709204 - protein, 17 aa, Staphylococcus aureus
RAKDGISKEDTKASSDG

SEQ ID NO: 1709205 - protein, 14 aa, Staphylococcus aureus
RAKEKGKSTGLVST

SEQ ID NO: 1709206 - protein, 16 aa, Staphylococcus aureus
RDGIRSNAIAPGTIET

SEQ ID NO: 1709207 - protein, 32 aa, Staphylococcus aureus; identical to SEQ ID NO: 1565950

SEQ ID NO: 1709208 - protein, 15 aa, Staphylococcus aureus
RGDTINKDGKIDYTN

SEQ ID NO: 1709209 - protein, 13 aa, Staphylococcus aureus
RLGVSTKENKDIS

SEQ ID NO: 1709210 - protein, 25 aa, Staphylococcus aureus
RNDNNTDRSTKPVATAPTSVAPKRL

SEQ ID NO: 1709211 - protein, 11 aa, Staphylococcus aureus
RNKEKVAPSKL

SEQ ID NO: 1709212 - protein, 19 aa, Staphylococcus aureus
RRNNTSPWVKEASADNVTG

SEQ ID NO: 1709213 - protein, 6 aa, Staphylococcus aureus
RYGPNA

SEQ ID NO: 1709214 - protein, 66 aa, Staphylococcus aureus
SAAKPAALETQYKAAAPKAATTSAPKAKTEATPKVTTFSASAQPRSVAATPKTSLPKYKPQVNSSI

SEQ ID NO: 1709215 - protein, 18 aa, Staphylococcus aureus
SATRVSGVDTVKQNAQHL

SEQ ID NO: 1709216 - protein, 5 aa, Staphylococcus aureus
SAVAT

SEQ ID NO: 1709217 - protein, 24 aa, Staphylococcus aureus
SDAIKSNDETLVDNNSNSNNENNA

SEQ ID NO: 1709218 - protein, 15 aa, Staphylococcus aureus
SDNDGKKTKSNSLKK

SEQ ID NO: 1709219 - protein, 19 aa, Staphylococcus aureus
SEGYHKNDDGIFEKNGKPL

SEQ ID NO: 1709220 - protein, 9 aa, Staphylococcus aureus
SEIEKDSYY

SEQ ID NO: 1709221 - protein, 9 aa, Staphylococcus aureus
SEKDKEEFE

SEQ ID NO: 1709222 - protein, 23 aa, Staphylococcus aureus
SEKSEEINGKDLQKKSELQGTAL

SEQ ID NO: 1709223 - protein, 17 aa, Staphylococcus aureus
SENSKKLKAYYTQPSIE

SEQ ID NO: 1709224 - protein, 14 aa, Staphylococcus aureus
SGEKDNAVSDKTVR

SEQ ID NO: 1709225 - protein, 25 aa, Staphylococcus aureus
SGNQAHASEQDNYGYNPNDPTSYSY

SEQ ID NO: 1709226 - protein, 31 aa, Staphylococcus aureus; identical to SEQ ID NO: 1565961

SEQ ID NO: 1709227 - protein, 5 aa, Staphylococcus aureus
SHPYN

SEQ ID NO: 1709228 - protein, 22 aa, Staphylococcus aureus
SINNAQKAALKSQIEGATTVAG

SEQ ID NO: 1709229 - protein, 34 aa, Staphylococcus aureus; identical to SEQ ID NO: 1565762

SEQ ID NO: 1709230 - protein, 22 aa, Staphylococcus aureus
SINNAQNEALKSQIDSATTVAG

SEQ ID NO: 1709231 - protein, 31 aa, Staphylococcus aureus; identical to SEQ ID NO: 1568453

SEQ ID NO: 1709232 - protein, 9 aa, Staphylococcus aureus
SITDAQKNN

SEQ ID NO: 1709233 - protein, 6 aa, Staphylococcus aureus
SKGDVK

SEQ ID NO: 1709234 - protein, 15 aa, Staphylococcus aureus
SKSIDAKDIAGKSVN

SEQ ID NO: 1709235 - protein, 5 aa, Staphylococcus aureus
SNGQW

SEQ ID NO: 1709236 - protein, 8 aa, Staphylococcus aureus
SNGSDIAD

SEQ ID NO: 1709237 - protein, 19 aa, Staphylococcus aureus
SNNANTNAFRPGGAQQLNE

SEQ ID NO: 1709238 - protein, 11 aa, Staphylococcus aureus
SNSASAQGDIG

SEQ ID NO: 1709239 - protein, 10 aa, Staphylococcus aureus
SNSTHNAADA

SEQ ID NO: 1709240 - protein, 24 aa, Staphylococcus aureus
SPLTNANEIQTNNTKTAHQSYENI

SEQ ID NO: 1709241 - protein, 11 aa, Staphylococcus aureus
SPSESTASSVP

SEQ ID NO: 1709242 - protein, 67 aa, Staphylococcus aureus; identical to SEQ ID NO: 1566951

SEQ ID NO: 1709243 - protein, 6 aa, Staphylococcus aureus
SQLNTL

SEQ ID NO: 1709244 - protein, 11 aa, Staphylococcus aureus
SQPKGESLKSR

SEQ ID NO: 1709245 - protein, 8 aa, Staphylococcus aureus
SRRAQTLS

SEQ ID NO: 1709246 - protein, 15 aa, Staphylococcus aureus
SRTISASQASSYNFI

SEQ ID NO: 1709247 - protein, 9 aa, Staphylococcus aureus
SSNNDVGHH

SEQ ID NO: 1709248 - protein, 14 aa, Staphylococcus aureus
SSVGQPEQAKGGNL

SEQ ID NO: 1709249 - protein, 6 aa, Staphylococcus aureus
STGKIT

SEQ ID NO: 1709250 - protein, 7 aa, Staphylococcus aureus
SVDESGK

SEQ ID NO: 1709251 - protein, 11 aa, Staphylococcus aureus
SVEDGKVNGKF

SEQ ID NO: 1709252 - protein, 12 aa, Staphylococcus aureus
SVSTDGASPKLT

SEQ ID NO: 1709253 - protein, 5 aa, Staphylococcus aureus
SYPST

SEQ ID NO: 1709254 - protein, 13 aa, Staphylococcus aureus
TAAKNKATSLNTA

SEQ ID NO: 1709255 - protein, 12 aa, Staphylococcus aureus
TATNEYLDKPRN

SEQ ID NO: 1709256 - protein, 14 aa, Staphylococcus aureus
TDADQAKKDAYTNA

SEQ ID NO: 1709257 - protein, 13 aa, Staphylococcus aureus
TDAPIDYKALKVN

SEQ ID NO: 1709258 - protein, 4 aa, Staphylococcus aureus
TDFN

SEQ ID NO: 1709259 - protein, 11 aa, Staphylococcus aureus
TDGKKNNGKVT

SEQ ID NO: 1709260 - protein, 16 aa, Staphylococcus aureus
TDNSAKAETKKDDTDL

SEQ ID NO: 1709261 - protein, 15 aa, Staphylococcus aureus
TDPSISNNDDSGQFN

SEQ ID NO: 1709262 - protein, 10 aa, Staphylococcus aureus
TEHNGNQLDK

SEQ ID NO: 1709263 - protein, 15 aa, Staphylococcus aureus
TEKLKEKNIVNNGDN

SEQ ID NO: 1709264 - protein, 17 aa, Staphylococcus aureus
TFTGGVTPAAKPSDKHY

SEQ ID NO: 1709265 - protein, 11 aa, Staphylococcus aureus
TGDLKGSSVGY

SEQ ID NO: 1709266 - protein, 15 aa, Staphylococcus aureus
TGGVTPAASSSDKPY

SEQ ID NO: 1709267 - protein, 16 aa, Staphylococcus aureus
TGVSSHTGPLGYENPD

SEQ ID NO: 1709268 - protein, 15 aa, Staphylococcus aureus
TIDKNNYKNRPDLTQ

SEQ ID NO: 1709269 - protein, 9 aa, Staphylococcus aureus
TINQKAQAL

SEQ ID NO: 1709270 - protein, 9 aa, Staphylococcus aureus
TINQKAQTL

SEQ ID NO: 1709271 - protein, 12 aa, Staphylococcus aureus
TKDFPSSNSGVD

SEQ ID NO: 1709272 - protein, 16 aa, Staphylococcus aureus
TKYKGGDISYNPEAPI

SEQ ID NO: 1709273 - protein, 19 aa, Staphylococcus aureus
TLGTPHNGTHASDLAGNEA

SEQ ID NO: 1709274 - protein, 23 aa, Staphylococcus aureus
TMENESKKDTKTETKSVPEEMEA

SEQ ID NO: 1709275 - protein, 18 aa, Staphylococcus aureus
TNEDENFVKDDQRAGVDA

SEQ ID NO: 1709276 - protein, 8 aa, Staphylococcus aureus
TNKTGQSY

SEQ ID NO: 1709277 - protein, 33 aa, Staphylococcus aureus; identical to SEQ ID NO: 1566291

SEQ ID NO: 1709278 - protein, 7 aa, Staphylococcus aureus
TQNSGFR

SEQ ID NO: 1709279 - protein, 13 aa, Staphylococcus aureus
TQSKYHDKKIAEE

SEQ ID NO: 1709280 - protein, 17 aa, Staphylococcus aureus
TRYDGTKHDYHKHKDGF

SEQ ID NO: 1709281 - protein, 8 aa, Staphylococcus aureus
TSDLKGKN

SEQ ID NO: 1709282 - protein, 16 aa, Staphylococcus aureus
TSKSNGQNTASVTSEY

SEQ ID NO: 1709283 - protein, 6 aa, Staphylococcus aureus
TSNTIN

SEQ ID NO: 1709284 - protein, 20 aa, Staphylococcus aureus
TSNTQSVQAKTEVKQQSEAD

SEQ ID NO: 1709285 - protein, 14 aa, Staphylococcus aureus
TSVDKTSDSTKTID

SEQ ID NO: 1709286 - protein, 12 aa, Staphylococcus aureus
TTAQRNDLTNQI

SEQ ID NO: 1709287 - protein, 6 aa, Staphylococcus aureus
TTESKA

SEQ ID NO: 1709288 - protein, 25 aa, Staphylococcus aureus
TTMNQAKDALNGDEKLAQAKQDAIA

SEQ ID NO: 1709289 - protein, 105 aa, Staphylococcus aureus
TTTTQAANATTPPSTKVETPQQVANATTPSSTKVEAPQQAANATTPSSTKVEAPQSKPNATTPSSTKVEAPQQAANATTPPSSNVDTSPPQSPTTKQVPTEINPK

SEQ ID NO: 1709290 - protein, 4 aa, Staphylococcus aureus
TTYY

SEQ ID NO: 1709291 - protein, 9 aa, Staphylococcus aureus
TVNTTKAAL

SEQ ID NO: 1709292 - protein, 31 aa, Staphylococcus aureus; identical to SEQ ID NO: 1565791

SEQ ID NO: 1709293 - protein, 4 aa, Staphylococcus aureus
VAPI

SEQ ID NO: 1709294 - protein, 14 aa, Staphylococcus aureus
VASDDSAFNNPTKP

SEQ ID NO: 1709295 - protein, 27 aa, Staphylococcus aureus
VATAKQNINAADTNQEVAQAKDQGTQN

SEQ ID NO: 1709296 - protein, 7 aa, Staphylococcus aureus
VDGTFND

SEQ ID NO: 1709297 - protein, 18 aa, Staphylococcus aureus
VEGAEGHAEGIVETEEDS

SEQ ID NO: 1709298 - protein, 10 aa, Staphylococcus aureus
VERQNSKSVQ

SEQ ID NO: 1709299 - protein, 7 aa, Staphylococcus aureus
VESRNGM

SEQ ID NO: 1709300 - protein, 5 aa, Staphylococcus aureus
VGAHY

SEQ ID NO: 1709301 - protein, 29 aa, Staphylococcus aureus
VGGSDAQNSSNTSPQAGSASSHTVQAGES

SEQ ID NO: 1709302 - protein, 7 aa, Staphylococcus aureus
VGNHPDL

SEQ ID NO: 1709303 - protein, 17 aa, Staphylococcus aureus
VKDYDGKYIGEHKKRNE

SEQ ID NO: 1709304 - protein, 44 aa, Staphylococcus aureus; identical to SEQ ID NO: 1565795

SEQ ID NO: 1709305 - protein, 22 aa, Staphylococcus aureus
VKKDPKHKDDYEKNYKKLNDDL

SEQ ID NO: 1709306 - protein, 36 aa, Staphylococcus aureus
VKKQTAKDEIDQLQATQTNVINNDQNATTEEKEAAI

SEQ ID NO: 1709307 - protein, 9 aa, Staphylococcus aureus
VKNDATKKS

SEQ ID NO: 1709308 - protein, 5 aa, Staphylococcus aureus
VKNTR

SEQ ID NO: 1709309 - protein, 11 aa, Staphylococcus aureus
VKQTATSLDQA

SEQ ID NO: 1709310 - protein, 10 aa, Staphylococcus aureus
VNKDTGAYTY

SEQ ID NO: 1709311 - protein, 9 aa, Staphylococcus aureus
VNKYKDNKG

SEQ ID NO: 1709312 - protein, 27 aa, Staphylococcus aureus
VNQEYPKGYGDSSTIPANSDGKNALYA

SEQ ID NO: 1709313 - protein, 34 aa, Staphylococcus aureus; identical to SEQ ID NO: 1567286

SEQ ID NO: 1709314 - protein, 25 aa, Staphylococcus aureus
VNTAKTALNGDARLNEAKNTAKQQL

SEQ ID NO: 1709315 - protein, 26 aa, Staphylococcus aureus
VPANAVGDAVKRGAINAGLSKSDAGI

SEQ ID NO: 1709316 - protein, 16 aa, Staphylococcus aureus
VPKGGNNGKEKLETGD

SEQ ID NO: 1709317 - protein, 29 aa, Staphylococcus aureus
VQDGQDYNSWKKAQNDFDNFKRQNSEVIQ

SEQ ID NO: 1709318 - protein, 31 aa, Staphylococcus aureus; identical to SEQ ID NO: 1565986

SEQ ID NO: 1709319 - protein, 12 aa, Staphylococcus aureus
VQPSSTDSKNVN

SEQ ID NO: 1709320 - protein, 11 aa, Staphylococcus aureus
VQPSSTEAKNV

SEQ ID NO: 1709321 - protein, 20 aa, Staphylococcus aureus
VQVSQNSKNLKAYYTQPSVE

SEQ ID NO: 1709322 - protein, 29 aa, Staphylococcus aureus
VSASQLDEHKRLQSDSQEISISGGENDEK

SEQ ID NO: 1709323 - protein, 18 aa, Staphylococcus aureus
VSLPTEAKADKLDAQGYD

SEQ ID NO: 1709324 - protein, 44 aa, Staphylococcus aureus
VSSPAANALSSKAMDNHPQQSQSSKQQTPKIQKGGNLKPLEQRE

SEQ ID NO: 1709325 - protein, 4 aa, Staphylococcus aureus
VTQN

SEQ ID NO: 1709326 - protein, 7 aa, Staphylococcus aureus
WGPYDRD

SEQ ID NO: 1709327 - protein, 7 aa, Staphylococcus aureus
YAKSRGS

SEQ ID NO: 1709328 - protein, 10 aa, Staphylococcus aureus
YDIPTKQAPK

SEQ ID NO: 1709329 - protein, 9 aa, Staphylococcus aureus
YDIPTNKAP

SEQ ID NO: 1709330 - protein, 18 aa, Staphylococcus aureus
YDKEGYRDDQFDKNDKGT

SEQ ID NO: 1709331 - protein, 19 aa, Staphylococcus aureus
YDKEGYRDDQFDKNDKGTW

SEQ ID NO: 1709332 - protein, 20 aa, Staphylococcus aureus
YDKEGYRDGEFKKGDKGTWT

SEQ ID NO: 1709333 - protein, 43 aa, Staphylococcus aureus; identical to SEQ ID NO: 1645279

SEQ ID NO: 1709334 - protein, 24 aa, Staphylococcus aureus
YDKYDEKNDAMKKKFEATENEAKK

SEQ ID NO: 1709335 - protein, 9 aa, Staphylococcus aureus
YENDDYKGY

SEQ ID NO: 1709336 - protein, 9 aa, Staphylococcus aureus
YGDPIYKEA

SEQ ID NO: 1709337 - protein, 4 aa, Staphylococcus aureus
YINN

SEQ ID NO: 1709338 - protein, 17 aa, Staphylococcus aureus
YKQESYRTTLSRNTNYK

SEQ ID NO: 1709339 - protein, 11 aa, Staphylococcus aureus
YKTEPKDSKIR

SEQ ID NO: 1709340 - protein, 21 aa, Staphylococcus aureus
YNEVKTELENTELANNYKGKK

SEQ ID NO: 1709341 - protein, 8 aa, Staphylococcus aureus
YNHNSGVR

SEQ ID NO: 1709342 - protein, 10 aa, Staphylococcus aureus
YNIPTKKAPK

SEQ ID NO: 1709343 - protein, 17 aa, Staphylococcus aureus
YQPEKLQGVSSGNFSTS

SEQ ID NO: 1709344 - protein, 17 aa, Staphylococcus aureus
YQPETLQGVSSGNFSTS

SEQ ID NO: 1709345 - protein, 59 aa, Staphylococcus aureus
YQSNVGPDASYYSHSNNNQAYNSHDGNGKVNYPNGTSNQNGGLASKATASGHAKDASWL

SEQ ID NO: 1709346 - protein, 12 aa, Staphylococcus aureus
YSNQADAKVYSQ

SEQ ID NO: 1709347 - protein, 14 aa, Staphylococcus aureus
YTIPTGKKETATTD

SEQ ID NO: 1709348 - protein, 6 aa, Staphylococcus aureus
YTQKYE

SEQ ID NO: 1709349 - protein, 25 aa, Staphylococcus aureus
YTQKYEDLAKATAKVSTLSQSHQNY

SEQ ID NO: 1709350 - protein, 8 aa, Staphylococcus aureus
AAEQHTPM

SEQ ID NO: 1709351 - protein, 8 aa, Staphylococcus aureus
AAETTDRD

SEQ ID NO: 1709352 - protein, 15 aa, Staphylococcus aureus
AAFQKDAKAKYKDAW

SEQ ID NO: 1709353 - protein, 58 aa, Staphylococcus aureus
AANADVDNAVTQANSNIEAANSQNDVDQAKTTGEASIDQVTPTVNKKATARNEITTTL

SEQ ID NO: 1709354 - protein, 5 aa, Staphylococcus aureus
AAQNH

SEQ ID NO: 1709355 - protein, 22 aa, Staphylococcus aureus
AAQSITDPTNGSNANKDAVEQA

SEQ ID NO: 1709356 - protein, 11 aa, Staphylococcus aureus
AARDAVTHDAQ

SEQ ID NO: 1709357 - protein, 11 aa, Staphylococcus aureus
ADNGGSTGKIR

SEQ ID NO: 1709358 - protein, 11 aa, Staphylococcus aureus
ADNKSEATNLT

SEQ ID NO: 1709359 - protein, 9 aa, Staphylococcus aureus
ADNSKTIVP

SEQ ID NO: 1709360 - protein, 4 aa, Staphylococcus aureus
ADNW

SEQ ID NO: 1709361 - protein, 33 aa, Staphylococcus aureus
ADQKKNNISADTNATQDEKQQAIKQVDQNVQTA

SEQ ID NO: 1709362 - protein, 17 aa, Staphylococcus aureus
AEATKVSPKEIQPAPKV

SEQ ID NO: 1709363 - protein, 7 aa, Staphylococcus aureus
AEIEERH

SEQ ID NO: 1709364 - protein, 6 aa, Staphylococcus aureus
AFNGKI

SEQ ID NO: 1709365 - protein, 8 aa, Staphylococcus aureus
AGAKAGDR

SEQ ID NO: 1709366 - protein, 19 aa, Staphylococcus aureus
AGNAANDGYQVNNTPSVGS

SEQ ID NO: 1709367 - protein, 15 aa, Staphylococcus aureus
AHAQQQGTQVKTPVQ

SEQ ID NO: 1709368 - protein, 14 aa, Staphylococcus aureus
AIDSKQIKDIEVNL

SEQ ID NO: 1709369 - protein, 10 aa, Staphylococcus aureus
AIERGPKGFN

SEQ ID NO: 1709370 - protein, 11 aa, Staphylococcus aureus
AIERGPNGYNF

SEQ ID NO: 1709371 - protein, 5 aa, Staphylococcus aureus
AIGDH

SEQ ID NO: 1709372 - protein, 11 aa, Staphylococcus aureus
AIHPKNRNFKD

SEQ ID NO: 1709373 - protein, 8 aa, Staphylococcus aureus
AIKYDDYS

SEQ ID NO: 1709374 - protein, 13 aa, Staphylococcus aureus
AITSYNPKNVNKV

SEQ ID NO: 1709375 - protein, 25 aa, Staphylococcus aureus
AKAEETTESIDQSEQLTAEEKTEAL

SEQ ID NO: 1709376 - protein, 17 aa, Staphylococcus aureus
AKKESMDTGSAKKDGEL

SEQ ID NO: 1709377 - protein, 23 aa, Staphylococcus aureus
AKKLNESQAPKADNKFNKEQQNA

SEQ ID NO: 1709378 - protein, 23 aa, Staphylococcus aureus
AKKLNESQAPKADNNFNKEQQNA

SEQ ID NO: 1709379 - protein, 6 aa, Staphylococcus aureus
AKKSIY

SEQ ID NO: 1709380 - protein, 7 aa, Staphylococcus aureus
AKNLKGV

SEQ ID NO: 1709381 - protein, 18 aa, Staphylococcus aureus
AKQDDNVHQSEQKPQVGD

SEQ ID NO: 1709382 - protein, 9 aa, Staphylococcus aureus
AKQQANNRL

SEQ ID NO: 1709383 - protein, 15 aa, Staphylococcus aureus
AKSAGFKVDKTPEVG

SEQ ID NO: 1709384 - protein, 10 aa, Staphylococcus aureus
AKSNRPGVLD

SEQ ID NO: 1709385 - protein, 10 aa, Staphylococcus aureus
AKTNGKHDID

SEQ ID NO: 1709386 - protein, 5 aa, Staphylococcus aureus
ALKSY

SEQ ID NO: 1709387 - protein, 16 aa, Staphylococcus aureus
ALLPSSTAVDYDENLN

SEQ ID NO: 1709388 - protein, 15 aa, Staphylococcus aureus
ALNQAKQNLTADTHA

SEQ ID NO: 1709389 - protein, 10 aa, Staphylococcus aureus
ALQDKTETLN

SEQ ID NO: 1709390 - protein, 39 aa, Staphylococcus aureus
AMENESSKDTNTETKSVPEEMEASKYEGQGFQPPAEKDA

SEQ ID NO: 1709391 - protein, 26 aa, Staphylococcus aureus
AMNNESKKDTNTETNTETKSVPEEME

SEQ ID NO: 1709392 - protein, 26 aa, Staphylococcus aureus
ANAADSDINIKPGTTDIGSNTTVKTG

SEQ ID NO: 1709393 - protein, 18 aa, Staphylococcus aureus
ANADDDSPKKLKYKENSA

SEQ ID NO: 1709394 - protein, 27 aa, Staphylococcus aureus
ANEVKESGGPASGGSNYGNSNPELKKR

SEQ ID NO: 1709395 - protein, 34 aa, Staphylococcus aureus
ANGGENSIEGTANLNELSNSNNKPINSDSVKSID

SEQ ID NO: 1709396 - protein, 14 aa, Staphylococcus aureus
ANNEATDEEQNAAI

SEQ ID NO: 1709397 - protein, 62 aa, Staphylococcus aureus
ANPVKKPAGKTALDQAAADRKTQIEQTPNASQQEINDAKQEVDAALNQAKTNVDQSSTNEYV

SEQ ID NO: 1709398 - protein, 62 aa, Staphylococcus aureus
ANPVKKPSGKTALEQAAADKKTQIEQTPNASQQEINDAKQEVDTELNQAKTNIDQSSTDDYV

SEQ ID NO: 1709399 - protein, 41 aa, Staphylococcus aureus
ANQHKENSSKSNDTNKKTQQTDNSTQSNTEKQMTPQEAEDI

SEQ ID NO: 1709400 - protein, 62 aa, Staphylococcus aureus
ANTEANSANKDSQDQTKKEHVDKAQQKEKRNVNDKDKNTPGPDDIGKNGKVTKRTETVYDEK

SEQ ID NO: 1709401 - protein, 16 aa, Staphylococcus aureus
ANTNADVEQVKTNAIQ

SEQ ID NO: 1709402 - protein, 16 aa, Staphylococcus aureus
ANTNAEVEQVKTNAIQ

SEQ ID NO: 1709403 - protein, 4 aa, Staphylococcus aureus
APKK

SEQ ID NO: 1709404 - protein, 6 aa, Staphylococcus aureus
AQARRY

SEQ ID NO: 1709405 - protein, 48 aa, Staphylococcus aureus
AQKDAEKKVAPKVEAPQIQSPQIEKPKAESPKVEVPQIQSPKVEVPQS

SEQ ID NO: 1709406 - protein, 15 aa, Staphylococcus aureus
AQPGNSGSPVLNSKN

SEQ ID NO: 1709407 - protein, 5 aa, Staphylococcus aureus
AQQTY

SEQ ID NO: 1709408 - protein, 139 aa, Staphylococcus aureus
ARPRFNKPSETNAYNVTTNQDGTVTYGARPTQNKPSKTNAYNVTTHANGQVSYGARPTQNKPSKTNAYNVTTHANGQVSYGARPTQNKPSKTNAYNVTTHANGQVSYGARPTYKKPSKTNAYNVTTHADGTATYGPRVT

SEQ ID NO: 1709409 - protein, 5 aa, Staphylococcus aureus
ARPTE

SEQ ID NO: 1709410 - protein, 10 aa, Staphylococcus aureus
ASEAKENESI

SEQ ID NO: 1709411 - protein, 11 aa, Staphylococcus aureus
ASGQQLPQSNK

SEQ ID NO: 1709412 - protein, 5 aa, Staphylococcus aureus
ASKTF

SEQ ID NO: 1709413 - protein, 18 aa, Staphylococcus aureus
ASNAANDGYQVNNTPSVG

SEQ ID NO: 1709414 - protein, 9 aa, Staphylococcus aureus
ASSGPDEEW

SEQ ID NO: 1709415 - protein, 9 aa, Staphylococcus aureus
ASSNNGGLN

SEQ ID NO: 1709416 - protein, 8 aa, Staphylococcus aureus
ASVGTANM

SEQ ID NO: 1709417 - protein, 9 aa, Staphylococcus aureus
ATGTPDGVH

SEQ ID NO: 1709418 - protein, 8 aa, Staphylococcus aureus
ATHGDPHA

SEQ ID NO: 1709419 - protein, 18 aa, Staphylococcus aureus
ATQVKTDARNAVNNKARE

SEQ ID NO: 1709420 - protein, 10 aa, Staphylococcus aureus
AVKPKANQVI

SEQ ID NO: 1709421 - protein, 10 aa, Staphylococcus aureus
AVSNTSTQLN

SEQ ID NO: 1709422 - protein, 24 aa, Staphylococcus aureus
AVTAAKKALNGEERLNNRKAEALQ

SEQ ID NO: 1709423 - protein, 84 aa, Staphylococcus aureus
AVTDAKNNITAATDNNGVDTAKDAGKNSIQSTHPATAVKSNAKNEVDQAVTTQNQTIDNTTGATTEEKNAAKDLVSKAKEKAYQ

SEQ ID NO: 1709424 - protein, 26 aa, Staphylococcus aureus
AYGKEPDKKVKELTSNFKNKTSRNTN

SEQ ID NO: 1709425 - protein, 5 aa, Staphylococcus aureus
AYNEK

SEQ ID NO: 1709426 - protein, 86 aa, Staphylococcus aureus
CGEKEKPKKEENKKSQTQKHKDSKTKNHQEKPKKVEDKNPPINSVQNNATNQSQAQNNQFSNHSDLSNNAPANINENDSQNTNLND

SEQ ID NO: 1709427 - protein, 11 aa, Staphylococcus aureus
CGFDNDSNKGF

SEQ ID NO: 1709428 - protein, 19 aa, Staphylococcus aureus
CGGNKGLEEKKENKQLTYT

SEQ ID NO: 1709429 - protein, 20 aa, Staphylococcus aureus
CGNSNSQDQGNKTEQKNKVR

SEQ ID NO: 1709430 - protein, 27 aa, Staphylococcus aureus
CGQNQSEKNSEKHNEEKTVDTTEERND

SEQ ID NO: 1709431 - protein, 121 aa, Staphylococcus aureus
CGSNDGDKKEESKKAETKKENKDKKKETKDKAEVKKENANQNDNNNQVNNDNNTNVNDHQQTNNAPKQNQTQNNPTSNKNNNAPVKDEFSSDTSYNAYQEAKRATEENKRQNGGHTAGIGG

SEQ ID NO: 1709432 - protein, 18 aa, Staphylococcus aureus
DAQKANLTSQIESGTTVA

SEQ ID NO: 1709433 - protein, 16 aa, Staphylococcus aureus
DAQKQALKGQIDQSPE

SEQ ID NO: 1709434 - protein, 18 aa, Staphylococcus aureus
DAQKQALKGQIDQSPEIA

SEQ ID NO: 1709435 - protein, 13 aa, Staphylococcus aureus
DDEDDNSENQINP

SEQ ID NO: 1709436 - protein, 8 aa, Staphylococcus aureus
DDKGNFNY

SEQ ID NO: 1709437 - protein, 15 aa, Staphylococcus aureus
DDKQTTASDNQETNS

SEQ ID NO: 1709438 - protein, 5 aa, Staphylococcus aureus
DDVEA

SEQ ID NO: 1709439 - protein, 17 aa, Staphylococcus aureus
DDVEEPSDFEKIRAEVS

SEQ ID NO: 1709440 - protein, 21 aa, Staphylococcus aureus
DEAVDKAKQALDKSSGQNLTA

SEQ ID NO: 1709441 - protein, 8 aa, Staphylococcus aureus
DEDKQTIE

SEQ ID NO: 1709442 - protein, 11 aa, Staphylococcus aureus
DEHDTEISNSN

SEQ ID NO: 1709443 - protein, 6 aa, Staphylococcus aureus
DEKREV

SEQ ID NO: 1709444 - protein, 10 aa, Staphylococcus aureus
DEQKGKEKQL

SEQ ID NO: 1709445 - protein, 8 aa, Staphylococcus aureus
DERKHEID

SEQ ID NO: 1709446 - protein, 16 aa, Staphylococcus aureus
DETQQIAKAEKHVTQV

SEQ ID NO: 1709447 - protein, 14 aa, Staphylococcus aureus
DFPSTVSKEDQQCS

SEQ ID NO: 1709448 - protein, 7 aa, Staphylococcus aureus
DGEVSDV

SEQ ID NO: 1709449 - protein, 11 aa, Staphylococcus aureus
DGSAKLNNMTS

SEQ ID NO: 1709450 - protein, 7 aa, Staphylococcus aureus
DGTSKYV

SEQ ID NO: 1709451 - protein, 13 aa, Staphylococcus aureus
DIDAATTNAQVEA

SEQ ID NO: 1709452 - protein, 13 aa, Staphylococcus aureus
DIKKDNPELKDFN

SEQ ID NO: 1709453 - protein, 11 aa, Staphylococcus aureus
DKDKYKEGLQG

SEQ ID NO: 1709454 - protein, 11 aa, Staphylococcus aureus
DKDYGEHAKEL

SEQ ID NO: 1709455 - protein, 8 aa, Staphylococcus aureus
DKEDKKGL

SEQ ID NO: 1709456 - protein, 18 aa, Staphylococcus aureus
DKEGYRDDQFDKKDKGTW

SEQ ID NO: 1709457 - protein, 15 aa, Staphylococcus aureus
DKEGYRDSEFKKGDK

SEQ ID NO: 1709458 - protein, 12 aa, Staphylococcus aureus
DKENPYKITNER

SEQ ID NO: 1709459 - protein, 95 aa, Staphylococcus aureus
DKLEKENKELKDKKEKLKQEKDKLEDKQKDLEKEVKDLKPSKDDKKDDKKDEDKNKDKEASQDKQSKDQTKSSDKDNHKKPTSTDKDQKANDKHQ

SEQ ID NO: 1709460 - protein, 17 aa, Staphylococcus aureus
DKSDETKEDSKETQIKK

SEQ ID NO: 1709461 - protein, 36 aa, Staphylococcus aureus
DKSDNTKSSVSGKVGADLTSGNGTTFKKHFIDKITI

SEQ ID NO: 1709462 - protein, 22 aa, Staphylococcus aureus
DKSFRDGIKNSKKQLNDKSRPY

SEQ ID NO: 1709463 - protein, 5 aa, Staphylococcus aureus
DKSRN

SEQ ID NO: 1709464 - protein, 15 aa, Staphylococcus aureus
DKTAGSNDNKAAVEQ

SEQ ID NO: 1709465 - protein, 20 aa, Staphylococcus aureus
DKVNEANQAKDQLNTARQGL

SEQ ID NO: 1709466 - protein, 17 aa, Staphylococcus aureus
DKVQGNAIAKAEAEQLK

SEQ ID NO: 1709467 - protein, 13 aa, Staphylococcus aureus
DKVQTDKKNVTVQ

SEQ ID NO: 1709468 - protein, 11 aa, Staphylococcus aureus
DKYDESNDAMK

SEQ ID NO: 1709469 - protein, 11 aa, Staphylococcus aureus
DKYDQNAKDLR

SEQ ID NO: 1709470 - protein, 13 aa, Staphylococcus aureus
DLKGLGGEHNDYD

SEQ ID NO: 1709471 - protein, 39 aa, Staphylococcus aureus; identical to SEQ ID NO: 1566784

SEQ ID NO: 1709472 - protein, 12 aa, Staphylococcus aureus
DNFTPKDKMPVT

SEQ ID NO: 1709473 - protein, 19 aa, Staphylococcus aureus
DNGDATAQQISDEKHRVDN

SEQ ID NO: 1709474 - protein, 15 aa, Staphylococcus aureus
DNKITGDSKEEQIKK

SEQ ID NO: 1709475 - protein, 17 aa, Staphylococcus aureus
DNKTIDSSDYHIDVYLF

SEQ ID NO: 1709476 - protein, 18 aa, Staphylococcus aureus
DNKTLSTEHLHIDIYLYE

SEQ ID NO: 1709477 - protein, 19 aa, Staphylococcus aureus
DNKTNKEVGRTITDDKGGY

SEQ ID NO: 1709478 - protein, 38 aa, Staphylococcus aureus; identical to SEQ ID NO: 1566786

SEQ ID NO: 1709479 - protein, 42 aa, Staphylococcus aureus
DNNKAIQNDTPNQNVDDKNDKNAVNKEEKHDNRVNNSAETKV

SEQ ID NO: 1709480 - protein, 7 aa, Staphylococcus aureus
DNRQTEE

SEQ ID NO: 1709481 - protein, 75 aa, Staphylococcus aureus; identical to SEQ ID NO: 1568735

SEQ ID NO: 1709482 - protein, 75 aa, Staphylococcus aureus; identical to SEQ ID NO: 1570103

SEQ ID NO: 1709483 - protein, 6 aa, Staphylococcus aureus
DPKHGF

SEQ ID NO: 1709484 - protein, 24 aa, Staphylococcus aureus
DPNGRLSTVGGVTKNNNKTSETKT

SEQ ID NO: 1709485 - protein, 7 aa, Staphylococcus aureus
DQDETNI

SEQ ID NO: 1709486 - protein, 7 aa, Staphylococcus aureus
DQKLKER

SEQ ID NO: 1709487 - protein, 6 aa, Staphylococcus aureus
DQLTKD

SEQ ID NO: 1709488 - protein, 9 aa, Staphylococcus aureus
DQNRPSNIT

SEQ ID NO: 1709489 - protein, 11 aa, Staphylococcus aureus
DQTTNPSLDPT

SEQ ID NO: 1709490 - protein, 8 aa, Staphylococcus aureus
DRNKYKEL

SEQ ID NO: 1709491 - protein, 29 aa, Staphylococcus aureus
DRQQAIESVKQANTNAEVDQAATTAENNI

SEQ ID NO: 1709492 - protein, 13 aa, Staphylococcus aureus
DSATDKERNGFYK

SEQ ID NO: 1709493 - protein, 8 aa, Staphylococcus aureus
DSDNKNIL

SEQ ID NO: 1709494 - protein, 17 aa, Staphylococcus aureus
DSDSSLRSKDKGDDMST

SEQ ID NO: 1709495 - protein, 7 aa, Staphylococcus aureus
DSGRGYR

SEQ ID NO: 1709496 - protein, 5 aa, Staphylococcus aureus
DSIDD

SEQ ID NO: 1709497 - protein, 14 aa, Staphylococcus aureus
DSKIKSLKDLKGKK

SEQ ID NO: 1709498 - protein, 14 aa, Staphylococcus aureus
DSVYPKNKKFGENT

SEQ ID NO: 1709499 - protein, 7 aa, Staphylococcus aureus
DTEGGVS

SEQ ID NO: 1709500 - protein, 17 aa, Staphylococcus aureus
DTKKQAKDKAKTSTQVP

SEQ ID NO: 1709501 - protein, 10 aa, Staphylococcus aureus
DTNKNGVQDL

SEQ ID NO: 1709502 - protein, 13 aa, Staphylococcus aureus
DTQSKEKKSYELN

SEQ ID NO: 1709503 - protein, 16 aa, Staphylococcus aureus
DTYKSYKEKYDTAKYY

SEQ ID NO: 1709504 - protein, 11 aa, Staphylococcus aureus
DVKDDDNRNAY

SEQ ID NO: 1709505 - protein, 9 aa, Staphylococcus aureus
DVKSSNPNL

SEQ ID NO: 1709506 - protein, 32 aa, Staphylococcus aureus; identical to SEQ ID NO: 1635820

SEQ ID NO: 1709507 - protein, 12 aa, Staphylococcus aureus
DVNSATSQVNAA

SEQ ID NO: 1709508 - protein, 5 aa, Staphylococcus aureus
DVQVG

SEQ ID NO: 1709509 - protein, 18 aa, Staphylococcus aureus
DVSPSMVDGNGRLKSDTN

SEQ ID NO: 1709510 - protein, 33 aa, Staphylococcus aureus; identical to SEQ ID NO: 1565829

SEQ ID NO: 1709511 - protein, 21 aa, Staphylococcus aureus
DYTQADSDKQKAYKQAIADAE

SEQ ID NO: 1709512 - protein, 9 aa, Staphylococcus aureus
EAGINATKD

SEQ ID NO: 1709513 - protein, 13 aa, Staphylococcus aureus
EAINKTQNSGYEN

SEQ ID NO: 1709514 - protein, 5 aa, Staphylococcus aureus
EALTQ

SEQ ID NO: 1709515 - protein, 25 aa, Staphylococcus aureus
EAQAQNKNNIADKNVETLNEKEIEK

SEQ ID NO: 1709516 - protein, 8 aa, Staphylococcus aureus
EASAANVT

SEQ ID NO: 1709517 - protein, 18 aa, Staphylococcus aureus
EASAANVTGIAGTNNGIT

SEQ ID NO: 1709518 - protein, 4 aa, Staphylococcus aureus
EDIK

SEQ ID NO: 1709519 - protein, 9 aa, Staphylococcus aureus
EDKKLKQKI

SEQ ID NO: 1709520 - protein, 11 aa, Staphylococcus aureus
EDQKNYVSKSY

SEQ ID NO: 1709521 - protein, 10 aa, Staphylococcus aureus
EDSDGMTHNH

SEQ ID NO: 1709522 - protein, 11 aa, Staphylococcus aureus
EDVRHSSDKPE

SEQ ID NO: 1709523 - protein, 4 aa, Staphylococcus aureus
EDVT

SEQ ID NO: 1709524 - protein, 16 aa, Staphylococcus aureus
EEKSTQPKGRKFKDFT

SEQ ID NO: 1709525 - protein, 11 aa, Staphylococcus aureus
EESTHENSKHH

SEQ ID NO: 1709526 - protein, 13 aa, Staphylococcus aureus
EFVTPDGKKSAHD

SEQ ID NO: 1709527 - protein, 8 aa, Staphylococcus aureus
EGIKDDGV

SEQ ID NO: 1709528 - protein, 23 aa, Staphylococcus aureus
EGNGRQADNHSIGGVTKTNRQSY

SEQ ID NO: 1709529 - protein, 5 aa, Staphylococcus aureus
EGNKP

SEQ ID NO: 1709530 - protein, 5 aa, Staphylococcus aureus
EGTLA

SEQ ID NO: 1709531 - protein, 8 aa, Staphylococcus aureus
EGVPSYNQ

SEQ ID NO: 1709532 - protein, 5 aa, Staphylococcus aureus
EHREG

SEQ ID NO: 1709533 - protein, 16 aa, Staphylococcus aureus
EHTRDGGTEADQIPSG

SEQ ID NO: 1709534 - protein, 4 aa, Staphylococcus aureus
EHVR

SEQ ID NO: 1709535 - protein, 12 aa, Staphylococcus aureus
EIGNNGNFGASL

SEQ ID NO: 1709536 - protein, 11 aa, Staphylococcus aureus
EIKKEKDLPTD

SEQ ID NO: 1709537 - protein, 16 aa, Staphylococcus aureus
EINKSQKDTQKTDEYY

SEQ ID NO: 1709538 - protein, 34 aa, Staphylococcus aureus
EKDVSKNKGDKNVQSKLNQISNDIQSAHTSYKDA

SEQ ID NO: 1709539 - protein, 54 aa, Staphylococcus aureus; identical to SEQ ID NO: 1566577

SEQ ID NO: 1709540 - protein, 11 aa, Staphylococcus aureus
EKIEKTKDMPI

SEQ ID NO: 1709541 - protein, 12 aa, Staphylococcus aureus
EKLQQAARNRTP

SEQ ID NO: 1709542 - protein, 24 aa, Staphylococcus aureus
EKVNELNGNERVAEAKTQAKQTID

SEQ ID NO: 1709543 - protein, 17 aa, Staphylococcus aureus
EKYNNGEFSYNPEAPIY

SEQ ID NO: 1709544 - protein, 31 aa, Staphylococcus aureus; identical to SEQ ID NO: 1559193

SEQ ID NO: 1709545 - protein, 12 aa, Staphylococcus aureus
ELPSPSNPPQGC

SEQ ID NO: 1709546 - protein, 12 aa, Staphylococcus aureus
ELSTYGPKGRFG

SEQ ID NO: 1709547 - protein, 9 aa, Staphylococcus aureus
EMKTESGRT

SEQ ID NO: 1709548 - protein, 6 aa, Staphylococcus aureus
ENERNS

SEQ ID NO: 1709549 - protein, 5 aa, Staphylococcus aureus
ENGRF

SEQ ID NO: 1709550 - protein, 19 aa, Staphylococcus aureus
ENIKGAKDYHEGKADHISG

SEQ ID NO: 1709551 - protein, 16 aa, Staphylococcus aureus
ENNTDMDKAEEQLKKE

SEQ ID NO: 1709552 - protein, 11 aa, Staphylococcus aureus
ENSDKSGNTLS

SEQ ID NO: 1709553 - protein, 38 aa, Staphylococcus aureus
EPASNRPKKRSRRAAPADPNATPADPGAAAAGNGGAPV

SEQ ID NO: 1709554 - protein, 11 aa, Staphylococcus aureus
EPRNAQAANTL

SEQ ID NO: 1709555 - protein, 11 aa, Staphylococcus aureus
ERVKSANDAIS

SEQ ID NO: 1709556 - protein, 12 aa, Staphylococcus aureus
ERVKSANDAISK

SEQ ID NO: 1709557 - protein, 8 aa, Staphylococcus aureus
ESENRNGT

SEQ ID NO: 1709558 - protein, 8 aa, Staphylococcus aureus
ESGKKFYP

SEQ ID NO: 1709559 - protein, 21 aa, Staphylococcus aureus
ESQPDPTPDELHKSSEFTGTM

SEQ ID NO: 1709560 - protein, 4 aa, Staphylococcus aureus
ESTN

SEQ ID NO: 1709561 - protein, 14 aa, Staphylococcus aureus
ESVKQNANSLDGAM

SEQ ID NO: 1709562 - protein, 5 aa, Staphylococcus aureus
ETLNT

SEQ ID NO: 1709563 - protein, 40 aa, Staphylococcus aureus; identical to SEQ ID NO: 1563926

SEQ ID NO: 1709564 - protein, 27 aa, Staphylococcus aureus
ETPTGYLPTKVNGTTDGEKDSNGSSVT

SEQ ID NO: 1709565 - protein, 9 aa, Staphylococcus aureus
ETVNGRQYS

SEQ ID NO: 1709566 - protein, 15 aa, Staphylococcus aureus
ETVSHAGNAEDPGYY

SEQ ID NO: 1709567 - protein, 6 aa, Staphylococcus aureus
EVKANE

SEQ ID NO: 1709568 - protein, 39 aa, Staphylococcus aureus
EVKQAATARKAQNATVSNTTNEEVAEADAAVDAAQTEGL

SEQ ID NO: 1709569 - protein, 46 aa, Staphylococcus aureus
EVSSSDPYLGDDEEDEEVEETSTEEVGAEEESTEAKATYTTPRYEK

SEQ ID NO: 1709570 - protein, 45 aa, Staphylococcus aureus
EVSSSSPDLGDDEEDEEVEEDSTEKAGTEEENTDAKATYTTPRYE

SEQ ID NO: 1709571 - protein, 5 aa, Staphylococcus aureus
EYTGA

SEQ ID NO: 1709572 - protein, 10 aa, Staphylococcus aureus
EYTTSESPTL

SEQ ID NO: 1709573 - protein, 10 aa, Staphylococcus aureus
FDSSDGSKVS

SEQ ID NO: 1709574 - protein, 8 aa, Staphylococcus aureus
FENDQDYQ

SEQ ID NO: 1709575 - protein, 42 aa, Staphylococcus aureus; identical to SEQ ID NO: 1566810

SEQ ID NO: 1709576 - protein, 8 aa, Staphylococcus aureus
FKYTDEGK

SEQ ID NO: 1709577 - protein, 8 aa, Staphylococcus aureus
FPKDSKIK

SEQ ID NO: 1709578 - protein, 14 aa, Staphylococcus aureus
FPNTPINSSSEAKA

SEQ ID NO: 1709579 - protein, 10 aa, Staphylococcus aureus
FSEYKKDALA

SEQ ID NO: 1709580 - protein, 13 aa, Staphylococcus aureus
FSNEEKKKYTAPI

SEQ ID NO: 1709581 - protein, 7 aa, Staphylococcus aureus
FTPDTSK

SEQ ID NO: 1709582 - protein, 13 aa, Staphylococcus aureus
FTPDTSKLKDVTD

SEQ ID NO: 1709583 - protein, 12 aa, Staphylococcus aureus
FTPEAPKTITEL

SEQ ID NO: 1709584 - protein, 39 aa, Staphylococcus aureus; identical to SEQ ID NO: 1565846

SEQ ID NO: 1709585 - protein, 33 aa, Staphylococcus aureus; identical to SEQ ID NO: 1566179

SEQ ID NO: 1709586 - protein, 10 aa, Staphylococcus aureus
FTTSENGQQK

SEQ ID NO: 1709587 - protein, 12 aa, Staphylococcus aureus
FVTASGQKSAFD

SEQ ID NO: 1709588 - protein, 5 aa, Staphylococcus aureus
GAKRV

SEQ ID NO: 1709589 - protein, 6 aa, Staphylococcus aureus
GDFPEK

SEQ ID NO: 1709590 - protein, 4 aa, Staphylococcus aureus
GDPE

SEQ ID NO: 1709591 - protein, 9 aa, Staphylococcus aureus
GDSAGAQLA

SEQ ID NO: 1709592 - protein, 20 aa, Staphylococcus aureus
GDSTDVENRLTEDQGKTRYQ

SEQ ID NO: 1709593 - protein, 19 aa, Staphylococcus aureus
GDYFSEANAPAATKALGEQ

SEQ ID NO: 1709594 - protein, 44 aa, Staphylococcus aureus
GEAHASEGSQSVGNSNATATDGIKVGSQPVQNNQEVSSEQTKKN

SEQ ID NO: 1709595 - protein, 28 aa, Staphylococcus aureus
GEAQKLNDSQAPKADAQQNNFNKDQQSA

SEQ ID NO: 1709596 - protein, 10 aa, Staphylococcus aureus
GEGLANEETA

SEQ ID NO: 1709597 - protein, 12 aa, Staphylococcus aureus
GERPTESPGAPK

SEQ ID NO: 1709598 - protein, 4 aa, Staphylococcus aureus
GEYG

SEQ ID NO: 1709599 - protein, 10 aa, Staphylococcus aureus
GFDNDSNKGF

SEQ ID NO: 1709600 - protein, 25 aa, Staphylococcus aureus
GGGNSGSGNSDLKGEAKGDGSSTVA

SEQ ID NO: 1709601 - protein, 5 aa, Staphylococcus aureus
GGTGV

SEQ ID NO: 1709602 - protein, 8 aa, Staphylococcus aureus
GHTSVKGK

SEQ ID NO: 1709603 - protein, 58 aa, Staphylococcus aureus
GIEGSSSKLEIKPQGTESTLKGIQGESSDIEVKPQASETTEASHYPARPQFNKTPKYV

SEQ ID NO: 1709604 - protein, 13 aa, Staphylococcus aureus
GIGKEAEVKKSFE

SEQ ID NO: 1709605 - protein, 4 aa, Staphylococcus aureus
GINE

SEQ ID NO: 1709606 - protein, 12 aa, Staphylococcus aureus
GISPIPVDDETI

SEQ ID NO: 1709607 - protein, 14 aa, Staphylococcus aureus
GITKTNSQDNIDNV

SEQ ID NO: 1709608 - protein, 7 aa, Staphylococcus aureus
GKAGQFV

SEQ ID NO: 1709609 - protein, 6 aa, Staphylococcus aureus
GKEYGI

SEQ ID NO: 1709610 - protein, 8 aa, Staphylococcus aureus
GKKAEQGV

SEQ ID NO: 1709611 - protein, 12 aa, Staphylococcus aureus
GKSEEKATLEKD

SEQ ID NO: 1709612 - protein, 4 aa, Staphylococcus aureus
GKYY

SEQ ID NO: 1709613 - protein, 35 aa, Staphylococcus aureus; identical to SEQ ID NO: 1565533

SEQ ID NO: 1709614 - protein, 9 aa, Staphylococcus aureus
GLNQQQQDL

SEQ ID NO: 1709615 - protein, 7 aa, Staphylococcus aureus
GLVNSGG

SEQ ID NO: 1709616 - protein, 7 aa, Staphylococcus aureus
GNDAYSE

SEQ ID NO: 1709617 - protein, 7 aa, Staphylococcus aureus
GNDTYSE

SEQ ID NO: 1709618 - protein, 16 aa, Staphylococcus aureus
GNFQSAPSIGGNGAFN

SEQ ID NO: 1709619 - protein, 4 aa, Staphylococcus aureus
GNGI

SEQ ID NO: 1709620 - protein, 22 aa, Staphylococcus aureus
GNNSEKEQSKSETKGSNETVKI

SEQ ID NO: 1709621 - protein, 15 aa, Staphylococcus aureus
GPEYPTMENKTLQGE

SEQ ID NO: 1709622 - protein, 17 aa, Staphylococcus aureus
GQAVSGKSTAKQTLNNP

SEQ ID NO: 1709623 - protein, 93 aa, Staphylococcus aureus
GQDSDQQKDNNKEKDDKTKTEQQDKKTNDSSKDKKDNKDDSKDVNKDNKDNSANDNQQQSNSNATNNDQNQTNNNQSSNNQANNNQKSSYVAP

SEQ ID NO: 1709624 - protein, 5 aa, Staphylococcus aureus
GQIDK

SEQ ID NO: 1709625 - protein, 68 aa, Staphylococcus aureus
GQNTEDNHKKDNNKTHEKDKKSDQTENQSNDEVAENNQNTKNQSQGESNAAKTTYETNSQNSQPITID

SEQ ID NO: 1709626 - protein, 4 aa, Staphylococcus aureus
GSEF

SEQ ID NO: 1709627 - protein, 10 aa, Staphylococcus aureus
GSKDTANIYK

SEQ ID NO: 1709628 - protein, 7 aa, Staphylococcus aureus
GSRGLRK

SEQ ID NO: 1709629 - protein, 5 aa, Staphylococcus aureus
GSVVT

SEQ ID NO: 1709630 - protein, 5 aa, Staphylococcus aureus
GTAIT

SEQ ID NO: 1709631 - protein, 25 aa, Staphylococcus aureus
GTFGYGPRPHFNKPAEKSVGTLKKE

SEQ ID NO: 1709632 - protein, 23 aa, Staphylococcus aureus
GTITSTHQTVNASEHEAKYENVT

SEQ ID NO: 1709633 - protein, 26 aa, Staphylococcus aureus
GTLTTEAHSGHAKQIQKSVNKHDKEA

SEQ ID NO: 1709634 - protein, 14 aa, Staphylococcus aureus
GVSTTTEKPVHAEK

SEQ ID NO: 1709635 - protein, 18 aa, Staphylococcus aureus
GVTKIGDGDVEKVAKEKP

SEQ ID NO: 1709636 - protein, 11 aa, Staphylococcus aureus
GVTKKNKGAYY

SEQ ID NO: 1709637 - protein, 17 aa, Staphylococcus aureus
GVTPAANAAQHDEAQQN

SEQ ID NO: 1709638 - protein, 15 aa, Staphylococcus aureus
GYAAGTGHQAHAAEV

SEQ ID NO: 1709639 - protein, 16 aa, Staphylococcus aureus
GYAAGTGHQAHAAEVN

SEQ ID NO: 1709640 - protein, 14 aa, Staphylococcus aureus
GYAASTGHEAHAAE

SEQ ID NO: 1709641 - protein, 25 aa, Staphylococcus aureus
GYTPTTVNAGTDDAVDSDGLTTTGV

SEQ ID NO: 1709642 - protein, 16 aa, Staphylococcus aureus
HADKTVQVNQNSIDAQ

SEQ ID NO: 1709643 - protein, 8 aa, Staphylococcus aureus
HAQQQALT

SEQ ID NO: 1709644 - protein, 6 aa, Staphylococcus aureus
HATDSI

SEQ ID NO: 1709645 - protein, 37 aa, Staphylococcus aureus; identical to SEQ ID NO: 1568064

SEQ ID NO: 1709646 - protein, 9 aa, Staphylococcus aureus
HDQNTVKQS

SEQ ID NO: 1709647 - protein, 114 aa, Staphylococcus aureus; identical to SEQ ID NO: 1567445

SEQ ID NO: 1709648 - protein, 123 aa, Staphylococcus aureus; identical to SEQ ID NO: 1566829

SEQ ID NO: 1709649 - protein, 36 aa, Staphylococcus aureus
HHQDSAKKESTSHKKKENDNEELNEELKEFKSKKIW

SEQ ID NO: 1709650 - protein, 11 aa, Staphylococcus aureus
HKKIKSELSKI

SEQ ID NO: 1709651 - protein, 15 aa, Staphylococcus aureus
HKTISTDKVSTNKKI

SEQ ID NO: 1709652 - protein, 67 aa, Staphylococcus aureus
HNNGSIVNQATPTSVQSSTPSAQNNNHTDGNTTATETVSNANNNDAVSNNTTLNVPNKTNENGSGGH

SEQ ID NO: 1709653 - protein, 24 aa, Staphylococcus aureus
HNSTWDPQSNSIAKYNYPNGKPEH

SEQ ID NO: 1709654 - protein, 9 aa, Staphylococcus aureus
HPKYPTNIG

SEQ ID NO: 1709655 - protein, 42 aa, Staphylococcus aureus; identical to SEQ ID NO: 1564783

SEQ ID NO: 1709656 - protein, 13 aa, Staphylococcus aureus
HRFYPTKKEQERL

SEQ ID NO: 1709657 - protein, 14 aa, Staphylococcus aureus
HRQDGAKKSKITVT

SEQ ID NO: 1709658 - protein, 10 aa, Staphylococcus aureus
HSSYPNNIGQ

SEQ ID NO: 1709659 - protein, 11 aa, Staphylococcus aureus
HSSYPNNIGQI

SEQ ID NO: 1709660 - protein, 7 aa, Staphylococcus aureus
HTIPSDI

SEQ ID NO: 1709661 - protein, 22 aa, Staphylococcus aureus
HTQSEDSRCGAGHDRKIRAEQM

SEQ ID NO: 1709662 - protein, 10 aa, Staphylococcus aureus
HVNQTTGKTE

SEQ ID NO: 1709663 - protein, 10 aa, Staphylococcus aureus
HVSETNIKAQ

SEQ ID NO: 1709664 - protein, 32 aa, Staphylococcus aureus
IADDGSTKNITKSVRDKIGTYESVGSRPQPNM

SEQ ID NO: 1709665 - protein, 30 aa, Staphylococcus aureus; identical to SEQ ID NO: 1631882

SEQ ID NO: 1709666 - protein, 4 aa, Staphylococcus aureus
IAFN

SEQ ID NO: 1709667 - protein, 11 aa, Staphylococcus aureus
IAKGADPEKVI

SEQ ID NO: 1709668 - protein, 27 aa, Staphylococcus aureus
IANKDQTKANENYIDADPTKKTAFDNA

SEQ ID NO: 1709669 - protein, 15 aa, Staphylococcus aureus
IASRPTDGGLSWSDD

SEQ ID NO: 1709670 - protein, 58 aa, Staphylococcus aureus; identical to SEQ ID NO: 1566381

SEQ ID NO: 1709671 - protein, 6 aa, Staphylococcus aureus
IDPKHG

SEQ ID NO: 1709672 - protein, 9 aa, Staphylococcus aureus
IEETDSSAI

SEQ ID NO: 1709673 - protein, 49 aa, Staphylococcus aureus; identical to SEQ ID NO: 1565540

SEQ ID NO: 1709674 - protein, 14 aa, Staphylococcus aureus
IENGGENTIEGTAN

SEQ ID NO: 1709675 - protein, 47 aa, Staphylococcus aureus
IGDQTTDDGVTRIKDQGIQTLSGDTATSVVKPNAKQAIRDKAAKQRE

SEQ ID NO: 1709676 - protein, 48 aa, Staphylococcus aureus
IGDQTTDEGVTRIKDQGIQTLSGDTATPVVKPNAKKAIRDKAAKQREI

SEQ ID NO: 1709677 - protein, 5 aa, Staphylococcus aureus
IGNEH

SEQ ID NO: 1709678 - protein, 47 aa, Staphylococcus aureus; identical to SEQ ID NO: 1570798

SEQ ID NO: 1709679 - protein, 46 aa, Staphylococcus aureus; identical to SEQ ID NO: 1566839

SEQ ID NO: 1709680 - protein, 4 aa, Staphylococcus aureus
IHNT

SEQ ID NO: 1709681 - protein, 21 aa, Staphylococcus aureus
IKAQETASSIKNTLSNLLSFW

SEQ ID NO: 1709682 - protein, 16 aa, Staphylococcus aureus
IKDAPKDGFSKGDTVK

SEQ ID NO: 1709683 - protein, 14 aa, Staphylococcus aureus
IKPGDQKVTGTTLP

SEQ ID NO: 1709684 - protein, 24 aa, Staphylococcus aureus
IKSTASSKNPVTTIENRKANGYTM

SEQ ID NO: 1709685 - protein, 21 aa, Staphylococcus aureus
IKYPSAKFNQPEAKDKTELTT

SEQ ID NO: 1709686 - protein, 15 aa, Staphylococcus aureus
INAHPNGDKANGGIY

SEQ ID NO: 1709687 - protein, 16 aa, Staphylococcus aureus
INATPDATNDEENAAI

SEQ ID NO: 1709688 - protein, 17 aa, Staphylococcus aureus
INATPGATREEKQEAID

SEQ ID NO: 1709689 - protein, 17 aa, Staphylococcus aureus
INATTGATREEKQEAIN

SEQ ID NO: 1709690 - protein, 10 aa, Staphylococcus aureus
INNADTVSDV

SEQ ID NO: 1709691 - protein, 22 aa, Staphylococcus aureus
INNGVDNSDVDDALTQGKATID

SEQ ID NO: 1709692 - protein, 19 aa, Staphylococcus aureus
INQADTNGEVDQAQQLGTK

SEQ ID NO: 1709693 - protein, 17 aa, Staphylococcus aureus
INQNQTNDQVDATTNQA

SEQ ID NO: 1709694 - protein, 16 aa, Staphylococcus aureus
INQTGNPTLDKAQVEQ

SEQ ID NO: 1709695 - protein, 17 aa, Staphylococcus aureus
INQTSNPTLDKAQVEQL

SEQ ID NO: 1709696 - protein, 12 aa, Staphylococcus aureus
IPGSHDSGSFTL

SEQ ID NO: 1709697 - protein, 50 aa, Staphylococcus aureus; identical to SEQ ID NO: 1619353

SEQ ID NO: 1709698 - protein, 31 aa, Staphylococcus aureus
IQPATTTKDDAKQAIATKANERKAAIAQTQD

SEQ ID NO: 1709699 - protein, 16 aa, Staphylococcus aureus
IQSPHSPISMSSNAKA

SEQ ID NO: 1709700 - protein, 73 aa, Staphylococcus aureus
IQTQARVKPAADTEVENAYNTRKQEIQNSNASTTEEKEAAYTQLDDKKQEARTNIDAANSNSEVATAKDNSIA

SEQ ID NO: 1709701 - protein, 62 aa, Staphylococcus aureus
ISATPAPKQEQSQTTTESTTPKTKVTTPPSTNTPQPMQSTKSDTPQSPTIKQAQTDMTPKYE

SEQ ID NO: 1709702 - protein, 61 aa, Staphylococcus aureus
ISATPAPKQEQSQTTTESTTQQTKMTTPPSTNTPQPMQSTKSDTPQSPTIKQAQTDMTPKY

SEQ ID NO: 1709703 - protein, 9 aa, Staphylococcus aureus
ISGNENETV

SEQ ID NO: 1709704 - protein, 12 aa, Staphylococcus aureus
ISGVRYNGTDLT

SEQ ID NO: 1709705 - protein, 7 aa, Staphylococcus aureus
ISGYKEE

SEQ ID NO: 1709706 - protein, 7 aa, Staphylococcus aureus
ISKDGRI

SEQ ID NO: 1709707 - protein, 6 aa, Staphylococcus aureus
ISPEFN

SEQ ID NO: 1709708 - protein, 25 aa, Staphylococcus aureus
ISYTQKSYVSEVDKQNSKSVKWGAK

SEQ ID NO: 1709709 - protein, 24 aa, Staphylococcus aureus
ITADTTIKDVAKDELATKANEQKA

SEQ ID NO: 1709710 - protein, 72 aa, Staphylococcus aureus
ITPDANVKPQAKQAIADKVQAQETAIDANNGATTEEKAAAKQQVQTEKTTADAAIDGAHSNAEVEAAKNAEI

SEQ ID NO: 1709711 - protein, 10 aa, Staphylococcus aureus
ITYGANDSVN

SEQ ID NO: 1709712 - protein, 43 aa, Staphylococcus aureus
KALKSYNDIEKDVSKNKGDKNVQSKLNQISNDIQSAHTSYKDA

SEQ ID NO: 1709713 - protein, 6 aa, Staphylococcus aureus
KALNRA

SEQ ID NO: 1709714 - protein, 12 aa, Staphylococcus aureus
KAMNKDSTVETL

SEQ ID NO: 1709715 - protein, 13 aa, Staphylococcus aureus
KAPKVNVGNLADN

SEQ ID NO: 1709716 - protein, 6 aa, Staphylococcus aureus
KASAAK

SEQ ID NO: 1709717 - protein, 13 aa, Staphylococcus aureus
KASDVKKVDIEIK

SEQ ID NO: 1709718 - protein, 20 aa, Staphylococcus aureus
KASVTMPTSQFKSNNYTYNE

SEQ ID NO: 1709719 - protein, 9 aa, Staphylococcus aureus
KAVTPNSND

SEQ ID NO: 1709720 - protein, 11 aa, Staphylococcus aureus
KDDPSQSANLL

SEQ ID NO: 1709721 - protein, 11 aa, Staphylococcus aureus
KDDPSQSANVL

SEQ ID NO: 1709722 - protein, 13 aa, Staphylococcus aureus
KDDPSQSTNVLGE

SEQ ID NO: 1709723 - protein, 8 aa, Staphylococcus aureus
KDGGPNGY

SEQ ID NO: 1709724 - protein, 15 aa, Staphylococcus aureus
KDGKAEINREIDPIS

SEQ ID NO: 1709725 - protein, 20 aa, Staphylococcus aureus
KDGTAKDVNLENAKSRYGYV

SEQ ID NO: 1709726 - protein, 8 aa, Staphylococcus aureus
KDKQHYHT

SEQ ID NO: 1709727 - protein, 8 aa, Staphylococcus aureus
KDKSNNDE

SEQ ID NO: 1709728 - protein, 7 aa, Staphylococcus aureus
KDLKGAK

SEQ ID NO: 1709729 - protein, 47 aa, Staphylococcus aureus; identical to SEQ ID NO: 1567491

SEQ ID NO: 1709730 - protein, 30 aa, Staphylococcus aureus; identical to SEQ ID NO: 1570959

SEQ ID NO: 1709731 - protein, 13 aa, Staphylococcus aureus
KDYPDNVGQINKD

SEQ ID NO: 1709732 - protein, 17 aa, Staphylococcus aureus
KEGFRDEEFDKGDKGTW

SEQ ID NO: 1709733 - protein, 9 aa, Staphylococcus aureus
KEGFRDQEF

SEQ ID NO: 1709734 - protein, 5 aa, Staphylococcus aureus
KEGND

SEQ ID NO: 1709735 - protein, 8 aa, Staphylococcus aureus
KEHTADNW

SEQ ID NO: 1709736 - protein, 4 aa, Staphylococcus aureus
KEIK

SEQ ID NO: 1709737 - protein, 15 aa, Staphylococcus aureus
KEKDEKSADVEKQTK

SEQ ID NO: 1709738 - protein, 26 aa, Staphylococcus aureus
KEKDGPTFSKKLDDSEVKKQGKQMAS

SEQ ID NO: 1709739 - protein, 12 aa, Staphylococcus aureus
KEKNPDDNSKMS

SEQ ID NO: 1709740 - protein, 12 aa, Staphylococcus aureus
KELHAKADTLDI

SEQ ID NO: 1709741 - protein, 17 aa, Staphylococcus aureus
KENVPGNDFNTTVNGDE

SEQ ID NO: 1709742 - protein, 139 aa, Staphylococcus aureus
KEQGYDNKSNQSTSNNNQSQNEKENNQTDNDSKQSRNENTKNEQNRDNIKEDNNKSNQKQNNEEQQENSNEEASQNEEREDPNQKIEQPSSEDKQNPDATQENNNQNNDENTDGSNYENEQSQDVKSKSSENDKETSNA

SEQ ID NO: 1709743 - protein, 7 aa, Staphylococcus aureus
KFNPNAK

SEQ ID NO: 1709744 - protein, 20 aa, Staphylococcus aureus
KFTDADKAKRDAYTNAVSRA

SEQ ID NO: 1709745 - protein, 6 aa, Staphylococcus aureus
KGDNEV

SEQ ID NO: 1709746 - protein, 31 aa, Staphylococcus aureus
KGDSKEAKNKISQLESKNQQLEAENEKLKKE

SEQ ID NO: 1709747 - protein, 6 aa, Staphylococcus aureus
KGHAPH

SEQ ID NO: 1709748 - protein, 19 aa, Staphylococcus aureus
KGILDKEGTKVIKGKTKFA

SEQ ID NO: 1709749 - protein, 11 aa, Staphylococcus aureus
KGRLTKSFTSN

SEQ ID NO: 1709750 - protein, 8 aa, Staphylococcus aureus
KGYDVNTN

SEQ ID NO: 1709751 - protein, 11 aa, Staphylococcus aureus
KGYQKLNGDEA

SEQ ID NO: 1709752 - protein, 12 aa, Staphylococcus aureus
KIKNDEEPIKTV

SEQ ID NO: 1709753 - protein, 12 aa, Staphylococcus aureus
KISSNAETVTSS

SEQ ID NO: 1709754 - protein, 78 aa, Staphylococcus aureus; identical to SEQ ID NO: 1568144

SEQ ID NO: 1709755 - protein, 5 aa, Staphylococcus aureus
KKATY

SEQ ID NO: 1709756 - protein, 6 aa, Staphylococcus aureus
KKDATL

SEQ ID NO: 1709757 - protein, 11 aa, Staphylococcus aureus
KKDENGRPLDN

SEQ ID NO: 1709758 - protein, 9 aa, Staphylococcus aureus
KKEVPNETN

SEQ ID NO: 1709759 - protein, 13 aa, Staphylococcus aureus
KKFDATESEAKNL

SEQ ID NO: 1709760 - protein, 12 aa, Staphylococcus aureus
KKFEATENEAKK

SEQ ID NO: 1709761 - protein, 6 aa, Staphylococcus aureus
KKGIKR

SEQ ID NO: 1709762 - protein, 20 aa, Staphylococcus aureus
KKLEDGTTKTIKMVRDQKKS

SEQ ID NO: 1709763 - protein, 37 aa, Staphylococcus aureus
KKLEEQGLLKTGDKVTIHSKDSNDPKITGTVGQDFTE

SEQ ID NO: 1709764 - protein, 14 aa, Staphylococcus aureus
KKMTVQPDVSQSDI

SEQ ID NO: 1709765 - protein, 7 aa, Staphylococcus aureus
KKNIPRD

SEQ ID NO: 1709766 - protein, 17 aa, Staphylococcus aureus
KKQAAKDEIDQLQTAQT

SEQ ID NO: 1709767 - protein, 20 aa, Staphylococcus aureus
KKSATNTKVDIAGSQVDDYG

SEQ ID NO: 1709768 - protein, 23 aa, Staphylococcus aureus
KKVSNSNHGQNVSNEYINKENPD

SEQ ID NO: 1709769 - protein, 17 aa, Staphylococcus aureus
KKYNNGDVSINENVPSY

SEQ ID NO: 1709770 - protein, 25 aa, Staphylococcus aureus
KLQKQAELQNQSAQTKGVKKETKDI

SEQ ID NO: 1709771 - protein, 14 aa, Staphylococcus aureus
KLSDQSDLMRAEVS

SEQ ID NO: 1709772 - protein, 14 aa, Staphylococcus aureus
KLSDQSDLMRAEVT

SEQ ID NO: 1709773 - protein, 24 aa, Staphylococcus aureus
KLSDTNRYVKNPRNTEIEVILEKS

SEQ ID NO: 1709774 - protein, 14 aa, Staphylococcus aureus
KLTAARNKIQQINQ

SEQ ID NO: 1709775 - protein, 24 aa, Staphylococcus aureus
KLTDTNSYVKNPRHAEIEVILEKS

SEQ ID NO: 1709776 - protein, 14 aa, Staphylococcus aureus
KMAQEQKKLKEERI

SEQ ID NO: 1709777 - protein, 8 aa, Staphylococcus aureus
KNDKGERQ

SEQ ID NO: 1709778 - protein, 16 aa, Staphylococcus aureus
KNEIREIEPVINKKAT

SEQ ID NO: 1709779 - protein, 4 aa, Staphylococcus aureus
KNGG

SEQ ID NO: 1709780 - protein, 6 aa, Staphylococcus aureus
KNGSIK

SEQ ID NO: 1709781 - protein, 14 aa, Staphylococcus aureus
KNKNYTKKSNSENV

SEQ ID NO: 1709782 - protein, 17 aa, Staphylococcus aureus
KNPKSVSEIKKEQNTSN

SEQ ID NO: 1709783 - protein, 12 aa, Staphylococcus aureus
KNPQKITVEILI

SEQ ID NO: 1709784 - protein, 14 aa, Staphylococcus aureus
KNQNISYKDLEDRV

SEQ ID NO: 1709785 - protein, 16 aa, Staphylococcus aureus
KNTKDLKDYYNGPTFS

SEQ ID NO: 1709786 - protein, 4 aa, Staphylococcus aureus
KNTR

SEQ ID NO: 1709787 - protein, 6 aa, Staphylococcus aureus
KNYDKE

SEQ ID NO: 1709788 - protein, 8 aa, Staphylococcus aureus
KNYKVTPE

SEQ ID NO: 1709789 - protein, 30 aa, Staphylococcus aureus; identical to SEQ ID NO: 1564806

SEQ ID NO: 1709790 - protein, 9 aa, Staphylococcus aureus
KPATTVKTT

SEQ ID NO: 1709791 - protein, 7 aa, Staphylococcus aureus
KPNAAKV

SEQ ID NO: 1709792 - protein, 7 aa, Staphylococcus aureus
KPNGSIH

SEQ ID NO: 1709793 - protein, 11 aa, Staphylococcus aureus
KPTNGNEKVNN

SEQ ID NO: 1709794 - protein, 9 aa, Staphylococcus aureus
KPTQMQNGD

SEQ ID NO: 1709795 - protein, 10 aa, Staphylococcus aureus
KQAPKQTVAK

SEQ ID NO: 1709796 - protein, 8 aa, Staphylococcus aureus
KQEGALNS

SEQ ID NO: 1709797 - protein, 6 aa, Staphylococcus aureus
KQELDS

SEQ ID NO: 1709798 - protein, 37 aa, Staphylococcus aureus; identical to SEQ ID NO: 1566209

SEQ ID NO: 1709799 - protein, 13 aa, Staphylococcus aureus
KQHTKSNKALNKV

SEQ ID NO: 1709800 - protein, 12 aa, Staphylococcus aureus
KQIADDKLRKEI

SEQ ID NO: 1709801 - protein, 13 aa, Staphylococcus aureus
KQNEAKKSKIKVT

SEQ ID NO: 1709802 - protein, 20 aa, Staphylococcus aureus
KQNIDDSDFNTKLDANATWK

SEQ ID NO: 1709803 - protein, 19 aa, Staphylococcus aureus
KQNTVPLGTVKTNKKEVTV

SEQ ID NO: 1709804 - protein, 7 aa, Staphylococcus aureus
KQTATSL

SEQ ID NO: 1709805 - protein, 6 aa, Staphylococcus aureus
KSDQYL

SEQ ID NO: 1709806 - protein, 26 aa, Staphylococcus aureus
KSEQGRGIPQNNSHSTKEIKGKTKFA

SEQ ID NO: 1709807 - protein, 8 aa, Staphylococcus aureus
KSKDNGKI

SEQ ID NO: 1709808 - protein, 6 aa, Staphylococcus aureus
KSMPEL

SEQ ID NO: 1709809 - protein, 13 aa, Staphylococcus aureus
KSNGFKTGKPALN

SEQ ID NO: 1709810 - protein, 21 aa, Staphylococcus aureus
KSSVTAEKAKEDSKEEQIKKS

SEQ ID NO: 1709811 - protein, 10 aa, Staphylococcus aureus
KSTAPKSLNT

SEQ ID NO: 1709812 - protein, 6 aa, Staphylococcus aureus
KSTSKS

SEQ ID NO: 1709813 - protein, 8 aa, Staphylococcus aureus
KTANETVG

SEQ ID NO: 1709814 - protein, 7 aa, Staphylococcus aureus
KTEYKDA

SEQ ID NO: 1709815 - protein, 7 aa, Staphylococcus aureus
KTNDPNI

SEQ ID NO: 1709816 - protein, 7 aa, Staphylococcus aureus
KTQSIQN

SEQ ID NO: 1709817 - protein, 10 aa, Staphylococcus aureus
KTVLNGDNNL

SEQ ID NO: 1709818 - protein, 8 aa, Staphylococcus aureus
KTVPNETS

SEQ ID NO: 1709819 - protein, 21 aa, Staphylococcus aureus
KVALDGDENLAAAKQQANNRL

SEQ ID NO: 1709820 - protein, 28 aa, Staphylococcus aureus
KVDQVNTDKAQPNYTEASTDKKEAVDQA

SEQ ID NO: 1709821 - protein, 28 aa, Staphylococcus aureus
KVNDTNQALNGNQKLADAKQDAKTTLGT

SEQ ID NO: 1709822 - protein, 29 aa, Staphylococcus aureus
KVNETRDVDTQQASINTKTNSHSNVQIIK

SEQ ID NO: 1709823 - protein, 28 aa, Staphylococcus aureus
KVSGTASSSNSASNSSRPSTNSSGGSYY

SEQ ID NO: 1709824 - protein, 6 aa, Staphylococcus aureus
KYGVDK

SEQ ID NO: 1709825 - protein, 11 aa, Staphylococcus aureus
KYTPGAEDDLA

SEQ ID NO: 1709826 - protein, 12 aa, Staphylococcus aureus
LADQAKQEEERI

SEQ ID NO: 1709827 - protein, 8 aa, Staphylococcus aureus
LAKQDDID

SEQ ID NO: 1709828 - protein, 27 aa, Staphylococcus aureus
LAPLQTAKTQLQNDINQPTSTTGMTSA

SEQ ID NO: 1709829 - protein, 13 aa, Staphylococcus aureus
LDKEIKKNKGKHK

SEQ ID NO: 1709830 - protein, 14 aa, Staphylococcus aureus
LDKVQTDKKMLPYK

SEQ ID NO: 1709831 - protein, 64 aa, Staphylococcus aureus; identical to SEQ ID NO: 1566878

SEQ ID NO: 1709832 - protein, 17 aa, Staphylococcus aureus
LENISTSNNPKINPQNV

SEQ ID NO: 1709833 - protein, 24 aa, Staphylococcus aureus
LGDTAKPTPTPTPKPSTPTTNNKL

SEQ ID NO: 1709834 - protein, 12 aa, Staphylococcus aureus
LGNGSTIIDQNT

SEQ ID NO: 1709835 - protein, 7 aa, Staphylococcus aureus
LGNGTYS

SEQ ID NO: 1709836 - protein, 6 aa, Staphylococcus aureus
LGTDSG

SEQ ID NO: 1709837 - protein, 10 aa, Staphylococcus aureus
LKNKPDKSTI

SEQ ID NO: 1709838 - protein, 14 aa, Staphylococcus aureus
LKQNKPYNTKGVIV

SEQ ID NO: 1709839 - protein, 18 aa, Staphylococcus aureus
LKSNRGVSERDLKHAKKA

SEQ ID NO: 1709840 - protein, 25 aa, Staphylococcus aureus
LKTTVTPTKVEENEAIQEDQVQYEN

SEQ ID NO: 1709841 - protein, 16 aa, Staphylococcus aureus
LKTYSKEAEEKATDEV

SEQ ID NO: 1709842 - protein, 12 aa, Staphylococcus aureus
LKYGGEVKNRND

SEQ ID NO: 1709843 - protein, 22 aa, Staphylococcus aureus
LLEKEKAYKESFKNSGLPTTLG

SEQ ID NO: 1709844 - protein, 9 aa, Staphylococcus aureus
LNADQRNGF

SEQ ID NO: 1709845 - protein, 16 aa, Staphylococcus aureus
LNAYNQKLQAARQKLT

SEQ ID NO: 1709846 - protein, 16 aa, Staphylococcus aureus
LNDRNSRHLKEAERDL

SEQ ID NO: 1709847 - protein, 6 aa, Staphylococcus aureus
LNPDDN

SEQ ID NO: 1709848 - protein, 51 aa, Staphylococcus aureus; identical to SEQ ID NO: 1568232

SEQ ID NO: 1709849 - protein, 31 aa, Staphylococcus aureus; identical to SEQ ID NO: 1566646

SEQ ID NO: 1709850 - protein, 79 aa, Staphylococcus aureus; identical to SEQ ID NO: 1565573

SEQ ID NO: 1709851 - protein, 18 aa, Staphylococcus aureus
LNRTGTTTGKKPASINAY

SEQ ID NO: 1709852 - protein, 35 aa, Staphylococcus aureus; identical to SEQ ID NO: 1566883

SEQ ID NO: 1709853 - protein, 5 aa, Staphylococcus aureus
LQEDR

SEQ ID NO: 1709854 - protein, 10 aa, Staphylococcus aureus
LQKKQEFNGV

SEQ ID NO: 1709855 - protein, 21 aa, Staphylococcus aureus
LQNEKGEVIGTTKTDENGKYR

SEQ ID NO: 1709856 - protein, 51 aa, Staphylococcus aureus
LQNKEDNSQLVTSKNNLQSSVNQVPSTAGMTQQSIDNYNAKKREAESEITA

SEQ ID NO: 1709857 - protein, 10 aa, Staphylococcus aureus
LQQRPKETLD

SEQ ID NO: 1709858 - protein, 13 aa, Staphylococcus aureus
LSDIPHHKFLEMI

SEQ ID NO: 1709859 - protein, 10 aa, Staphylococcus aureus
LSKEKVGTFD

SEQ ID NO: 1709860 - protein, 5 aa, Staphylococcus aureus
LSKNQ

SEQ ID NO: 1709861 - protein, 6 aa, Staphylococcus aureus
LSKNQA

SEQ ID NO: 1709862 - protein, 10 aa, Staphylococcus aureus
LSPINDKNDF

SEQ ID NO: 1709863 - protein, 15 aa, Staphylococcus aureus
LSRKNPNGDRFDAND

SEQ ID NO: 1709864 - protein, 15 aa, Staphylococcus aureus
LSSTGNKSVSTGNAL

SEQ ID NO: 1709865 - protein, 6 aa, Staphylococcus aureus
LTEAQA

SEQ ID NO: 1709866 - protein, 15 aa, Staphylococcus aureus
LTEEEGKQKIDNVEE

SEQ ID NO: 1709867 - protein, 10 aa, Staphylococcus aureus
LTGKENLEFN

SEQ ID NO: 1709868 - protein, 15 aa, Staphylococcus aureus
LTSDGNRSVSTGNAL

SEQ ID NO: 1709869 - protein, 6 aa, Staphylococcus aureus
LVNSGG

SEQ ID NO: 1709870 - protein, 4 aa, Staphylococcus aureus
MELN

SEQ ID NO: 1709871 - protein, 20 aa, Staphylococcus aureus
MKDNDKQGSDDNGSSKSPYH

SEQ ID NO: 1709872 - protein, 12 aa, Staphylococcus aureus
MKGIKDAPSLDK

SEQ ID NO: 1709873 - protein, 6 aa, Staphylococcus aureus
MRTATG

SEQ ID NO: 1709874 - protein, 6 aa, Staphylococcus aureus
MSTGTV

SEQ ID NO: 1709875 - protein, 9 aa, Staphylococcus aureus
NAAPNHATL

SEQ ID NO: 1709876 - protein, 19 aa, Staphylococcus aureus
NAASTTGDVTTAKDTAVQK

SEQ ID NO: 1709877 - protein, 9 aa, Staphylococcus aureus
NAATGTNDA

SEQ ID NO: 1709878 - protein, 13 aa, Staphylococcus aureus
NADATTEEKEAFT

SEQ ID NO: 1709879 - protein, 21 aa, Staphylococcus aureus
NADGTNVQWSNGAGAGANKPL

SEQ ID NO: 1709880 - protein, 8 aa, Staphylococcus aureus
NADNDAVL

SEQ ID NO: 1709881 - protein, 11 aa, Staphylococcus aureus
NADQATKDNLR

SEQ ID NO: 1709882 - protein, 17 aa, Staphylococcus aureus
NADTDKQTAYTTAVNEA

SEQ ID NO: 1709883 - protein, 20 aa, Staphylococcus aureus
NAKAPSRDLKGQNLTNGTDA

SEQ ID NO: 1709884 - protein, 34 aa, Staphylococcus aureus; identical to SEQ ID NO: 1566230

SEQ ID NO: 1709885 - protein, 5 aa, Staphylococcus aureus
NALEQ

SEQ ID NO: 1709886 - protein, 19 aa, Staphylococcus aureus
NALNGDQNLANAKDKANAF

SEQ ID NO: 1709887 - protein, 17 aa, Staphylococcus aureus
NASNKGAPYNLPTSPWN

SEQ ID NO: 1709888 - protein, 49 aa, Staphylococcus aureus
NATPDATDDEKNAAINTLNQDRQQAIESVKQANTNAEVDQAATVAENNI

SEQ ID NO: 1709889 - protein, 13 aa, Staphylococcus aureus
NATPDATEDEIQD

SEQ ID NO: 1709890 - protein, 16 aa, Staphylococcus aureus
NATPGATREEKQEAIN

SEQ ID NO: 1709891 - protein, 10 aa, Staphylococcus aureus
NAVKAGDTMT

SEQ ID NO: 1709892 - protein, 8 aa, Staphylococcus aureus
NAYHKDTE

SEQ ID NO: 1709893 - protein, 18 aa, Staphylococcus aureus
NDDGQNIADKPISKQAGH

SEQ ID NO: 1709894 - protein, 42 aa, Staphylococcus aureus
NDDQPNNPDNPDNPNNPDNPNNPNNPDNPDNGDNNNSDNPDA

SEQ ID NO: 1709895 - protein, 7 aa, Staphylococcus aureus
NDEEEAL

SEQ ID NO: 1709896 - protein, 22 aa, Staphylococcus aureus
NDIAQNKTNAEVDQTEADGNNN

SEQ ID NO: 1709897 - protein, 26 aa, Staphylococcus aureus
NDIENKKKTSSISPRAVGGNYKNSGD

SEQ ID NO: 1709898 - protein, 25 aa, Staphylococcus aureus
NDKELKEGMERARKELNYTANTNTV

SEQ ID NO: 1709899 - protein, 12 aa, Staphylococcus aureus
NDTSGNTATTSF

SEQ ID NO: 1709900 - protein, 17 aa, Staphylococcus aureus
NDVEAASDFEKIRAEVS

SEQ ID NO: 1709901 - protein, 7 aa, Staphylococcus aureus
NDVEVPS

SEQ ID NO: 1709902 - protein, 9 aa, Staphylococcus aureus
NEHANVEQT

SEQ ID NO: 1709903 - protein, 5 aa, Staphylococcus aureus
NEKGN

SEQ ID NO: 1709904 - protein, 26 aa, Staphylococcus aureus
NEQTATLDNNAINQAATTVNTTKAAL

SEQ ID NO: 1709905 - protein, 5 aa, Staphylococcus aureus
NERNT

SEQ ID NO: 1709906 - protein, 4 aa, Staphylococcus aureus
NETE

SEQ ID NO: 1709907 - protein, 5 aa, Staphylococcus aureus
NETEI

SEQ ID NO: 1709908 - protein, 16 aa, Staphylococcus aureus
NEVTQAQNNADALNTA

SEQ ID NO: 1709909 - protein, 9 aa, Staphylococcus aureus
NFVASEDKL

SEQ ID NO: 1709910 - protein, 8 aa, Staphylococcus aureus
NGKDDMSL

SEQ ID NO: 1709911 - protein, 8 aa, Staphylococcus aureus
NGKDNLSA

SEQ ID NO: 1709912 - protein, 46 aa, Staphylococcus aureus; identical to SEQ ID NO: 1571552

SEQ ID NO: 1709913 - protein, 10 aa, Staphylococcus aureus
NGNPTVQNIN

SEQ ID NO: 1709914 - protein, 9 aa, Staphylococcus aureus
NGQTNSNKQ

SEQ ID NO: 1709915 - protein, 6 aa, Staphylococcus aureus
NGREYD

SEQ ID NO: 1709916 - protein, 7 aa, Staphylococcus aureus
NGSEDLY

SEQ ID NO: 1709917 - protein, 6 aa, Staphylococcus aureus
NGTKKV

SEQ ID NO: 1709918 - protein, 9 aa, Staphylococcus aureus
NHKNQNTVT

SEQ ID NO: 1709919 - protein, 7 aa, Staphylococcus aureus
NINGENL

SEQ ID NO: 1709920 - protein, 13 aa, Staphylococcus aureus
NITDSTQTKMDAY

SEQ ID NO: 1709921 - protein, 36 aa, Staphylococcus aureus; identical to SEQ ID NO: 1568304

SEQ ID NO: 1709922 - protein, 9 aa, Staphylococcus aureus
NKALNDGDI

SEQ ID NO: 1709923 - protein, 10 aa, Staphylococcus aureus
NKDYEGSYYP

SEQ ID NO: 1709924 - protein, 16 aa, Staphylococcus aureus
NKNSGSNLDKTAVENA

SEQ ID NO: 1709925 - protein, 7 aa, Staphylococcus aureus
NKNYGTN

SEQ ID NO: 1709926 - protein, 11 aa, Staphylococcus aureus
NKQSGTNEVQA

SEQ ID NO: 1709927 - protein, 13 aa, Staphylococcus aureus
NKSTGPNTAQNAV

SEQ ID NO: 1709928 - protein, 17 aa, Staphylococcus aureus
NKTIKSKNMHIDIYLYT

SEQ ID NO: 1709929 - protein, 8 aa, Staphylococcus aureus
NKTVDSKR

SEQ ID NO: 1709930 - protein, 32 aa, Staphylococcus aureus
NKVKQTKAVKSPVRKASQAKKVVQQPVQQASK

SEQ ID NO: 1709931 - protein, 9 aa, Staphylococcus aureus
NLERSNEHE

SEQ ID NO: 1709932 - protein, 6 aa, Staphylococcus aureus
NLTDKV

SEQ ID NO: 1709933 - protein, 28 aa, Staphylococcus aureus
NMSDQPHSIAKAEKNIKEVTDATKAPYN

SEQ ID NO: 1709934 - protein, 18 aa, Staphylococcus aureus
NNAQKQQLQSQITQSSDI

SEQ ID NO: 1709935 - protein, 12 aa, Staphylococcus aureus
NNDTLGGKIQRG

SEQ ID NO: 1709936 - protein, 14 aa, Staphylococcus aureus
NNETTNEEKEKGIV

SEQ ID NO: 1709937 - protein, 7 aa, Staphylococcus aureus
NNFNSEA

SEQ ID NO: 1709938 - protein, 66 aa, Staphylococcus aureus
NNGSIVNQATPTSVQSSTPSAQNNNHTDGNTTATETVSNANNNDVASNNTTLNVPNKTNENGSGGH

SEQ ID NO: 1709939 - protein, 22 aa, Staphylococcus aureus
NNINTANTTGDVTTAKDTAVQK

SEQ ID NO: 1709940 - protein, 37 aa, Staphylococcus aureus; identical to SEQ ID NO: 1569281

SEQ ID NO: 1709941 - protein, 13 aa, Staphylococcus aureus
NNNRLANSSFQDK

SEQ ID NO: 1709942 - protein, 9 aa, Staphylococcus aureus
NNQLEEEKK

SEQ ID NO: 1709943 - protein, 10 aa, Staphylococcus aureus
NNSWSTNAQN

SEQ ID NO: 1709944 - protein, 7 aa, Staphylococcus aureus
NNYKGKK

SEQ ID NO: 1709945 - protein, 6 aa, Staphylococcus aureus
NPEDIK

SEQ ID NO: 1709946 - protein, 63 aa, Staphylococcus aureus
NPNGAQALTTDHNVQGGSNQALPGNSQNTNADTRRDNVNSSQNTPNAHATVNTSTNQALANHQ

SEQ ID NO: 1709947 - protein, 7 aa, Staphylococcus aureus
NPPHGST

SEQ ID NO: 1709948 - protein, 25 aa, Staphylococcus aureus
NPSNGYGGQPVTNSNTRANHSNSTV

SEQ ID NO: 1709949 - protein, 32 aa, Staphylococcus aureus; identical to SEQ ID NO: 1566242

SEQ ID NO: 1709950 - protein, 103 aa, Staphylococcus aureus; identical to SEQ ID NO: 1567628

SEQ ID NO: 1709951 - protein, 103 aa, Staphylococcus aureus; identical to SEQ ID NO: 1566668

SEQ ID NO: 1709952 - protein, 9 aa, Staphylococcus aureus
NQNETNVNE

SEQ ID NO: 1709953 - protein, 10 aa, Staphylococcus aureus
NQPKNTYTKQ

SEQ ID NO: 1709954 - protein, 13 aa, Staphylococcus aureus
NQTTNPMLNPDDI

SEQ ID NO: 1709955 - protein, 30 aa, Staphylococcus aureus; identical to SEQ ID NO: 1568327

SEQ ID NO: 1709956 - protein, 13 aa, Staphylococcus aureus
NQVSTTASELNTA

SEQ ID NO: 1709957 - protein, 4 aa, Staphylococcus aureus
NRNH

SEQ ID NO: 1709958 - protein, 5 aa, Staphylococcus aureus
NRPKH

SEQ ID NO: 1709959 - protein, 74 aa, Staphylococcus aureus; identical to SEQ ID NO: 1569301

SEQ ID NO: 1709960 - protein, 10 aa, Staphylococcus aureus
NSDQQLPQSN

SEQ ID NO: 1709961 - protein, 29 aa, Staphylococcus aureus
NSIQDQQQTEAGSKFINEDKPQKDAYQAA

SEQ ID NO: 1709962 - protein, 33 aa, Staphylococcus aureus; identical to SEQ ID NO: 1564663

SEQ ID NO: 1709963 - protein, 29 aa, Staphylococcus aureus
NSIQDQQQTESGSKFINEDKPQKDAYQAA

SEQ ID NO: 1709964 - protein, 33 aa, Staphylococcus aureus; identical to SEQ ID NO: 1565300

SEQ ID NO: 1709965 - protein, 14 aa, Staphylococcus aureus
NSKDIRGIAVTINQ

SEQ ID NO: 1709966 - protein, 25 aa, Staphylococcus aureus
NSNDLNQAQKDALKQQVQNATTVAG

SEQ ID NO: 1709967 - protein, 16 aa, Staphylococcus aureus
NSNSPHAKELNDLEKK

SEQ ID NO: 1709968 - protein, 16 aa, Staphylococcus aureus
NSNSPHAKKLNDLEKK

SEQ ID NO: 1709969 - protein, 10 aa, Staphylococcus aureus
NSTISTNGLT

SEQ ID NO: 1709970 - protein, 21 aa, Staphylococcus aureus
NSVKSDSSYDQNDTLSSYSDI

SEQ ID NO: 1709971 - protein, 27 aa, Staphylococcus aureus
NTGKIIKTGGAITSPDGPIKAKNGYID

SEQ ID NO: 1709972 - protein, 9 aa, Staphylococcus aureus
NTITANDNF

SEQ ID NO: 1709973 - protein, 11 aa, Staphylococcus aureus
NTKRPNYSKKD

SEQ ID NO: 1709974 - protein, 12 aa, Staphylococcus aureus
NTLNQDRQQAIE

SEQ ID NO: 1709975 - protein, 7 aa, Staphylococcus aureus
NTRKTKG

SEQ ID NO: 1709976 - protein, 35 aa, Staphylococcus aureus
NTVTEQPVHAENKSIQVSQNSKNLKAYYTQPSVEY

SEQ ID NO: 1709977 - protein, 8 aa, Staphylococcus aureus
NVEDPGYY

SEQ ID NO: 1709978 - protein, 12 aa, Staphylococcus aureus
NYSDSAKTFEIN

SEQ ID NO: 1709979 - protein, 4 aa, Staphylococcus aureus
NYTV

SEQ ID NO: 1709980 - protein, 16 aa, Staphylococcus aureus
NYVTEVESQNSKGVKW

SEQ ID NO: 1709981 - protein, 18 aa, Staphylococcus aureus
PAEATKVSPNVGQPAPKV

SEQ ID NO: 1709982 - protein, 9 aa, Staphylococcus aureus
PDSHGNAET

SEQ ID NO: 1709983 - protein, 63 aa, Staphylococcus aureus
PEAQQPIKASADNQVESIKDTPHATTDELDEANQQINDTLKQGQQDIDNTTQDAAVNDVRNQT

SEQ ID NO: 1709984 - protein, 18 aa, Staphylococcus aureus
PEGTIQGVTAEGPKYPTM

SEQ ID NO: 1709985 - protein, 5 aa, Staphylococcus aureus
PESYL

SEQ ID NO: 1709986 - protein, 15 aa, Staphylococcus aureus
PGMKGAEATVKGAYK

SEQ ID NO: 1709987 - protein, 26 aa, Staphylococcus aureus
PIKKEDKQEVSKVEKELPNTGSEEMD

SEQ ID NO: 1709988 - protein, 57 aa, Staphylococcus aureus
PKNKISTAKVDSTFSYNSGGKFDSVKGVGRTSSNSYSKTISYNQQNYDTIASGKNNN

SEQ ID NO: 1709989 - protein, 13 aa, Staphylococcus aureus
PKNQTKDIPKTVS

SEQ ID NO: 1709990 - protein, 12 aa, Staphylococcus aureus
PKNQTKSIPKTV

SEQ ID NO: 1709991 - protein, 5 aa, Staphylococcus aureus
PKRVP

SEQ ID NO: 1709992 - protein, 18 aa, Staphylococcus aureus
PKSTRTITPSFTSNGFGM

SEQ ID NO: 1709993 - protein, 5 aa, Staphylococcus aureus
PLDPS

SEQ ID NO: 1709994 - protein, 16 aa, Staphylococcus aureus
PNLNQTQKTALKDQVS

SEQ ID NO: 1709995 - protein, 345 aa, Staphylococcus aureus
PQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNLSQKDDTATADTNDTQKSVGSAANNKATQNDGANASPATVSNGSNSANQD

SEQ ID NO: 1709996 - protein, 352 aa, Staphylococcus aureus
PQNDPNANDTNSGSDNNDATANSNANATPENTGQPNVTESTDNANADTSSATTNNHNDAATGGTTATSTNNSSTDDANNKPTANNNSSVDASTDNSATGNGTTDKPAVESTNNGTTDKPATETDNATPAEGTTNNNSTTATNENAPTGSTATAPTTNASTGAASSADSKDNASVNDSKQNAEVNNGAESQSTNGKVAQPKSENKAKDEKDGRDSTNQSMVESTTKTLPSADITEPKVPSNTEKDKEESTTNQTDAGQLKSETNVASNEADKSEGNVDTDVSNKPSTSKPSEVKDKTTSTEDSQKADMATADTKDNQAAIGATADVNNKATQNDGANASPATVSNGSNSANQD

SEQ ID NO: 1709997 - protein, 39 aa, Staphylococcus aureus
PQRQQTSRRSSRIQTRSVESRAAEPRSVSSYQNADSSYY

SEQ ID NO: 1709998 - protein, 12 aa, Staphylococcus aureus
PSETPRYTHPSQ

SEQ ID NO: 1709999 - protein, 4 aa, Staphylococcus aureus
PSLQ

SEQ ID NO: 1710000 - protein, 8 aa, Staphylococcus aureus
PSSGDSVG

SEQ ID NO: 1710001 - protein, 24 aa, Staphylococcus aureus
PTGLTQTGTNTTEDDKDADGGEVD

SEQ ID NO: 1710002 - protein, 11 aa, Staphylococcus aureus
PTNEEIESNKK

SEQ ID NO: 1710003 - protein, 16 aa, Staphylococcus aureus
PTSANPNGRRPGGVQG

SEQ ID NO: 1710004 - protein, 11 aa, Staphylococcus aureus
PTSVSNDEKQR

SEQ ID NO: 1710005 - protein, 5 aa, Staphylococcus aureus
PYTGS

SEQ ID NO: 1710006 - protein, 8 aa, Staphylococcus aureus
QAATTLND

SEQ ID NO: 1710007 - protein, 4 aa, Staphylococcus aureus
QAGQ

SEQ ID NO: 1710008 - protein, 32 aa, Staphylococcus aureus; identical to SEQ ID NO: 1565152

SEQ ID NO: 1710009 - protein, 14 aa, Staphylococcus aureus
QDFPAGNGSSASDY

SEQ ID NO: 1710010 - protein, 30 aa, Staphylococcus aureus; identical to SEQ ID NO: 1565934

SEQ ID NO: 1710011 - protein, 35 aa, Staphylococcus aureus; identical to SEQ ID NO: 1565454

SEQ ID NO: 1710012 - protein, 7 aa, Staphylococcus aureus
QGQYPDT

SEQ ID NO: 1710013 - protein, 17 aa, Staphylococcus aureus
QHTKANKEVKKATNNKV

SEQ ID NO: 1710014 - protein, 8 aa, Staphylococcus aureus
QINAKNNG

SEQ ID NO: 1710015 - protein, 26 aa, Staphylococcus aureus
QITTTTADITYPAYKEADNNSIGSAF

SEQ ID NO: 1710016 - protein, 6 aa, Staphylococcus aureus
QKAPVT

SEQ ID NO: 1710017 - protein, 6 aa, Staphylococcus aureus
QKDQNH

SEQ ID NO: 1710018 - protein, 16 aa, Staphylococcus aureus
QKETELIRTNKKNVTL

SEQ ID NO: 1710019 - protein, 71 aa, Staphylococcus aureus
QKVTTSPSPNVQPQSPQPTPSVTTPPSPNVQPQSPQPTPNPTTPHSSNVETKQPQSPTTKQAQKEINPKYK

SEQ ID NO: 1710020 - protein, 90 aa, Staphylococcus aureus
QKVTTSPSTKVKATQPTPSVTTTTPPSPNVQPQSPQPTPSVTTPSSPNVQPQSPQPTPNPTTPHSSNVETKQPQSPTTKQAQKEINPKYK

SEQ ID NO: 1710021 - protein, 10 aa, Staphylococcus aureus
QLKNSDYNVE

SEQ ID NO: 1710022 - protein, 32 aa, Staphylococcus aureus
QLTTDETDAIDNVTNATTNDDVETAKNNGINT

SEQ ID NO: 1710023 - protein, 10 aa, Staphylococcus aureus
QNINPDNNSL

SEQ ID NO: 1710024 - protein, 14 aa, Staphylococcus aureus
QNSDRLANSSFQDK

SEQ ID NO: 1710025 - protein, 9 aa, Staphylococcus aureus
QPKNTYTKE

SEQ ID NO: 1710026 - protein, 11 aa, Staphylococcus aureus
QPNSTDSKNVN

SEQ ID NO: 1710027 - protein, 17 aa, Staphylococcus aureus
QPTTVAASSKDKSISKL

SEQ ID NO: 1710028 - protein, 14 aa, Staphylococcus aureus
QQTAKAENNVTKVK

SEQ ID NO: 1710029 - protein, 15 aa, Staphylococcus aureus
QQTAKAENNVTKVKD

SEQ ID NO: 1710030 - protein, 9 aa, Staphylococcus aureus
QRINPEVKK

SEQ ID NO: 1710031 - protein, 14 aa, Staphylococcus aureus
QRTSKEPSKNAQHQ

SEQ ID NO: 1710032 - protein, 31 aa, Staphylococcus aureus; identical to SEQ ID NO: 1568402

SEQ ID NO: 1710033 - protein, 13 aa, Staphylococcus aureus
QSGLYSNGLKQGQ

SEQ ID NO: 1710034 - protein, 13 aa, Staphylococcus aureus
QSIADNATTKPKL

SEQ ID NO: 1710035 - protein, 34 aa, Staphylococcus aureus; identical to SEQ ID NO: 1566092

SEQ ID NO: 1710036 - protein, 5 aa, Staphylococcus aureus
QSIDA

SEQ ID NO: 1710037 - protein, 11 aa, Staphylococcus aureus
QSVQTNGQALN

SEQ ID NO: 1710038 - protein, 7 aa, Staphylococcus aureus
QTNNQLR

SEQ ID NO: 1710039 - protein, 12 aa, Staphylococcus aureus
QTVQSNANTLDQ

SEQ ID NO: 1710040 - protein, 14 aa, Staphylococcus aureus
QVNQAKGDLNGNHN

SEQ ID NO: 1710041 - protein, 28 aa, Staphylococcus aureus
QVTDAKNSLNGEAKLATEKQNAKDAVSG

SEQ ID NO: 1710042 - protein, 13 aa, Staphylococcus aureus
QYGEKEYKDAKDK

SEQ ID NO: 1710043 - protein, 12 aa, Staphylococcus aureus
QYTPSEDTSYES

SEQ ID NO: 1710044 - protein, 83 aa, Staphylococcus aureus; identical to SEQ ID NO: 1567215

SEQ ID NO: 1710045 - protein, 15 aa, Staphylococcus aureus
RESDKNLTPYKGETV

SEQ ID NO: 1710046 - protein, 34 aa, Staphylococcus aureus; identical to SEQ ID NO: 1566264

SEQ ID NO: 1710047 - protein, 15 aa, Staphylococcus aureus
RIGTTKNVEVGQDTY

SEQ ID NO: 1710048 - protein, 9 aa, Staphylococcus aureus
RKASAREKL

SEQ ID NO: 1710049 - protein, 11 aa, Staphylococcus aureus
RKNATTDKTAY

SEQ ID NO: 1710050 - protein, 6 aa, Staphylococcus aureus
RKNEID

SEQ ID NO: 1710051 - protein, 15 aa, Staphylococcus aureus
RKNVTGYKYTEKGKD

SEQ ID NO: 1710052 - protein, 6 aa, Staphylococcus aureus
RKPYDN

SEQ ID NO: 1710053 - protein, 9 aa, Staphylococcus aureus
RLKTRKNPG

SEQ ID NO: 1710054 - protein, 13 aa, Staphylococcus aureus
RLSVTSKDTQELK

SEQ ID NO: 1710055 - protein, 17 aa, Staphylococcus aureus
RMTTTNKYNYSSYAGYT

SEQ ID NO: 1710056 - protein, 26 aa, Staphylococcus aureus
RNDSNTDHSTKPVATAPTSVAPKRVN

SEQ ID NO: 1710057 - protein, 26 aa, Staphylococcus aureus
RNDSNTDRSTKPVATAPTSVAPKRVN

SEQ ID NO: 1710058 - protein, 8 aa, Staphylococcus aureus
RNTRTVKG

SEQ ID NO: 1710059 - protein, 4 aa, Staphylococcus aureus
RPGI

SEQ ID NO: 1710060 - protein, 6 aa, Staphylococcus aureus
RQAQTF

SEQ ID NO: 1710061 - protein, 4 aa, Staphylococcus aureus
RQPA

SEQ ID NO: 1710062 - protein, 13 aa, Staphylococcus aureus
RQSADSFEGSDGE

SEQ ID NO: 1710063 - protein, 8 aa, Staphylococcus aureus
RQSNLNAG

SEQ ID NO: 1710064 - protein, 9 aa, Staphylococcus aureus
RRNNTSPWV

SEQ ID NO: 1710065 - protein, 6 aa, Staphylococcus aureus
RSLKEY

SEQ ID NO: 1710066 - protein, 7 aa, Staphylococcus aureus
RSRKIGK

SEQ ID NO: 1710067 - protein, 12 aa, Staphylococcus aureus
RYNIPTKKALNY

SEQ ID NO: 1710068 - protein, 5 aa, Staphylococcus aureus
SAFES

SEQ ID NO: 1710069 - protein, 5 aa, Staphylococcus aureus
SAKVQ

SEQ ID NO: 1710070 - protein, 18 aa, Staphylococcus aureus
SAKVQLDKEIKKNKGKHK

SEQ ID NO: 1710071 - protein, 4 aa, Staphylococcus aureus
SDES

SEQ ID NO: 1710072 - protein, 25 aa, Staphylococcus aureus
SDNTTTNEEKGKDIEPVRATYEEGL

SEQ ID NO: 1710073 - protein, 7 aa, Staphylococcus aureus
SDVPEQK

SEQ ID NO: 1710074 - protein, 14 aa, Staphylococcus aureus
SEAGATPATKAFGR

SEQ ID NO: 1710075 - protein, 20 aa, Staphylococcus aureus
SEELNEEEKKSSKRKYDDTL

SEQ ID NO: 1710076 - protein, 19 aa, Staphylococcus aureus
SESIEYSNVSGKVENYNGS

SEQ ID NO: 1710077 - protein, 5 aa, Staphylococcus aureus
SESYE

SEQ ID NO: 1710078 - protein, 15 aa, Staphylococcus aureus
SEYQTANAPKTATVT

SEQ ID NO: 1710079 - protein, 20 aa, Staphylococcus aureus
SGASKELKNVTGYRYSKGGK

SEQ ID NO: 1710080 - protein, 12 aa, Staphylococcus aureus
SGFHSSSNYNGI

SEQ ID NO: 1710081 - protein, 12 aa, Staphylococcus aureus
SGLYSNGLKQGQ

SEQ ID NO: 1710082 - protein, 15 aa, Staphylococcus aureus
SGMKGATANIDNVKK

SEQ ID NO: 1710083 - protein, 9 aa, Staphylococcus aureus
SGNKDEEVK

SEQ ID NO: 1710084 - protein, 44 aa, Staphylococcus aureus; identical to SEQ ID NO: 1567231

SEQ ID NO: 1710085 - protein, 4 aa, Staphylococcus aureus
SHDP

SEQ ID NO: 1710086 - protein, 9 aa, Staphylococcus aureus
SHKEENNSS

SEQ ID NO: 1710087 - protein, 6 aa, Staphylococcus aureus
SHYSNR

SEQ ID NO: 1710088 - protein, 34 aa, Staphylococcus aureus; identical to SEQ ID NO: 1567233

SEQ ID NO: 1710089 - protein, 16 aa, Staphylococcus aureus
SIGGITEASDKAVDQI

SEQ ID NO: 1710090 - protein, 34 aa, Staphylococcus aureus; identical to SEQ ID NO: 1566706

SEQ ID NO: 1710091 - protein, 22 aa, Staphylococcus aureus
SINNAQKEALKSQIDSATTVAG

SEQ ID NO: 1710092 - protein, 21 aa, Staphylococcus aureus
SINNAQKEALKSQIEGATTVA

SEQ ID NO: 1710093 - protein, 30 aa, Staphylococcus aureus; identical to SEQ ID NO: 1565163

SEQ ID NO: 1710094 - protein, 13 aa, Staphylococcus aureus
SKDIQNIAVTINQ

SEQ ID NO: 1710095 - protein, 13 aa, Staphylococcus aureus
SKLKEKGLLTDGQ

SEQ ID NO: 1710096 - protein, 13 aa, Staphylococcus aureus
SKNQTKDIPKTVS

SEQ ID NO: 1710097 - protein, 7 aa, Staphylococcus aureus
SKPEIYT

SEQ ID NO: 1710098 - protein, 5 aa, Staphylococcus aureus
SKQAK

SEQ ID NO: 1710099 - protein, 4 aa, Staphylococcus aureus
SLKK

SEQ ID NO: 1710100 - protein, 11 aa, Staphylococcus aureus
SLSKEKVGTFD

SEQ ID NO: 1710101 - protein, 14 aa, Staphylococcus aureus
SLTTDGQRVNNKDG

SEQ ID NO: 1710102 - protein, 8 aa, Staphylococcus aureus
SNENFTDR

SEQ ID NO: 1710103 - protein, 9 aa, Staphylococcus aureus
SNKENDLKK

SEQ ID NO: 1710104 - protein, 40 aa, Staphylococcus aureus
SNNDEKDKDTNDQKSESHMKHNDESKVPEDMKSTNEGEFK

SEQ ID NO: 1710105 - protein, 13 aa, Staphylococcus aureus
SNSIKQIDVNVKT

SEQ ID NO: 1710106 - protein, 23 aa, Staphylococcus aureus
SNSNDNQDNKKDDADNGKKQEIQ

SEQ ID NO: 1710107 - protein, 11 aa, Staphylococcus aureus
SPKNDAITDAR

SEQ ID NO: 1710108 - protein, 21 aa, Staphylococcus aureus
SPNGPSGSAREYFAPDNQLPP

SEQ ID NO: 1710109 - protein, 8 aa, Staphylococcus aureus
SQATRDHI

SEQ ID NO: 1710110 - protein, 25 aa, Staphylococcus aureus
SQEITGNEGRTKGSTNYVNADTQVK

SEQ ID NO: 1710111 - protein, 4 aa, Staphylococcus aureus
SQLN

SEQ ID NO: 1710112 - protein, 5 aa, Staphylococcus aureus
SQLNT

SEQ ID NO: 1710113 - protein, 59 aa, Staphylococcus aureus
SQVAPAPIQPSASPAQNNNNSNANSTATEPASNTNNHLASNNTTLNVPNNTNDNDSGRH

SEQ ID NO: 1710114 - protein, 9 aa, Staphylococcus aureus
SRQKGSNIK

SEQ ID NO: 1710115 - protein, 11 aa, Staphylococcus aureus
SSELTKARYAK

SEQ ID NO: 1710116 - protein, 12 aa, Staphylococcus aureus
SSEQIKNIEVNL

SEQ ID NO: 1710117 - protein, 20 aa, Staphylococcus aureus
SSVTAEKAKEDSKEEQIKKS

SEQ ID NO: 1710118 - protein, 19 aa, Staphylococcus aureus
STAQTVNASEHEAKYENVT

SEQ ID NO: 1710119 - protein, 29 aa, Staphylococcus aureus
STPAGYTPTTANVGTDDAVDSDGLTTTGV

SEQ ID NO: 1710120 - protein, 5 aa, Staphylococcus aureus
STQDY

SEQ ID NO: 1710121 - protein, 13 aa, Staphylococcus aureus
STQIDDGEETNYD

SEQ ID NO: 1710122 - protein, 18 aa, Staphylococcus aureus
STTDSGGGDGTVKPEEKL

SEQ ID NO: 1710123 - protein, 9 aa, Staphylococcus aureus
STVENPELS

SEQ ID NO: 1710124 - protein, 13 aa, Staphylococcus aureus
SVGQPEQAKGGNL

SEQ ID NO: 1710125 - protein, 4 aa, Staphylococcus aureus
SVGT

SEQ ID NO: 1710126 - protein, 4 aa, Staphylococcus aureus
SVQE

SEQ ID NO: 1710127 - protein, 12 aa, Staphylococcus aureus
SVTNTPNGANVS

SEQ ID NO: 1710128 - protein, 13 aa, Staphylococcus aureus
SVTNTPNGSNVST

SEQ ID NO: 1710129 - protein, 6 aa, Staphylococcus aureus
SYTNEL

SEQ ID NO: 1710130 - protein, 12 aa, Staphylococcus aureus
TADKETSKNVKV

SEQ ID NO: 1710131 - protein, 11 aa, Staphylococcus aureus
TAGKETSQNVT

SEQ ID NO: 1710132 - protein, 5 aa, Staphylococcus aureus
TAGSG

SEQ ID NO: 1710133 - protein, 19 aa, Staphylococcus aureus
TAQKTNLTNQINSGTTVAG

SEQ ID NO: 1710134 - protein, 20 aa, Staphylococcus aureus
TAQRNDLTNQISQATNLAGV

SEQ ID NO: 1710135 - protein, 7 aa, Staphylococcus aureus
TATNEYL

SEQ ID NO: 1710136 - protein, 12 aa, Staphylococcus aureus
TATNEYLDKSRN

SEQ ID NO: 1710137 - protein, 15 aa, Staphylococcus aureus
TDADQAKKDDYTNAV

SEQ ID NO: 1710138 - protein, 15 aa, Staphylococcus aureus
TDNVNNTTNDSQSKH

SEQ ID NO: 1710139 - protein, 11 aa, Staphylococcus aureus
TEHNGNQLDKY

SEQ ID NO: 1710140 - protein, 7 aa, Staphylococcus aureus
TEITTEE

SEQ ID NO: 1710141 - protein, 22 aa, Staphylococcus aureus
TEQGKGILDKQGTKEITGKTKF

SEQ ID NO: 1710142 - protein, 10 aa, Staphylococcus aureus
TESSAYDTKQ

SEQ ID NO: 1710143 - protein, 6 aa, Staphylococcus aureus
TEWAPK

SEQ ID NO: 1710144 - protein, 15 aa, Staphylococcus aureus
TFKYQSRPKFNTTPK

SEQ ID NO: 1710145 - protein, 4 aa, Staphylococcus aureus
TGAN

SEQ ID NO: 1710146 - protein, 11 aa, Staphylococcus aureus
TGDPRVGYKDI

SEQ ID NO: 1710147 - protein, 6 aa, Staphylococcus aureus
TGGTPF

SEQ ID NO: 1710148 - protein, 23 aa, Staphylococcus aureus
TIENESKKDRNTETKSVPEEMEA

SEQ ID NO: 1710149 - protein, 23 aa, Staphylococcus aureus
TIKVGDGKDNVAAAHDGKDIEYD

SEQ ID NO: 1710150 - protein, 5 aa, Staphylococcus aureus
TIPPE

SEQ ID NO: 1710151 - protein, 6 aa, Staphylococcus aureus
TIPVDK

SEQ ID NO: 1710152 - protein, 8 aa, Staphylococcus aureus
TKAPETVN

SEQ ID NO: 1710153 - protein, 13 aa, Staphylococcus aureus
TKDFPSNNSGVDM

SEQ ID NO: 1710154 - protein, 11 aa, Staphylococcus aureus
TKDNYTKDNTI

SEQ ID NO: 1710155 - protein, 21 aa, Staphylococcus aureus
TKDYSKESRVKEDSKYDTPIS

SEQ ID NO: 1710156 - protein, 15 aa, Staphylococcus aureus
TKLKSAMANDQGITK

SEQ ID NO: 1710157 - protein, 13 aa, Staphylococcus aureus
TKNFPSGNSGVDI

SEQ ID NO: 1710158 - protein, 9 aa, Staphylococcus aureus
TKPITDDKL

SEQ ID NO: 1710159 - protein, 12 aa, Staphylococcus aureus
TLDTTQDERDVD

SEQ ID NO: 1710160 - protein, 11 aa, Staphylococcus aureus
TLDTTQDERNV

SEQ ID NO: 1710161 - protein, 14 aa, Staphylococcus aureus
TLSDNNKYDNDKNI

SEQ ID NO: 1710162 - protein, 9 aa, Staphylococcus aureus
TNNSNMESR

SEQ ID NO: 1710163 - protein, 159 aa, Staphylococcus aureus
TNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTT

SEQ ID NO: 1710164 - protein, 40 aa, Staphylococcus aureus
TNTDDHQAKTKSAQQGKVNKPKQQAKTLPDTGMSHNDDLP

SEQ ID NO: 1710165 - protein, 40 aa, Staphylococcus aureus
TNTDKHKAKATSAQQGKENKAKQQAKTLPDTGMSHNDDLP

SEQ ID NO: 1710166 - protein, 6 aa, Staphylococcus aureus
TNVRGS

SEQ ID NO: 1710167 - protein, 26 aa, Staphylococcus aureus
TPAGYLPTKVNGTTDGEKDSNGSSIT

SEQ ID NO: 1710168 - protein, 26 aa, Staphylococcus aureus
TPAGYTPTVKNTTADDKDSNGLTTTG

SEQ ID NO: 1710169 - protein, 18 aa, Staphylococcus aureus
TPAQKTNLTNQINSGTTV

SEQ ID NO: 1710170 - protein, 13 aa, Staphylococcus aureus
TPFKDSNQNDTTL

SEQ ID NO: 1710171 - protein, 22 aa, Staphylococcus aureus
TPLANNIKEKESAKTVSPQLKQ

SEQ ID NO: 1710172 - protein, 26 aa, Staphylococcus aureus
TPRLEDKKLKKTESIPTGNNVTQLKQ

SEQ ID NO: 1710173 - protein, 46 aa, Staphylococcus aureus
TPRLEDKKVKKTESIPTGNNVTQLKQKASVTMPTSQFKSNNYTYNE

SEQ ID NO: 1710174 - protein, 8 aa, Staphylococcus aureus
TQGPTTNK

SEQ ID NO: 1710175 - protein, 7 aa, Staphylococcus aureus
TQGRSPQ

SEQ ID NO: 1710176 - protein, 4 aa, Staphylococcus aureus
TQQG

SEQ ID NO: 1710177 - protein, 51 aa, Staphylococcus aureus
TQVTSTKNALDGTHNLTQAKQTATNAIDGDTNLNKAQKDALKAQVTSAQRV

SEQ ID NO: 1710178 - protein, 10 aa, Staphylococcus aureus
TRHNNTSPWV

SEQ ID NO: 1710179 - protein, 19 aa, Staphylococcus aureus
TRKADRDTTSTKDSKFKIT

SEQ ID NO: 1710180 - protein, 15 aa, Staphylococcus aureus
TRTATTSDSQKNITQ

SEQ ID NO: 1710181 - protein, 16 aa, Staphylococcus aureus
TSEGQAVKAAEKQERV

SEQ ID NO: 1710182 - protein, 37 aa, Staphylococcus aureus
TSNAPNRNYATASTNEITSKTVSNVSRTGNNANVTAT

SEQ ID NO: 1710183 - protein, 5 aa, Staphylococcus aureus
TSNTT

SEQ ID NO: 1710184 - protein, 30 aa, Staphylococcus aureus
TSPLVNGSEKSEEINEKDLRKKSELQGTAL

SEQ ID NO: 1710185 - protein, 127 aa, Staphylococcus aureus
TSQAQATETNQPASALKQKQQNGDAQTENRESQVQNSQNSQNGQSLSAPIENEQLNNNQTNHVDASAVQSSTTEHDQPVSQNEQAKKDTTAATPTQSAKAESKHEQNESRSANKKENDNKATHVESH

SEQ ID NO: 1710186 - protein, 23 aa, Staphylococcus aureus
TSTTGLNDPDADPSVRLSPYTRQ

SEQ ID NO: 1710187 - protein, 9 aa, Staphylococcus aureus
TTAQPVKAI

SEQ ID NO: 1710188 - protein, 14 aa, Staphylococcus aureus
TTAQPVKASESSSL

SEQ ID NO: 1710189 - protein, 7 aa, Staphylococcus aureus
TTKHEVE

SEQ ID NO: 1710190 - protein, 4 aa, Staphylococcus aureus
TTLT

SEQ ID NO: 1710191 - protein, 25 aa, Staphylococcus aureus
TTMNQAKDALNGDEKLAQAKQDALA

SEQ ID NO: 1710192 - protein, 29 aa, Staphylococcus aureus
TTSTQPPKEPISFSSEAKAYNISENETNI

SEQ ID NO: 1710193 - protein, 27 aa, Staphylococcus aureus
TTTAAPSSNARSISNGYASGSNLYTSG

SEQ ID NO: 1710194 - protein, 24 aa, Staphylococcus aureus
TTTLASTADASEGYGPREKKPISI

SEQ ID NO: 1710195 - protein, 29 aa, Staphylococcus aureus
TTTSGQSNSVESTGNQTGDVFSTPSNFSK

SEQ ID NO: 1710196 - protein, 4 aa, Staphylococcus aureus
TVEP

SEQ ID NO: 1710197 - protein, 8 aa, Staphylococcus aureus
TVGNTHKT

SEQ ID NO: 1710198 - protein, 11 aa, Staphylococcus aureus
TYSNDNKTATV

SEQ ID NO: 1710199 - protein, 6 aa, Staphylococcus aureus
VAPNNK

SEQ ID NO: 1710200 - protein, 19 aa, Staphylococcus aureus
VASEDKLNKIADSSAASKI

SEQ ID NO: 1710201 - protein, 10 aa, Staphylococcus aureus
VDAQQTARAL

SEQ ID NO: 1710202 - protein, 7 aa, Staphylococcus aureus
VDDIQSK

SEQ ID NO: 1710203 - protein, 8 aa, Staphylococcus aureus
VDGGNLDA

SEQ ID NO: 1710204 - protein, 22 aa, Staphylococcus aureus
VDSEAGHVGGYTESSEESNPID

SEQ ID NO: 1710205 - protein, 17 aa, Staphylococcus aureus
VDTKKQEKDKEAKANVQ

SEQ ID NO: 1710206 - protein, 11 aa, Staphylococcus aureus
VERQNSKSVQW

SEQ ID NO: 1710207 - protein, 4 aa, Staphylococcus aureus
VGAG

SEQ ID NO: 1710208 - protein, 36 aa, Staphylococcus aureus
VGNEKAQAEAGGRPNYKTTGYSQANPISDGQRQYTL

SEQ ID NO: 1710209 - protein, 7 aa, Staphylococcus aureus
VKDESNI

SEQ ID NO: 1710210 - protein, 24 aa, Staphylococcus aureus
VKPDPPRIDGNSVTYKAGLTNQEV

SEQ ID NO: 1710211 - protein, 14 aa, Staphylococcus aureus
VKPGDTSIKGKTLP

SEQ ID NO: 1710212 - protein, 7 aa, Staphylococcus aureus
VKPGTKL

SEQ ID NO: 1710213 - protein, 36 aa, Staphylococcus aureus
VKQTPNATDEEKQAAVNQINQNQTNDQVDATTNQAI

SEQ ID NO: 1710214 - protein, 13 aa, Staphylococcus aureus
VKTAKAEENMTEG

SEQ ID NO: 1710215 - protein, 12 aa, Staphylococcus aureus
VKTGSKAKAERY

SEQ ID NO: 1710216 - protein, 24 aa, Staphylococcus aureus
VNAAKQALNGNANVQHAKDEATAL

SEQ ID NO: 1710217 - protein, 14 aa, Staphylococcus aureus
VNANESTDHGNFNG

SEQ ID NO: 1710218 - protein, 12 aa, Staphylococcus aureus
VNNAKDALNGDA

SEQ ID NO: 1710219 - protein, 11 aa, Staphylococcus aureus
VNPSEKSLTNA

SEQ ID NO: 1710220 - protein, 19 aa, Staphylococcus aureus
VNRATSAVTSNKNALNGYE

SEQ ID NO: 1710221 - protein, 32 aa, Staphylococcus aureus
VNSATSAVTTNKNALNGDEKLAQSKTDAASAI

SEQ ID NO: 1710222 - protein, 15 aa, Staphylococcus aureus
VQETIKQEGKKFQVM

SEQ ID NO: 1710223 - protein, 61 aa, Staphylococcus aureus
VQPKAANKTGNAQVNQKVDTTQVNGDTRANQSTTSNNAKPVTKTTNTTAPKTNNNVTSAGY

SEQ ID NO: 1710224 - protein, 61 aa, Staphylococcus aureus
VQPKAANKTGNAQVNQKVDTTQVNGDTRATQSTTSNNVKPVTKSTNTTAPKTNNNVTSAGY

SEQ ID NO: 1710225 - protein, 23 aa, Staphylococcus aureus
VQQTAKAENSVKQITNTNVAPYS

SEQ ID NO: 1710226 - protein, 17 aa, Staphylococcus aureus
VQSVQAKTEVKQQSEAD

SEQ ID NO: 1710227 - protein, 6 aa, Staphylococcus aureus
VRTPSN

SEQ ID NO: 1710228 - protein, 6 aa, Staphylococcus aureus
VSAHSE

SEQ ID NO: 1710229 - protein, 32 aa, Staphylococcus aureus
VSASQLDEHKRLQSDSQEISISGGENDEKKMI

SEQ ID NO: 1710230 - protein, 23 aa, Staphylococcus aureus
VSEPSKKPTTPPTYTETTTQLPM

SEQ ID NO: 1710231 - protein, 10 aa, Staphylococcus aureus
VSKDHKVGDR

SEQ ID NO: 1710232 - protein, 12 aa, Staphylococcus aureus
VSRDNNSIGSAF

SEQ ID NO: 1710233 - protein, 11 aa, Staphylococcus aureus
VSVSSESNDSV

SEQ ID NO: 1710234 - protein, 7 aa, Staphylococcus aureus
VTGAGTT

SEQ ID NO: 1710235 - protein, 9 aa, Staphylococcus aureus
VTKENGEDA

SEQ ID NO: 1710236 - protein, 27 aa, Staphylococcus aureus
VTTHANGQVSYGARPSQNKPSETNAYN

SEQ ID NO: 1710237 - protein, 81 aa, Staphylococcus aureus
VTTHANGQVSYGARPTQNKPSKTNAYNVTTHANGQVSYGARPTQKKPSKTNAYNVTTHANGQVSYGARPTYKKPSETNAYN

SEQ ID NO: 1710238 - protein, 54 aa, Staphylococcus aureus
VTTHANGQVSYGARPTYNKPSKTNAYNVTTHANGQVSYGARPTQNKPSETNAYN

SEQ ID NO: 1710239 - protein, 97 aa, Staphylococcus aureus
VTTHANGQVSYGTRPTQNKPSKTNAYNVTTHGNGQVSYGARPTQNKPSKTNAYNVTTHANGQVSYGARPTYKKPSKTNAYNVTTHADGTATYGPRVT

SEQ ID NO: 1710240 - protein, 18 aa, Staphylococcus aureus
VTTQAAKAEVTPSLKAER

SEQ ID NO: 1710241 - protein, 12 aa, Staphylococcus aureus
VTYQDGTTSTVT

SEQ ID NO: 1710242 - protein, 12 aa, Staphylococcus aureus
VVKTAKADSLTD

SEQ ID NO: 1710243 - protein, 11 aa, Staphylococcus aureus
YAEKEYKDAVD

SEQ ID NO: 1710244 - protein, 22 aa, Staphylococcus aureus
YAKINSEIKQVSEKNLDGETKM

SEQ ID NO: 1710245 - protein, 5 aa, Staphylococcus aureus
YAKKA

SEQ ID NO: 1710246 - protein, 5 aa, Staphylococcus aureus
YDDKV

SEQ ID NO: 1710247 - protein, 29 aa, Staphylococcus aureus
YDKEDKAKELNKDLENKIASMKDKTKKFN

SEQ ID NO: 1710248 - protein, 18 aa, Staphylococcus aureus
YDKEGYRDGEFKKGEKGT

SEQ ID NO: 1710249 - protein, 17 aa, Staphylococcus aureus
YDKEGYRDSEFKKGDKG

SEQ ID NO: 1710250 - protein, 43 aa, Staphylococcus aureus
YDKSNAPNNNHQNQSRTNDNHQHANQHDLNNNQYHSSLSGQYT

SEQ ID NO: 1710251 - protein, 12 aa, Staphylococcus aureus
YDKYDEKNDAMK

SEQ ID NO: 1710252 - protein, 6 aa, Staphylococcus aureus
YDVNTN

SEQ ID NO: 1710253 - protein, 9 aa, Staphylococcus aureus
YEDVTNSVT

SEQ ID NO: 1710254 - protein, 7 aa, Staphylococcus aureus
YEGNKPV

SEQ ID NO: 1710255 - protein, 11 aa, Staphylococcus aureus
YFAPDNQLPPL

SEQ ID NO: 1710256 - protein, 12 aa, Staphylococcus aureus
YGEKEYKDAKDK

SEQ ID NO: 1710257 - protein, 6 aa, Staphylococcus aureus
YGSGYT

SEQ ID NO: 1710258 - protein, 10 aa, Staphylococcus aureus
YGSNVTPAEI

SEQ ID NO: 1710259 - protein, 37 aa, Staphylococcus aureus
YGYKTGGDFSINQGGLTGNITKESNYSETISYQQPSY

SEQ ID NO: 1710260 - protein, 6 aa, Staphylococcus aureus
YHGDYN

SEQ ID NO: 1710261 - protein, 9 aa, Staphylococcus aureus
YINNEDLSR

SEQ ID NO: 1710262 - protein, 10 aa, Staphylococcus aureus
YINNEDLSRN

SEQ ID NO: 1710263 - protein, 9 aa, Staphylococcus aureus
YKDKSGTVI

SEQ ID NO: 1710264 - protein, 10 aa, Staphylococcus aureus
YKTTTKDNYI

SEQ ID NO: 1710265 - protein, 14 aa, Staphylococcus aureus
YKVPNQQLKQENGH

SEQ ID NO: 1710266 - protein, 8 aa, Staphylococcus aureus
YNEKTGVW

SEQ ID NO: 1710267 - protein, 7 aa, Staphylococcus aureus
YNEVKTE

SEQ ID NO: 1710268 - protein, 9 aa, Staphylococcus aureus
YNIPTNKDP

SEQ ID NO: 1710269 - protein, 22 aa, Staphylococcus aureus
YNRNESRGAHYKPEFPERNDEE

SEQ ID NO: 1710270 - protein, 6 aa, Staphylococcus aureus
YNSTTD

SEQ ID NO: 1710271 - protein, 6 aa, Staphylococcus aureus
YNTGNK

SEQ ID NO: 1710272 - protein, 60 aa, Staphylococcus aureus
YNYNNYNNGYSYNNYSRYNNYSNNNQSYNYNNYNSYNTNSYRTGGLGASYSTSSNNVQVT

SEQ ID NO: 1710273 - protein, 13 aa, Staphylococcus aureus
YPDNTSTDNGKID

SEQ ID NO: 1710274 - protein, 5 aa, Staphylococcus aureus
YPIES

SEQ ID NO: 1710275 - protein, 7 aa, Staphylococcus aureus
YPKPYKN

SEQ ID NO: 1710276 - protein, 6 aa, Staphylococcus aureus
YPQPHK

SEQ ID NO: 1710277 - protein, 8 aa, Staphylococcus aureus
YQGTSKYG

SEQ ID NO: 1710278 - protein, 19 aa, Staphylococcus aureus
YRDAGTGIREYNDGTFGYE

SEQ ID NO: 1710279 - protein, 12 aa, Staphylococcus aureus
YTKFADGAKMKD

SEQ ID NO: 1710280 - protein, 8 aa, Staphylococcus aureus
YTYGGDNR

SEQ ID NO: 1710281 - protein, 101 aa, Staphylococcus aureus; identical to SEQ ID NO: 1563176

SEQ ID NO: 1710282 - protein, 135 aa, Staphylococcus aureus
YYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDS

SEQ ID NO: 1710283 - protein, 14 aa, Staphylococcus aureus
AADAPAAGTDITNQ

SEQ ID NO: 1710284 - protein, 22 aa, Staphylococcus aureus
AAESITDPTNGSNANKDAVDQA

SEQ ID NO: 1710285 - protein, 16 aa, Staphylococcus aureus
AAHAQQQGTQVKTPVQ

SEQ ID NO: 1710286 - protein, 6 aa, Staphylococcus aureus
AAKGHT

SEQ ID NO: 1710287 - protein, 12 aa, Staphylococcus aureus
AANGQTTGFSNV

SEQ ID NO: 1710288 - protein, 25 aa, Staphylococcus aureus
AAQKYTDADREKQAAYNDAVSAAKT

SEQ ID NO: 1710289 - protein, 6 aa, Staphylococcus aureus
AAWTSY

SEQ ID NO: 1710290 - protein, 11 aa, Staphylococcus aureus
ADAAENYTNYN

SEQ ID NO: 1710291 - protein, 13 aa, Staphylococcus aureus
ADAKNKSEVPNHM

SEQ ID NO: 1710292 - protein, 5 aa, Staphylococcus aureus
ADEKG

SEQ ID NO: 1710293 - protein, 33 aa, Staphylococcus aureus
ADHSTGGLTIGKDKGYEWNPQSIKSMKHSGSYM

SEQ ID NO: 1710294 - protein, 22 aa, Staphylococcus aureus
ADIDNAAANNDVDNAKTTNEAT

SEQ ID NO: 1710295 - protein, 32 aa, Staphylococcus aureus; identical to SEQ ID NO: 1634291

SEQ ID NO: 1710296 - protein, 14 aa, Staphylococcus aureus
ADKHTKDSHNHGTA

SEQ ID NO: 1710297 - protein, 18 aa, Staphylococcus aureus
ADKSTRQALVQSVKDAKK

SEQ ID NO: 1710298 - protein, 29 aa, Staphylococcus aureus
ADKTTTLASSKYVNADSNKQNAYTTKVTN

SEQ ID NO: 1710299 - protein, 7 aa, Staphylococcus aureus
ADNDAIL

SEQ ID NO: 1710300 - protein, 11 aa, Staphylococcus aureus
ADNKSETTNLT

SEQ ID NO: 1710301 - protein, 13 aa, Staphylococcus aureus
ADNTKEKNPLQGK

SEQ ID NO: 1710302 - protein, 26 aa, Staphylococcus aureus
ADQKKNNISADTIATQDEKQQAIKQV

SEQ ID NO: 1710303 - protein, 48 aa, Staphylococcus aureus
ADTEEAKTNTAKRSKRSLNTQNYKSASQEVTAEQKAEYERKAEERKEK

SEQ ID NO: 1710304 - protein, 6 aa, Staphylococcus aureus
AEEHDY

SEQ ID NO: 1710305 - protein, 5 aa, Staphylococcus aureus
AEHNQ

SEQ ID NO: 1710306 - protein, 47 aa, Staphylococcus aureus; identical to SEQ ID NO: 1569744

SEQ ID NO: 1710307 - protein, 47 aa, Staphylococcus aureus; identical to SEQ ID NO: 1634340

SEQ ID NO: 1710308 - protein, 48 aa, Staphylococcus aureus
AEKDTTKRSVNYTDADHPKQQAYDTAVTQAEGITNANGSNADEAQVQT

SEQ ID NO: 1710309 - protein, 9 aa, Staphylococcus aureus
AEKKNLDNK

SEQ ID NO: 1710310 - protein, 10 aa, Staphylococcus aureus
AEKKNLDNKE

SEQ ID NO: 1710311 - protein, 24 aa, Staphylococcus aureus
AELDTKAQEKVTAAQQSKKVTQDE

SEQ ID NO: 1710312 - protein, 7 aa, Staphylococcus aureus
AELEGGQ

SEQ ID NO: 1710313 - protein, 13 aa, Staphylococcus aureus
AENIHPNNRQRGL

SEQ ID NO: 1710314 - protein, 17 aa, Staphylococcus aureus
AEPVAPKKAVAQPKTAV

SEQ ID NO: 1710315 - protein, 14 aa, Staphylococcus aureus
AESQPDPKPDELHK

SEQ ID NO: 1710316 - protein, 13 aa, Staphylococcus aureus
AESQPDPTPDELH

SEQ ID NO: 1710317 - protein, 7 aa, Staphylococcus aureus
AESQTVH

SEQ ID NO: 1710318 - protein, 4 aa, Staphylococcus aureus
AETI

SEQ ID NO: 1710319 - protein, 9 aa, Staphylococcus aureus
AEYNQGPAF

SEQ ID NO: 1710320 - protein, 11 aa, Staphylococcus aureus
AFHPKNRNFKD

SEQ ID NO: 1710321 - protein, 12 aa, Staphylococcus aureus
AFTTTNNPIREG

SEQ ID NO: 1710322 - protein, 66 aa, Staphylococcus aureus
AGADYTTSYNQGSNVQSVSYNAQSSNSNVEAVSAPTYHNYSTSTTSSSVRLSNGNTAGATGSSAAQ

SEQ ID NO: 1710323 - protein, 9 aa, Staphylococcus aureus
AGAKAGDRI

SEQ ID NO: 1710324 - protein, 114 aa, Staphylococcus aureus
AGANSATTQAANTRQERTPKLEKAPNTNEEKTSASKIEKISQPKQEEQKSLNISATPAPKQEQSQTTTESTTPKTKVTTPPSTNTPQPMQSTKSDTPQSPTIKQAQTDMTPKYE

SEQ ID NO: 1710325 - protein, 10 aa, Staphylococcus aureus
AGATRIGASA

SEQ ID NO: 1710326 - protein, 8 aa, Staphylococcus aureus
AGDTPLDD

SEQ ID NO: 1710327 - protein, 13 aa, Staphylococcus aureus
AGEMKTKPTQHSV

SEQ ID NO: 1710328 - protein, 7 aa, Staphylococcus aureus
AGEQATF

SEQ ID NO: 1710329 - protein, 23 aa, Staphylococcus aureus
AGESHAQTKNAETVKKYNEYQTK

SEQ ID NO: 1710330 - protein, 23 aa, Staphylococcus aureus
AGESHAQTKNAETVKKYNEYQTN

SEQ ID NO: 1710331 - protein, 11 aa, Staphylococcus aureus
AGGAVTGGTTL

SEQ ID NO: 1710332 - protein, 5 aa, Staphylococcus aureus
AGGEN

SEQ ID NO: 1710333 - protein, 7 aa, Staphylococcus aureus
AGKGEAV

SEQ ID NO: 1710334 - protein, 9 aa, Staphylococcus aureus
AGQTPVGRT

SEQ ID NO: 1710335 - protein, 26 aa, Staphylococcus aureus
AGSPTVDQINTNTSVANQAKSDLDHA

SEQ ID NO: 1710336 - protein, 26 aa, Staphylococcus aureus
AGSPTVEQINTNTSAANQAKSDLDHA

SEQ ID NO: 1710337 - protein, 18 aa, Staphylococcus aureus
AGYHKNSDGIFEKDGKSL

SEQ ID NO: 1710338 - protein, 26 aa, Staphylococcus aureus
AHADTTSMNVSNKQSQNVQNHRPYGG

SEQ ID NO: 1710339 - protein, 14 aa, Staphylococcus aureus
AHASNSLSKSPENW

SEQ ID NO: 1710340 - protein, 16 aa, Staphylococcus aureus
AHATTPNMGQGAGQAM

SEQ ID NO: 1710341 - protein, 11 aa, Staphylococcus aureus
AHGQNMTKAQV

SEQ ID NO: 1710342 - protein, 10 aa, Staphylococcus aureus
AIADKDATKA

SEQ ID NO: 1710343 - protein, 6 aa, Staphylococcus aureus
AIKEDK

SEQ ID NO: 1710344 - protein, 15 aa, Staphylococcus aureus
AINGASDLNQHQKDA

SEQ ID NO: 1710345 - protein, 42 aa, Staphylococcus aureus
AINGASDLNQHQKDTLKAQANGAQRVSNAQDVQRNTTELNTA

SEQ ID NO: 1710346 - protein, 42 aa, Staphylococcus aureus; identical to SEQ ID NO: 1567831

SEQ ID NO: 1710347 - protein, 9 aa, Staphylococcus aureus
AINGNEITF

SEQ ID NO: 1710348 - protein, 12 aa, Staphylococcus aureus
AINKTQNSGCEN

SEQ ID NO: 1710349 - protein, 14 aa, Staphylococcus aureus
AKAALKKNDFKSMA

SEQ ID NO: 1710350 - protein, 15 aa, Staphylococcus aureus
AKAANDTEEIGKGSD

SEQ ID NO: 1710351 - protein, 13 aa, Staphylococcus aureus
AKAMNKDSTVETL

SEQ ID NO: 1710352 - protein, 15 aa, Staphylococcus aureus
AKASEVNENMKKQNH

SEQ ID NO: 1710353 - protein, 20 aa, Staphylococcus aureus
AKDNLHGDQKLADDKQHAVT

SEQ ID NO: 1710354 - protein, 8 aa, Staphylococcus aureus
AKDPVRIT

SEQ ID NO: 1710355 - protein, 9 aa, Staphylococcus aureus
AKGIKNAGQ

SEQ ID NO: 1710356 - protein, 7 aa, Staphylococcus aureus
AKKATYT

SEQ ID NO: 1710357 - protein, 6 aa, Staphylococcus aureus
AKKHNV

SEQ ID NO: 1710358 - protein, 9 aa, Staphylococcus aureus
AKMDSNKDN

SEQ ID NO: 1710359 - protein, 9 aa, Staphylococcus aureus
AKNKAEELA

SEQ ID NO: 1710360 - protein, 8 aa, Staphylococcus aureus
AKNKDNPV

SEQ ID NO: 1710361 - protein, 20 aa, Staphylococcus aureus
AKPTPTPTPKPSTPTTNNKL

SEQ ID NO: 1710362 - protein, 5 aa, Staphylococcus aureus
AKSND

SEQ ID NO: 1710363 - protein, 12 aa, Staphylococcus aureus
AKSNKPDELDDE

SEQ ID NO: 1710364 - protein, 12 aa, Staphylococcus aureus
AKSNKPGELNDE

SEQ ID NO: 1710365 - protein, 11 aa, Staphylococcus aureus
AKSNKPGELSN

SEQ ID NO: 1710366 - protein, 7 aa, Staphylococcus aureus
AKSSISM

SEQ ID NO: 1710367 - protein, 10 aa, Staphylococcus aureus
AKTNGKHDIE

SEQ ID NO: 1710368 - protein, 14 aa, Staphylococcus aureus
AKTNIDQSSTDDYV

SEQ ID NO: 1710369 - protein, 11 aa, Staphylococcus aureus
AKVKNYKVTPE

SEQ ID NO: 1710370 - protein, 35 aa, Staphylococcus aureus
AKYFGKSNGNLDKKFKKDGYDLATNSKELSKYDKD

SEQ ID NO: 1710371 - protein, 36 aa, Staphylococcus aureus
AKYLGKSNGNLDKKFKKDGYDLATNSKELSKSDKDK

SEQ ID NO: 1710372 - protein, 17 aa, Staphylococcus aureus
ALNQAKQNLTADTHELE

SEQ ID NO: 1710373 - protein, 16 aa, Staphylococcus aureus
ALNQAKQNLTTDTHTL

SEQ ID NO: 1710374 - protein, 5 aa, Staphylococcus aureus
ALPNG

SEQ ID NO: 1710375 - protein, 12 aa, Staphylococcus aureus
ALQGEVDRRIQQ

SEQ ID NO: 1710376 - protein, 15 aa, Staphylococcus aureus
ALSAARQGARKETLE

SEQ ID NO: 1710377 - protein, 5 aa, Staphylococcus aureus
ALSKD

SEQ ID NO: 1710378 - protein, 6 aa, Staphylococcus aureus
ALSNEY

SEQ ID NO: 1710379 - protein, 9 aa, Staphylococcus aureus
ALSTSESQI

SEQ ID NO: 1710380 - protein, 5 aa, Staphylococcus aureus
ALTQQ

SEQ ID NO: 1710381 - protein, 4 aa, Staphylococcus aureus
ALYE

SEQ ID NO: 1710382 - protein, 12 aa, Staphylococcus aureus
AMDESTKAKYKK

SEQ ID NO: 1710383 - protein, 12 aa, Staphylococcus aureus
AMDESTKAKYKQ

SEQ ID NO: 1710384 - protein, 66 aa, Staphylococcus aureus
ANEVKESGGPASGGSNYGNSNPELKKRVQETIKQEGKKISSDAVTASGSGLDPDITVDNAKQQVKR

SEQ ID NO: 1710385 - protein, 13 aa, Staphylococcus aureus
ANGQNAQIKDTFN

SEQ ID NO: 1710386 - protein, 16 aa, Staphylococcus aureus
ANHVETANRASQTDID

SEQ ID NO: 1710387 - protein, 11 aa, Staphylococcus aureus
ANKKQETTANI

SEQ ID NO: 1710388 - protein, 20 aa, Staphylococcus aureus
ANNSTLNVPNNINDNDSERH

SEQ ID NO: 1710389 - protein, 43 aa, Staphylococcus aureus
ANPVKKPAGKTALDQAAADRKTQIEQTPNASQQEINDAKQEVD

SEQ ID NO: 1710390 - protein, 44 aa, Staphylococcus aureus
ANPVKKPSGKTALDQAAADKKTQIEQTPNASQQEINDAKQEVDT

SEQ ID NO: 1710391 - protein, 41 aa, Staphylococcus aureus
ANQHKENSSKSNDINKKTQQTDNTTQSNTEKQMTPQEAEDI

SEQ ID NO: 1710392 - protein, 41 aa, Staphylococcus aureus
ANQHKENSSKSNDTNKKTQQTDNTTQSNTEKQMTPQEAEEI

SEQ ID NO: 1710393 - protein, 5 aa, Staphylococcus aureus
ANQTL

SEQ ID NO: 1710394 - protein, 24 aa, Staphylococcus aureus
ANTDIDNAAANTDVDNAKTTNEAT

SEQ ID NO: 1710395 - protein, 64 aa, Staphylococcus aureus
ANTEANSANKDSQDQTKKEHVDKAQQKEKRNVNDKDKNTPGSDDIGKNGKVTKRTVSEYDKETN

SEQ ID NO: 1710396 - protein, 18 aa, Staphylococcus aureus
ANTNAEVDQAATVAENNI

SEQ ID NO: 1710397 - protein, 15 aa, Staphylococcus aureus
ANTNAEVEQVKTNAI

SEQ ID NO: 1710398 - protein, 16 aa, Staphylococcus aureus
ANTNANVEQVKTNAIQ

SEQ ID NO: 1710399 - protein, 9 aa, Staphylococcus aureus
APDRNRVDG

SEQ ID NO: 1710400 - protein, 61 aa, Staphylococcus aureus
APKEEKETNIKNANKLKSDTEAAKNDEAKRSLNTHNHKSVSQEVSEQQKADYERKAEERKA

SEQ ID NO: 1710401 - protein, 10 aa, Staphylococcus aureus
APKNQNEEFQ

SEQ ID NO: 1710402 - protein, 16 aa, Staphylococcus aureus
APLATVSKGSNSANQD

SEQ ID NO: 1710403 - protein, 4 aa, Staphylococcus aureus
APSI

SEQ ID NO: 1710404 - protein, 23 aa, Staphylococcus aureus
APWGTQSTTTPTTPSKPSTGKLT

SEQ ID NO: 1710405 - protein, 29 aa, Staphylococcus aureus
APWGTQSTTTPTTPSKPSTPSTPSTGKLT

SEQ ID NO: 1710406 - protein, 47 aa, Staphylococcus aureus
APWGTQSTTTPTTPSKPSTPSTPSTGKLTVATNNGVAQIKPTNSGLY

SEQ ID NO: 1710407 - protein, 47 aa, Staphylococcus aureus
APWGTQSTTTPTTPSKPTTPSKPSTGKLTVTANNGVAQIKPTNSGLY

SEQ ID NO: 1710408 - protein, 24 aa, Staphylococcus aureus
APYTPTTDPNNNNIGQNAPNEALS

SEQ ID NO: 1710409 - protein, 22 aa, Staphylococcus aureus
APYTPTTDPNNNNIGQNAPNEV

SEQ ID NO: 1710410 - protein, 10 aa, Staphylococcus aureus
AQAAETTDGQ

SEQ ID NO: 1710411 - protein, 13 aa, Staphylococcus aureus
AQAKTNATNTINN

SEQ ID NO: 1710412 - protein, 8 aa, Staphylococcus aureus
AQANRNEG

SEQ ID NO: 1710413 - protein, 8 aa, Staphylococcus aureus
AQDRHTSA

SEQ ID NO: 1710414 - protein, 18 aa, Staphylococcus aureus
AQDYKKSGFKMNDRKQSV

SEQ ID NO: 1710415 - protein, 6 aa, Staphylococcus aureus
AQGDIG

SEQ ID NO: 1710416 - protein, 48 aa, Staphylococcus aureus
AQKDAEKKVAPKVEAPQIQSPQIEKPKVESPKVEVPQIQSPKVEVPQS

SEQ ID NO: 1710417 - protein, 10 aa, Staphylococcus aureus
AQKNDQEAYE

SEQ ID NO: 1710418 - protein, 17 aa, Staphylococcus aureus
AQPRTVSESKPRVTRSA

SEQ ID NO: 1710419 - protein, 7 aa, Staphylococcus aureus
AQQQTLT

SEQ ID NO: 1710420 - protein, 37 aa, Staphylococcus aureus
AQTADATTEEKEQANQQVDAQLTQGNQNIENAHSQSM

SEQ ID NO: 1710421 - protein, 46 aa, Staphylococcus aureus
AQTADATTEEKEQANQQVDAQLTQGNQNIENAQSIDDVNTAKENAI

SEQ ID NO: 1710422 - protein, 46 aa, Staphylococcus aureus
AQTADATTEEKEQENQQVDAQLTQGNQNIENAQSIDDVNTAKDNAI

SEQ ID NO: 1710423 - protein, 16 aa, Staphylococcus aureus
AQTTNDVTQIKDQAVA

SEQ ID NO: 1710424 - protein, 14 aa, Staphylococcus aureus
ARDELATKANEQKA

SEQ ID NO: 1710425 - protein, 20 aa, Staphylococcus aureus
ARPQFNKPAAKTEATIKKEQ

SEQ ID NO: 1710426 - protein, 34 aa, Staphylococcus aureus
ARPRFNKPSETNAYNVTTNQDGTVSYGARPTQNK

SEQ ID NO: 1710427 - protein, 96 aa, Staphylococcus aureus
ARPRFNKPSETNAYNVTTNQDGTVSYGARPTQNKPSKTNAYNVTTHANGQVSYGARPTQNKPSKTNEYNVTTHANGQVSYGARPTYKKPSETNAYN

SEQ ID NO: 1710428 - protein, 139 aa, Staphylococcus aureus
ARPRFNKPSETNAYNVTTNQDGTVSYGARPTQNKPSKTNAYNVTTHANGQVSYGARPTYNKPSETNAYNVTTNRDGTVSYGARPTQNKPSETNAYNVTTHGNGQVSYGARPTYNKPSKTNAYNVTTHADGTATYGPRVT

SEQ ID NO: 1710429 - protein, 41 aa, Staphylococcus aureus
ARPRFNKPSETNAYNVTTNQDGTVSYGARPTQNNQAKQTHI

SEQ ID NO: 1710430 - protein, 123 aa, Staphylococcus aureus
ARPRFNKPSETNAYNVTTNQDGTVTYGARPTQNKPSKTNAYNVTTHANGQVSYGARPTQNKPSKTNAYNVTTHANGQVSYGARPTQNKPSKTNAYNVTTHANGQVSYGARPTYKKPSETNAYN

SEQ ID NO: 1710431 - protein, 139 aa, Staphylococcus aureus
ARPRFNKPSETNAYNVTTNQDGTVTYGARPTQNKPSKTNAYNVTTHANRQVSYGARPTQNKPSKTNAYNVTTHANGQVSYGARPTQNKPSKTNAYNVTTHANGQVSYGARPTYKKPSKTNAYNVTTHADGTATYGPRVT

SEQ ID NO: 1710432 - protein, 69 aa, Staphylococcus aureus
ARPRFNKPSETNAYNVTTNQDGTVTYGARPTQNKPSKTNAYNVTTNQDGTVTYGARPTYKKPSETNAYN

SEQ ID NO: 1710433 - protein, 42 aa, Staphylococcus aureus
ARPRFNKPSKTNAYNVTTNQDGTVSYGARPTQNKPSETNAYN

SEQ ID NO: 1710434 - protein, 7 aa, Staphylococcus aureus
ASAKDDV

SEQ ID NO: 1710435 - protein, 9 aa, Staphylococcus aureus
ASANSSGEI

SEQ ID NO: 1710436 - protein, 15 aa, Staphylococcus aureus
ASDKNKYKDVTNEMQ

SEQ ID NO: 1710437 - protein, 15 aa, Staphylococcus aureus
ASDLSDNGNVQHDRN

SEQ ID NO: 1710438 - protein, 11 aa, Staphylococcus aureus
ASGGSAFNNTY

SEQ ID NO: 1710439 - protein, 23 aa, Staphylococcus aureus
ASGNYTNASPDKQGAYTDAYNAA

SEQ ID NO: 1710440 - protein, 14 aa, Staphylococcus aureus
ASIDSGSNNQYQKD

SEQ ID NO: 1710441 - protein, 6 aa, Staphylococcus aureus
ASKKDF

SEQ ID NO: 1710442 - protein, 4 aa, Staphylococcus aureus
ASKY

SEQ ID NO: 1710443 - protein, 9 aa, Staphylococcus aureus
ASNIDTSKG

SEQ ID NO: 1710444 - protein, 13 aa, Staphylococcus aureus
ASPKVGQPAPKVC

SEQ ID NO: 1710445 - protein, 9 aa, Staphylococcus aureus
ASRRAQTLS

SEQ ID NO: 1710446 - protein, 5 aa, Staphylococcus aureus
ASSIP

SEQ ID NO: 1710447 - protein, 37 aa, Staphylococcus aureus
ASVKPKANQAIEAKAEETKESIDQSDQLTAEEKTEAL

SEQ ID NO: 1710448 - protein, 16 aa, Staphylococcus aureus
ASVTQQLEDYRSNDKY

SEQ ID NO: 1710449 - protein, 21 aa, Staphylococcus aureus
ATAKKQEINQNTNATDEEKQV

SEQ ID NO: 1710450 - protein, 14 aa, Staphylococcus aureus
ATDDQCVPSSKGVI

SEQ ID NO: 1710451 - protein, 9 aa, Staphylococcus aureus
ATENGDNIQ

SEQ ID NO: 1710452 - protein, 10 aa, Staphylococcus aureus
ATERASIKHS

SEQ ID NO: 1710453 - protein, 12 aa, Staphylococcus aureus
ATFETKINNGNL

SEQ ID NO: 1710454 - protein, 71 aa, Staphylococcus aureus
ATGANGADMSAQAPATNNVAPSAVQANQVQSQEVEAPQNAQTQQPQASTSNNSQVTATPTESKASEGSSVN

SEQ ID NO: 1710455 - protein, 4 aa, Staphylococcus aureus
ATGI

SEQ ID NO: 1710456 - protein, 71 aa, Staphylococcus aureus
ATGTNGADMSAQAPTTNNVAPSAVQANQVQSQEVEAPQNAQTQQPQASTSNNSQVTATPTESKSSEGSSVN

SEQ ID NO: 1710457 - protein, 7 aa, Staphylococcus aureus
ATHPNSK

SEQ ID NO: 1710458 - protein, 14 aa, Staphylococcus aureus
ATIEGNKADASSLD

SEQ ID NO: 1710459 - protein, 5 aa, Staphylococcus aureus
ATIQK

SEQ ID NO: 1710460 - protein, 9 aa, Staphylococcus aureus
ATKASSFKP

SEQ ID NO: 1710461 - protein, 5 aa, Staphylococcus aureus
ATKRR

SEQ ID NO: 1710462 - protein, 8 aa, Staphylococcus aureus
ATLSGQYL

SEQ ID NO: 1710463 - protein, 20 aa, Staphylococcus aureus
ATMGKSPHQNDRLTLKLNKN

SEQ ID NO: 1710464 - protein, 6 aa, Staphylococcus aureus
ATPAGS

SEQ ID NO: 1710465 - protein, 6 aa, Staphylococcus aureus
ATQNIA

SEQ ID NO: 1710466 - protein, 8 aa, Staphylococcus aureus
ATQQGFKK

SEQ ID NO: 1710467 - protein, 20 aa, Staphylococcus aureus
ATQVKTDARNTVNEKAREAI

SEQ ID NO: 1710468 - protein, 4 aa, Staphylococcus aureus
ATSD

SEQ ID NO: 1710469 - protein, 43 aa, Staphylococcus aureus
ATSQPTLDPSAVTQAANQVSTNKTALNGAQNLANKKQETTANI

SEQ ID NO: 1710470 - protein, 4 aa, Staphylococcus aureus
ATSS

SEQ ID NO: 1710471 - protein, 8 aa, Staphylococcus aureus
ATVEERNS

SEQ ID NO: 1710472 - protein, 9 aa, Staphylococcus aureus
ATVENPELS

SEQ ID NO: 1710473 - protein, 12 aa, Staphylococcus aureus
ATVKPKANQAIE

SEQ ID NO: 1710474 - protein, 7 aa, Staphylococcus aureus
ATYEEGL

SEQ ID NO: 1710475 - protein, 12 aa, Staphylococcus aureus
ATYQDGTTSTVT

SEQ ID NO: 1710476 - protein, 53 aa, Staphylococcus aureus
AVAPKAATTTAPKAKTEATPKVTTFSASAQPRSVAATPKTSLPKYKPQVNSSI

SEQ ID NO: 1710477 - protein, 35 aa, Staphylococcus aureus
AVATLPNKGTKELTAKAKGDQMNKVAKQGQYKNQD

SEQ ID NO: 1710478 - protein, 10 aa, Staphylococcus aureus
AVEGQDNQLL

SEQ ID NO: 1710479 - protein, 6 aa, Staphylococcus aureus
AVGHGY

SEQ ID NO: 1710480 - protein, 18 aa, Staphylococcus aureus
AVSETVDKIKSNGDKAKD

SEQ ID NO: 1710481 - protein, 24 aa, Staphylococcus aureus
AVTAAKKALNGEEKLNNRKSEALQ

SEQ ID NO: 1710482 - protein, 73 aa, Staphylococcus aureus
AVTDAKNNITAATDNNGVDTAKDAGKNSIQSTQPATAVKSNAKNDVDQAVTTQNQAIDNTTDATTEEKNAAKD

SEQ ID NO: 1710483 - protein, 19 aa, Staphylococcus aureus
AVTRAKAALNGADNLRNAK

SEQ ID NO: 1710484 - protein, 28 aa, Staphylococcus aureus
AVTRAKAALNGADNLRNAKTSATNTIDG

SEQ ID NO: 1710485 - protein, 27 aa, Staphylococcus aureus
AVTRAKAALNGAENLRNTKTSATNTIN

SEQ ID NO: 1710486 - protein, 28 aa, Staphylococcus aureus
AVTRAKAALNGAENLRNTKTSATNTING

SEQ ID NO: 1710487 - protein, 15 aa, Staphylococcus aureus
AVTSAKNKATSLNTA

SEQ ID NO: 1710488 - protein, 25 aa, Staphylococcus aureus
AVTTAKDNLHGDQKLARDQQQAVTT

SEQ ID NO: 1710489 - protein, 26 aa, Staphylococcus aureus
AVTTKKSDAKAEIAQKASERKTAIEA

SEQ ID NO: 1710490 - protein, 27 aa, Staphylococcus aureus
AYGKDPDKKVADLKTNFSKSAPQKNTN

SEQ ID NO: 1710491 - protein, 14 aa, Staphylococcus aureus
AYGKEPDKKVKELT

SEQ ID NO: 1710492 - protein, 27 aa, Staphylococcus aureus
AYGKEPGKKVADLKTNFSKSAPQKNTN

SEQ ID NO: 1710493 - protein, 14 aa, Staphylococcus aureus
AYGKEPTDKVKELT

SEQ ID NO: 1710494 - protein, 22 aa, Staphylococcus aureus
CDGDNKITGDSKETQNQKSFSK

SEQ ID NO: 1710495 - protein, 19 aa, Staphylococcus aureus
CDSDNKITGDSKEEQIKKS

SEQ ID NO: 1710496 - protein, 64 aa, Staphylococcus aureus
CGEKEKPKKEENKKSHTQKHKDSEPKKQKEKTKKVEDKNPPSNSVQNNATNQSQTQNPNSNNAV

SEQ ID NO: 1710497 - protein, 30 aa, Staphylococcus aureus
CGEKEKPKKEENKKSQTQNTKIANQKRNKK

SEQ ID NO: 1710498 - protein, 10 aa, Staphylococcus aureus
CGFDNDSNKG

SEQ ID NO: 1710499 - protein, 15 aa, Staphylococcus aureus
CGGGNKITEDSKEIQ

SEQ ID NO: 1710500 - protein, 15 aa, Staphylococcus aureus
CGKEQTKTYEGDVSG

SEQ ID NO: 1710501 - protein, 19 aa, Staphylococcus aureus
CGKSDETKEVSKEEQIKKS

SEQ ID NO: 1710502 - protein, 27 aa, Staphylococcus aureus
CGKSSNKDEGVKDATKTETSKHKGGTL

SEQ ID NO: 1710503 - protein, 14 aa, Staphylococcus aureus
CGMGKEEEIKKSFE

SEQ ID NO: 1710504 - protein, 14 aa, Staphylococcus aureus
CGNDDGKDKGGKVT

SEQ ID NO: 1710505 - protein, 14 aa, Staphylococcus aureus
CGNEQNENKYQSQI

SEQ ID NO: 1710506 - protein, 25 aa, Staphylococcus aureus
CGPNRSKEDIDKALNKDNSKDKPNQ

SEQ ID NO: 1710507 - protein, 26 aa, Staphylococcus aureus
CGPNRSKEDIDKALNKDNSKDKPNQL

SEQ ID NO: 1710508 - protein, 27 aa, Staphylococcus aureus
CGQNQSEKNSKKDNEEKTVDTTEERND

SEQ ID NO: 1710509 - protein, 121 aa, Staphylococcus aureus
CGSNDGDKKEESKKTETKKENKDKKKETKDKAEAKKENANQNDNNNQVNNDNNTNVNDHQQTNNAPKQNQTQNNPTSNKNNNAPVKDEFSSDTSYNAYQEAKRATEENKRQNGGHTAGIGG

SEQ ID NO: 1710510 - protein, 95 aa, Staphylococcus aureus
CGSNDTDKKEESKKTETKKENKDKKKETKEKAEAKKENANQNDNNNQVNNENNTNINNNQQTNNTSKQQVQKNLPATNNGQQAQPRDPNEPSYEE

SEQ ID NO: 1710511 - protein, 27 aa, Staphylococcus aureus
CNDKSNSTTSTVSGKVGEGISSGSGTV

SEQ ID NO: 1710512 - protein, 18 aa, Staphylococcus aureus
CNSNSSHAKELNDLEKKY

SEQ ID NO: 1710513 - protein, 5 aa, Staphylococcus aureus
CQSIT

SEQ ID NO: 1710514 - protein, 24 aa, Staphylococcus aureus
CSNSNDNNETKKDDADNGKKQEIQ

SEQ ID NO: 1710515 - protein, 47 aa, Staphylococcus aureus
CSTGNEEEENSKDQKQEKHMNHKSESKAPDNMKSTDDSKYKKDDKIT

SEQ ID NO: 1710516 - protein, 15 aa, Staphylococcus aureus
CSTTNNESNNETKLV

SEQ ID NO: 1710517 - protein, 22 aa, Staphylococcus aureus
CSTTNNESNNETKSVPEEMEAS

SEQ ID NO: 1710518 - protein, 30 aa, Staphylococcus aureus
CSTTNNESNNETKSVPEEMEASKYVGQGFQ

SEQ ID NO: 1710519 - protein, 16 aa, Staphylococcus aureus
DADGNTWYQAQGAGDV

SEQ ID NO: 1710520 - protein, 4 aa, Staphylococcus aureus
DADN

SEQ ID NO: 1710521 - protein, 19 aa, Staphylococcus aureus
DADQAKQQAYNTAVTNAEN

SEQ ID NO: 1710522 - protein, 13 aa, Staphylococcus aureus
DAENAVNKKVDQI

SEQ ID NO: 1710523 - protein, 25 aa, Staphylococcus aureus
DAIVTKDYSKESRVNEKSKKGATVS

SEQ ID NO: 1710524 - protein, 17 aa, Staphylococcus aureus
DAKSDVNQTPVGTGPYQ

SEQ ID NO: 1710525 - protein, 18 aa, Staphylococcus aureus
DAKSDVNQTPVGTSPYQI

SEQ ID NO: 1710526 - protein, 11 aa, Staphylococcus aureus
DAKWSNGDPVT

SEQ ID NO: 1710527 - protein, 20 aa, Staphylococcus aureus
DALQQQVNSQVDDSHYTTAS

SEQ ID NO: 1710528 - protein, 15 aa, Staphylococcus aureus
DALQQQVNSQVDNSH

SEQ ID NO: 1710529 - protein, 40 aa, Staphylococcus aureus
DANGVNHGGSEMVQNKTGHMSQQGHMNQNTHEPTATHATR

SEQ ID NO: 1710530 - protein, 4 aa, Staphylococcus aureus
DAPK

SEQ ID NO: 1710531 - protein, 8 aa, Staphylococcus aureus
DAPKKNPK

SEQ ID NO: 1710532 - protein, 19 aa, Staphylococcus aureus
DAQKQALKAQIDQSPEIAT

SEQ ID NO: 1710533 - protein, 18 aa, Staphylococcus aureus
DAQKQALKGQIDQSAEIA

SEQ ID NO: 1710534 - protein, 32 aa, Staphylococcus aureus; identical to SEQ ID NO: 1566554

SEQ ID NO: 1710535 - protein, 13 aa, Staphylococcus aureus
DAQKQSVESQITQ

SEQ ID NO: 1710536 - protein, 48 aa, Staphylococcus aureus
DAYNAKVNEEDNSNASTSSEIAEAKQKLAELKQTADQNVNQATSKDDI

SEQ ID NO: 1710537 - protein, 7 aa, Staphylococcus aureus
DDAVNQI

SEQ ID NO: 1710538 - protein, 6 aa, Staphylococcus aureus
DDDALK

SEQ ID NO: 1710539 - protein, 10 aa, Staphylococcus aureus
DDDQDYKKTP

SEQ ID NO: 1710540 - protein, 14 aa, Staphylococcus aureus
DDEDKWKVIETFNL

SEQ ID NO: 1710541 - protein, 7 aa, Staphylococcus aureus
DDEKNVE

SEQ ID NO: 1710542 - protein, 15 aa, Staphylococcus aureus
DDFPSTVSKEDQQCS

SEQ ID NO: 1710543 - protein, 15 aa, Staphylococcus aureus
DDKQTTNSDNQETNS

SEQ ID NO: 1710544 - protein, 15 aa, Staphylococcus aureus
DDKQTTNSNNQETNS

SEQ ID NO: 1710545 - protein, 12 aa, Staphylococcus aureus
DDKSITKNDLTQ

SEQ ID NO: 1710546 - protein, 4 aa, Staphylococcus aureus
DDKV

SEQ ID NO: 1710547 - protein, 8 aa, Staphylococcus aureus
DDKYTNIG

SEQ ID NO: 1710548 - protein, 7 aa, Staphylococcus aureus
DDLQNIG

SEQ ID NO: 1710549 - protein, 8 aa, Staphylococcus aureus
DDLQNISE

SEQ ID NO: 1710550 - protein, 5 aa, Staphylococcus aureus
DDSGK

SEQ ID NO: 1710551 - protein, 8 aa, Staphylococcus aureus
DDVEAPSD

SEQ ID NO: 1710552 - protein, 11 aa, Staphylococcus aureus
DDVEAPSDFAK

SEQ ID NO: 1710553 - protein, 24 aa, Staphylococcus aureus
DDVEAPSDFAKLSDQSDLMRAEVT

SEQ ID NO: 1710554 - protein, 24 aa, Staphylococcus aureus
DDVEAPSDFAKLSDQSDLMRVEVS

SEQ ID NO: 1710555 - protein, 16 aa, Staphylococcus aureus
DDVEASSDYVFRAEVS

SEQ ID NO: 1710556 - protein, 9 aa, Staphylococcus aureus
DDVSSSNKV

SEQ ID NO: 1710557 - protein, 21 aa, Staphylococcus aureus
DEAVDKAKQALDKSTGQNLTA

SEQ ID NO: 1710558 - protein, 4 aa, Staphylococcus aureus
DEAY

SEQ ID NO: 1710559 - protein, 10 aa, Staphylococcus aureus
DEDDNENDKQ

SEQ ID NO: 1710560 - protein, 19 aa, Staphylococcus aureus
DEDSNYTSVKDLKDNDKLA

SEQ ID NO: 1710561 - protein, 12 aa, Staphylococcus aureus
DEERANKKAVNK

SEQ ID NO: 1710562 - protein, 10 aa, Staphylococcus aureus
DEKAKGQQVK

SEQ ID NO: 1710563 - protein, 6 aa, Staphylococcus aureus
DEKDDT

SEQ ID NO: 1710564 - protein, 9 aa, Staphylococcus aureus
DEKEKQKAI

SEQ ID NO: 1710565 - protein, 8 aa, Staphylococcus aureus
DEKLKKEI

SEQ ID NO: 1710566 - protein, 12 aa, Staphylococcus aureus
DELGTEKIKKNP

SEQ ID NO: 1710567 - protein, 9 aa, Staphylococcus aureus
DEMKNYSKP

SEQ ID NO: 1710568 - protein, 22 aa, Staphylococcus aureus
DENGKFSFDAEKAGFRLQNGET

SEQ ID NO: 1710569 - protein, 24 aa, Staphylococcus aureus
DERVKSANDAISKLNEKDSIENRR

SEQ ID NO: 1710570 - protein, 14 aa, Staphylococcus aureus
DERVSYKQDFDSRR

SEQ ID NO: 1710571 - protein, 18 aa, Staphylococcus aureus
DETQQIANAEKNVTQVKD

SEQ ID NO: 1710572 - protein, 8 aa, Staphylococcus aureus
DETVTSAQ

SEQ ID NO: 1710573 - protein, 10 aa, Staphylococcus aureus
DEVGQPELRR

SEQ ID NO: 1710574 - protein, 12 aa, Staphylococcus aureus
DEVGQPELRRNS

SEQ ID NO: 1710575 - protein, 6 aa, Staphylococcus aureus
DEYKQY

SEQ ID NO: 1710576 - protein, 19 aa, Staphylococcus aureus
DFAKATAKVSTLSQSHQNY

SEQ ID NO: 1710577 - protein, 13 aa, Staphylococcus aureus
DFEEDTLPKVSGQ

SEQ ID NO: 1710578 - protein, 11 aa, Staphylococcus aureus
DFNSTGDRKVT

SEQ ID NO: 1710579 - protein, 15 aa, Staphylococcus aureus
DFPTTVSKKEQQRSF

SEQ ID NO: 1710580 - protein, 12 aa, Staphylococcus aureus
DGDLKGSSIGSK

SEQ ID NO: 1710581 - protein, 17 aa, Staphylococcus aureus
DGDNKITGDSKETQIKK

SEQ ID NO: 1710582 - protein, 7 aa, Staphylococcus aureus
DGDYKQN

SEQ ID NO: 1710583 - protein, 6 aa, Staphylococcus aureus
DGEFRS

SEQ ID NO: 1710584 - protein, 10 aa, Staphylococcus aureus
DGGNLDATND

SEQ ID NO: 1710585 - protein, 22 aa, Staphylococcus aureus
DGIPKDYKVADKSGQAITYASR

SEQ ID NO: 1710586 - protein, 25 aa, Staphylococcus aureus
DGQSNSVTAYGNNNDDFSSTPSNFS

SEQ ID NO: 1710587 - protein, 7 aa, Staphylococcus aureus
DGRFDDV

SEQ ID NO: 1710588 - protein, 17 aa, Staphylococcus aureus
DGTFKYQSRPKFNTTPK

SEQ ID NO: 1710589 - protein, 11 aa, Staphylococcus aureus
DHLTTKGSLSH

SEQ ID NO: 1710590 - protein, 16 aa, Staphylococcus aureus
DHTRQLTNDSDDRVKS

SEQ ID NO: 1710591 - protein, 20 aa, Staphylococcus aureus
DIKDPNNGETIATAKHDTAN

SEQ ID NO: 1710592 - protein, 25 aa, Staphylococcus aureus
DIQSAEARMKAKQKVNTLSKPHQNY

SEQ ID NO: 1710593 - protein, 9 aa, Staphylococcus aureus
DIQTKKAPK

SEQ ID NO: 1710594 - protein, 12 aa, Staphylococcus aureus
DISKNHNEKKYR

SEQ ID NO: 1710595 - protein, 27 aa, Staphylococcus aureus
DISTKRSPKLKLRGSGDLKGSSVGSKE

SEQ ID NO: 1710596 - protein, 9 aa, Staphylococcus aureus
DITDPSGEV

SEQ ID NO: 1710597 - protein, 13 aa, Staphylococcus aureus
DKANGQNMTKAQV

SEQ ID NO: 1710598 - protein, 38 aa, Staphylococcus aureus
DKDKDEKIEQYDKNVKEQASKDKKQQAKPQIPKDKSKV

SEQ ID NO: 1710599 - protein, 39 aa, Staphylococcus aureus
DKDKDEKIEQYDKNVKEQASKDNKQQAKPQIPKDKSKVA

SEQ ID NO: 1710600 - protein, 4 aa, Staphylococcus aureus
DKDV

SEQ ID NO: 1710601 - protein, 6 aa, Staphylococcus aureus
DKEEGL

SEQ ID NO: 1710602 - protein, 19 aa, Staphylococcus aureus
DKEGCRDGEFKKGDKGTWT

SEQ ID NO: 1710603 - protein, 17 aa, Staphylococcus aureus
DKEGYRDDQFDKKDKGT

SEQ ID NO: 1710604 - protein, 25 aa, Staphylococcus aureus
DKEGYRDGEFKKGDKGTWVVRSEMI

SEQ ID NO: 1710605 - protein, 7 aa, Staphylococcus aureus
DKEHPDP

SEQ ID NO: 1710606 - protein, 6 aa, Staphylococcus aureus
DKEYPF

SEQ ID NO: 1710607 - protein, 5 aa, Staphylococcus aureus
DKGEI

SEQ ID NO: 1710608 - protein, 11 aa, Staphylococcus aureus
DKHGQSAKELR

SEQ ID NO: 1710609 - protein, 9 aa, Staphylococcus aureus
DKKETAKKL

SEQ ID NO: 1710610 - protein, 17 aa, Staphylococcus aureus
DKKGYRDDQFDKNDKGT

SEQ ID NO: 1710611 - protein, 53 aa, Staphylococcus aureus
DKKGYVDSVKNNGSIPSDTLTAKGIAKAPNGKDYASTTNSPLKYNPKEARAHW

SEQ ID NO: 1710612 - protein, 7 aa, Staphylococcus aureus
DKKYKFQ

SEQ ID NO: 1710613 - protein, 6 aa, Staphylococcus aureus
DKLKEV

SEQ ID NO: 1710614 - protein, 13 aa, Staphylococcus aureus
DKLPDRKNYKVEM

SEQ ID NO: 1710615 - protein, 11 aa, Staphylococcus aureus
DKLPKKGIDIT

SEQ ID NO: 1710616 - protein, 8 aa, Staphylococcus aureus
DKLTREKK

SEQ ID NO: 1710617 - protein, 5 aa, Staphylococcus aureus
DKMGG

SEQ ID NO: 1710618 - protein, 6 aa, Staphylococcus aureus
DKNEEF

SEQ ID NO: 1710619 - protein, 7 aa, Staphylococcus aureus
DKNHNQT

SEQ ID NO: 1710620 - protein, 10 aa, Staphylococcus aureus
DKNRFQQRSY

SEQ ID NO: 1710621 - protein, 16 aa, Staphylococcus aureus
DKPTDFNSQKQSLKEK

SEQ ID NO: 1710622 - protein, 8 aa, Staphylococcus aureus
DKQAGASL

SEQ ID NO: 1710623 - protein, 25 aa, Staphylococcus aureus
DKSNSTTSTVSGKVGEGISSGSGTV

SEQ ID NO: 1710624 - protein, 15 aa, Staphylococcus aureus
DKTAGTNENKAAVEQ

SEQ ID NO: 1710625 - protein, 13 aa, Staphylococcus aureus
DKTSTNSKPTIEL

SEQ ID NO: 1710626 - protein, 4 aa, Staphylococcus aureus
DKVD

SEQ ID NO: 1710627 - protein, 22 aa, Staphylococcus aureus
DKVQGNAIAKAEAEQLKQNIID

SEQ ID NO: 1710628 - protein, 12 aa, Staphylococcus aureus
DKYDESNPDMKK

SEQ ID NO: 1710629 - protein, 23 aa, Staphylococcus aureus
DKYDESNPDMKKKFEATEKEARK

SEQ ID NO: 1710630 - protein, 13 aa, Staphylococcus aureus
DLAPKATNNKEFT

SEQ ID NO: 1710631 - protein, 33 aa, Staphylococcus aureus
DLAPKATNNKEYTINTEIGNNGNFGASLKSDQF

SEQ ID NO: 1710632 - protein, 8 aa, Staphylococcus aureus
DLDNGNYT

SEQ ID NO: 1710633 - protein, 7 aa, Staphylococcus aureus
DLEENGY

SEQ ID NO: 1710634 - protein, 23 aa, Staphylococcus aureus
DLKNNQKSPVEPTKDNDKKKGLN

SEQ ID NO: 1710635 - protein, 19 aa, Staphylococcus aureus
DLTAPTAVKPTTSAAEDYN

SEQ ID NO: 1710636 - protein, 18 aa, Staphylococcus aureus
DLTDAQKDAVKRQIEGAT

SEQ ID NO: 1710637 - protein, 16 aa, Staphylococcus aureus
DLTNAQKDAAKRQIEG

SEQ ID NO: 1710638 - protein, 18 aa, Staphylococcus aureus
DLTNAQKEAAKRQIEGAT

SEQ ID NO: 1710639 - protein, 20 aa, Staphylococcus aureus
DLYEDNKIDDMTKKDAQQLL

SEQ ID NO: 1710640 - protein, 21 aa, Staphylococcus aureus
DMNEKEYQSNHKPVYEENNMK

SEQ ID NO: 1710641 - protein, 8 aa, Staphylococcus aureus
DMSDNTHL

SEQ ID NO: 1710642 - protein, 18 aa, Staphylococcus aureus
DNGDATPQQISEEKHRVD

SEQ ID NO: 1710643 - protein, 11 aa, Staphylococcus aureus
DNIDESNNNQL

SEQ ID NO: 1710644 - protein, 24 aa, Staphylococcus aureus
DNKINTVKPNYNGKSTSEYGVFDQ

SEQ ID NO: 1710645 - protein, 18 aa, Staphylococcus aureus
DNKTVDSTQFHLDVEIPK

SEQ ID NO: 1710646 - protein, 38 aa, Staphylococcus aureus; identical to SEQ ID NO: 1567915

SEQ ID NO: 1710647 - protein, 14 aa, Staphylococcus aureus
DNNIRPSTNRSVPT

SEQ ID NO: 1710648 - protein, 42 aa, Staphylococcus aureus
DNNKAIQNDIPDQKVDDKNDKNAVNKEEQHDNGTNNSEETKV

SEQ ID NO: 1710649 - protein, 42 aa, Staphylococcus aureus
DNNKAIQNDLPDQKVDDKNDKNAVNKEKKHDNRENNSAETKV

SEQ ID NO: 1710650 - protein, 42 aa, Staphylococcus aureus
DNNKAIQNDTPDQKVDDKNDKNAVNKEEKHDNRVNKSAETKV

SEQ ID NO: 1710651 - protein, 42 aa, Staphylococcus aureus
DNNKAIQNDTPDQKVDDKSDKNAVNKEEKHDNRTNNSEETKV

SEQ ID NO: 1710652 - protein, 74 aa, Staphylococcus aureus; identical to SEQ ID NO: 1568734

SEQ ID NO: 1710653 - protein, 75 aa, Staphylococcus aureus; identical to SEQ ID NO: 1570105

SEQ ID NO: 1710654 - protein, 75 aa, Staphylococcus aureus
DNSALRTAKTKLDEEINKSVTTDGMTQSSIQAYESAKRAGQTESTNAQNVINNGDATDQQIAAEKAKVEEKYNSL

SEQ ID NO: 1710655 - protein, 6 aa, Staphylococcus aureus
DNTARI

SEQ ID NO: 1710656 - protein, 17 aa, Staphylococcus aureus
DNTTTNEEKGKDIGPVR

SEQ ID NO: 1710657 - protein, 4 aa, Staphylococcus aureus
DNVN

SEQ ID NO: 1710658 - protein, 11 aa, Staphylococcus aureus
DNYPNGGFTAE

SEQ ID NO: 1710659 - protein, 16 aa, Staphylococcus aureus
DPAISTNDNRQDPTVT

SEQ ID NO: 1710660 - protein, 12 aa, Staphylococcus aureus
DPENVKKTGNVT

SEQ ID NO: 1710661 - protein, 6 aa, Staphylococcus aureus
DPGFTQ

SEQ ID NO: 1710662 - protein, 36 aa, Staphylococcus aureus
DPGHGGSDQGASSNTKYKSLEKDYTLKTAKELQRTL

SEQ ID NO: 1710663 - protein, 6 aa, Staphylococcus aureus
DPKHDN

SEQ ID NO: 1710664 - protein, 6 aa, Staphylococcus aureus
DPKKDK

SEQ ID NO: 1710665 - protein, 8 aa, Staphylococcus aureus
DPKTGSEY

SEQ ID NO: 1710666 - protein, 23 aa, Staphylococcus aureus
DPNGRLSTVGGVTKKNNQSSETN

SEQ ID NO: 1710667 - protein, 26 aa, Staphylococcus aureus
DPNGRLSTVGGVTKKNNQSSETNTPL

SEQ ID NO: 1710668 - protein, 25 aa, Staphylococcus aureus
DPNGRVSTVGGVTKKNNQSSETNTP

SEQ ID NO: 1710669 - protein, 17 aa, Staphylococcus aureus
DQAQTNSQVNQAATDGI

SEQ ID NO: 1710670 - protein, 32 aa, Staphylococcus aureus; identical to SEQ ID NO: 1566163

SEQ ID NO: 1710671 - protein, 32 aa, Staphylococcus aureus
DQATQAVTDAKNNLHGDRKLAQDKQRATETLN

SEQ ID NO: 1710672 - protein, 5 aa, Staphylococcus aureus
DQDDQ

SEQ ID NO: 1710673 - protein, 10 aa, Staphylococcus aureus
DQETKATQIS

SEQ ID NO: 1710674 - protein, 10 aa, Staphylococcus aureus
DQFNSSRKSI

SEQ ID NO: 1710675 - protein, 22 aa, Staphylococcus aureus
DQHEHGEEHEHEGHDHEKEEHH

SEQ ID NO: 1710676 - protein, 8 aa, Staphylococcus aureus
DQHQFNQK

SEQ ID NO: 1710677 - protein, 14 aa, Staphylococcus aureus
DQIGHSKKESSSVY

SEQ ID NO: 1710678 - protein, 19 aa, Staphylococcus aureus
DQIGHSKKESYSVYLTTEI

SEQ ID NO: 1710679 - protein, 25 aa, Staphylococcus aureus
DQNPNLTDKEKQALKDRINQILSTR

SEQ ID NO: 1710680 - protein, 7 aa, Staphylococcus aureus
DQRDESI

SEQ ID NO: 1710681 - protein, 11 aa, Staphylococcus aureus
DQTKDIPKTVS

SEQ ID NO: 1710682 - protein, 48 aa, Staphylococcus aureus; identical to SEQ ID NO: 1567040

SEQ ID NO: 1710683 - protein, 15 aa, Staphylococcus aureus
DRGISEQDLKYAKKA

SEQ ID NO: 1710684 - protein, 33 aa, Staphylococcus aureus; identical to SEQ ID NO: 1568741

SEQ ID NO: 1710685 - protein, 35 aa, Staphylococcus aureus
DRHSGIKSTTITTLPSGWTSNLTKADKNNGSLSIT

SEQ ID NO: 1710686 - protein, 6 aa, Staphylococcus aureus
DRNKYK

SEQ ID NO: 1710687 - protein, 16 aa, Staphylococcus aureus
DRNPNLTDKEKQALKD

SEQ ID NO: 1710688 - protein, 11 aa, Staphylococcus aureus
DRQKSKKEPVV

SEQ ID NO: 1710689 - protein, 6 aa, Staphylococcus aureus
DRQQAI

SEQ ID NO: 1710690 - protein, 14 aa, Staphylococcus aureus
DSATDKDRNGFYKD

SEQ ID NO: 1710691 - protein, 13 aa, Staphylococcus aureus
DSATGKARNGFYK

SEQ ID NO: 1710692 - protein, 14 aa, Staphylococcus aureus
DSATGKERNGFYKD

SEQ ID NO: 1710693 - protein, 16 aa, Staphylococcus aureus
DSDADRKKKGGGERSD

SEQ ID NO: 1710694 - protein, 6 aa, Staphylococcus aureus
DSDKDY

SEQ ID NO: 1710695 - protein, 7 aa, Staphylococcus aureus
DSDNKNF

SEQ ID NO: 1710696 - protein, 12 aa, Staphylococcus aureus
DSDTSQLDKAKS

SEQ ID NO: 1710697 - protein, 7 aa, Staphylococcus aureus
DSEFRSV

SEQ ID NO: 1710698 - protein, 8 aa, Staphylococcus aureus
DSKDTRQF

SEQ ID NO: 1710699 - protein, 7 aa, Staphylococcus aureus
DSKIKSL

SEQ ID NO: 1710700 - protein, 16 aa, Staphylococcus aureus
DSNEAMETKIRNGGTH

SEQ ID NO: 1710701 - protein, 16 aa, Staphylococcus aureus
DSRKNLDERETEKKYP

SEQ ID NO: 1710702 - protein, 18 aa, Staphylococcus aureus
DSRKSLDERETEKKYPVK

SEQ ID NO: 1710703 - protein, 16 aa, Staphylococcus aureus
DSSSDTAEKAKEDSKE

SEQ ID NO: 1710704 - protein, 25 aa, Staphylococcus aureus
DSSSDTAEKAKEDSKEEQIKKSFSK

SEQ ID NO: 1710705 - protein, 9 aa, Staphylococcus aureus
DSTISTNGL

SEQ ID NO: 1710706 - protein, 10 aa, Staphylococcus aureus
DSTLSTNDLT

SEQ ID NO: 1710707 - protein, 18 aa, Staphylococcus aureus
DSVTSTSTSSTHTINKEE

SEQ ID NO: 1710708 - protein, 21 aa, Staphylococcus aureus
DTDSGENNKDSSIPEGGVTVS

SEQ ID NO: 1710709 - protein, 18 aa, Staphylococcus aureus
DTGNKQRQDLEKVEKAIN

SEQ ID NO: 1710710 - protein, 17 aa, Staphylococcus aureus
DTIDGTKIKEISVELEY

SEQ ID NO: 1710711 - protein, 9 aa, Staphylococcus aureus
DTKGKIKPT

SEQ ID NO: 1710712 - protein, 12 aa, Staphylococcus aureus
DTMDDSTKTKYK

SEQ ID NO: 1710713 - protein, 12 aa, Staphylococcus aureus
DTMDESTKTKYK

SEQ ID NO: 1710714 - protein, 16 aa, Staphylococcus aureus
DTNKDGKQDADEKGIK

SEQ ID NO: 1710715 - protein, 15 aa, Staphylococcus aureus
DTNKDGKQDANEKGI

SEQ ID NO: 1710716 - protein, 5 aa, Staphylococcus aureus
DTNQV

SEQ ID NO: 1710717 - protein, 11 aa, Staphylococcus aureus
DTNTQTPNYEK

SEQ ID NO: 1710718 - protein, 11 aa, Staphylococcus aureus
DTNVQTPDYEK

SEQ ID NO: 1710719 - protein, 6 aa, Staphylococcus aureus
DTPNRQ

SEQ ID NO: 1710720 - protein, 11 aa, Staphylococcus aureus
DTTEIKGKPKR

SEQ ID NO: 1710721 - protein, 17 aa, Staphylococcus aureus
DTVGPDVEVKASGGVRN

SEQ ID NO: 1710722 - protein, 9 aa, Staphylococcus aureus
DTVSTKSSL

SEQ ID NO: 1710723 - protein, 13 aa, Staphylococcus aureus
DVAHAEDKLDHSQ

SEQ ID NO: 1710724 - protein, 22 aa, Staphylococcus aureus
DVKTGKKEILPSTAKDKNGKNV

SEQ ID NO: 1710725 - protein, 22 aa, Staphylococcus aureus
DVNSATSQVNPAKTVLNGDNNL

SEQ ID NO: 1710726 - protein, 9 aa, Staphylococcus aureus
DVNSGGTIG

SEQ ID NO: 1710727 - protein, 4 aa, Staphylococcus aureus
DVNT

SEQ ID NO: 1710728 - protein, 7 aa, Staphylococcus aureus
DVSNQAR

SEQ ID NO: 1710729 - protein, 18 aa, Staphylococcus aureus
DVSPSMVDGNDRLKSDTN

SEQ ID NO: 1710730 - protein, 33 aa, Staphylococcus aureus; identical to SEQ ID NO: 1567936

SEQ ID NO: 1710731 - protein, 17 aa, Staphylococcus aureus
DWKQEDKTLLSKNQYYW

SEQ ID NO: 1710732 - protein, 12 aa, Staphylococcus aureus
DYDNEQKSSGLM

SEQ ID NO: 1710733 - protein, 22 aa, Staphylococcus aureus
DYKTKDSKSWKAAEKDKKIAED

SEQ ID NO: 1710734 - protein, 9 aa, Staphylococcus aureus
DYRDEADKM

SEQ ID NO: 1710735 - protein, 10 aa, Staphylococcus aureus
DYRNKLENKA

SEQ ID NO: 1710736 - protein, 6 aa, Staphylococcus aureus
EAKSSA

SEQ ID NO: 1710737 - protein, 18 aa, Staphylococcus aureus
EAKTRSDYMDIIKKKGWI

SEQ ID NO: 1710738 - protein, 14 aa, Staphylococcus aureus
EAQNSNQKKMNKVT

SEQ ID NO: 1710739 - protein, 6 aa, Staphylococcus aureus
EASQTL

SEQ ID NO: 1710740 - protein, 11 aa, Staphylococcus aureus
EASTKDGNGNI

SEQ ID NO: 1710741 - protein, 12 aa, Staphylococcus aureus
EATEGKGTQLKA

SEQ ID NO: 1710742 - protein, 18 aa, Staphylococcus aureus
EDANHVKTANRASQADID

SEQ ID NO: 1710743 - protein, 24 aa, Staphylococcus aureus
EDDKSFRDGIRNSKKQLKDKSRPY

SEQ ID NO: 1710744 - protein, 9 aa, Staphylococcus aureus
EDEKLKQKI

SEQ ID NO: 1710745 - protein, 8 aa, Staphylococcus aureus
EDENLKQK

SEQ ID NO: 1710746 - protein, 4 aa, Staphylococcus aureus
EDET

SEQ ID NO: 1710747 - protein, 19 aa, Staphylococcus aureus
EDIDQLRKEKDKDDKSTYD

SEQ ID NO: 1710748 - protein, 12 aa, Staphylococcus aureus
EDKDMTKNSIDS

SEQ ID NO: 1710749 - protein, 14 aa, Staphylococcus aureus
EDKGKHQDNEKRYP

SEQ ID NO: 1710750 - protein, 16 aa, Staphylococcus aureus
EDKKIDDVTKKDAQQL

SEQ ID NO: 1710751 - protein, 14 aa, Staphylococcus aureus
EDKKIDDVTKKECT

SEQ ID NO: 1710752 - protein, 6 aa, Staphylococcus aureus
EDNGIN

SEQ ID NO: 1710753 - protein, 16 aa, Staphylococcus aureus
EDNLKDNKREDNPKAK

SEQ ID NO: 1710754 - protein, 8 aa, Staphylococcus aureus
EDPNLKNK

SEQ ID NO: 1710755 - protein, 8 aa, Staphylococcus aureus
EDSGRGYR

SEQ ID NO: 1710756 - protein, 11 aa, Staphylococcus aureus
EDSKKFKTDVY

SEQ ID NO: 1710757 - protein, 9 aa, Staphylococcus aureus
EDTSSNEKS

SEQ ID NO: 1710758 - protein, 35 aa, Staphylococcus aureus
EEASNRPKKRSRRAAPTDPNATPADPTAGNGSAPV

SEQ ID NO: 1710759 - protein, 13 aa, Staphylococcus aureus
EEDERKSKKPINN

SEQ ID NO: 1710760 - protein, 5 aa, Staphylococcus aureus
EEINT

SEQ ID NO: 1710761 - protein, 17 aa, Staphylococcus aureus
EEKKIKNRNTNTNTSNY

SEQ ID NO: 1710762 - protein, 11 aa, Staphylococcus aureus
EEKKPNRITNE

SEQ ID NO: 1710763 - protein, 32 aa, Staphylococcus aureus
EEKKVEEPQSPKVSEKVDVQETVGTTEEAPLP

SEQ ID NO: 1710764 - protein, 40 aa, Staphylococcus aureus
EENLERKSDLLDKKGEILEQKESKIEEKQQQVDAKESSVQ

SEQ ID NO: 1710765 - protein, 6 aa, Staphylococcus aureus
EENSHV

SEQ ID NO: 1710766 - protein, 4 aa, Staphylococcus aureus
EENV

SEQ ID NO: 1710767 - protein, 14 aa, Staphylococcus aureus
EEQGQEMTPNSKQQ

SEQ ID NO: 1710768 - protein, 16 aa, Staphylococcus aureus
EERKIESSKKNNNQVP

SEQ ID NO: 1710769 - protein, 19 aa, Staphylococcus aureus
EESFESTNISVKSEDYYGS

SEQ ID NO: 1710770 - protein, 67 aa, Staphylococcus aureus
EETKKAVKEADDSWKKKTVKKYGETETKSPVVKEEKKVEEPQLPKVGNQQEDKTTVDKAEETTQPVA

SEQ ID NO: 1710771 - protein, 12 aa, Staphylococcus aureus
EETKQQILTKLQ

SEQ ID NO: 1710772 - protein, 44 aa, Staphylococcus aureus; identical to SEQ ID NO: 1570240

SEQ ID NO: 1710773 - protein, 16 aa, Staphylococcus aureus
EGAFDPDKKYKSGHRD

SEQ ID NO: 1710774 - protein, 7 aa, Staphylococcus aureus
EGDKKLP

SEQ ID NO: 1710775 - protein, 16 aa, Staphylococcus aureus
EGHNNTNKVEPHAGQR

SEQ ID NO: 1710776 - protein, 6 aa, Staphylococcus aureus
EGMATG

SEQ ID NO: 1710777 - protein, 25 aa, Staphylococcus aureus
EGSGRQATDYSIGGISKTNGENYKD

SEQ ID NO: 1710778 - protein, 6 aa, Staphylococcus aureus
EGTDLT

SEQ ID NO: 1710779 - protein, 8 aa, Staphylococcus aureus
EGVPSYEQ

SEQ ID NO: 1710780 - protein, 19 aa, Staphylococcus aureus
EIEKVEPQQNNQANDKITN

SEQ ID NO: 1710781 - protein, 7 aa, Staphylococcus aureus
EIGDGDL

SEQ ID NO: 1710782 - protein, 23 aa, Staphylococcus aureus
EIGGNKKVKQRLKGLGDKVTNPV

SEQ ID NO: 1710783 - protein, 51 aa, Staphylococcus aureus
EINATPDATDDEKNAAINTLNQDRQQAIESVKQANTNNEVDQAATTAENNI

SEQ ID NO: 1710784 - protein, 29 aa, Staphylococcus aureus
EINATPDATNDEKNAAINTLNQDRQQAIE

SEQ ID NO: 1710785 - protein, 30 aa, Staphylococcus aureus
EINATPDATNDEKNAAINTLNQDRQQAIES

SEQ ID NO: 1710786 - protein, 18 aa, Staphylococcus aureus
EIPKGSKVNPQAKNSAIY

SEQ ID NO: 1710787 - protein, 27 aa, Staphylococcus aureus
EIPNAEQTVNYQNADDNAKTNFDDAKR

SEQ ID NO: 1710788 - protein, 49 aa, Staphylococcus aureus
EIQATPDATDEEKQEADLEANTENAKANHAITAATTNAEVDDAKANAEV

SEQ ID NO: 1710789 - protein, 51 aa, Staphylococcus aureus
EIQATPDVTDEEKQTADAEANTENGKANQAISAATTNAQVDEAKANAEAAI

SEQ ID NO: 1710790 - protein, 15 aa, Staphylococcus aureus
EISKSLKDAEEEFRK

SEQ ID NO: 1710791 - protein, 10 aa, Staphylococcus aureus
EISSEVTAQT

SEQ ID NO: 1710792 - protein, 13 aa, Staphylococcus aureus
EITTCENKLLLQK

SEQ ID NO: 1710793 - protein, 5 aa, Staphylococcus aureus
EKAYQ

SEQ ID NO: 1710794 - protein, 5 aa, Staphylococcus aureus
EKDDT

SEQ ID NO: 1710795 - protein, 12 aa, Staphylococcus aureus
EKEDTPKEVRQE

SEQ ID NO: 1710796 - protein, 4 aa, Staphylococcus aureus
EKEE

SEQ ID NO: 1710797 - protein, 5 aa, Staphylococcus aureus
EKETD

SEQ ID NO: 1710798 - protein, 14 aa, Staphylococcus aureus
EKKYHNSKELESLK

SEQ ID NO: 1710799 - protein, 15 aa, Staphylococcus aureus
EKLGKGKTLQHGDDV

SEQ ID NO: 1710800 - protein, 20 aa, Staphylococcus aureus
EKLPEKYKAEYKKKLDQTRV

SEQ ID NO: 1710801 - protein, 6 aa, Staphylococcus aureus
EKMESR

SEQ ID NO: 1710802 - protein, 13 aa, Staphylococcus aureus
EKSMQPKGRKFKD

SEQ ID NO: 1710803 - protein, 5 aa, Staphylococcus aureus
EKSRR

SEQ ID NO: 1710804 - protein, 4 aa, Staphylococcus aureus
EKSY

SEQ ID NO: 1710805 - protein, 23 aa, Staphylococcus aureus
EKVNELNGNERVAEAKTQAKQTI

SEQ ID NO: 1710806 - protein, 18 aa, Staphylococcus aureus
EKVNIKKGKKVSISCTNF

SEQ ID NO: 1710807 - protein, 17 aa, Staphylococcus aureus
EKVQPQQKNQSNDKMTS

SEQ ID NO: 1710808 - protein, 19 aa, Staphylococcus aureus
ELGYEGGQNSGNQSFEEDT

SEQ ID NO: 1710809 - protein, 14 aa, Staphylococcus aureus
ELKDSTMASSFDGK

SEQ ID NO: 1710810 - protein, 12 aa, Staphylococcus aureus
ELPKKSNGGKTL

SEQ ID NO: 1710811 - protein, 16 aa, Staphylococcus aureus
ELQQKTSSFGQSTTVT

SEQ ID NO: 1710812 - protein, 4 aa, Staphylococcus aureus
ELTT

SEQ ID NO: 1710813 - protein, 4 aa, Staphylococcus aureus
EMGG

SEQ ID NO: 1710814 - protein, 4 aa, Staphylococcus aureus
ENAK

SEQ ID NO: 1710815 - protein, 23 aa, Staphylococcus aureus
ENANDGSGGSVAKLKNKCLTLCL

SEQ ID NO: 1710816 - protein, 21 aa, Staphylococcus aureus
ENESSKDTNTETKSVPEEMEA

SEQ ID NO: 1710817 - protein, 5 aa, Staphylococcus aureus
ENGTI

SEQ ID NO: 1710818 - protein, 11 aa, Staphylococcus aureus
ENHVDEKEEKL

SEQ ID NO: 1710819 - protein, 39 aa, Staphylococcus aureus
ENKHEKENTHNINNNGSEANENFNNKKKRIENIEDKQKA

SEQ ID NO: 1710820 - protein, 11 aa, Staphylococcus aureus
ENKNVTEEQQL

SEQ ID NO: 1710821 - protein, 8 aa, Staphylococcus aureus
ENNPKGSV

SEQ ID NO: 1710822 - protein, 17 aa, Staphylococcus aureus
ENPKSVSEIKKEQNTSN

SEQ ID NO: 1710823 - protein, 7 aa, Staphylococcus aureus
ENPVSKR

SEQ ID NO: 1710824 - protein, 9 aa, Staphylococcus aureus
ENQQSKVYR

SEQ ID NO: 1710825 - protein, 16 aa, Staphylococcus aureus
ENSAPTSKQAQAEITP

SEQ ID NO: 1710826 - protein, 11 aa, Staphylococcus aureus
ENSAPTSKQVQ

SEQ ID NO: 1710827 - protein, 13 aa, Staphylococcus aureus
ENSDRSGNFNWWY

SEQ ID NO: 1710828 - protein, 12 aa, Staphylococcus aureus
ENSQNSDYSQMN

SEQ ID NO: 1710829 - protein, 6 aa, Staphylococcus aureus
ENTEYE

SEQ ID NO: 1710830 - protein, 38 aa, Staphylococcus aureus
EPASNRPKKRSKRAAPADPNATPADPAAAAAGNGGAPV

SEQ ID NO: 1710831 - protein, 38 aa, Staphylococcus aureus
EPASNRPKKRSRRAAPADPNATPADPAAAAAGNGGAPV

SEQ ID NO: 1710832 - protein, 38 aa, Staphylococcus aureus
EPASNRPKKRSRRAAPADPNATPADPWAAAAGNGGAPV

SEQ ID NO: 1710833 - protein, 5 aa, Staphylococcus aureus
EPEIE

SEQ ID NO: 1710834 - protein, 10 aa, Staphylococcus aureus
EPGNSGSAVF

SEQ ID NO: 1710835 - protein, 9 aa, Staphylococcus aureus
EPGNSGSPV

SEQ ID NO: 1710836 - protein, 14 aa, Staphylococcus aureus
EPGNSGSPVLNSKN

SEQ ID NO: 1710837 - protein, 20 aa, Staphylococcus aureus
EPKPKTVSSNNKSNSNNSTL

SEQ ID NO: 1710838 - protein, 10 aa, Staphylococcus aureus
EPSDAYPTIS

SEQ ID NO: 1710839 - protein, 4 aa, Staphylococcus aureus
EPVS

SEQ ID NO: 1710840 - protein, 5 aa, Staphylococcus aureus
EPVSA

SEQ ID NO: 1710841 - protein, 46 aa, Staphylococcus aureus
EQNRANELKSNPNSNYNQNWTAEDQAQAEARTKGSGMANDTGESVE

SEQ ID NO: 1710842 - protein, 5 aa, Staphylococcus aureus
EQQER

SEQ ID NO: 1710843 - protein, 15 aa, Staphylococcus aureus
ERAKEKGKSTGLVST

SEQ ID NO: 1710844 - protein, 48 aa, Staphylococcus aureus; identical to SEQ ID NO: 1568809

SEQ ID NO: 1710845 - protein, 8 aa, Staphylococcus aureus
ERGNAKQG

SEQ ID NO: 1710846 - protein, 44 aa, Staphylococcus aureus
ERKRTKKKQLEKEKANILNQNTNDTESSIQEPSLQQAKEQKDDK

SEQ ID NO: 1710847 - protein, 23 aa, Staphylococcus aureus
ERVKSANDAITKLQKNDSIENRR

SEQ ID NO: 1710848 - protein, 21 aa, Staphylococcus aureus
ESDSSLRSEDKGDDMSTLVGT

SEQ ID NO: 1710849 - protein, 15 aa, Staphylococcus aureus
ESDSSLRSEDKSGDM

SEQ ID NO: 1710850 - protein, 14 aa, Staphylococcus aureus
ESIKDQPQTEASSK

SEQ ID NO: 1710851 - protein, 30 aa, Staphylococcus aureus
ESITNEVNAAKQALNGNDNLANAKQQAKQQ

SEQ ID NO: 1710852 - protein, 15 aa, Staphylococcus aureus
ESLKDSKNPDRRVAQ

SEQ ID NO: 1710853 - protein, 9 aa, Staphylococcus aureus
ESNDSEKLS

SEQ ID NO: 1710854 - protein, 8 aa, Staphylococcus aureus
ESNEENIE

SEQ ID NO: 1710855 - protein, 21 aa, Staphylococcus aureus
ESPEQKKEREFDEKLESTPAY

SEQ ID NO: 1710856 - protein, 12 aa, Staphylococcus aureus
ESQPDPTPDELH

SEQ ID NO: 1710857 - protein, 17 aa, Staphylococcus aureus
ESQTVKAAESTQGQHNY

SEQ ID NO: 1710858 - protein, 13 aa, Staphylococcus aureus
ESTDNKKEHRLSI

SEQ ID NO: 1710859 - protein, 7 aa, Staphylococcus aureus
ESTGPVM

SEQ ID NO: 1710860 - protein, 21 aa, Staphylococcus aureus
ESTIGEATNNISNHINPMKWA

SEQ ID NO: 1710861 - protein, 11 aa, Staphylococcus aureus
ESTQDQQQRLN

SEQ ID NO: 1710862 - protein, 14 aa, Staphylococcus aureus
ESVKQSANSLDGAM

SEQ ID NO: 1710863 - protein, 10 aa, Staphylococcus aureus
ESYELASKTF

SEQ ID NO: 1710864 - protein, 4 aa, Staphylococcus aureus
ESYL

SEQ ID NO: 1710865 - protein, 21 aa, Staphylococcus aureus
ETFTNTITANDTSGNTATTSF

SEQ ID NO: 1710866 - protein, 6 aa, Staphylococcus aureus
ETGSVD

SEQ ID NO: 1710867 - protein, 25 aa, Staphylococcus aureus
ETIYGETVKGPEYPTMENKTLQGEI

SEQ ID NO: 1710868 - protein, 26 aa, Staphylococcus aureus
ETKKAVKEADASWKKKTVKNYDESVT

SEQ ID NO: 1710869 - protein, 18 aa, Staphylococcus aureus
ETKKQAKDKEAKVNNQVP

SEQ ID NO: 1710870 - protein, 17 aa, Staphylococcus aureus
ETNDISKSLNRGKHTTR

SEQ ID NO: 1710871 - protein, 5 aa, Staphylococcus aureus
ETQEK

SEQ ID NO: 1710872 - protein, 65 aa, Staphylococcus aureus
ETREAVAKADESWKNKTVKKYGETETKSPVVKEEKKVEEPQAPKVSEKVGVQETVGTTEEAPLPI

SEQ ID NO: 1710873 - protein, 65 aa, Staphylococcus aureus
ETREAVAKAGESWKNKTVKKYGETETKSPVVKEEKKVEEPQAPKVSEKVGVQETVGTTEEAPLPI

SEQ ID NO: 1710874 - protein, 66 aa, Staphylococcus aureus
ETREAVEKADDSWKKKTVKKYGETETKSPVVKEEKKVEEPQAPKVDNQQEVKTTAGKAEETTQPVA

SEQ ID NO: 1710875 - protein, 29 aa, Staphylococcus aureus
ETREAVSKADESWKTKTVKKYGETETKYP

SEQ ID NO: 1710876 - protein, 13 aa, Staphylococcus aureus
ETSALPGRKTGSL

SEQ ID NO: 1710877 - protein, 6 aa, Staphylococcus aureus
ETSPMG

SEQ ID NO: 1710878 - protein, 20 aa, Staphylococcus aureus
ETTEDKKGYVHNKDKKYSVK

SEQ ID NO: 1710879 - protein, 34 aa, Staphylococcus aureus; identical to SEQ ID NO: 1570385

SEQ ID NO: 1710880 - protein, 33 aa, Staphylococcus aureus
ETVPNRSYARASTNEITSKTVSNVSRNGNNANV

SEQ ID NO: 1710881 - protein, 4 aa, Staphylococcus aureus
ETVT

SEQ ID NO: 1710882 - protein, 25 aa, Staphylococcus aureus
EVEGKTGTAQVAAPNGGGYVKGPNP

SEQ ID NO: 1710883 - protein, 8 aa, Staphylococcus aureus
EVGPYEDT

SEQ ID NO: 1710884 - protein, 39 aa, Staphylococcus aureus
EVKQAATARKAQNATVSNATDEEVAEANAAVDAAQTEGL

SEQ ID NO: 1710885 - protein, 45 aa, Staphylococcus aureus; identical to SEQ ID NO: 1566021

SEQ ID NO: 1710886 - protein, 9 aa, Staphylococcus aureus
EVSEDGKTY

SEQ ID NO: 1710887 - protein, 12 aa, Staphylococcus aureus
EVSEKKNEDQKE

SEQ ID NO: 1710888 - protein, 14 aa, Staphylococcus aureus
EVSKESGNLAKSYA

SEQ ID NO: 1710889 - protein, 43 aa, Staphylococcus aureus
EVSSSDPNLGDDEEDEEVEETSTEEVGAEEESTDAKATYITPR

SEQ ID NO: 1710890 - protein, 46 aa, Staphylococcus aureus
EVSSSDPYLGDDEEDEEVEETSTEEVGAEEENTEAKATYTTPRYEK

SEQ ID NO: 1710891 - protein, 46 aa, Staphylococcus aureus
EVSSSSPDLGDDEEDEEVEEDSTEKAGTEEENTDAKATYTTPRYEK

SEQ ID NO: 1710892 - protein, 16 aa, Staphylococcus aureus
EYKEDTIKETLTGQYD

SEQ ID NO: 1710893 - protein, 17 aa, Staphylococcus aureus
EYKEDTLTETVTGQYDE

SEQ ID NO: 1710894 - protein, 9 aa, Staphylococcus aureus
EYLGKSKKF

SEQ ID NO: 1710895 - protein, 10 aa, Staphylococcus aureus
EYLGKSKKFG

SEQ ID NO: 1710896 - protein, 20 aa, Staphylococcus aureus
FAEGRGKAQAGSLRQAQSNL

SEQ ID NO: 1710897 - protein, 11 aa, Staphylococcus aureus
FAKATAKVSTL

SEQ ID NO: 1710898 - protein, 18 aa, Staphylococcus aureus
FAKATAKVSTLSQSHQNY

SEQ ID NO: 1710899 - protein, 13 aa, Staphylococcus aureus
FAKSNKQGEMNSE

SEQ ID NO: 1710900 - protein, 15 aa, Staphylococcus aureus
FANPTDLENKNTNDR

SEQ ID NO: 1710901 - protein, 16 aa, Staphylococcus aureus
FANPTELENKKTNDRL

SEQ ID NO: 1710902 - protein, 27 aa, Staphylococcus aureus
FAPQNEKVAKKYGENYGTAADRAVYNG

SEQ ID NO: 1710903 - protein, 21 aa, Staphylococcus aureus
FAPQNEKVAKKYGKNYGTAAD

SEQ ID NO: 1710904 - protein, 16 aa, Staphylococcus aureus
FEEDTSDSDSDSDSDS

SEQ ID NO: 1710905 - protein, 25 aa, Staphylococcus aureus
FEEDTSDSDSDSDSDSDSDSDSDSD

SEQ ID NO: 1710906 - protein, 35 aa, Staphylococcus aureus
FEEDTSDSDSDSDSDSDSDSDSDSDSDSDSDSDSD

SEQ ID NO: 1710907 - protein, 54 aa, Staphylococcus aureus
FEEDTSDSDSDSDSDSDSDSDSDSDSDSDSDSDSDSDSDSDSDSDSDSDSDSDS

SEQ ID NO: 1710908 - protein, 79 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSD

SEQ ID NO: 1710909 - protein, 28 aa, Staphylococcus aureus
FEEETSDSDSDSDSDSDSDSDSDSDSDS

SEQ ID NO: 1710910 - protein, 5 aa, Staphylococcus aureus
FEENS

SEQ ID NO: 1710911 - protein, 8 aa, Staphylococcus aureus
FESTGTIK

SEQ ID NO: 1710912 - protein, 16 aa, Staphylococcus aureus
FESTGTIKRIKDNILN

SEQ ID NO: 1710913 - protein, 15 aa, Staphylococcus aureus
FESTGTVKSIKDNNL

SEQ ID NO: 1710914 - protein, 41 aa, Staphylococcus aureus; identical to SEQ ID NO: 1570432

SEQ ID NO: 1710915 - protein, 29 aa, Staphylococcus aureus
FETPSGYTPTSVTSGNDTEKDSNGLTTTG

SEQ ID NO: 1710916 - protein, 6 aa, Staphylococcus aureus
FGADQH

SEQ ID NO: 1710917 - protein, 43 aa, Staphylococcus aureus
FGGNHKLSSKKSEESKQETVKKESEEEKDPKVAHYKKNKEKIA

SEQ ID NO: 1710918 - protein, 26 aa, Staphylococcus aureus
FGRQADNNSIGGITKTNGTQHKDTVQ

SEQ ID NO: 1710919 - protein, 11 aa, Staphylococcus aureus
FGVKDSDNKNI

SEQ ID NO: 1710920 - protein, 16 aa, Staphylococcus aureus
FINEDQAQKDAYTQAV

SEQ ID NO: 1710921 - protein, 9 aa, Staphylococcus aureus
FKGSSELST

SEQ ID NO: 1710922 - protein, 13 aa, Staphylococcus aureus
FKKQVNKKVMDAQ

SEQ ID NO: 1710923 - protein, 6 aa, Staphylococcus aureus
FKNQDK

SEQ ID NO: 1710924 - protein, 37 aa, Staphylococcus aureus
FKSAPKVNVGSLTDNKNFVASEDKLNKIADPSAASKI

SEQ ID NO: 1710925 - protein, 9 aa, Staphylococcus aureus
FKSKASQVT

SEQ ID NO: 1710926 - protein, 10 aa, Staphylococcus aureus
FKSKASQVTV

SEQ ID NO: 1710927 - protein, 30 aa, Staphylococcus aureus
FNDQTGQATLITNEDENFVKDDQRAGVDAN

SEQ ID NO: 1710928 - protein, 178 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSD

SEQ ID NO: 1710929 - protein, 6 aa, Staphylococcus aureus
FNPNAK

SEQ ID NO: 1710930 - protein, 12 aa, Staphylococcus aureus
FNRKAQAKELND

SEQ ID NO: 1710931 - protein, 13 aa, Staphylococcus aureus
FNSSDLANQFKGK

SEQ ID NO: 1710932 - protein, 10 aa, Staphylococcus aureus
FNTPDDQITT

SEQ ID NO: 1710933 - protein, 6 aa, Staphylococcus aureus
FPNPNQ

SEQ ID NO: 1710934 - protein, 15 aa, Staphylococcus aureus
FPSWKDKAEKVQRQL

SEQ ID NO: 1710935 - protein, 6 aa, Staphylococcus aureus
FRQENN

SEQ ID NO: 1710936 - protein, 15 aa, Staphylococcus aureus
FSGQNGSAIRDSKNN

SEQ ID NO: 1710937 - protein, 11 aa, Staphylococcus aureus
FSKSSKPGVID

SEQ ID NO: 1710938 - protein, 13 aa, Staphylococcus aureus
FSNDEKKKYTDPI

SEQ ID NO: 1710939 - protein, 11 aa, Staphylococcus aureus
FSQHGGNRLGA

SEQ ID NO: 1710940 - protein, 17 aa, Staphylococcus aureus
FSTGPNDLISESNNWDE

SEQ ID NO: 1710941 - protein, 30 aa, Staphylococcus aureus
FSTPDGYTPTTANAGTDDAVDSDGLTTTGV

SEQ ID NO: 1710942 - protein, 14 aa, Staphylococcus aureus
FTGGVTPAATSFDK

SEQ ID NO: 1710943 - protein, 15 aa, Staphylococcus aureus
FTGGVTPAATSSDKH

SEQ ID NO: 1710944 - protein, 12 aa, Staphylococcus aureus
FTKESKGASMED

SEQ ID NO: 1710945 - protein, 12 aa, Staphylococcus aureus
FTNTITANDNFG

SEQ ID NO: 1710946 - protein, 12 aa, Staphylococcus aureus
FTPDTSKLTDVT

SEQ ID NO: 1710947 - protein, 16 aa, Staphylococcus aureus
FTPEAPKTITELEKKV

SEQ ID NO: 1710948 - protein, 39 aa, Staphylococcus aureus; identical to SEQ ID NO: 1637042

SEQ ID NO: 1710949 - protein, 39 aa, Staphylococcus aureus
FTQADQDKQQAYNNATNQAQQIANGTPTPVLTPDTVTQA

SEQ ID NO: 1710950 - protein, 29 aa, Staphylococcus aureus
FTTPEGYTPTTVTSGSDIEKDSNGLTTTG

SEQ ID NO: 1710951 - protein, 4 aa, Staphylococcus aureus
FYDD

SEQ ID NO: 1710952 - protein, 16 aa, Staphylococcus aureus
FYDDNRPIEYGVHSKD

SEQ ID NO: 1710953 - protein, 5 aa, Staphylococcus aureus
FYPNG

SEQ ID NO: 1710954 - protein, 12 aa, Staphylococcus aureus
GAFSDYADSIQK

SEQ ID NO: 1710955 - protein, 5 aa, Staphylococcus aureus
GAGVG

SEQ ID NO: 1710956 - protein, 42 aa, Staphylococcus aureus
GANQHKENNSKSNNTNKKTQQTDNTTKSNTDKQMTPQEAEDI

SEQ ID NO: 1710957 - protein, 42 aa, Staphylococcus aureus
GANQNKENNSKSNDTTKKTQQTDNTTQSNTDKQISPQEAEDI

SEQ ID NO: 1710958 - protein, 5 aa, Staphylococcus aureus
GARHK

SEQ ID NO: 1710959 - protein, 8 aa, Staphylococcus aureus
GASNPTLS

SEQ ID NO: 1710960 - protein, 22 aa, Staphylococcus aureus
GASTTATKAFETEDAIQNGADE

SEQ ID NO: 1710961 - protein, 11 aa, Staphylococcus aureus
GDDKAAAFESN

SEQ ID NO: 1710962 - protein, 7 aa, Staphylococcus aureus
GDEGSHC

SEQ ID NO: 1710963 - protein, 14 aa, Staphylococcus aureus
GDGDLKGSSIGSKD

SEQ ID NO: 1710964 - protein, 14 aa, Staphylococcus aureus
GDGDLKGSSVGSKE

SEQ ID NO: 1710965 - protein, 8 aa, Staphylococcus aureus
GDKTIEKE

SEQ ID NO: 1710966 - protein, 10 aa, Staphylococcus aureus
GDLKGSSIGH

SEQ ID NO: 1710967 - protein, 9 aa, Staphylococcus aureus
GDPNNALSE

SEQ ID NO: 1710968 - protein, 47 aa, Staphylococcus aureus; identical to SEQ ID NO: 1637132

SEQ ID NO: 1710969 - protein, 21 aa, Staphylococcus aureus
GDSRQAANYSIGGVTKTNSQP

SEQ ID NO: 1710970 - protein, 88 aa, Staphylococcus aureus; identical to SEQ ID NO: 1565094

SEQ ID NO: 1710971 - protein, 10 aa, Staphylococcus aureus
GEGLANEKTA

SEQ ID NO: 1710972 - protein, 10 aa, Staphylococcus aureus
GEGLASETTA

SEQ ID NO: 1710973 - protein, 27 aa, Staphylococcus aureus
GEHKKDETADFNKNDQYWGEKSKLNKV

SEQ ID NO: 1710974 - protein, 4 aa, Staphylococcus aureus
GEHQ

SEQ ID NO: 1710975 - protein, 16 aa, Staphylococcus aureus
GEKLGKGKTLKHGDDV

SEQ ID NO: 1710976 - protein, 7 aa, Staphylococcus aureus
GELQQFN

SEQ ID NO: 1710977 - protein, 10 aa, Staphylococcus aureus
GENIDKSKTN

SEQ ID NO: 1710978 - protein, 16 aa, Staphylococcus aureus
GETVKGPDYPTMENKT

SEQ ID NO: 1710979 - protein, 7 aa, Staphylococcus aureus
GGATCAS

SEQ ID NO: 1710980 - protein, 14 aa, Staphylococcus aureus
GGAVGGGLTGGATF

SEQ ID NO: 1710981 - protein, 5 aa, Staphylococcus aureus
GGDLD

SEQ ID NO: 1710982 - protein, 4 aa, Staphylococcus aureus
GGFE

SEQ ID NO: 1710983 - protein, 7 aa, Staphylococcus aureus
GGKNGYY

SEQ ID NO: 1710984 - protein, 17 aa, Staphylococcus aureus
GGNKITGDSKEQQIKKS

SEQ ID NO: 1710985 - protein, 22 aa, Staphylococcus aureus
GGNYTNASPDKQGAYTDAYNAA

SEQ ID NO: 1710986 - protein, 53 aa, Staphylococcus aureus
GGQAQAAEKQVNMGNSQEDTVTAQSIGDQQTRENANYQRENGVDEQQHTENLT

SEQ ID NO: 1710987 - protein, 7 aa, Staphylococcus aureus
GGTEMTV

SEQ ID NO: 1710988 - protein, 12 aa, Staphylococcus aureus
GGVTKKNKGAYY

SEQ ID NO: 1710989 - protein, 23 aa, Staphylococcus aureus
GHNDINNALTKEEIEQAKAQLAQ

SEQ ID NO: 1710990 - protein, 9 aa, Staphylococcus aureus
GHVNETSAA

SEQ ID NO: 1710991 - protein, 10 aa, Staphylococcus aureus
GIDEKKRKDI

SEQ ID NO: 1710992 - protein, 9 aa, Staphylococcus aureus
GIDNKEKKL

SEQ ID NO: 1710993 - protein, 13 aa, Staphylococcus aureus
GIGKEAEIKKSFE

SEQ ID NO: 1710994 - protein, 14 aa, Staphylococcus aureus
GIGKEAEVKKSFEK

SEQ ID NO: 1710995 - protein, 14 aa, Staphylococcus aureus
GIGKEAKIKKSFEK

SEQ ID NO: 1710996 - protein, 16 aa, Staphylococcus aureus
GIGNQYAVDPTSYLQS

SEQ ID NO: 1710997 - protein, 10 aa, Staphylococcus aureus
GIGSTTANKT

SEQ ID NO: 1710998 - protein, 12 aa, Staphylococcus aureus
GINTDGDALKKR

SEQ ID NO: 1710999 - protein, 12 aa, Staphylococcus aureus
GISPIPVDEESI

SEQ ID NO: 1711000 - protein, 17 aa, Staphylococcus aureus
GKDDKSKESRRQKVQKD

SEQ ID NO: 1711001 - protein, 27 aa, Staphylococcus aureus
GKDPDKKVADLTTNRKEKDSSKKNNSL

SEQ ID NO: 1711002 - protein, 18 aa, Staphylococcus aureus
GKFQSAPSIGGNGSFNYS

SEQ ID NO: 1711003 - protein, 33 aa, Staphylococcus aureus
GKIGSTWGNANNWASAAAASGYTVNNTPKAGAI

SEQ ID NO: 1711004 - protein, 33 aa, Staphylococcus aureus
GKIGSTWGNASNWANAAASSGYTVNNTPKAGAI

SEQ ID NO: 1711005 - protein, 9 aa, Staphylococcus aureus
GKISKNAVN

SEQ ID NO: 1711006 - protein, 6 aa, Staphylococcus aureus
GKKEVI

SEQ ID NO: 1711007 - protein, 7 aa, Staphylococcus aureus
GKKEVID

SEQ ID NO: 1711008 - protein, 8 aa, Staphylococcus aureus
GKLSKKNK

SEQ ID NO: 1711009 - protein, 59 aa, Staphylococcus aureus; identical to SEQ ID NO: 1562172

SEQ ID NO: 1711010 - protein, 8 aa, Staphylococcus aureus
GKSNSAVP

SEQ ID NO: 1711011 - protein, 9 aa, Staphylococcus aureus
GKSQGRDTQ

SEQ ID NO: 1711012 - protein, 17 aa, Staphylococcus aureus
GKSTKGMFDGEAPGQIG

SEQ ID NO: 1711013 - protein, 4 aa, Staphylococcus aureus
GKVE

SEQ ID NO: 1711014 - protein, 33 aa, Staphylococcus aureus
GLNNPQRQALESQINNAATRDEVAQKLAEAKAL

SEQ ID NO: 1711015 - protein, 34 aa, Staphylococcus aureus; identical to SEQ ID NO: 1565677

SEQ ID NO: 1711016 - protein, 35 aa, Staphylococcus aureus; identical to SEQ ID NO: 1566597

SEQ ID NO: 1711017 - protein, 13 aa, Staphylococcus aureus
GLRPFRNKGGHAE

SEQ ID NO: 1711018 - protein, 7 aa, Staphylococcus aureus
GLYPERK

SEQ ID NO: 1711019 - protein, 4 aa, Staphylococcus aureus
GMIP

SEQ ID NO: 1711020 - protein, 11 aa, Staphylococcus aureus
GMKEARKGVGY

SEQ ID NO: 1711021 - protein, 19 aa, Staphylococcus aureus
GNAGHEAHASESDLNKASL

SEQ ID NO: 1711022 - protein, 38 aa, Staphylococcus aureus
GNDDSKKNDSKASKKDDGIKAELKQATKAYDKYTDEQL

SEQ ID NO: 1711023 - protein, 7 aa, Staphylococcus aureus
GNDPVEN

SEQ ID NO: 1711024 - protein, 10 aa, Staphylococcus aureus
GNDQKEDKNI

SEQ ID NO: 1711025 - protein, 25 aa, Staphylococcus aureus
GNDQYDENNQDMKKKFDAKENEAKK

SEQ ID NO: 1711026 - protein, 18 aa, Staphylococcus aureus
GNFQSAPSLGGNGSFSYS

SEQ ID NO: 1711027 - protein, 24 aa, Staphylococcus aureus
GNGDKGGSDDKKITVGASPAPHAE

SEQ ID NO: 1711028 - protein, 5 aa, Staphylococcus aureus
GNGIT

SEQ ID NO: 1711029 - protein, 4 aa, Staphylococcus aureus
GNGV

SEQ ID NO: 1711030 - protein, 16 aa, Staphylococcus aureus
GNINSGYKKPNPRDYD

SEQ ID NO: 1711031 - protein, 10 aa, Staphylococcus aureus
GNKKAQPLIT

SEQ ID NO: 1711032 - protein, 9 aa, Staphylococcus aureus
GNKTEREVK

SEQ ID NO: 1711033 - protein, 7 aa, Staphylococcus aureus
GNMGSGT

SEQ ID NO: 1711034 - protein, 23 aa, Staphylococcus aureus
GNNSDKEQSKSETKGSKETVKIE

SEQ ID NO: 1711035 - protein, 6 aa, Staphylococcus aureus
GNRVTE

SEQ ID NO: 1711036 - protein, 10 aa, Staphylococcus aureus
GNSGGIVSAE

SEQ ID NO: 1711037 - protein, 27 aa, Staphylococcus aureus
GNSSSLDNQKNASNDSDSKSGRYKPKE

SEQ ID NO: 1711038 - protein, 27 aa, Staphylococcus aureus
GNSSSLDNQKNASNNSDSKSGGYKPKE

SEQ ID NO: 1711039 - protein, 33 aa, Staphylococcus aureus
GNTDNSSKKELSTKDTISVKDENGTVKVPKDAK

SEQ ID NO: 1711040 - protein, 11 aa, Staphylococcus aureus
GNTPSGEGKRG

SEQ ID NO: 1711041 - protein, 18 aa, Staphylococcus aureus
GPATTNKASYNGPKGPTG

SEQ ID NO: 1711042 - protein, 25 aa, Staphylococcus aureus
GPDFPTMEQNRPSLSDNYTQPSLTN

SEQ ID NO: 1711043 - protein, 26 aa, Staphylococcus aureus
GPDFPTMEQNRPSLSDNYTQPTTPNS

SEQ ID NO: 1711044 - protein, 15 aa, Staphylococcus aureus
GPDKDKFKEGNNPGL

SEQ ID NO: 1711045 - protein, 4 aa, Staphylococcus aureus
GPES

SEQ ID NO: 1711046 - protein, 25 aa, Staphylococcus aureus
GPNRSKEDIDKALNKDNSKDKPNQL

SEQ ID NO: 1711047 - protein, 43 aa, Staphylococcus aureus
GQADASEKENNNQQESNEKAHTEKNNAQVKNTDVKTATDKPAN

SEQ ID NO: 1711048 - protein, 43 aa, Staphylococcus aureus
GQAEASEKENNNQQESNEKAHTEKNNAQVKNTDVKTATDKPAN

SEQ ID NO: 1711049 - protein, 13 aa, Staphylococcus aureus
GQAMVTDPNYQQS

SEQ ID NO: 1711050 - protein, 11 aa, Staphylococcus aureus
GQAPNKDNTCI

SEQ ID NO: 1711051 - protein, 52 aa, Staphylococcus aureus
GQAQAAEKQVNMGNSQEDTVTARSIGDQQTRENANYQRENGVDEQQHTENLT

SEQ ID NO: 1711052 - protein, 52 aa, Staphylococcus aureus
GQAQATEKQVNMGNSQEDTVTAQSIGDQQTRENANYQRENGVDEQQHTENLT

SEQ ID NO: 1711053 - protein, 14 aa, Staphylococcus aureus
GQDFPAGNGSSAAD

SEQ ID NO: 1711054 - protein, 92 aa, Staphylococcus aureus
GQDSDQQKDGNKEKDDKAKTEQQDKKTNDSSKDKKDNKDDSKDVNKDNKDNSANDNQQQSNSNATNNDQNQTNNNQSSNNQANNNQKSSYVA

SEQ ID NO: 1711055 - protein, 86 aa, Staphylococcus aureus
GQDSDQQKDSNKEKDDKAKTEKQDKKTNDSSKDKKDNKDDSKDVNKDNKDNSANDNQQQSNSNATNNDQNQTNNNQSSNNQKSSYV

SEQ ID NO: 1711056 - protein, 87 aa, Staphylococcus aureus
GQDSDQQKDSNKEKDDKAKTEKQDKKTNDSSKDKKDNKDDSKDVNKDNKDNSANDNQQQSNSNATNNDQNQTNNNQSSNNQKSSYVA

SEQ ID NO: 1711057 - protein, 93 aa, Staphylococcus aureus
GQDSDQQKDSNKEKDDKAKTEQQDEKTNDSSKDKKDKKDDSKDVNKDNKDNSANDNQQQSNSNATNNDQNQTNNNQSSNNQANNNQKSSYVAP

SEQ ID NO: 1711058 - protein, 93 aa, Staphylococcus aureus
GQDSDQQKDSNKEKDDKAKTEQQDKKTNDSSKDKKDNKDDSKDVNKDNKDNSANDNQQQSNSNATNNDQNQTNNNQSSNNQANNNQKSSYVAP

SEQ ID NO: 1711059 - protein, 87 aa, Staphylococcus aureus
GQDSDQQKDSNKEKDDKAKTEQQDKKTNDSSKDKKDNKDDSKDVNKDNKDNSANDNQQQSNSNATNNDQNQTNNNQSSNNQKSSYVA

SEQ ID NO: 1711060 - protein, 14 aa, Staphylococcus aureus
GQGFQPPAEKDAIE

SEQ ID NO: 1711061 - protein, 16 aa, Staphylococcus aureus
GQGFQPPAEKDAIEFV

SEQ ID NO: 1711062 - protein, 14 aa, Staphylococcus aureus
GQGFQPPAEKNAIE

SEQ ID NO: 1711063 - protein, 16 aa, Staphylococcus aureus
GQGFQPPAEKNAIEFA

SEQ ID NO: 1711064 - protein, 13 aa, Staphylococcus aureus
GQKDTEEKTEMTT

SEQ ID NO: 1711065 - protein, 7 aa, Staphylococcus aureus
GQNRPVK

SEQ ID NO: 1711066 - protein, 78 aa, Staphylococcus aureus
GQQRPTSIPTLAPKEEKETNTNNANKLKSDTEAAKNDETKRSKRSKRSLNTHNHKSASQEVTAEQKADYEKRAEERKA

SEQ ID NO: 1711067 - protein, 6 aa, Staphylococcus aureus
GQSFSI

SEQ ID NO: 1711068 - protein, 8 aa, Staphylococcus aureus
GQSGVGKS

SEQ ID NO: 1711069 - protein, 4 aa, Staphylococcus aureus
GQTP

SEQ ID NO: 1711070 - protein, 13 aa, Staphylococcus aureus
GQVRNTGERVSAE

SEQ ID NO: 1711071 - protein, 15 aa, Staphylococcus aureus
GRAISRENETSHSAS

SEQ ID NO: 1711072 - protein, 5 aa, Staphylococcus aureus
GRDEG

SEQ ID NO: 1711073 - protein, 5 aa, Staphylococcus aureus
GRIHP

SEQ ID NO: 1711074 - protein, 12 aa, Staphylococcus aureus
GRQSSSNANQNF

SEQ ID NO: 1711075 - protein, 6 aa, Staphylococcus aureus
GSFENF

SEQ ID NO: 1711076 - protein, 12 aa, Staphylococcus aureus
GSGDLKGASVGY

SEQ ID NO: 1711077 - protein, 12 aa, Staphylococcus aureus
GSGNLDGSSVGY

SEQ ID NO: 1711078 - protein, 12 aa, Staphylococcus aureus
GSGNLKDSSVGY

SEQ ID NO: 1711079 - protein, 21 aa, Staphylococcus aureus
GSGNLKGSSVGYKNIEFTFVE

SEQ ID NO: 1711080 - protein, 6 aa, Staphylococcus aureus
GSIETF

SEQ ID NO: 1711081 - protein, 13 aa, Staphylococcus aureus
GSIETFDKEKNKF

SEQ ID NO: 1711082 - protein, 9 aa, Staphylococcus aureus
GSKDTANIY

SEQ ID NO: 1711083 - protein, 10 aa, Staphylococcus aureus
GSNDPINNKD

SEQ ID NO: 1711084 - protein, 5 aa, Staphylococcus aureus
GSNMS

SEQ ID NO: 1711085 - protein, 15 aa, Staphylococcus aureus
GSPRPEQLNKASEFS

SEQ ID NO: 1711086 - protein, 20 aa, Staphylococcus aureus
GSQNLAPLEEKTTDLREDNY

SEQ ID NO: 1711087 - protein, 8 aa, Staphylococcus aureus
GSSTTLDA

SEQ ID NO: 1711088 - protein, 27 aa, Staphylococcus aureus
GTFGYGPRPHFNKPAEKSDATIKKEQK

SEQ ID NO: 1711089 - protein, 16 aa, Staphylococcus aureus
GTFKYQSGPKFNTTPK

SEQ ID NO: 1711090 - protein, 16 aa, Staphylococcus aureus
GTFKYQSRPKFNTTPQ

SEQ ID NO: 1711091 - protein, 6 aa, Staphylococcus aureus
GTIAGQ

SEQ ID NO: 1711092 - protein, 4 aa, Staphylococcus aureus
GTID

SEQ ID NO: 1711093 - protein, 6 aa, Staphylococcus aureus
GTIDKT

SEQ ID NO: 1711094 - protein, 15 aa, Staphylococcus aureus
GTLTTEAHSGHAKQI

SEQ ID NO: 1711095 - protein, 25 aa, Staphylococcus aureus
GTLTTEAHSSHAKQNQESVNKHDKE

SEQ ID NO: 1711096 - protein, 7 aa, Staphylococcus aureus
GTPRSLT

SEQ ID NO: 1711097 - protein, 21 aa, Staphylococcus aureus
GTSISGDLGDAHNWNNRAQYR

SEQ ID NO: 1711098 - protein, 7 aa, Staphylococcus aureus
GTSYETG

SEQ ID NO: 1711099 - protein, 7 aa, Staphylococcus aureus
GTTTPIA

SEQ ID NO: 1711100 - protein, 22 aa, Staphylococcus aureus
GTVGGAGTGGLGGASAASVIPG

SEQ ID NO: 1711101 - protein, 9 aa, Staphylococcus aureus
GVDGKGNEL

SEQ ID NO: 1711102 - protein, 9 aa, Staphylococcus aureus
GVDNATGRI

SEQ ID NO: 1711103 - protein, 6 aa, Staphylococcus aureus
GVDRND

SEQ ID NO: 1711104 - protein, 4 aa, Staphylococcus aureus
GVGG

SEQ ID NO: 1711105 - protein, 6 aa, Staphylococcus aureus
GVKIED

SEQ ID NO: 1711106 - protein, 7 aa, Staphylococcus aureus
GVNDSRS

SEQ ID NO: 1711107 - protein, 6 aa, Staphylococcus aureus
GVNTEH

SEQ ID NO: 1711108 - protein, 16 aa, Staphylococcus aureus
GVTAANAAQHDEAQQN

SEQ ID NO: 1711109 - protein, 20 aa, Staphylococcus aureus
GVTKIGDGDVEKVAKEKRIL

SEQ ID NO: 1711110 - protein, 10 aa, Staphylococcus aureus
GVTKKNQGAY

SEQ ID NO: 1711111 - protein, 12 aa, Staphylococcus aureus
GYAASTGHEAHA

SEQ ID NO: 1711112 - protein, 7 aa, Staphylococcus aureus
GYAYNST

SEQ ID NO: 1711113 - protein, 10 aa, Staphylococcus aureus
GYGDNAKAAL

SEQ ID NO: 1711114 - protein, 5 aa, Staphylococcus aureus
GYHED

SEQ ID NO: 1711115 - protein, 36 aa, Staphylococcus aureus
GYTPTQVGSGTDEGIDSNGTSTTGVIKDKDNDTIDS

SEQ ID NO: 1711116 - protein, 16 aa, Staphylococcus aureus
HAAKYGHERYGKTYEG

SEQ ID NO: 1711117 - protein, 27 aa, Staphylococcus aureus
HAERNGSQSTTSQSNDVDKSQPSIPAQ

SEQ ID NO: 1711118 - protein, 15 aa, Staphylococcus aureus
HAQQQALTDAINAAP

SEQ ID NO: 1711119 - protein, 9 aa, Staphylococcus aureus
HAQQQTLTD

SEQ ID NO: 1711120 - protein, 6 aa, Staphylococcus aureus
HATGSI

SEQ ID NO: 1711121 - protein, 16 aa, Staphylococcus aureus
HATTPNMGQGAGQAME

SEQ ID NO: 1711122 - protein, 28 aa, Staphylococcus aureus
HDAQAAEQNNNGYNSNDAQSYSYTYTID

SEQ ID NO: 1711123 - protein, 23 aa, Staphylococcus aureus
HDAQAAEQNNNGYNSNNAQSYSY

SEQ ID NO: 1711124 - protein, 13 aa, Staphylococcus aureus
HDEFNEKDQQKKY

SEQ ID NO: 1711125 - protein, 14 aa, Staphylococcus aureus
HDFKEARKGDIKHS

SEQ ID NO: 1711126 - protein, 22 aa, Staphylococcus aureus
HDGTTFDADAVKKNIDAVQQNK

SEQ ID NO: 1711127 - protein, 36 aa, Staphylococcus aureus
HDLNQKQKDALKTQVNNAQRVSDANNVQHTATELNG

SEQ ID NO: 1711128 - protein, 37 aa, Staphylococcus aureus; identical to SEQ ID NO: 1567090

SEQ ID NO: 1711129 - protein, 30 aa, Staphylococcus aureus; identical to SEQ ID NO: 1570685

SEQ ID NO: 1711130 - protein, 113 aa, Staphylococcus aureus
HEAKAAEHTNGELNQSKNETTDSSENKTTEKVDSRQQNNIEQSTTSNQPKVNESDNTSVKETTEEPQNTTSTQPTKQNNDATANKDNLEAQNISTQAKDVSATPKTTTIKPRT

SEQ ID NO: 1711131 - protein, 142 aa, Staphylococcus aureus
HEAQASEKTPTNAAAQKETLNQPGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNGSQSTTSQSNDVDKSQPSIPAQ

SEQ ID NO: 1711132 - protein, 143 aa, Staphylococcus aureus
HEAQASEKTPTSNAAAQKETLNQPGEQGNAITSHQMQSGKQLDDMHKENGKSGTVTEGKDTLQSSKHQSTQNSKTIRTQNDNQVKQDSERQGSKHSHQNNATNNTERQNDQVQNTHHAERNGSQSTTSQSNDVDKSQPSIPAQ

SEQ ID NO: 1711133 - protein, 111 aa, Staphylococcus aureus
HEAQASEKTPTSNAAAQKETLNQSGEQGNAITSHQMQSGKQLDDMHKKNDKSGTVTEGKDTLQSSKHQSTQNSKTIRTQNDDQVKQDSERQGSKQSHQNNATNKTERQNDQ

SEQ ID NO: 1711134 - protein, 142 aa, Staphylococcus aureus
HEAQASEKTSTNAAAQKETLNQPGEQGNAITSHQMQSGKQLDDMHKENGKSGTVTEGKDTLQSSKHQSTHNSKTIRTQNDNQVKQDSERQGSKQSHQNNATNNTERQNDQVQNTHHAERNGSQSTTSQSNDVDKSQPSIPAQ

SEQ ID NO: 1711135 - protein, 6 aa, Staphylococcus aureus
HEGPDS

SEQ ID NO: 1711136 - protein, 16 aa, Staphylococcus aureus
HEIEQAEHATDEEKQV

SEQ ID NO: 1711137 - protein, 11 aa, Staphylococcus aureus
HEKDSGDTSEF

SEQ ID NO: 1711138 - protein, 12 aa, Staphylococcus aureus
HERGSSDTSEFE

SEQ ID NO: 1711139 - protein, 11 aa, Staphylococcus aureus
HESQPTKQQQT

SEQ ID NO: 1711140 - protein, 4 aa, Staphylococcus aureus
HEST

SEQ ID NO: 1711141 - protein, 6 aa, Staphylococcus aureus
HFDSQK

SEQ ID NO: 1711142 - protein, 11 aa, Staphylococcus aureus
HGAEAGANKPL

SEQ ID NO: 1711143 - protein, 13 aa, Staphylococcus aureus
HGAGAGAGANKPL

SEQ ID NO: 1711144 - protein, 5 aa, Staphylococcus aureus
HGGEI

SEQ ID NO: 1711145 - protein, 7 aa, Staphylococcus aureus
HGKKYTY

SEQ ID NO: 1711146 - protein, 14 aa, Staphylococcus aureus
HGNVQTKKVLESSN

SEQ ID NO: 1711147 - protein, 36 aa, Staphylococcus aureus
HHQDSAKKESASHKKKENDNEELNEELKEFKSKKIW

SEQ ID NO: 1711148 - protein, 26 aa, Staphylococcus aureus
HHQDSAKKESATHKKKENDNEELNEE

SEQ ID NO: 1711149 - protein, 5 aa, Staphylococcus aureus
HIAQP

SEQ ID NO: 1711150 - protein, 10 aa, Staphylococcus aureus
HKDKIAKREE

SEQ ID NO: 1711151 - protein, 10 aa, Staphylococcus aureus
HKDKIAKRSE

SEQ ID NO: 1711152 - protein, 14 aa, Staphylococcus aureus
HKNTSLKTDENKLK

SEQ ID NO: 1711153 - protein, 15 aa, Staphylococcus aureus
HKTISTNKVSTNKKL

SEQ ID NO: 1711154 - protein, 9 aa, Staphylococcus aureus
HNDDEKNVE

SEQ ID NO: 1711155 - protein, 16 aa, Staphylococcus aureus
HNDTGKGKEYGTSSKF

SEQ ID NO: 1711156 - protein, 15 aa, Staphylococcus aureus
HNKKTKDHYIETQEK

SEQ ID NO: 1711157 - protein, 33 aa, Staphylococcus aureus
HNKRNHGSTAVGKYSSFSGVARPGVQSKASAPK

SEQ ID NO: 1711158 - protein, 68 aa, Staphylococcus aureus
HNNGSIANQATPAPIQPSASPAQNNNHSDANSTATETVSNANNNDVVSNNTTLNVPNRTNENGSGGHL

SEQ ID NO: 1711159 - protein, 68 aa, Staphylococcus aureus
HNNGSIANQATPTSVQSSTPSAQNNNHTDGNTTATETVSNANNKDVVSNNTTLNVPNKTNENGSGGHL

SEQ ID NO: 1711160 - protein, 67 aa, Staphylococcus aureus
HNNGSIVNQATPTSVQSSTPSAQNNNHTDGNTTATETVSNANNNDVASNNTTLNVPNKTNENGSGGH

SEQ ID NO: 1711161 - protein, 68 aa, Staphylococcus aureus
HNNGSIVNQATPTSVQSSTPSAQNNNHTDGNTTATETVSNANNNDVVSNNTALNVPTKTNENGSGGHL

SEQ ID NO: 1711162 - protein, 5 aa, Staphylococcus aureus
HNPLD

SEQ ID NO: 1711163 - protein, 63 aa, Staphylococcus aureus
HQAQAAENTNTSDKISENQNNNATTTQPPKDTNQTQPATQPTNTAKTYPAADESLKDAIKNPA

SEQ ID NO: 1711164 - protein, 75 aa, Staphylococcus aureus
HQAQAAENTNTSDKISENQNSNATTTQPPKDTNQTQPATQPANTAKTYPAADESLKDAIKNPAVENKEHDIGPRE

SEQ ID NO: 1711165 - protein, 16 aa, Staphylococcus aureus
HQKGSMRSNDNGDDMS

SEQ ID NO: 1711166 - protein, 5 aa, Staphylococcus aureus
HQTVE

SEQ ID NO: 1711167 - protein, 6 aa, Staphylococcus aureus
HRDEVE

SEQ ID NO: 1711168 - protein, 6 aa, Staphylococcus aureus
HSNGQD

SEQ ID NO: 1711169 - protein, 135 aa, Staphylococcus aureus
HSTSSIHNNEQDNKATHQKKDTEVNHQKDENTNNTNENQNNNNGVTNGNQSSTPSTVQNNGSTAPANTQPSNPNQSNSNQSNSNQSSSNHGGSSQPSTNNQNHKQQNTPAPNKSNNANTNESSKQVSPSQPQSSK

SEQ ID NO: 1711170 - protein, 125 aa, Staphylococcus aureus
HSTSSSNNQEQENKATHKKTDTEENDQQDDSADKADKNQNNGNNVTNDNQPSLPSNVPNNHSTAPSNTQPAQPKDSNSNKNNAHGGGSQSSTNNQNNQQQNTPPANKSNNTNTPSKQTPQVQSPK

SEQ ID NO: 1711171 - protein, 125 aa, Staphylococcus aureus
HSTSSSNNQEQENKATHKKTETEENDQQDDSADKADKNQNNGNNDTNDNQPSSPSNVPNNHSTAPSNTQPAQPKDSNSNKNNTHDGGSQSSTNNQNNQQQNTPPANKSNNTNTSSKQTPQAQSPK

SEQ ID NO: 1711172 - protein, 125 aa, Staphylococcus aureus
HSTSSSNNQEQENKSTHKKTETEENDQQDDSADKTDKNQNNGNNDTNDNQPSSPSNVHNNHSTVPSNTQPAQPKDSNSNKNNTHGGGSQSSTNNQNNQQQNTPPANKSNNTNTPSKQTPQAQSPK

SEQ ID NO: 1711173 - protein, 125 aa, Staphylococcus aureus
HSTSSSNNQEQENKSTHKKTETEENDQQDDSADKTDKNQNNGNNVTNDNQPSSPSNVPNNHSTAPSNTQPAQPKDSNSNKNNTHDGGSQSSTNNQNNQQQNTPPANKSNNTNTSSKQTPQAQSPK

SEQ ID NO: 1711174 - protein, 24 aa, Staphylococcus aureus
HTEKGKGILDKEGTKVIKGKTKFA

SEQ ID NO: 1711175 - protein, 23 aa, Staphylococcus aureus
HTEKGKGILDKQGTKEITGKTKF

SEQ ID NO: 1711176 - protein, 23 aa, Staphylococcus aureus
HTEQGKGILDKQGTKEITGKTKF

SEQ ID NO: 1711177 - protein, 16 aa, Staphylococcus aureus
HTESGNSRSPVLNSNN

SEQ ID NO: 1711178 - protein, 8 aa, Staphylococcus aureus
HTNGQGKA

SEQ ID NO: 1711179 - protein, 9 aa, Staphylococcus aureus
HTRKPVISS

SEQ ID NO: 1711180 - protein, 16 aa, Staphylococcus aureus
HVTTPNMGQGAGQAME

SEQ ID NO: 1711181 - protein, 31 aa, Staphylococcus aureus
IADDGSSKNITKSVRDKIGAYESVGSRPQIW

SEQ ID NO: 1711182 - protein, 32 aa, Staphylococcus aureus
IADDGSSKNITKSVRDKIGEYESVGSRPQPNM

SEQ ID NO: 1711183 - protein, 30 aa, Staphylococcus aureus
IADDGSTKNITKSVRDKIGAYESVGSRLQP

SEQ ID NO: 1711184 - protein, 27 aa, Staphylococcus aureus
IADKADTKASGNYVNADANKRQAYDEK

SEQ ID NO: 1711185 - protein, 34 aa, Staphylococcus aureus; identical to SEQ ID NO: 1568941

SEQ ID NO: 1711186 - protein, 34 aa, Staphylococcus aureus; identical to SEQ ID NO: 1566835

SEQ ID NO: 1711187 - protein, 34 aa, Staphylococcus aureus; identical to SEQ ID NO: 1567094

SEQ ID NO: 1711188 - protein, 8 aa, Staphylococcus aureus
IADTPGFS

SEQ ID NO: 1711189 - protein, 27 aa, Staphylococcus aureus
IAELDEKKKKLTEDVNSKDTAVRGKSV

SEQ ID NO: 1711190 - protein, 11 aa, Staphylococcus aureus
IAKGEDPEKVI

SEQ ID NO: 1711191 - protein, 9 aa, Staphylococcus aureus
IAKNNGINT

SEQ ID NO: 1711192 - protein, 20 aa, Staphylococcus aureus
IANGESNSNIKAKDKKHVQV

SEQ ID NO: 1711193 - protein, 7 aa, Staphylococcus aureus
IANKPQA

SEQ ID NO: 1711194 - protein, 7 aa, Staphylococcus aureus
IAQGTFN

SEQ ID NO: 1711195 - protein, 9 aa, Staphylococcus aureus
IASGLNDSN

SEQ ID NO: 1711196 - protein, 8 aa, Staphylococcus aureus
IDANNTWK

SEQ ID NO: 1711197 - protein, 28 aa, Staphylococcus aureus
IDDENTTKQTQKYRDAEQSKKTAYDQAV

SEQ ID NO: 1711198 - protein, 8 aa, Staphylococcus aureus
IDGEGGYV

SEQ ID NO: 1711199 - protein, 8 aa, Staphylococcus aureus
IDGGGGYV

SEQ ID NO: 1711200 - protein, 10 aa, Staphylococcus aureus
IDGNENETID

SEQ ID NO: 1711201 - protein, 15 aa, Staphylococcus aureus
IDGTSIDRIEVNLTS

SEQ ID NO: 1711202 - protein, 7 aa, Staphylococcus aureus
IDKHNNN

SEQ ID NO: 1711203 - protein, 10 aa, Staphylococcus aureus
IDKTDQETVK

SEQ ID NO: 1711204 - protein, 9 aa, Staphylococcus aureus
IDKTNNETI

SEQ ID NO: 1711205 - protein, 98 aa, Staphylococcus aureus
IDNLQKENKELKDKKEKLQQEKEKLADKKKDLEKEVKDLKPSKEDNKDDKKDEDKNKDKDKEASQDKQSKDPTKSSDKDNHKKPTSTDKDQKANDKHQ

SEQ ID NO: 1711206 - protein, 102 aa, Staphylococcus aureus
IDNLQKENKELKDKKEKLQQEKEKLADKQKDLEKEVKDLKPSKEDNKDDKKDEEKNKDKDKNEDKEASQDKQSKDQTKSSDKDNHKKPTSTDKDQKANDKHQ

SEQ ID NO: 1711207 - protein, 98 aa, Staphylococcus aureus
IDNLQKENKELKDKKEKLQQEKEKLADKQKDLEKEVKDLKPSKEDNKDDKKDNKKDEDKDKEASQDKQPKDQTKSSNKDNHKKPTSTDKDQKANDKHQ

SEQ ID NO: 1711208 - protein, 47 aa, Staphylococcus aureus
IDNSKKDFKDPSVTEKLKGQVRDYKNGVAERGKATITAKAGAKAIRA

SEQ ID NO: 1711209 - protein, 7 aa, Staphylococcus aureus
IDPKHGF

SEQ ID NO: 1711210 - protein, 10 aa, Staphylococcus aureus
IDPNSKGDLA

SEQ ID NO: 1711211 - protein, 8 aa, Staphylococcus aureus
IDQQNTSI

SEQ ID NO: 1711212 - protein, 5 aa, Staphylococcus aureus
IDSDG

SEQ ID NO: 1711213 - protein, 4 aa, Staphylococcus aureus
IDSE

SEQ ID NO: 1711214 - protein, 10 aa, Staphylococcus aureus
IDSGTTVYPH

SEQ ID NO: 1711215 - protein, 12 aa, Staphylococcus aureus
IDSTEKQKAIEE

SEQ ID NO: 1711216 - protein, 15 aa, Staphylococcus aureus
IDTEGQKEVEHRKTS

SEQ ID NO: 1711217 - protein, 16 aa, Staphylococcus aureus
IDTEGQKEVENRKTSV

SEQ ID NO: 1711218 - protein, 11 aa, Staphylococcus aureus
IDTLNKADGKF

SEQ ID NO: 1711219 - protein, 30 aa, Staphylococcus aureus
IDTQTSTTGMTQDSVNAYNAKLTAARNKIQ

SEQ ID NO: 1711220 - protein, 12 aa, Staphylococcus aureus
IDYSVDKNGVAT

SEQ ID NO: 1711221 - protein, 13 aa, Staphylococcus aureus
IEATTTAQELERV

SEQ ID NO: 1711222 - protein, 16 aa, Staphylococcus aureus
IEEDTNKDKPNYQFGG

SEQ ID NO: 1711223 - protein, 16 aa, Staphylococcus aureus
IEEDTNKDKPSYQFGG

SEQ ID NO: 1711224 - protein, 7 aa, Staphylococcus aureus
IEEHNGN

SEQ ID NO: 1711225 - protein, 28 aa, Staphylococcus aureus
IEEINNKNPELKEYNNEEQTKADTELNT

SEQ ID NO: 1711226 - protein, 23 aa, Staphylococcus aureus
IEETPEQKADREFDEKLENTPTY

SEQ ID NO: 1711227 - protein, 22 aa, Staphylococcus aureus
IEETPEQKADREFDERMENTPA

SEQ ID NO: 1711228 - protein, 44 aa, Staphylococcus aureus; identical to SEQ ID NO: 1567457

SEQ ID NO: 1711229 - protein, 49 aa, Staphylococcus aureus; identical to SEQ ID NO: 1566039

SEQ ID NO: 1711230 - protein, 49 aa, Staphylococcus aureus
IEEVTNKDTAPQGVESKSEVTSNKDTIEHEASVKAEDISKKEDTPKEVA

SEQ ID NO: 1711231 - protein, 57 aa, Staphylococcus aureus
IEGNSSKLEIKPQGTESTLKGIQGESSDIEVKPQATETTEASHYPARPQFNKTPKYV

SEQ ID NO: 1711232 - protein, 7 aa, Staphylococcus aureus
IEKGTAK

SEQ ID NO: 1711233 - protein, 31 aa, Staphylococcus aureus
IENGGENTIEGTANLENISTSNNPKINPQNV

SEQ ID NO: 1711234 - protein, 7 aa, Staphylococcus aureus
IENTTGT

SEQ ID NO: 1711235 - protein, 8 aa, Staphylococcus aureus
IENYENGH

SEQ ID NO: 1711236 - protein, 5 aa, Staphylococcus aureus
IEPES

SEQ ID NO: 1711237 - protein, 9 aa, Staphylococcus aureus
IEQNANTLN

SEQ ID NO: 1711238 - protein, 12 aa, Staphylococcus aureus
IESINNQGKREL

SEQ ID NO: 1711239 - protein, 13 aa, Staphylococcus aureus
IETEENQDNTPLD

SEQ ID NO: 1711240 - protein, 47 aa, Staphylococcus aureus
IEVSSSDPYLGDDEEDEEVEETSTEEVGAEEESTEAKATYTTPRYEK

SEQ ID NO: 1711241 - protein, 9 aa, Staphylococcus aureus
IGDDQYGND

SEQ ID NO: 1711242 - protein, 29 aa, Staphylococcus aureus
IGDQTTDDGVTRIKDQGIQTLSGDTATPV

SEQ ID NO: 1711243 - protein, 48 aa, Staphylococcus aureus
IGDQTTDDGVTRIKDQGIQTLSGDTATPVVKPNAKQAIRDKAAKQREI

SEQ ID NO: 1711244 - protein, 10 aa, Staphylococcus aureus
IGGNGSFNYS

SEQ ID NO: 1711245 - protein, 9 aa, Staphylococcus aureus
IGGTTGDIE

SEQ ID NO: 1711246 - protein, 9 aa, Staphylococcus aureus
IGKSKSEQI

SEQ ID NO: 1711247 - protein, 47 aa, Staphylococcus aureus; identical to SEQ ID NO: 1638269

SEQ ID NO: 1711248 - protein, 5 aa, Staphylococcus aureus
IGTGT

SEQ ID NO: 1711249 - protein, 16 aa, Staphylococcus aureus
IIPNEEIKDEKLKKEI

SEQ ID NO: 1711250 - protein, 9 aa, Staphylococcus aureus
IKARKNPGL

SEQ ID NO: 1711251 - protein, 22 aa, Staphylococcus aureus
IKDENCKATEPTKKTIQDNSYA

SEQ ID NO: 1711252 - protein, 9 aa, Staphylococcus aureus
IKDGGSNGY

SEQ ID NO: 1711253 - protein, 5 aa, Staphylococcus aureus
IKENK

SEQ ID NO: 1711254 - protein, 6 aa, Staphylococcus aureus
IKENKA

SEQ ID NO: 1711255 - protein, 8 aa, Staphylococcus aureus
IKGSSVGY

SEQ ID NO: 1711256 - protein, 9 aa, Staphylococcus aureus
IKNNTINKA

SEQ ID NO: 1711257 - protein, 30 aa, Staphylococcus aureus
IKNNTINKAYEHKDPTNNSERRDGKVFALI

SEQ ID NO: 1711258 - protein, 30 aa, Staphylococcus aureus
IKNNTINKEYEHKDPTNDSEQRDGKVFALI

SEQ ID NO: 1711259 - protein, 24 aa, Staphylococcus aureus
IKNTDSSMNPVTTIENRKANGYTL

SEQ ID NO: 1711260 - protein, 9 aa, Staphylococcus aureus
IKPSGYQEI

SEQ ID NO: 1711261 - protein, 24 aa, Staphylococcus aureus
IKSTDSSKNPVTSVENRKANGYKL

SEQ ID NO: 1711262 - protein, 48 aa, Staphylococcus aureus; identical to SEQ ID NO: 1570826

SEQ ID NO: 1711263 - protein, 21 aa, Staphylococcus aureus
IKTTDSSKNPVTTIENRKAHG

SEQ ID NO: 1711264 - protein, 23 aa, Staphylococcus aureus
IKVGDGKDNVAAAHDGKDIEYDT

SEQ ID NO: 1711265 - protein, 14 aa, Staphylococcus aureus
INASAAEELSYITG

SEQ ID NO: 1711266 - protein, 16 aa, Staphylococcus aureus
INATPDATNDEKNAAI

SEQ ID NO: 1711267 - protein, 19 aa, Staphylococcus aureus
INATPDATNDEKNAAINTL

SEQ ID NO: 1711268 - protein, 31 aa, Staphylococcus aureus
INDYKDGDIAYNPNVPSYSAEYQLSNNDYNV

SEQ ID NO: 1711269 - protein, 31 aa, Staphylococcus aureus; identical to SEQ ID NO: 1570833

SEQ ID NO: 1711270 - protein, 32 aa, Staphylococcus aureus
INDYKDGDISYNPNVPSYSAKYQLNSDDYNVQ

SEQ ID NO: 1711271 - protein, 31 aa, Staphylococcus aureus; identical to SEQ ID NO: 1570835

SEQ ID NO: 1711272 - protein, 14 aa, Staphylococcus aureus
INGTDTNDHGDFNG

SEQ ID NO: 1711273 - protein, 34 aa, Staphylococcus aureus; identical to SEQ ID NO: 1638383

SEQ ID NO: 1711274 - protein, 19 aa, Staphylococcus aureus
INKNDGYDEPEYKEAMDTY

SEQ ID NO: 1711275 - protein, 8 aa, Staphylococcus aureus
INNDKKVT

SEQ ID NO: 1711276 - protein, 9 aa, Staphylococcus aureus
INNEDLSRN

SEQ ID NO: 1711277 - protein, 22 aa, Staphylococcus aureus
INNGVDNGDVDDALTQGKAAID

SEQ ID NO: 1711278 - protein, 22 aa, Staphylococcus aureus
INNGVDNGDVDDALTQGKATID

SEQ ID NO: 1711279 - protein, 23 aa, Staphylococcus aureus
INNGVDNSDVDDALTQGKAAIDT

SEQ ID NO: 1711280 - protein, 6 aa, Staphylococcus aureus
INPKTY

SEQ ID NO: 1711281 - protein, 21 aa, Staphylococcus aureus
INQADTNAEVDQALQAGKQAM

SEQ ID NO: 1711282 - protein, 20 aa, Staphylococcus aureus
INQADTNAEVDQAQQLGTKA

SEQ ID NO: 1711283 - protein, 18 aa, Staphylococcus aureus
INQADTNTEVDQAQQLGA

SEQ ID NO: 1711284 - protein, 34 aa, Staphylococcus aureus; identical to SEQ ID NO: 1568970

SEQ ID NO: 1711285 - protein, 14 aa, Staphylococcus aureus
INQDNYPNGGFTAE

SEQ ID NO: 1711286 - protein, 17 aa, Staphylococcus aureus
INQNQTNDQADTTTNQA

SEQ ID NO: 1711287 - protein, 18 aa, Staphylococcus aureus
INQNQTNDQVDTTTNQAL

SEQ ID NO: 1711288 - protein, 17 aa, Staphylococcus aureus
INQTNNPTLDKAQVEQL

SEQ ID NO: 1711289 - protein, 14 aa, Staphylococcus aureus
INQTSNPTMEPNTI

SEQ ID NO: 1711290 - protein, 45 aa, Staphylococcus aureus; identical to SEQ ID NO: 1638407

SEQ ID NO: 1711291 - protein, 27 aa, Staphylococcus aureus
INRGGLPGNITKESNYSETISYQQPSY

SEQ ID NO: 1711292 - protein, 21 aa, Staphylococcus aureus
INTTRPNYSKKDVIEVGVFNH

SEQ ID NO: 1711293 - protein, 23 aa, Staphylococcus aureus
IPGKEGDALRSMSNPEQFGQPSH

SEQ ID NO: 1711294 - protein, 44 aa, Staphylococcus aureus
IPNHDKAAPTSTTPPSNDKTAPKSTKAQDATTDKHPNQQDTHQP

SEQ ID NO: 1711295 - protein, 6 aa, Staphylococcus aureus
IPPYGH

SEQ ID NO: 1711296 - protein, 15 aa, Staphylococcus aureus
IPTKDIKDEKIKKEI

SEQ ID NO: 1711297 - protein, 14 aa, Staphylococcus aureus
IPTKEIKDENIKKE

SEQ ID NO: 1711298 - protein, 11 aa, Staphylococcus aureus
IPTKGIKDEHI

SEQ ID NO: 1711299 - protein, 24 aa, Staphylococcus aureus
IPTKGIKDENIKKKSRILSSSRNM

SEQ ID NO: 1711300 - protein, 12 aa, Staphylococcus aureus
IPTKPIKDEKLK

SEQ ID NO: 1711301 - protein, 6 aa, Staphylococcus aureus
IQGAET

SEQ ID NO: 1711302 - protein, 9 aa, Staphylococcus aureus
IQKKGEALN

SEQ ID NO: 1711303 - protein, 10 aa, Staphylococcus aureus
IQKKPTDLGV

SEQ ID NO: 1711304 - protein, 19 aa, Staphylococcus aureus
IQNGKERSDAYKNTLKQID

SEQ ID NO: 1711305 - protein, 4 aa, Staphylococcus aureus
IQNN

SEQ ID NO: 1711306 - protein, 95 aa, Staphylococcus aureus
IQPATTTKDDAKQAIATKANERKAAIAQTQDITAEEIEAANANVDNAVTEANSHIEAANSQNEVDQAKTTGESSIDQVTPTVNKKATARNEITTA

SEQ ID NO: 1711307 - protein, 37 aa, Staphylococcus aureus
IQPATTTKDDAKQAITTKANERKTAIAQTQDITAEEI

SEQ ID NO: 1711308 - protein, 14 aa, Staphylococcus aureus
IQQTDKAEHNVTKI

SEQ ID NO: 1711309 - protein, 22 aa, Staphylococcus aureus
IQSKNSDLQTYDKKTEDEETDK

SEQ ID NO: 1711310 - protein, 73 aa, Staphylococcus aureus
IQTQAKVKPAADTEVENAYNTRKQEIQNSNASTTEEKQAAYTELDTKKQEARTNLDAANTNSDVTTAKDNGIA

SEQ ID NO: 1711311 - protein, 73 aa, Staphylococcus aureus
IQTQARVKPAADREVDNAYNTRKQEIQNSNASTTEEKEAAYTQLDAKKQEARTNLDAANTNSAVTTAKDNGIA

SEQ ID NO: 1711312 - protein, 9 aa, Staphylococcus aureus
IRETQGNNG

SEQ ID NO: 1711313 - protein, 25 aa, Staphylococcus aureus
IRRNNPELERSLKDAKETFANRKNQ

SEQ ID NO: 1711314 - protein, 26 aa, Staphylococcus aureus
IRSNYKDANDTINKHQLSGQGGIQSD

SEQ ID NO: 1711315 - protein, 60 aa, Staphylococcus aureus
ISATPAPKQEQSQTTTESTTPKTKVTTPPSTNTPQPMQSTKSDTPQSPTTKQVPTEINPK

SEQ ID NO: 1711316 - protein, 62 aa, Staphylococcus aureus
ISATPAPKQEQSQTTTESTTQQTKMTTPPSTNTPQPMQSTKSDTPQSPTIKQAQTDMTPKYE

SEQ ID NO: 1711317 - protein, 97 aa, Staphylococcus aureus
ISDYEQPRNGEKSTNDSNKNSANSIKNDTDTQSSKQDKADNQKAPKSNNTKPSTSNKQPNSPKPTQPNQSNSQPASDDKANQKSSSKDNQSMSDSAL

SEQ ID NO: 1711318 - protein, 21 aa, Staphylococcus aureus
ISGTPNANVDPQQVAQALQQV

SEQ ID NO: 1711319 - protein, 10 aa, Staphylococcus aureus
ISGTPNATLT

SEQ ID NO: 1711320 - protein, 12 aa, Staphylococcus aureus
ISIKKETHTGNW

SEQ ID NO: 1711321 - protein, 8 aa, Staphylococcus aureus
ISKGENIE

SEQ ID NO: 1711322 - protein, 12 aa, Staphylococcus aureus
ISPKDITHITIE

SEQ ID NO: 1711323 - protein, 10 aa, Staphylococcus aureus
ISYNSEGPIY

SEQ ID NO: 1711324 - protein, 15 aa, Staphylococcus aureus
ITAHPNSDKSNGGIY

SEQ ID NO: 1711325 - protein, 8 aa, Staphylococcus aureus
ITDPSGEV

SEQ ID NO: 1711326 - protein, 27 aa, Staphylococcus aureus
ITDQAKQGITDAATTAEVEKAKAQGLE

SEQ ID NO: 1711327 - protein, 27 aa, Staphylococcus aureus
ITDQAKQGITDATKTAEVEKAKAQGLE

SEQ ID NO: 1711328 - protein, 27 aa, Staphylococcus aureus
ITDQAKQGITDATTTAEVEKAKAQGLE

SEQ ID NO: 1711329 - protein, 12 aa, Staphylococcus aureus
ITDSTQTKMDAY

SEQ ID NO: 1711330 - protein, 34 aa, Staphylococcus aureus; identical to SEQ ID NO: 1566042

SEQ ID NO: 1711331 - protein, 5 aa, Staphylococcus aureus
ITKEE

SEQ ID NO: 1711332 - protein, 10 aa, Staphylococcus aureus
ITKKGDNKLN

SEQ ID NO: 1711333 - protein, 19 aa, Staphylococcus aureus
ITNKNASTTNESGVRFELT

SEQ ID NO: 1711334 - protein, 19 aa, Staphylococcus aureus
ITNKNTSNTNESGVRFELT

SEQ ID NO: 1711335 - protein, 19 aa, Staphylococcus aureus
ITNKNTSTSNESGARYELT

SEQ ID NO: 1711336 - protein, 19 aa, Staphylococcus aureus
ITNKNTSTSNESGVRFELT

SEQ ID NO: 1711337 - protein, 14 aa, Staphylococcus aureus
ITNNPDDYVDEETY

SEQ ID NO: 1711338 - protein, 10 aa, Staphylococcus aureus
ITNPEKEKGI

SEQ ID NO: 1711339 - protein, 19 aa, Staphylococcus aureus
ITNQSVSNFKESDIHFELT

SEQ ID NO: 1711340 - protein, 72 aa, Staphylococcus aureus
ITPDANVKPAAKQAIADKVQAQETAIDGNNGSTTEEKAAAKQQVQTEKTTADAAIDAAHTNAEVEAAKKAAI

SEQ ID NO: 1711341 - protein, 55 aa, Staphylococcus aureus
ITPDANVKPQAKQAIADKVQAQETAIDANNGSTTEEKTAAKQQVQTEKTTADAAI

SEQ ID NO: 1711342 - protein, 72 aa, Staphylococcus aureus
ITPDANVKPTAKQAIADKVQAQETAIDANNGATTEEKATAKQQVQTEKATADTAIDGAHSNAEVEAAKNAEI

SEQ ID NO: 1711343 - protein, 72 aa, Staphylococcus aureus
ITPDANVKSTAKQAIADKVQAQETAIDANNGATTEEKNAAKQQVQTEKTTADAAIDGAHSNAEVEAAKNAEI

SEQ ID NO: 1711344 - protein, 21 aa, Staphylococcus aureus
ITTAETASSIKNTLSNLLSFW

SEQ ID NO: 1711345 - protein, 16 aa, Staphylococcus aureus
ITTPNTQSYKDTTNNV

SEQ ID NO: 1711346 - protein, 11 aa, Staphylococcus aureus
ITTSDVNAQET

SEQ ID NO: 1711347 - protein, 10 aa, Staphylococcus aureus
ITVKKESHIG

SEQ ID NO: 1711348 - protein, 14 aa, Staphylococcus aureus
IVKGPDYPTMENKT

SEQ ID NO: 1711349 - protein, 18 aa, Staphylococcus aureus
IVTTQSAKAEVASALKSE

SEQ ID NO: 1711350 - protein, 11 aa, Staphylococcus aureus
IVTTQSAQAEV

SEQ ID NO: 1711351 - protein, 15 aa, Staphylococcus aureus
IYENGKVNASVEPTL

SEQ ID NO: 1711352 - protein, 9 aa, Staphylococcus aureus
IYTDGQEKF

SEQ ID NO: 1711353 - protein, 8 aa, Staphylococcus aureus
KAALRSNN

SEQ ID NO: 1711354 - protein, 13 aa, Staphylococcus aureus
KAKEDAKQDVDKQ

SEQ ID NO: 1711355 - protein, 19 aa, Staphylococcus aureus
KAKTTGLITENSNDSLKEH

SEQ ID NO: 1711356 - protein, 44 aa, Staphylococcus aureus
KALKSYNDIEKDVSKNKGDKNVQSKLNQISNDIQSAHTSYKDAI

SEQ ID NO: 1711357 - protein, 11 aa, Staphylococcus aureus
KAMNKDTTVET

SEQ ID NO: 1711358 - protein, 8 aa, Staphylococcus aureus
KANATQAI

SEQ ID NO: 1711359 - protein, 6 aa, Staphylococcus aureus
KANPAA

SEQ ID NO: 1711360 - protein, 12 aa, Staphylococcus aureus
KAQETASSIKNT

SEQ ID NO: 1711361 - protein, 16 aa, Staphylococcus aureus
KAQGPNTAKDNVESAL

SEQ ID NO: 1711362 - protein, 15 aa, Staphylococcus aureus
KAQGPNTAKDNVETA

SEQ ID NO: 1711363 - protein, 15 aa, Staphylococcus aureus
KAQGPNTSKDGVETA

SEQ ID NO: 1711364 - protein, 5 aa, Staphylococcus aureus
KARKE

SEQ ID NO: 1711365 - protein, 7 aa, Staphylococcus aureus
KASAAKE

SEQ ID NO: 1711366 - protein, 15 aa, Staphylococcus aureus
KATEDISDQTTNAEI

SEQ ID NO: 1711367 - protein, 16 aa, Staphylococcus aureus
KATEDISDQTTNAEIA

SEQ ID NO: 1711368 - protein, 7 aa, Staphylococcus aureus
KAYKEAT

SEQ ID NO: 1711369 - protein, 12 aa, Staphylococcus aureus
KAYSIGQDETNI

SEQ ID NO: 1711370 - protein, 14 aa, Staphylococcus aureus
KDAEKERTYTGKTV

SEQ ID NO: 1711371 - protein, 11 aa, Staphylococcus aureus
KDAHRIGQDSD

SEQ ID NO: 1711372 - protein, 8 aa, Staphylococcus aureus
KDDGPRDY

SEQ ID NO: 1711373 - protein, 5 aa, Staphylococcus aureus
KDDKL

SEQ ID NO: 1711374 - protein, 13 aa, Staphylococcus aureus
KDDKVLKQSTINT

SEQ ID NO: 1711375 - protein, 13 aa, Staphylococcus aureus
KDDMKYKDGPYDN

SEQ ID NO: 1711376 - protein, 10 aa, Staphylococcus aureus
KDDPSQSANL

SEQ ID NO: 1711377 - protein, 39 aa, Staphylococcus aureus
KDDPSQSANVLGEAKKLNDSQAPKADAQQNDFNKDQQSA

SEQ ID NO: 1711378 - protein, 5 aa, Staphylococcus aureus
KDDSY

SEQ ID NO: 1711379 - protein, 6 aa, Staphylococcus aureus
KDEAIK

SEQ ID NO: 1711380 - protein, 8 aa, Staphylococcus aureus
KDENRETV

SEQ ID NO: 1711381 - protein, 11 aa, Staphylococcus aureus
KDGEKKEIDLG

SEQ ID NO: 1711382 - protein, 6 aa, Staphylococcus aureus
KDGETY

SEQ ID NO: 1711383 - protein, 6 aa, Staphylococcus aureus
KDGIGN

SEQ ID NO: 1711384 - protein, 14 aa, Staphylococcus aureus
KDKFSDRKNYKVEM

SEQ ID NO: 1711385 - protein, 14 aa, Staphylococcus aureus
KDKLPDRKNYKVEM

SEQ ID NO: 1711386 - protein, 6 aa, Staphylococcus aureus
KDKNYS

SEQ ID NO: 1711387 - protein, 14 aa, Staphylococcus aureus
KDLDNKSADMTRTY

SEQ ID NO: 1711388 - protein, 18 aa, Staphylococcus aureus
KDNDGKSLKESGLTLDTK

SEQ ID NO: 1711389 - protein, 12 aa, Staphylococcus aureus
KDNFKSKASQVT

SEQ ID NO: 1711390 - protein, 14 aa, Staphylococcus aureus
KDNPTSQEGRWANQ

SEQ ID NO: 1711391 - protein, 8 aa, Staphylococcus aureus
KDPKPVPY

SEQ ID NO: 1711392 - protein, 29 aa, Staphylococcus aureus
KDSKAVNDAIAKQKKERQQQIKKCYFPNL

SEQ ID NO: 1711393 - protein, 7 aa, Staphylococcus aureus
KDSPLEN

SEQ ID NO: 1711394 - protein, 47 aa, Staphylococcus aureus
KDSVADNNAIKSDQNYTDATPANKQAYDNAVNAAKGVIGETTNPTMD

SEQ ID NO: 1711395 - protein, 23 aa, Staphylococcus aureus
KDWEEKTAKDGKEIKKAIGQDAT

SEQ ID NO: 1711396 - protein, 30 aa, Staphylococcus aureus; identical to SEQ ID NO: 1638853

SEQ ID NO: 1711397 - protein, 18 aa, Staphylococcus aureus
KDYKNGDISYNPNVPSYS

SEQ ID NO: 1711398 - protein, 13 aa, Staphylococcus aureus
KDYTKNKKAAEEV

SEQ ID NO: 1711399 - protein, 15 aa, Staphylococcus aureus
KEADKNQKPYKGETV

SEQ ID NO: 1711400 - protein, 10 aa, Staphylococcus aureus
KEDKQIKENF

SEQ ID NO: 1711401 - protein, 28 aa, Staphylococcus aureus
KEEKKVEEPQSPKVDNQQDDKATQPVAQ

SEQ ID NO: 1711402 - protein, 7 aa, Staphylococcus aureus
KEEKVPE

SEQ ID NO: 1711403 - protein, 8 aa, Staphylococcus aureus
KEENRHKV

SEQ ID NO: 1711404 - protein, 10 aa, Staphylococcus aureus
KEFKSKKNME

SEQ ID NO: 1711405 - protein, 17 aa, Staphylococcus aureus
KEGFRDQEFEKGDKGTW

SEQ ID NO: 1711406 - protein, 39 aa, Staphylococcus aureus
KEGGRQIGQFSSKDNDYNPPGYSTLPTVKADENGNATIK

SEQ ID NO: 1711407 - protein, 38 aa, Staphylococcus aureus
KEGGRQIGQFSSKDNDYNQPGYSTLPTVKADENGNATI

SEQ ID NO: 1711408 - protein, 14 aa, Staphylococcus aureus
KEIEASNATDQDKL

SEQ ID NO: 1711409 - protein, 6 aa, Staphylococcus aureus
KEIEHK

SEQ ID NO: 1711410 - protein, 8 aa, Staphylococcus aureus
KEINPTYP

SEQ ID NO: 1711411 - protein, 11 aa, Staphylococcus aureus
KEIYENPKHPY

SEQ ID NO: 1711412 - protein, 12 aa, Staphylococcus aureus
KEIYENPKHPYT

SEQ ID NO: 1711413 - protein, 4 aa, Staphylococcus aureus
KEKD

SEQ ID NO: 1711414 - protein, 26 aa, Staphylococcus aureus
KEKDGSTFSKKLDDSEVKKQGKQMAS

SEQ ID NO: 1711415 - protein, 9 aa, Staphylococcus aureus
KEKDPKYKL

SEQ ID NO: 1711416 - protein, 6 aa, Staphylococcus aureus
KELEDE

SEQ ID NO: 1711417 - protein, 11 aa, Staphylococcus aureus
KELPKSENVKN

SEQ ID NO: 1711418 - protein, 12 aa, Staphylococcus aureus
KELPNTGSEEMD

SEQ ID NO: 1711419 - protein, 6 aa, Staphylococcus aureus
KELYAK

SEQ ID NO: 1711420 - protein, 6 aa, Staphylococcus aureus
KEMTDD

SEQ ID NO: 1711421 - protein, 7 aa, Staphylococcus aureus
KENGEDA

SEQ ID NO: 1711422 - protein, 9 aa, Staphylococcus aureus
KENGRNAQI

SEQ ID NO: 1711423 - protein, 31 aa, Staphylococcus aureus; identical to SEQ ID NO: 1632175

SEQ ID NO: 1711424 - protein, 9 aa, Staphylococcus aureus
KENPDKSQQ

SEQ ID NO: 1711425 - protein, 5 aa, Staphylococcus aureus
KEPNC

SEQ ID NO: 1711426 - protein, 14 aa, Staphylococcus aureus
KESDKNLTPYKAET

SEQ ID NO: 1711427 - protein, 15 aa, Staphylococcus aureus
KESDKNQTPYKAETV

SEQ ID NO: 1711428 - protein, 47 aa, Staphylococcus aureus
KESVADNNTIKSGQNYTDATPANKQAYDNAVNAAKGVIGETNNPTMD

SEQ ID NO: 1711429 - protein, 47 aa, Staphylococcus aureus
KESVADNNTIKSGQNYTDATPANKQAYDNAVNAAKGVIGETTNPTMD

SEQ ID NO: 1711430 - protein, 5 aa, Staphylococcus aureus
KETGE

SEQ ID NO: 1711431 - protein, 27 aa, Staphylococcus aureus
KEVKAKELNKDLDNKIASMKDKTKNFN

SEQ ID NO: 1711432 - protein, 10 aa, Staphylococcus aureus
KEVTGVGENY

SEQ ID NO: 1711433 - protein, 41 aa, Staphylococcus aureus; identical to SEQ ID NO: 1568129

SEQ ID NO: 1711434 - protein, 11 aa, Staphylococcus aureus
KFEATENEAKK

SEQ ID NO: 1711435 - protein, 25 aa, Staphylococcus aureus
KFQNGQKLTAEKVKSSLESSMKKSD

SEQ ID NO: 1711436 - protein, 8 aa, Staphylococcus aureus
KGERLKSR

SEQ ID NO: 1711437 - protein, 9 aa, Staphylococcus aureus
KGESFKQKS

SEQ ID NO: 1711438 - protein, 4 aa, Staphylococcus aureus
KGGI

SEQ ID NO: 1711439 - protein, 9 aa, Staphylococcus aureus
KGKEEPQNS

SEQ ID NO: 1711440 - protein, 14 aa, Staphylococcus aureus
KGKSLTSKAKLCNM

SEQ ID NO: 1711441 - protein, 4 aa, Staphylococcus aureus
KGLE

SEQ ID NO: 1711442 - protein, 16 aa, Staphylococcus aureus
KGPDYPTMENKTLQGE

SEQ ID NO: 1711443 - protein, 16 aa, Staphylococcus aureus
KGPEYPTMENKTLQGE

SEQ ID NO: 1711444 - protein, 6 aa, Staphylococcus aureus
KGQSFN

SEQ ID NO: 1711445 - protein, 5 aa, Staphylococcus aureus
KGSEF

SEQ ID NO: 1711446 - protein, 6 aa, Staphylococcus aureus
KGSEFT

SEQ ID NO: 1711447 - protein, 4 aa, Staphylococcus aureus
KGSG

SEQ ID NO: 1711448 - protein, 8 aa, Staphylococcus aureus
KGSKSGIT

SEQ ID NO: 1711449 - protein, 11 aa, Staphylococcus aureus
KGSNQNGNQPK

SEQ ID NO: 1711450 - protein, 14 aa, Staphylococcus aureus
KGSSFKQKAKPLKP

SEQ ID NO: 1711451 - protein, 35 aa, Staphylococcus aureus
KGTNRTYSNDPKQNITDSAAGGTAFNSGHKTYNGA

SEQ ID NO: 1711452 - protein, 35 aa, Staphylococcus aureus
KGTNRTYSNDPKQNITDSAAGGTSFSSGHKTYNGA

SEQ ID NO: 1711453 - protein, 6 aa, Staphylococcus aureus
KGWNGL

SEQ ID NO: 1711454 - protein, 7 aa, Staphylococcus aureus
KGYREGN

SEQ ID NO: 1711455 - protein, 12 aa, Staphylococcus aureus
KGYTTHVDNNDM

SEQ ID NO: 1711456 - protein, 19 aa, Staphylococcus aureus
KHALNGTQNLNNAKQAAIT

SEQ ID NO: 1711457 - protein, 11 aa, Staphylococcus aureus
KHEGNHFDNGK

SEQ ID NO: 1711458 - protein, 6 aa, Staphylococcus aureus
KHINDN

SEQ ID NO: 1711459 - protein, 15 aa, Staphylococcus aureus
KHKAKNLKDKVIKEN

SEQ ID NO: 1711460 - protein, 26 aa, Staphylococcus aureus
KHNEKAQNKSVNPNEYAKHKSKVDEH

SEQ ID NO: 1711461 - protein, 18 aa, Staphylococcus aureus
KHPKTTLKNDENKKKVKD

SEQ ID NO: 1711462 - protein, 18 aa, Staphylococcus aureus
KHPKTTLNTDQNKNKVKD

SEQ ID NO: 1711463 - protein, 7 aa, Staphylococcus aureus
KIAKRGE

SEQ ID NO: 1711464 - protein, 8 aa, Staphylococcus aureus
KIASPSSI

SEQ ID NO: 1711465 - protein, 23 aa, Staphylococcus aureus
KIESENPDLRPYSESEERTAYGK

SEQ ID NO: 1711466 - protein, 6 aa, Staphylococcus aureus
KIETVD

SEQ ID NO: 1711467 - protein, 6 aa, Staphylococcus aureus
KINDQE

SEQ ID NO: 1711468 - protein, 31 aa, Staphylococcus aureus
KINVKKESHTGKWSEINKSQKTEDKKDEYYE

SEQ ID NO: 1711469 - protein, 89 aa, Staphylococcus aureus
KISQPKQEAQKSLNISTTPAPKQEHSQTTTESTTQQTKVTTPPSTNTQQTKVTTPPSTNTPQPMQSTKSDTPQSPTIKQAQTDMTPKYE

SEQ ID NO: 1711470 - protein, 31 aa, Staphylococcus aureus
KITIKKESHTGKWSEINKSQKPDDKKDEYYE

SEQ ID NO: 1711471 - protein, 4 aa, Staphylococcus aureus
KITV

SEQ ID NO: 1711472 - protein, 31 aa, Staphylococcus aureus
KITVKKESHTGKWSDINKSQKDTQKTDEYYE

SEQ ID NO: 1711473 - protein, 22 aa, Staphylococcus aureus
KITVKKESHTGKWSEINKSQKK

SEQ ID NO: 1711474 - protein, 30 aa, Staphylococcus aureus
KITVKKESHTGKWSEINKSQKKMTKKMSIM

SEQ ID NO: 1711475 - protein, 31 aa, Staphylococcus aureus
KITVKKESHTGKWSEINKSQKTDDKKDEYYE

SEQ ID NO: 1711476 - protein, 7 aa, Staphylococcus aureus
KKAEVEL

SEQ ID NO: 1711477 - protein, 7 aa, Staphylococcus aureus
KKAIEEN

SEQ ID NO: 1711478 - protein, 14 aa, Staphylococcus aureus
KKAPKVNVGNLADN

SEQ ID NO: 1711479 - protein, 36 aa, Staphylococcus aureus
KKAPKVNVGSLADNKNFVASEDKLSKIADPSAASKI

SEQ ID NO: 1711480 - protein, 73 aa, Staphylococcus aureus
KKAPNNTNNDVTTKPSTSEIQTKPTTPQESTNIENSQPQPTPSKVDNQVTDATNPKQTVNVSKEDLKNDPEKL

SEQ ID NO: 1711481 - protein, 73 aa, Staphylococcus aureus; identical to SEQ ID NO: 1571045

SEQ ID NO: 1711482 - protein, 73 aa, Staphylococcus aureus; identical to SEQ ID NO: 1566625

SEQ ID NO: 1711483 - protein, 13 aa, Staphylococcus aureus
KKASANSKKPRHV

SEQ ID NO: 1711484 - protein, 14 aa, Staphylococcus aureus
KKDEDGRPQDNKIE

SEQ ID NO: 1711485 - protein, 8 aa, Staphylococcus aureus
KKDIPSAV

SEQ ID NO: 1711486 - protein, 4 aa, Staphylococcus aureus
KKDK

SEQ ID NO: 1711487 - protein, 13 aa, Staphylococcus aureus
KKDKKLSDDIQTN

SEQ ID NO: 1711488 - protein, 14 aa, Staphylococcus aureus
KKEESSKDKQIKEN

SEQ ID NO: 1711489 - protein, 15 aa, Staphylococcus aureus
KKEESSKDKQIKENL

SEQ ID NO: 1711490 - protein, 8 aa, Staphylococcus aureus
KKENGEQQ

SEQ ID NO: 1711491 - protein, 8 aa, Staphylococcus aureus
KKERPKDI

SEQ ID NO: 1711492 - protein, 5 aa, Staphylococcus aureus
KKGYK

SEQ ID NO: 1711493 - protein, 6 aa, Staphylococcus aureus
KKIESG

SEQ ID NO: 1711494 - protein, 12 aa, Staphylococcus aureus
KKIGKDQIANAS

SEQ ID NO: 1711495 - protein, 8 aa, Staphylococcus aureus
KKKAEVEL

SEQ ID NO: 1711496 - protein, 11 aa, Staphylococcus aureus
KKLGDKVTNPV

SEQ ID NO: 1711497 - protein, 22 aa, Staphylococcus aureus
KKLNDAQSPKADNKFNKEQQNA

SEQ ID NO: 1711498 - protein, 15 aa, Staphylococcus aureus
KKMTVQPDVSKSDID

SEQ ID NO: 1711499 - protein, 6 aa, Staphylococcus aureus
KKNDDI

SEQ ID NO: 1711500 - protein, 31 aa, Staphylococcus aureus
KKNEEKHSKPVEVNKAELEKESINVKTSSNL

SEQ ID NO: 1711501 - protein, 18 aa, Staphylococcus aureus
KKNKDEKSANVEKQTKAL

SEQ ID NO: 1711502 - protein, 10 aa, Staphylococcus aureus
KKNSKGRPQY

SEQ ID NO: 1711503 - protein, 18 aa, Staphylococcus aureus
KKNYTKKSNSENVIKWQK

SEQ ID NO: 1711504 - protein, 4 aa, Staphylococcus aureus
KKTL

SEQ ID NO: 1711505 - protein, 25 aa, Staphylococcus aureus
KKYKAEDQLRAGKTQYVETGKDTAT

SEQ ID NO: 1711506 - protein, 18 aa, Staphylococcus aureus
KKYKAENKYRKATGQAPI

SEQ ID NO: 1711507 - protein, 18 aa, Staphylococcus aureus
KKYKAESKYRKATGQAPV

SEQ ID NO: 1711508 - protein, 6 aa, Staphylococcus aureus
KKYNKN

SEQ ID NO: 1711509 - protein, 8 aa, Staphylococcus aureus
KLDKTAKE

SEQ ID NO: 1711510 - protein, 23 aa, Staphylococcus aureus
KLEKERMGDSIDGRQIQKILVEM

SEQ ID NO: 1711511 - protein, 23 aa, Staphylococcus aureus
KLEKERMGESIDGREIQKILVEI

SEQ ID NO: 1711512 - protein, 10 aa, Staphylococcus aureus
KLKQQADTIL

SEQ ID NO: 1711513 - protein, 4 aa, Staphylococcus aureus
KLNN

SEQ ID NO: 1711514 - protein, 15 aa, Staphylococcus aureus
KLPNGGENSIEGAAN

SEQ ID NO: 1711515 - protein, 7 aa, Staphylococcus aureus
KLQEDRM

SEQ ID NO: 1711516 - protein, 11 aa, Staphylococcus aureus
KLQQAARNRTP

SEQ ID NO: 1711517 - protein, 12 aa, Staphylococcus aureus
KLSGEKNSSYTL

SEQ ID NO: 1711518 - protein, 13 aa, Staphylococcus aureus
KLSKDELKGFNKQ

SEQ ID NO: 1711519 - protein, 9 aa, Staphylococcus aureus
KLTAARNKI

SEQ ID NO: 1711520 - protein, 24 aa, Staphylococcus aureus
KLTDTNRYVKNPRNTEIEVILEKS

SEQ ID NO: 1711521 - protein, 13 aa, Staphylococcus aureus
KLTGSKSTGVTPA

SEQ ID NO: 1711522 - protein, 8 aa, Staphylococcus aureus
KLTTNNKG

SEQ ID NO: 1711523 - protein, 11 aa, Staphylococcus aureus
KMNNSDKNVKK

SEQ ID NO: 1711524 - protein, 25 aa, Staphylococcus aureus
KMQKQAEMQNQSAQTKGVEKETKDI

SEQ ID NO: 1711525 - protein, 6 aa, Staphylococcus aureus
KMSESR

SEQ ID NO: 1711526 - protein, 10 aa, Staphylococcus aureus
KMTYGSNQSV

SEQ ID NO: 1711527 - protein, 11 aa, Staphylococcus aureus
KMTYGSNQSVN

SEQ ID NO: 1711528 - protein, 17 aa, Staphylococcus aureus
KNADDRLKEFEKEEDAI

SEQ ID NO: 1711529 - protein, 7 aa, Staphylococcus aureus
KNDKAKL

SEQ ID NO: 1711530 - protein, 13 aa, Staphylococcus aureus
KNDSHTKEMTPTA

SEQ ID NO: 1711531 - protein, 11 aa, Staphylococcus aureus
KNDSSGNSQMV

SEQ ID NO: 1711532 - protein, 9 aa, Staphylococcus aureus
KNENFSNSN

SEQ ID NO: 1711533 - protein, 15 aa, Staphylococcus aureus
KNESAEFGSSIGGEI

SEQ ID NO: 1711534 - protein, 15 aa, Staphylococcus aureus
KNESAEFSSSIGGEI

SEQ ID NO: 1711535 - protein, 33 aa, Staphylococcus aureus
KNETTGKYEQDYDAKKERYMKEHKPDYKEENLK

SEQ ID NO: 1711536 - protein, 10 aa, Staphylococcus aureus
KNFVASEDKL

SEQ ID NO: 1711537 - protein, 6 aa, Staphylococcus aureus
KNGTKK

SEQ ID NO: 1711538 - protein, 27 aa, Staphylococcus aureus
KNGYQNKDKKQLTKGQQALSKVNLNAK

SEQ ID NO: 1711539 - protein, 12 aa, Staphylococcus aureus
KNINSQLSTHVI

SEQ ID NO: 1711540 - protein, 4 aa, Staphylococcus aureus
KNKI

SEQ ID NO: 1711541 - protein, 12 aa, Staphylococcus aureus
KNKIESTNVSQT

SEQ ID NO: 1711542 - protein, 23 aa, Staphylococcus aureus
KNKKVINKKTEKEDTMNENNNFK

SEQ ID NO: 1711543 - protein, 24 aa, Staphylococcus aureus
KNKKVINKKTEKEDTVNENDNFKY

SEQ ID NO: 1711544 - protein, 113 aa, Staphylococcus aureus
KNLHNDKTISEANHRKTDDLNKDQLKDDKKSSLNNKNIQRDTTKNNNANPSDVNQGLEQAINDGKQSKVASQQQSKQADNSQDSNANNNLPSQSRTKEALPLNKSNQTSQREI

SEQ ID NO: 1711545 - protein, 113 aa, Staphylococcus aureus
KNLHNDKTISEENHRKTDDLNKDQLKDDKKSSLNNKNIQRDTTKNNNANPSDVNQGLEQAINDGKQSKVASQQQSKEADNSQDSNANNNLPSQSLTKEAPSLNKSDQTNQREI

SEQ ID NO: 1711546 - protein, 114 aa, Staphylococcus aureus
KNLHNDKTISEENHRKTDDLNKNQLKDDKKSSLNNKNIQRDTTKNNNANPSDVNQGLEQAINDGKQSKAASQQQAKEAANSQGSNANNNLPLQSRTKESTSLNKSDQKSQPEIV

SEQ ID NO: 1711547 - protein, 113 aa, Staphylococcus aureus
KNLHNDKTISEENYRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREI

SEQ ID NO: 1711548 - protein, 19 aa, Staphylococcus aureus
KNNDGKSGVLANDKTLTQQ

SEQ ID NO: 1711549 - protein, 6 aa, Staphylococcus aureus
KNNKEI

SEQ ID NO: 1711550 - protein, 9 aa, Staphylococcus aureus
KNNLQNPNE

SEQ ID NO: 1711551 - protein, 4 aa, Staphylococcus aureus
KNPA

SEQ ID NO: 1711552 - protein, 18 aa, Staphylococcus aureus
KNPAIKDKDHSAPNSRPI

SEQ ID NO: 1711553 - protein, 13 aa, Staphylococcus aureus
KNQNISYKDLEDR

SEQ ID NO: 1711554 - protein, 6 aa, Staphylococcus aureus
KNQSTE

SEQ ID NO: 1711555 - protein, 30 aa, Staphylococcus aureus; identical to SEQ ID NO: 1567532

SEQ ID NO: 1711556 - protein, 12 aa, Staphylococcus aureus
KNTDQYTKKTGI

SEQ ID NO: 1711557 - protein, 10 aa, Staphylococcus aureus
KNTFTENESA

SEQ ID NO: 1711558 - protein, 13 aa, Staphylococcus aureus
KNVTGYKYTEHGK

SEQ ID NO: 1711559 - protein, 30 aa, Staphylococcus aureus
KNYKDGDISYNPEVPSYSAKYQLTNDDYNV

SEQ ID NO: 1711560 - protein, 16 aa, Staphylococcus aureus
KNYKNGRISSNENVPY

SEQ ID NO: 1711561 - protein, 19 aa, Staphylococcus aureus
KNYQDGNITTNENVPSYEA

SEQ ID NO: 1711562 - protein, 19 aa, Staphylococcus aureus
KNYQNGDYSYNSEAPTYSA

SEQ ID NO: 1711563 - protein, 12 aa, Staphylococcus aureus
KPAALAQTNQHY

SEQ ID NO: 1711564 - protein, 17 aa, Staphylococcus aureus
KPAARQSVGVKAEAQNA

SEQ ID NO: 1711565 - protein, 6 aa, Staphylococcus aureus
KPAQVQ

SEQ ID NO: 1711566 - protein, 12 aa, Staphylococcus aureus
KPDSAEYDGKGT

SEQ ID NO: 1711567 - protein, 7 aa, Staphylococcus aureus
KPIEQQL

SEQ ID NO: 1711568 - protein, 16 aa, Staphylococcus aureus
KPITYKAGATSDSKLA

SEQ ID NO: 1711569 - protein, 12 aa, Staphylococcus aureus
KPKITSKKRKSY

SEQ ID NO: 1711570 - protein, 30 aa, Staphylococcus aureus
KPKPLAGLNGESHDFTTTHQSPTTSNHTHN

SEQ ID NO: 1711571 - protein, 7 aa, Staphylococcus aureus
KPLLEKK

SEQ ID NO: 1711572 - protein, 9 aa, Staphylococcus aureus
KPLLEKKGY

SEQ ID NO: 1711573 - protein, 10 aa, Staphylococcus aureus
KPNSKDPRDY

SEQ ID NO: 1711574 - protein, 20 aa, Staphylococcus aureus
KPSNDESKSKYAFIKSSNEP

SEQ ID NO: 1711575 - protein, 9 aa, Staphylococcus aureus
KPTQMRDGD

SEQ ID NO: 1711576 - protein, 10 aa, Staphylococcus aureus
KQAAKDEIDQ

SEQ ID NO: 1711577 - protein, 8 aa, Staphylococcus aureus
KQAPKQAV

SEQ ID NO: 1711578 - protein, 9 aa, Staphylococcus aureus
KQAPKQAVA

SEQ ID NO: 1711579 - protein, 19 aa, Staphylococcus aureus
KQEVSPQTVKVTGGEEQLN

SEQ ID NO: 1711580 - protein, 36 aa, Staphylococcus aureus; identical to SEQ ID NO: 1566866

SEQ ID NO: 1711581 - protein, 12 aa, Staphylococcus aureus
KQHGPNTAQNAV

SEQ ID NO: 1711582 - protein, 14 aa, Staphylococcus aureus
KQHGPNTAQNDVEA

SEQ ID NO: 1711583 - protein, 19 aa, Staphylococcus aureus
KQHTKSNKALNKVTNKATK

SEQ ID NO: 1711584 - protein, 17 aa, Staphylococcus aureus
KQIDNQTKVTEKQAETL

SEQ ID NO: 1711585 - protein, 18 aa, Staphylococcus aureus
KQIDSQTKVTEKQAETLS

SEQ ID NO: 1711586 - protein, 16 aa, Staphylococcus aureus
KQITSQGVTTEKDNGI

SEQ ID NO: 1711587 - protein, 11 aa, Staphylococcus aureus
KQKDVKKSKIK

SEQ ID NO: 1711588 - protein, 8 aa, Staphylococcus aureus
KQMKKEGF

SEQ ID NO: 1711589 - protein, 7 aa, Staphylococcus aureus
KQNTENI

SEQ ID NO: 1711590 - protein, 8 aa, Staphylococcus aureus
KQPKGKIM

SEQ ID NO: 1711591 - protein, 11 aa, Staphylococcus aureus
KQSNKKLNSYT

SEQ ID NO: 1711592 - protein, 12 aa, Staphylococcus aureus
KQSRYKKSAYQK

SEQ ID NO: 1711593 - protein, 8 aa, Staphylococcus aureus
KQTASVTK

SEQ ID NO: 1711594 - protein, 15 aa, Staphylococcus aureus
KQTGPNTAKTAVEQA

SEQ ID NO: 1711595 - protein, 6 aa, Staphylococcus aureus
KQVEYE

SEQ ID NO: 1711596 - protein, 13 aa, Staphylococcus aureus
KQVSTTASELNTA

SEQ ID NO: 1711597 - protein, 6 aa, Staphylococcus aureus
KQVSVG

SEQ ID NO: 1711598 - protein, 4 aa, Staphylococcus aureus
KRAT

SEQ ID NO: 1711599 - protein, 43 aa, Staphylococcus aureus
KREIDKMSEKDKKDKKANENLGLNPSHEGETDPEKIAEKSPAY

SEQ ID NO: 1711600 - protein, 5 aa, Staphylococcus aureus
KRNTI

SEQ ID NO: 1711601 - protein, 24 aa, Staphylococcus aureus
KRSPKYNPGMSDHDETDGESEDIQ

SEQ ID NO: 1711602 - protein, 24 aa, Staphylococcus aureus
KRSPKYNPGMSDQAEMDNESEDIQ

SEQ ID NO: 1711603 - protein, 70 aa, Staphylococcus aureus
KRSPKYNPGMSDQAEMDNESEDIQHHDNDNNKAIQNDIPDQKVDDKSDKNAVNKEEKHDNGTNNSEETKV

SEQ ID NO: 1711604 - protein, 24 aa, Staphylococcus aureus
KRSPKYNPGMSDQAETDNESEDIQ

SEQ ID NO: 1711605 - protein, 8 aa, Staphylococcus aureus
KRSRKIGK

SEQ ID NO: 1711606 - protein, 13 aa, Staphylococcus aureus
KRTEDVSSRKWGV

SEQ ID NO: 1711607 - protein, 14 aa, Staphylococcus aureus
KRTEGVSSKKWGVT

SEQ ID NO: 1711608 - protein, 4 aa, Staphylococcus aureus
KRVP

SEQ ID NO: 1711609 - protein, 5 aa, Staphylococcus aureus
KSAVT

SEQ ID NO: 1711610 - protein, 25 aa, Staphylococcus aureus
KSDAIKSNAETLVDNNSNSNNENNA

SEQ ID NO: 1711611 - protein, 6 aa, Staphylococcus aureus
KSENNK

SEQ ID NO: 1711612 - protein, 27 aa, Staphylococcus aureus
KSEQDFKKAKSHVDNIDNDVKRKEVKQ

SEQ ID NO: 1711613 - protein, 5 aa, Staphylococcus aureus
KSFPE

SEQ ID NO: 1711614 - protein, 10 aa, Staphylococcus aureus
KSKLDSKGLY

SEQ ID NO: 1711615 - protein, 9 aa, Staphylococcus aureus
KSKLNSKRL

SEQ ID NO: 1711616 - protein, 12 aa, Staphylococcus aureus
KSKLNSKRLSNA

SEQ ID NO: 1711617 - protein, 26 aa, Staphylococcus aureus
KSNSEFSKEMSNVKKQLKDKSKVSVT

SEQ ID NO: 1711618 - protein, 22 aa, Staphylococcus aureus
KSSVTAEKAKEDSKEDQIKKSF

SEQ ID NO: 1711619 - protein, 8 aa, Staphylococcus aureus
KSTENDEM

SEQ ID NO: 1711620 - protein, 5 aa, Staphylococcus aureus
KSTGG

SEQ ID NO: 1711621 - protein, 7 aa, Staphylococcus aureus
KSTSKSL

SEQ ID NO: 1711622 - protein, 10 aa, Staphylococcus aureus
KSVNKHDKEA

SEQ ID NO: 1711623 - protein, 6 aa, Staphylococcus aureus
KTAAQR

SEQ ID NO: 1711624 - protein, 5 aa, Staphylococcus aureus
KTDDL

SEQ ID NO: 1711625 - protein, 6 aa, Staphylococcus aureus
KTDDLE

SEQ ID NO: 1711626 - protein, 49 aa, Staphylococcus aureus
KTEDFSHRAETREEAEKKEKEFEEEYKKEQEREKEKEKQKDDDHSGLDE

SEQ ID NO: 1711627 - protein, 45 aa, Staphylococcus aureus
KTEDFSHRAETREEVEKKEKEFEEEYKKEQEREKKKKSKKMTTTV

SEQ ID NO: 1711628 - protein, 4 aa, Staphylococcus aureus
KTGE

SEQ ID NO: 1711629 - protein, 12 aa, Staphylococcus aureus
KTGKEKTTMKPN

SEQ ID NO: 1711630 - protein, 13 aa, Staphylococcus aureus
KTGTKAKADRYVP

SEQ ID NO: 1711631 - protein, 14 aa, Staphylococcus aureus
KTHTVSAHRKAQKA

SEQ ID NO: 1711632 - protein, 4 aa, Staphylococcus aureus
KTKK

SEQ ID NO: 1711633 - protein, 5 aa, Staphylococcus aureus
KTLER

SEQ ID NO: 1711634 - protein, 7 aa, Staphylococcus aureus
KTNDSNV

SEQ ID NO: 1711635 - protein, 10 aa, Staphylococcus aureus
KTNGRNAQIK

SEQ ID NO: 1711636 - protein, 4 aa, Staphylococcus aureus
KTNH

SEQ ID NO: 1711637 - protein, 6 aa, Staphylococcus aureus
KTPKYN

SEQ ID NO: 1711638 - protein, 4 aa, Staphylococcus aureus
KTPM

SEQ ID NO: 1711639 - protein, 22 aa, Staphylococcus aureus
KTSVKSDSSYKQNDYLSSYSDI

SEQ ID NO: 1711640 - protein, 6 aa, Staphylococcus aureus
KTTPTA

SEQ ID NO: 1711641 - protein, 25 aa, Staphylococcus aureus
KTVQTNGNQTITSTLNEEQTSKELD

SEQ ID NO: 1711642 - protein, 15 aa, Staphylococcus aureus
KTYSEDEEEKATKEV

SEQ ID NO: 1711643 - protein, 9 aa, Staphylococcus aureus
KVALDGDEN

SEQ ID NO: 1711644 - protein, 6 aa, Staphylococcus aureus
KVAPKA

SEQ ID NO: 1711645 - protein, 58 aa, Staphylococcus aureus; identical to SEQ ID NO: 1569132

SEQ ID NO: 1711646 - protein, 62 aa, Staphylococcus aureus
KVAQSSTTNDEQPASQNVNTKKDSATAATTQPDKEESKHKQNESQSANKNGNDNRAAHVENH

SEQ ID NO: 1711647 - protein, 5 aa, Staphylococcus aureus
KVDQV

SEQ ID NO: 1711648 - protein, 10 aa, Staphylococcus aureus
KVEDPYDYES

SEQ ID NO: 1711649 - protein, 8 aa, Staphylococcus aureus
KVHADKSG

SEQ ID NO: 1711650 - protein, 5 aa, Staphylococcus aureus
KVKER

SEQ ID NO: 1711651 - protein, 10 aa, Staphylococcus aureus
KVKKGDTMTI

SEQ ID NO: 1711652 - protein, 10 aa, Staphylococcus aureus
KVLKQSTINT

SEQ ID NO: 1711653 - protein, 9 aa, Staphylococcus aureus
KVNGKARTG

SEQ ID NO: 1711654 - protein, 5 aa, Staphylococcus aureus
KVPNI

SEQ ID NO: 1711655 - protein, 26 aa, Staphylococcus aureus
KVQANGAQRVSNAQDVQRNATELNTA

SEQ ID NO: 1711656 - protein, 46 aa, Staphylococcus aureus; identical to SEQ ID NO: 1562933

SEQ ID NO: 1711657 - protein, 50 aa, Staphylococcus aureus
KVQHDDAKEVPSKHQNQENNQDQLKKDIDDKKDSQKSDTKERRTSLFTEK

SEQ ID NO: 1711658 - protein, 13 aa, Staphylococcus aureus
KVSDYKNNKGTMG

SEQ ID NO: 1711659 - protein, 24 aa, Staphylococcus aureus
KVTGNATSSNSASATTTNRGYNTP

SEQ ID NO: 1711660 - protein, 23 aa, Staphylococcus aureus
KVTQAKNDLNGNTNLAKAKQNVQ

SEQ ID NO: 1711661 - protein, 13 aa, Staphylococcus aureus
KYAEKEYKDAVDK

SEQ ID NO: 1711662 - protein, 9 aa, Staphylococcus aureus
KYDKEIDEV

SEQ ID NO: 1711663 - protein, 9 aa, Staphylococcus aureus
KYDKEIEEV

SEQ ID NO: 1711664 - protein, 12 aa, Staphylococcus aureus
KYEDNANTVQYS

SEQ ID NO: 1711665 - protein, 9 aa, Staphylococcus aureus
KYKKGLEGQ

SEQ ID NO: 1711666 - protein, 9 aa, Staphylococcus aureus
KYKSAPSLP

SEQ ID NO: 1711667 - protein, 14 aa, Staphylococcus aureus
LADDEKKDEERADR

SEQ ID NO: 1711668 - protein, 12 aa, Staphylococcus aureus
LADEAKKDDERI

SEQ ID NO: 1711669 - protein, 35 aa, Staphylococcus aureus
LADTTTLENEEPKGTDVKKSSKTFVGGTKFDDQHA

SEQ ID NO: 1711670 - protein, 5 aa, Staphylococcus aureus
LAEDQ

SEQ ID NO: 1711671 - protein, 7 aa, Staphylococcus aureus
LAEDRKN

SEQ ID NO: 1711672 - protein, 48 aa, Staphylococcus aureus; identical to SEQ ID NO: 1568211

SEQ ID NO: 1711673 - protein, 33 aa, Staphylococcus aureus
LAGTTTLDNEEPKENKNSDKTFVGGTKFDDQHA

SEQ ID NO: 1711674 - protein, 51 aa, Staphylococcus aureus
LANGGENSIEGTANLNELSNSNNKPINSDSVKSIDLSRKNPNGDRFDANDA

SEQ ID NO: 1711675 - protein, 11 aa, Staphylococcus aureus
LANNEKRALQN

SEQ ID NO: 1711676 - protein, 33 aa, Staphylococcus aureus
LAPLQTAKTQLQNDIDQPTSTTGMTSASVASFN

SEQ ID NO: 1711677 - protein, 28 aa, Staphylococcus aureus
LAPLQTAKTQLQNDIDQPTSTTGMTSTS

SEQ ID NO: 1711678 - protein, 20 aa, Staphylococcus aureus
LARAGDYFSEAGAPASTKAF

SEQ ID NO: 1711679 - protein, 22 aa, Staphylococcus aureus
LATDETDAIDNVTNATTNADVE

SEQ ID NO: 1711680 - protein, 14 aa, Staphylococcus aureus
LATVSNGSNSANQD

SEQ ID NO: 1711681 - protein, 22 aa, Staphylococcus aureus
LDAKAQEKVTAAQQSKKVTQDE

SEQ ID NO: 1711682 - protein, 11 aa, Staphylococcus aureus
LDDETVQKFND

SEQ ID NO: 1711683 - protein, 4 aa, Staphylococcus aureus
LDET

SEQ ID NO: 1711684 - protein, 15 aa, Staphylococcus aureus
LDHDRSNAQVDKTAS

SEQ ID NO: 1711685 - protein, 19 aa, Staphylococcus aureus
LDKSEYEADPPLFFFSGRL

SEQ ID NO: 1711686 - protein, 12 aa, Staphylococcus aureus
LDKTQTNAEVDE

SEQ ID NO: 1711687 - protein, 8 aa, Staphylococcus aureus
LEADGNKL

SEQ ID NO: 1711688 - protein, 22 aa, Staphylococcus aureus
LEAKDRNDSSDPEFNKYERKKS

SEQ ID NO: 1711689 - protein, 6 aa, Staphylococcus aureus
LEEHRK

SEQ ID NO: 1711690 - protein, 46 aa, Staphylococcus aureus
LEGSSSKLEIKPQGTESTLKGIQGESSDIEVKPQATETTEASQYGL

SEQ ID NO: 1711691 - protein, 20 aa, Staphylococcus aureus
LEKNNNSQPSENGKLQTSDV

SEQ ID NO: 1711692 - protein, 7 aa, Staphylococcus aureus
LEKNRKN

SEQ ID NO: 1711693 - protein, 33 aa, Staphylococcus aureus
LENGGEGSITGTANLDELSTSNNNTVNTDSVNT

SEQ ID NO: 1711694 - protein, 15 aa, Staphylococcus aureus
LENYKEDEVSYNPEV

SEQ ID NO: 1711695 - protein, 9 aa, Staphylococcus aureus
LESKQRSEK

SEQ ID NO: 1711696 - protein, 5 aa, Staphylococcus aureus
LESQF

SEQ ID NO: 1711697 - protein, 57 aa, Staphylococcus aureus
LESSSSKLEIKPQGTESTLKGIQGESSDIEVKPQASETTEASHYPARPQFNKTPKYV

SEQ ID NO: 1711698 - protein, 5 aa, Staphylococcus aureus
LETNV

SEQ ID NO: 1711699 - protein, 4 aa, Staphylococcus aureus
LGAN

SEQ ID NO: 1711700 - protein, 6 aa, Staphylococcus aureus
LGKGNT

SEQ ID NO: 1711701 - protein, 17 aa, Staphylococcus aureus
LHGEYSKAYKNAVNSEK

SEQ ID NO: 1711702 - protein, 12 aa, Staphylococcus aureus
LHPFRNKGGHAE

SEQ ID NO: 1711703 - protein, 5 aa, Staphylococcus aureus
LHPGN

SEQ ID NO: 1711704 - protein, 10 aa, Staphylococcus aureus
LHTPPGNQNT

SEQ ID NO: 1711705 - protein, 21 aa, Staphylococcus aureus
LIQTGTNTTEDDKDADGGEVD

SEQ ID NO: 1711706 - protein, 50 aa, Staphylococcus aureus; identical to SEQ ID NO: 1632573

SEQ ID NO: 1711707 - protein, 12 aa, Staphylococcus aureus
LKDDPSVSKEIL

SEQ ID NO: 1711708 - protein, 14 aa, Staphylococcus aureus
LKDKSNKSNSYENF

SEQ ID NO: 1711709 - protein, 19 aa, Staphylococcus aureus
LKDPTNNGEQRDGKVFALI

SEQ ID NO: 1711710 - protein, 9 aa, Staphylococcus aureus
LKEVSEKYT

SEQ ID NO: 1711711 - protein, 23 aa, Staphylococcus aureus
LKKNDDAKNLIDPSTIKQIQIVV

SEQ ID NO: 1711712 - protein, 23 aa, Staphylococcus aureus
LKKNDNAKNSIDPSTIKQIQIVV

SEQ ID NO: 1711713 - protein, 32 aa, Staphylococcus aureus
LKNGGESEISGTANLDNLSNTNNSTVSTDSVN

SEQ ID NO: 1711714 - protein, 23 aa, Staphylococcus aureus
LKNGSENKISANGNSNGDFSKQN

SEQ ID NO: 1711715 - protein, 9 aa, Staphylococcus aureus
LKNSPEEDI

SEQ ID NO: 1711716 - protein, 4 aa, Staphylococcus aureus
LKPT

SEQ ID NO: 1711717 - protein, 58 aa, Staphylococcus aureus
LKTEQTPKSNIQKATTSPSSKAEATQQTPSVTTTPPPNVQPQSPTTKQAQKEINPKYK

SEQ ID NO: 1711718 - protein, 8 aa, Staphylococcus aureus
LNADQRNG

SEQ ID NO: 1711719 - protein, 8 aa, Staphylococcus aureus
LNDGNKKV

SEQ ID NO: 1711720 - protein, 8 aa, Staphylococcus aureus
LNEAQRNG

SEQ ID NO: 1711721 - protein, 12 aa, Staphylococcus aureus
LNEAQRNGFIPK

SEQ ID NO: 1711722 - protein, 18 aa, Staphylococcus aureus
LNGDQRLQDAKDKAIQSI

SEQ ID NO: 1711723 - protein, 14 aa, Staphylococcus aureus
LNKEKEGEKRLAEH

SEQ ID NO: 1711724 - protein, 6 aa, Staphylococcus aureus
LNKPNL

SEQ ID NO: 1711725 - protein, 22 aa, Staphylococcus aureus
LNNAQKAKLKEQVQSATTLEGV

SEQ ID NO: 1711726 - protein, 19 aa, Staphylococcus aureus
LNNAQQTSANAEVDQAPNL

SEQ ID NO: 1711727 - protein, 16 aa, Staphylococcus aureus
LNNAQRQNLQSQINSA

SEQ ID NO: 1711728 - protein, 20 aa, Staphylococcus aureus
LNNDSKDSKDKFNDIPKEQR

SEQ ID NO: 1711729 - protein, 9 aa, Staphylococcus aureus
LNNSDTNVK

SEQ ID NO: 1711730 - protein, 51 aa, Staphylococcus aureus; identical to SEQ ID NO: 1567575

SEQ ID NO: 1711731 - protein, 65 aa, Staphylococcus aureus; identical to SEQ ID NO: 1640306

SEQ ID NO: 1711732 - protein, 65 aa, Staphylococcus aureus
LNQAKNNLNGDNKVAKAKEAAKRALASYSNLNNAQSTAATSQIDNATTVAGVTAAQNTANELNTA

SEQ ID NO: 1711733 - protein, 85 aa, Staphylococcus aureus
LNQEDNTKNDNQKEMVSSQGNETTSNGNKLIEKESVQSTTGNKVEVSTAKSDEQASPKSTNEDLNTKQTISNQEALQPDLQENKS

SEQ ID NO: 1711734 - protein, 18 aa, Staphylococcus aureus
LNRTGTTTGKKPASIAAY

SEQ ID NO: 1711735 - protein, 12 aa, Staphylococcus aureus
LNSAKNNLDGTR

SEQ ID NO: 1711736 - protein, 6 aa, Staphylococcus aureus
LNSIET

SEQ ID NO: 1711737 - protein, 4 aa, Staphylococcus aureus
LNTA

SEQ ID NO: 1711738 - protein, 23 aa, Staphylococcus aureus
LNTKKNPDKTQIDYQTDTNQNSI

SEQ ID NO: 1711739 - protein, 15 aa, Staphylococcus aureus
LNTPQKAKLKEQVGQ

SEQ ID NO: 1711740 - protein, 19 aa, Staphylococcus aureus
LNTPQKAKLKEQVGQANRL

SEQ ID NO: 1711741 - protein, 21 aa, Staphylococcus aureus
LNTPQKAKLKEQVGQANRLED

SEQ ID NO: 1711742 - protein, 6 aa, Staphylococcus aureus
LPAQNT

SEQ ID NO: 1711743 - protein, 14 aa, Staphylococcus aureus
LPEEHGQAQGPVEE

SEQ ID NO: 1711744 - protein, 21 aa, Staphylococcus aureus
LPESNNDGELTNSKSISASPI

SEQ ID NO: 1711745 - protein, 13 aa, Staphylococcus aureus
LPGLGSKSTENDV

SEQ ID NO: 1711746 - protein, 45 aa, Staphylococcus aureus
LPNHDKAAPTSTTPPSNDKTAPKSTKAQDATTEKHPNQQDTHQPA

SEQ ID NO: 1711747 - protein, 12 aa, Staphylococcus aureus
LPQLSAGSNMQD

SEQ ID NO: 1711748 - protein, 14 aa, Staphylococcus aureus
LPSITGESTPTNPI

SEQ ID NO: 1711749 - protein, 16 aa, Staphylococcus aureus
LPTEAKADKLDAQGYD

SEQ ID NO: 1711750 - protein, 7 aa, Staphylococcus aureus
LQAARQK

SEQ ID NO: 1711751 - protein, 30 aa, Staphylococcus aureus; identical to SEQ ID NO: 1569174

SEQ ID NO: 1711752 - protein, 30 aa, Staphylococcus aureus
LQAPKTRSTTNATADAKKIRPLKANQVQPL

SEQ ID NO: 1711753 - protein, 5 aa, Staphylococcus aureus
LQEHR

SEQ ID NO: 1711754 - protein, 4 aa, Staphylococcus aureus
LQGD

SEQ ID NO: 1711755 - protein, 33 aa, Staphylococcus aureus
LQHEKETNETLSKRVQRQSKTVIADEEKQIRET

SEQ ID NO: 1711756 - protein, 13 aa, Staphylococcus aureus
LQNDKDRAKQTVS

SEQ ID NO: 1711757 - protein, 20 aa, Staphylococcus aureus
LQNEKGEVIGTTETDENGKY

SEQ ID NO: 1711758 - protein, 6 aa, Staphylococcus aureus
LQNGEK

SEQ ID NO: 1711759 - protein, 8 aa, Staphylococcus aureus
LQNNGSYS

SEQ ID NO: 1711760 - protein, 15 aa, Staphylococcus aureus
LQPNERYENLKKSEE

SEQ ID NO: 1711761 - protein, 5 aa, Staphylococcus aureus
LQQKN

SEQ ID NO: 1711762 - protein, 22 aa, Staphylococcus aureus
LQQTAKADNSVTKITNTSISPY

SEQ ID NO: 1711763 - protein, 9 aa, Staphylococcus aureus
LSDSQEKTF

SEQ ID NO: 1711764 - protein, 15 aa, Staphylococcus aureus
LSGGLNGSKSFSETI

SEQ ID NO: 1711765 - protein, 5 aa, Staphylococcus aureus
LSGQY

SEQ ID NO: 1711766 - protein, 12 aa, Staphylococcus aureus
LSITKKDEKGKI

SEQ ID NO: 1711767 - protein, 12 aa, Staphylococcus aureus
LSITKKDNQGMI

SEQ ID NO: 1711768 - protein, 11 aa, Staphylococcus aureus
LSKGKGGGNYD

SEQ ID NO: 1711769 - protein, 18 aa, Staphylococcus aureus
LSKYKDGDISYNPEAPIY

SEQ ID NO: 1711770 - protein, 15 aa, Staphylococcus aureus
LSLSDDDKKRLKISI

SEQ ID NO: 1711771 - protein, 20 aa, Staphylococcus aureus
LSLSDDGKKTSKNIDKLNSD

SEQ ID NO: 1711772 - protein, 8 aa, Staphylococcus aureus
LSNDDYNI

SEQ ID NO: 1711773 - protein, 8 aa, Staphylococcus aureus
LSNDDYNV

SEQ ID NO: 1711774 - protein, 9 aa, Staphylococcus aureus
LSNDDYNVQ

SEQ ID NO: 1711775 - protein, 4 aa, Staphylococcus aureus
LSNS

SEQ ID NO: 1711776 - protein, 10 aa, Staphylococcus aureus
LSPINDKNDL

SEQ ID NO: 1711777 - protein, 22 aa, Staphylococcus aureus
LSRASDYFSEAGATAATKAFGR

SEQ ID NO: 1711778 - protein, 8 aa, Staphylococcus aureus
LSTQTNDA

SEQ ID NO: 1711779 - protein, 14 aa, Staphylococcus aureus
LSVTSKDTQNLKTY

SEQ ID NO: 1711780 - protein, 14 aa, Staphylococcus aureus
LTDAPIDYKALKVN

SEQ ID NO: 1711781 - protein, 4 aa, Staphylococcus aureus
LTDG

SEQ ID NO: 1711782 - protein, 13 aa, Staphylococcus aureus
LTEEEGKQKIDNI

SEQ ID NO: 1711783 - protein, 10 aa, Staphylococcus aureus
LTEEKTSCLN

SEQ ID NO: 1711784 - protein, 8 aa, Staphylococcus aureus
LTEEQRNG

SEQ ID NO: 1711785 - protein, 16 aa, Staphylococcus aureus
LTENEKNKFEDGNGIQ

SEQ ID NO: 1711786 - protein, 16 aa, Staphylococcus aureus
LTGKEGDVVQPNDDVT

SEQ ID NO: 1711787 - protein, 16 aa, Staphylococcus aureus
LTGTSEDEEGKAFREN

SEQ ID NO: 1711788 - protein, 14 aa, Staphylococcus aureus
LTGTSEDKEGKVFR

SEQ ID NO: 1711789 - protein, 16 aa, Staphylococcus aureus
LTGTSEDMEGKAFREN

SEQ ID NO: 1711790 - protein, 11 aa, Staphylococcus aureus
LTIKTNSAYPE

SEQ ID NO: 1711791 - protein, 10 aa, Staphylococcus aureus
LTKDGNFYQT

SEQ ID NO: 1711792 - protein, 12 aa, Staphylococcus aureus
LTKQKNKNNTPV

SEQ ID NO: 1711793 - protein, 4 aa, Staphylococcus aureus
LTMP

SEQ ID NO: 1711794 - protein, 7 aa, Staphylococcus aureus
LTNDDYN

SEQ ID NO: 1711795 - protein, 7 aa, Staphylococcus aureus
LTNNDYN

SEQ ID NO: 1711796 - protein, 9 aa, Staphylococcus aureus
LTSKDQNTS

SEQ ID NO: 1711797 - protein, 4 aa, Staphylococcus aureus
LTTK

SEQ ID NO: 1711798 - protein, 5 aa, Staphylococcus aureus
LVDSK

SEQ ID NO: 1711799 - protein, 32 aa, Staphylococcus aureus
LVEDSSPKYVREDNGGKKKTYDGFKEQDNGKL

SEQ ID NO: 1711800 - protein, 105 aa, Staphylococcus aureus; identical to SEQ ID NO: 1571425

SEQ ID NO: 1711801 - protein, 42 aa, Staphylococcus aureus
LVKSDTNDAVVTNDQSSSDASNQTNTNTSNQNTSTTNNANNQ

SEQ ID NO: 1711802 - protein, 8 aa, Staphylococcus aureus
LYEQGGDI

SEQ ID NO: 1711803 - protein, 12 aa, Staphylococcus aureus
LYNTEPKDSKIK

SEQ ID NO: 1711804 - protein, 4 aa, Staphylococcus aureus
MAAN

SEQ ID NO: 1711805 - protein, 13 aa, Staphylococcus aureus
MASQTAGEYEGTN

SEQ ID NO: 1711806 - protein, 12 aa, Staphylococcus aureus
MKGIKDASSLDK

SEQ ID NO: 1711807 - protein, 9 aa, Staphylococcus aureus
MKKQDGDLS

SEQ ID NO: 1711808 - protein, 8 aa, Staphylococcus aureus
MKNGGKYT

SEQ ID NO: 1711809 - protein, 7 aa, Staphylococcus aureus
MKQSDQQ

SEQ ID NO: 1711810 - protein, 17 aa, Staphylococcus aureus
MNDSTTEEQQAAKDKVD

SEQ ID NO: 1711811 - protein, 11 aa, Staphylococcus aureus
MNNKDENVKQL

SEQ ID NO: 1711812 - protein, 59 aa, Staphylococcus aureus
MPAPKQEQSQTTTESTTPKTKVTTPPSTNTPQPMQSTKSDTPQSPTIKQAQTDMTPKYE

SEQ ID NO: 1711813 - protein, 16 aa, Staphylococcus aureus
MPGMKGAEAQIDDVEK

SEQ ID NO: 1711814 - protein, 14 aa, Staphylococcus aureus
MPGSHDSGSFTLTD

SEQ ID NO: 1711815 - protein, 17 aa, Staphylococcus aureus
MQPEQQKLTAKAGWAEV

SEQ ID NO: 1711816 - protein, 7 aa, Staphylococcus aureus
MRTATGH

SEQ ID NO: 1711817 - protein, 14 aa, Staphylococcus aureus
MSKSRNLLKNRSQN

SEQ ID NO: 1711818 - protein, 10 aa, Staphylococcus aureus
MSNKDENVKR

SEQ ID NO: 1711819 - protein, 16 aa, Staphylococcus aureus
MTLNSNKPTPRGPIGA

SEQ ID NO: 1711820 - protein, 8 aa, Staphylococcus aureus
MTRTDDTY

SEQ ID NO: 1711821 - protein, 7 aa, Staphylococcus aureus
NAADLSE

SEQ ID NO: 1711822 - protein, 22 aa, Staphylococcus aureus
NADGTNVQWSNGAGAGANKPLP

SEQ ID NO: 1711823 - protein, 23 aa, Staphylococcus aureus
NADIDNAAANTDVDNAKATNEAT

SEQ ID NO: 1711824 - protein, 16 aa, Staphylococcus aureus
NADPDKQNAYKQAVAK

SEQ ID NO: 1711825 - protein, 12 aa, Staphylococcus aureus
NADSINSGKLPV

SEQ ID NO: 1711826 - protein, 16 aa, Staphylococcus aureus
NADTDKQTAYTTAVNE

SEQ ID NO: 1711827 - protein, 21 aa, Staphylococcus aureus
NAEEASQKELPNQKNTKVNID

SEQ ID NO: 1711828 - protein, 4 aa, Staphylococcus aureus
NAEV

SEQ ID NO: 1711829 - protein, 5 aa, Staphylococcus aureus
NAGTY

SEQ ID NO: 1711830 - protein, 17 aa, Staphylococcus aureus
NAHAEQKSDNIGKLNTK

SEQ ID NO: 1711831 - protein, 17 aa, Staphylococcus aureus
NANAENNKPEGVNENSN

SEQ ID NO: 1711832 - protein, 73 aa, Staphylococcus aureus
NANNENKKKEDEKKSEVKKEAKKNNDKPKNEKKNQDINKNNNEQVQNVNNKQPVLNNNSNHNNQQQSNKNNYT

SEQ ID NO: 1711833 - protein, 73 aa, Staphylococcus aureus
NANNENKKKEDEKKSEVKKEATKNNDKPKNEKKNLDINKNNNEQVQNVNNKQPVLNNNSNHNNQQQSNKNNYT

SEQ ID NO: 1711834 - protein, 17 aa, Staphylococcus aureus
NANSNADVEQVKTNAIQ

SEQ ID NO: 1711835 - protein, 4 aa, Staphylococcus aureus
NAPT

SEQ ID NO: 1711836 - protein, 18 aa, Staphylococcus aureus
NAQKANLTSQIERGTTVA

SEQ ID NO: 1711837 - protein, 33 aa, Staphylococcus aureus
NAQKQDLTSQIEDATTVNGVNGVKTKAQDLDGA

SEQ ID NO: 1711838 - protein, 15 aa, Staphylococcus aureus
NAQQPERGKIYDRNG

SEQ ID NO: 1711839 - protein, 33 aa, Staphylococcus aureus
NAQRTALEGQINQATTVDGVNTVKTNANTLDDA

SEQ ID NO: 1711840 - protein, 73 aa, Staphylococcus aureus
NASNENKEFEDEKKSEVKKEAKKNNNKPKNVKKNQDINKNNNEQVQNANNNQPVLNNNSNHNNQQQSNKNNYT

SEQ ID NO: 1711841 - protein, 16 aa, Staphylococcus aureus
NASNKGAPYNLPTTPW

SEQ ID NO: 1711842 - protein, 46 aa, Staphylococcus aureus; identical to SEQ ID NO: 1640714

SEQ ID NO: 1711843 - protein, 5 aa, Staphylococcus aureus
NATNP

SEQ ID NO: 1711844 - protein, 10 aa, Staphylococcus aureus
NATNTPNMDA

SEQ ID NO: 1711845 - protein, 30 aa, Staphylococcus aureus; identical to SEQ ID NO: 1640725

SEQ ID NO: 1711846 - protein, 13 aa, Staphylococcus aureus
NAVERGANGYNFN

SEQ ID NO: 1711847 - protein, 6 aa, Staphylococcus aureus
NAVSGT

SEQ ID NO: 1711848 - protein, 11 aa, Staphylococcus aureus
NAYKNEKTKEI

SEQ ID NO: 1711849 - protein, 9 aa, Staphylococcus aureus
NDAITDTRG

SEQ ID NO: 1711850 - protein, 25 aa, Staphylococcus aureus
NDDAEAPSDFAKLSDQSDLMRAEVS

SEQ ID NO: 1711851 - protein, 45 aa, Staphylococcus aureus
NDDHPNNPDNPDNPNNPDNPNNPDQPNNPNNPDNGDNNNSDNPDA

SEQ ID NO: 1711852 - protein, 48 aa, Staphylococcus aureus
NDDNPNNPDNPNNPDNPNNPDNPNNPDQPNNPNNPDNGDNNNSDNPDA

SEQ ID NO: 1711853 - protein, 16 aa, Staphylococcus aureus
NDDQPNNPDNPDNPNN

SEQ ID NO: 1711854 - protein, 51 aa, Staphylococcus aureus
NDDQPNNPDNPDNPNNPDNPNNPDEPNNPDNPNNPDNPDNGDTNNSDNPDA

SEQ ID NO: 1711855 - protein, 63 aa, Staphylococcus aureus
NDDQPNNPDNPDNPNNPDNPNNPDNPNNPDNPNNPDEPNNPDNPNNPDNPDNGDNNNSDNPDA

SEQ ID NO: 1711856 - protein, 69 aa, Staphylococcus aureus
NDDQPNNPDNPDNPNNPDNPNNPDNPNNPDNPNNPDNPNNPDEPNNPDNPNNPDNPDNGDNNNSDNPDA

SEQ ID NO: 1711857 - protein, 48 aa, Staphylococcus aureus
NDDQPNNPDNPDNPNNPDNPNNPDNPNNPNNPDNPDNGDNNNSDNPDA

SEQ ID NO: 1711858 - protein, 39 aa, Staphylococcus aureus
NDDQPNNPDNPNNPDEPNNPDNPDNPDNGDNNNSDNPDA

SEQ ID NO: 1711859 - protein, 87 aa, Staphylococcus aureus
NDDQPNNPDNPNNPDNPNNPDNPNNPDNPDNPDQPNNPDNPDNPDQPNNPDNPDNPDQPNNPDNPNNPDNPDNPDNGDNNNSDNPDA

SEQ ID NO: 1711860 - protein, 87 aa, Staphylococcus aureus
NDDQPNNPDNPNNPDNPNNPDNPNNPDNPDNPDQPNNPDNPDNPDQPNNPDNPNNPDQPNNPDNPNNPDNPDNPDNGDNNNSDNPDA

SEQ ID NO: 1711861 - protein, 25 aa, Staphylococcus aureus
NDDVEAPSDFAKLSDQSDLMRAEVS

SEQ ID NO: 1711862 - protein, 8 aa, Staphylococcus aureus
NDEGIKKE

SEQ ID NO: 1711863 - protein, 63 aa, Staphylococcus aureus
NDIPVQKDKVQQDSNKKIENERPKASGTLKVENSPPTIKKVENNHKEQPKHKDEKYKKGKEKS

SEQ ID NO: 1711864 - protein, 24 aa, Staphylococcus aureus
NDKEFKEGMERARKEVNYAADTDA

SEQ ID NO: 1711865 - protein, 24 aa, Staphylococcus aureus
NDKEFKEGMERARKEVNYAANTDA

SEQ ID NO: 1711866 - protein, 7 aa, Staphylococcus aureus
NDKNEEF

SEQ ID NO: 1711867 - protein, 14 aa, Staphylococcus aureus
NDQNATNEEKEAAI

SEQ ID NO: 1711868 - protein, 4 aa, Staphylococcus aureus
NDSV

SEQ ID NO: 1711869 - protein, 9 aa, Staphylococcus aureus
NDSWTQNAQ

SEQ ID NO: 1711870 - protein, 17 aa, Staphylococcus aureus
NEEKKIKNADISRKSND

SEQ ID NO: 1711871 - protein, 31 aa, Staphylococcus aureus; identical to SEQ ID NO: 1566071

SEQ ID NO: 1711872 - protein, 18 aa, Staphylococcus aureus
NEIPKAKIDANKDVDKQV

SEQ ID NO: 1711873 - protein, 6 aa, Staphylococcus aureus
NEKGEF

SEQ ID NO: 1711874 - protein, 16 aa, Staphylococcus aureus
NEKKDAIYQLKKIHRF

SEQ ID NO: 1711875 - protein, 8 aa, Staphylococcus aureus
NEKKDTIY

SEQ ID NO: 1711876 - protein, 9 aa, Staphylococcus aureus
NEKTNDKTR

SEQ ID NO: 1711877 - protein, 4 aa, Staphylococcus aureus
NEKV

SEQ ID NO: 1711878 - protein, 16 aa, Staphylococcus aureus
NELSNSNNKPINTDSV

SEQ ID NO: 1711879 - protein, 8 aa, Staphylococcus aureus
NENFSNSN

SEQ ID NO: 1711880 - protein, 5 aa, Staphylococcus aureus
NENGE

SEQ ID NO: 1711881 - protein, 18 aa, Staphylococcus aureus
NENKKADFTAYATPEHNY

SEQ ID NO: 1711882 - protein, 9 aa, Staphylococcus aureus
NENNTNNRI

SEQ ID NO: 1711883 - protein, 10 aa, Staphylococcus aureus
NEPAANGASA

SEQ ID NO: 1711884 - protein, 16 aa, Staphylococcus aureus
NEQEVNPQKDEKTLSV

SEQ ID NO: 1711885 - protein, 4 aa, Staphylococcus aureus
NEQP

SEQ ID NO: 1711886 - protein, 8 aa, Staphylococcus aureus
NEQTATLD

SEQ ID NO: 1711887 - protein, 32 aa, Staphylococcus aureus
NETTGNYKEDINGKPKKFMKENKPDFKEENLK

SEQ ID NO: 1711888 - protein, 17 aa, Staphylococcus aureus
NETVESAKTEIEVHLTK

SEQ ID NO: 1711889 - protein, 6 aa, Staphylococcus aureus
NEVKAS

SEQ ID NO: 1711890 - protein, 19 aa, Staphylococcus aureus
NFLDPNKASSLLSSGFSPD

SEQ ID NO: 1711891 - protein, 5 aa, Staphylococcus aureus
NGDHN

SEQ ID NO: 1711892 - protein, 13 aa, Staphylococcus aureus
NGDHYQWNSSIYG

SEQ ID NO: 1711893 - protein, 4 aa, Staphylococcus aureus
NGDI

SEQ ID NO: 1711894 - protein, 17 aa, Staphylococcus aureus
NGEKVETVDVTSETNWK

SEQ ID NO: 1711895 - protein, 20 aa, Staphylococcus aureus
NGEKVETVDVTSETNWKYKF

SEQ ID NO: 1711896 - protein, 8 aa, Staphylococcus aureus
NGGEFRSI

SEQ ID NO: 1711897 - protein, 5 aa, Staphylococcus aureus
NGGKR

SEQ ID NO: 1711898 - protein, 30 aa, Staphylococcus aureus; identical to SEQ ID NO: 1569246

SEQ ID NO: 1711899 - protein, 36 aa, Staphylococcus aureus
NGINDETQTKQTQKYLDAEPSKKSAYDQAVNASKAI

SEQ ID NO: 1711900 - protein, 7 aa, Staphylococcus aureus
NGKKQVV

SEQ ID NO: 1711901 - protein, 7 aa, Staphylococcus aureus
NGKSGWI

SEQ ID NO: 1711902 - protein, 8 aa, Staphylococcus aureus
NGNAQHPV

SEQ ID NO: 1711903 - protein, 15 aa, Staphylococcus aureus
NGQSHTTTNNPIREE

SEQ ID NO: 1711904 - protein, 7 aa, Staphylococcus aureus
NGQTYTI

SEQ ID NO: 1711905 - protein, 4 aa, Staphylococcus aureus
NGRF

SEQ ID NO: 1711906 - protein, 7 aa, Staphylococcus aureus
NGSDIAD

SEQ ID NO: 1711907 - protein, 8 aa, Staphylococcus aureus
NGTKLSTE

SEQ ID NO: 1711908 - protein, 14 aa, Staphylococcus aureus
NGTPNANVDPQQVA

SEQ ID NO: 1711909 - protein, 6 aa, Staphylococcus aureus
NGVGTY

SEQ ID NO: 1711910 - protein, 12 aa, Staphylococcus aureus
NGVTSTAKVPPI

SEQ ID NO: 1711911 - protein, 19 aa, Staphylococcus aureus
NGYSSSVSAPGNDDGGYLT

SEQ ID NO: 1711912 - protein, 35 aa, Staphylococcus aureus
NHKDDQAGKDNQKHNNSSNQAKEIATDKNVQGDNY

SEQ ID NO: 1711913 - protein, 18 aa, Staphylococcus aureus
NHPKTTLKNDENKKKLKD

SEQ ID NO: 1711914 - protein, 17 aa, Staphylococcus aureus
NHSELRDKKVSLNDGDP

SEQ ID NO: 1711915 - protein, 36 aa, Staphylococcus aureus
NIAGNEKAQAEAGGRPNYKSSGYSQSNPTTDGQRQF

SEQ ID NO: 1711916 - protein, 21 aa, Staphylococcus aureus
NINTANTTGDVTTAKDTAVQK

SEQ ID NO: 1711917 - protein, 28 aa, Staphylococcus aureus
NISDQSHSIAKAEKNVKEITDATKAPYN

SEQ ID NO: 1711918 - protein, 28 aa, Staphylococcus aureus
NISNQPHSIAKAEKNVKEITDATKAPYN

SEQ ID NO: 1711919 - protein, 8 aa, Staphylococcus aureus
NISTEKSP

SEQ ID NO: 1711920 - protein, 8 aa, Staphylococcus aureus
NITTEKAP

SEQ ID NO: 1711921 - protein, 16 aa, Staphylococcus aureus
NIYSGYTQPTSDSSIN

SEQ ID NO: 1711922 - protein, 13 aa, Staphylococcus aureus
NKADGNGKNGQII

SEQ ID NO: 1711923 - protein, 11 aa, Staphylococcus aureus
NKALSAENAEL

SEQ ID NO: 1711924 - protein, 13 aa, Staphylococcus aureus
NKANGNGKNGPII

SEQ ID NO: 1711925 - protein, 7 aa, Staphylococcus aureus
NKANNRF

SEQ ID NO: 1711926 - protein, 19 aa, Staphylococcus aureus
NKATSNQAVSQVQTAGNHA

SEQ ID NO: 1711927 - protein, 17 aa, Staphylococcus aureus
NKAYADEIDKSKDFTRA

SEQ ID NO: 1711928 - protein, 26 aa, Staphylococcus aureus
NKDGSTVQTTNNKGGNQLDGQSKKFG

SEQ ID NO: 1711929 - protein, 16 aa, Staphylococcus aureus
NKDHGANKDKQAVEQT

SEQ ID NO: 1711930 - protein, 18 aa, Staphylococcus aureus
NKDNQQAHDYDVKDAEKL

SEQ ID NO: 1711931 - protein, 20 aa, Staphylococcus aureus
NKDSKSVNDAIAKQKKNDNN

SEQ ID NO: 1711932 - protein, 6 aa, Staphylococcus aureus
NKEEVS

SEQ ID NO: 1711933 - protein, 7 aa, Staphylococcus aureus
NKFGLRD

SEQ ID NO: 1711934 - protein, 7 aa, Staphylococcus aureus
NKGNDFV

SEQ ID NO: 1711935 - protein, 8 aa, Staphylococcus aureus
NKIESTNV

SEQ ID NO: 1711936 - protein, 12 aa, Staphylococcus aureus
NKIETTDVGQTL

SEQ ID NO: 1711937 - protein, 23 aa, Staphylococcus aureus
NKINTIKPNYNGESTSEYGVFDQ

SEQ ID NO: 1711938 - protein, 23 aa, Staphylococcus aureus
NKINTIKPNYSSKNNSEYGVFDN

SEQ ID NO: 1711939 - protein, 37 aa, Staphylococcus aureus
NKKDIKDFDDVKGKKVAQTFTSNYGKLAKDKGADITK

SEQ ID NO: 1711940 - protein, 15 aa, Staphylococcus aureus
NKKGVKRKEVTTYDG

SEQ ID NO: 1711941 - protein, 29 aa, Staphylococcus aureus
NKLKGQKIIKDGDKVTIHSKDQKDPKISG

SEQ ID NO: 1711942 - protein, 45 aa, Staphylococcus aureus
NKNNGSNLDKAAVESALSQVTNAKGALNGNHNLEQAKSNANTTIN

SEQ ID NO: 1711943 - protein, 10 aa, Staphylococcus aureus
NKNVTEEQQL

SEQ ID NO: 1711944 - protein, 4 aa, Staphylococcus aureus
NKPD

SEQ ID NO: 1711945 - protein, 5 aa, Staphylococcus aureus
NKPDH

SEQ ID NO: 1711946 - protein, 5 aa, Staphylococcus aureus
NKPNV

SEQ ID NO: 1711947 - protein, 15 aa, Staphylococcus aureus
NKQTDSNSDKAAVDR

SEQ ID NO: 1711948 - protein, 15 aa, Staphylococcus aureus
NKTAGANDNKAAVEQ

SEQ ID NO: 1711949 - protein, 7 aa, Staphylococcus aureus
NKVGEKA

SEQ ID NO: 1711950 - protein, 11 aa, Staphylococcus aureus
NKVKKGDTMTI

SEQ ID NO: 1711951 - protein, 32 aa, Staphylococcus aureus
NKVKQTKAVKTPVRKASQAKKVVKQPVQQASK

SEQ ID NO: 1711952 - protein, 22 aa, Staphylococcus aureus
NKVKQTKTVKSPVRKASQAKRV

SEQ ID NO: 1711953 - protein, 32 aa, Staphylococcus aureus
NKVKQTKVVKSPVRKASQAKKVVKQPVQQASK

SEQ ID NO: 1711954 - protein, 15 aa, Staphylococcus aureus
NLDSGKYKVIFENLL

SEQ ID NO: 1711955 - protein, 7 aa, Staphylococcus aureus
NLGANKR

SEQ ID NO: 1711956 - protein, 11 aa, Staphylococcus aureus
NLKPNTDSNAL

SEQ ID NO: 1711957 - protein, 16 aa, Staphylococcus aureus
NLNQAQRDEYNKQITQ

SEQ ID NO: 1711958 - protein, 33 aa, Staphylococcus aureus; identical to SEQ ID NO: 1566079

SEQ ID NO: 1711959 - protein, 25 aa, Staphylococcus aureus
NMKDEQKKEAQTNKTDSKEEQIKKS

SEQ ID NO: 1711960 - protein, 27 aa, Staphylococcus aureus
NMKEEQKKEANTNKTDSKEEKIKKSFA

SEQ ID NO: 1711961 - protein, 18 aa, Staphylococcus aureus
NNANTNAFRPGGAQQLNE

SEQ ID NO: 1711962 - protein, 20 aa, Staphylococcus aureus
NNAQKQDLNTQVTNAPNINT

SEQ ID NO: 1711963 - protein, 18 aa, Staphylococcus aureus
NNAQKQQLQSQIARSSDI

SEQ ID NO: 1711964 - protein, 17 aa, Staphylococcus aureus
NNAQQTSATAEVDQAQN

SEQ ID NO: 1711965 - protein, 15 aa, Staphylococcus aureus
NNDQNATNEEKAAAI

SEQ ID NO: 1711966 - protein, 15 aa, Staphylococcus aureus
NNDQNATNEEKEAAI

SEQ ID NO: 1711967 - protein, 11 aa, Staphylococcus aureus
NNDRATPQQVN

SEQ ID NO: 1711968 - protein, 13 aa, Staphylococcus aureus
NNDRATPQQVSDA

SEQ ID NO: 1711969 - protein, 15 aa, Staphylococcus aureus
NNDRHQITDTTNGHY

SEQ ID NO: 1711970 - protein, 18 aa, Staphylococcus aureus
NNDRHQITDTTNGHYAPA

SEQ ID NO: 1711971 - protein, 7 aa, Staphylococcus aureus
NNEDIAK

SEQ ID NO: 1711972 - protein, 8 aa, Staphylococcus aureus
NNEPATRR

SEQ ID NO: 1711973 - protein, 5 aa, Staphylococcus aureus
NNETQ

SEQ ID NO: 1711974 - protein, 11 aa, Staphylococcus aureus
NNGESTPSNVE

SEQ ID NO: 1711975 - protein, 22 aa, Staphylococcus aureus
NNGVEGIEDYENEVERIRKRFK

SEQ ID NO: 1711976 - protein, 22 aa, Staphylococcus aureus
NNINTSTTTGDVTTAKDAAVQK

SEQ ID NO: 1711977 - protein, 37 aa, Staphylococcus aureus; identical to SEQ ID NO: 1569280

SEQ ID NO: 1711978 - protein, 14 aa, Staphylococcus aureus
NNKQYTAEAYKKSL

SEQ ID NO: 1711979 - protein, 80 aa, Staphylococcus aureus
NNNDSEHHNDNNSSDTNTSENKDNEASNEIDEKTNTSDSADNSESSNKQNKEKNDNKKQEKNNDSNKKQQSTDKNKSYLN

SEQ ID NO: 1711980 - protein, 6 aa, Staphylococcus aureus
NNNVGG

SEQ ID NO: 1711981 - protein, 6 aa, Staphylococcus aureus
NNTGIR

SEQ ID NO: 1711982 - protein, 7 aa, Staphylococcus aureus
NNVKTDL

SEQ ID NO: 1711983 - protein, 13 aa, Staphylococcus aureus
NNYGGQDNRNNAA

SEQ ID NO: 1711984 - protein, 17 aa, Staphylococcus aureus
NNYKASDKAKDKLRKNA

SEQ ID NO: 1711985 - protein, 57 aa, Staphylococcus aureus
NNYNNGYSYNNYSRYNNYSNNNQSYNYNNYNSYNTNSYRTGGLGASYSTSSNNVQVT

SEQ ID NO: 1711986 - protein, 20 aa, Staphylococcus aureus
NPDDEETDEGIIAKWTKNKI

SEQ ID NO: 1711987 - protein, 8 aa, Staphylococcus aureus
NPETKEIK

SEQ ID NO: 1711988 - protein, 23 aa, Staphylococcus aureus
NPLKGNGELGKRSPFNDNKTRLY

SEQ ID NO: 1711989 - protein, 13 aa, Staphylococcus aureus
NPMYSYNENGTEH

SEQ ID NO: 1711990 - protein, 64 aa, Staphylococcus aureus
NPNGAQALTTDHNVQGGSNQALPGNSQNTNADTNRNIVNGSQNTPNADATDNTSTNQALTNHQN

SEQ ID NO: 1711991 - protein, 58 aa, Staphylococcus aureus
NPNGAQALTTDNNVQSDTNQAIPVNSQDTNVANNRGLANSAQNTPNQSATPNQSTNQA

SEQ ID NO: 1711992 - protein, 4 aa, Staphylococcus aureus
NPNV

SEQ ID NO: 1711993 - protein, 14 aa, Staphylococcus aureus
NPRPEQLNKASEFT

SEQ ID NO: 1711994 - protein, 6 aa, Staphylococcus aureus
NPSGDN

SEQ ID NO: 1711995 - protein, 5 aa, Staphylococcus aureus
NPSLQ

SEQ ID NO: 1711996 - protein, 14 aa, Staphylococcus aureus
NPTSTNSTSNIESK

SEQ ID NO: 1711997 - protein, 18 aa, Staphylococcus aureus
NPTSTNSTSNKESKISVT

SEQ ID NO: 1711998 - protein, 161 aa, Staphylococcus aureus
NPTTASAAEQNQPAQNQPAQPADANAQPNANAGAQANPTAQPAAPANQGQPAAQPANQGGQANPAGGAAQPAGGAAQPAAGTAQPAGQGNQADPNNAVQAQPGNQAAPANQAGQGNNQATPANQTQPANAPAAAQPAAPVAANAQTQDPNASNTGEGSINT

SEQ ID NO: 1711999 - protein, 154 aa, Staphylococcus aureus
NPTTASAAEQNQPAQNQPAQPADANAQPNANAGAQANPTAQPAAPANQGQPAAQPANQGGQANPAGGAAQPAGGAAQPAGQGNQADPNNAVQAQPGNQAAPANQAGQGNNQATPANQTQPANAPAAAQPAAPVAANAQTQDPNASNTGEGSINT

SEQ ID NO: 1712000 - protein, 166 aa, Staphylococcus aureus
NPTTASAAEQNQPAQNQPAQPADASAQPNANAGAQANPTAQPAAPANQGGQADPAANQGGQATPAAGTTQPAAGTTQPAAGTTQPAGQGNQADPNNAVQAQPGNQAAPANQAGQGNNQATPNNAAPANQTQPANAPAAAQPAAPVAANAQPQDPNANNTGEGSINT

SEQ ID NO: 1712001 - protein, 17 aa, Staphylococcus aureus
NQATTNDDVDTAKGDGL

SEQ ID NO: 1712002 - protein, 7 aa, Staphylococcus aureus
NQDAVDE

SEQ ID NO: 1712003 - protein, 103 aa, Staphylococcus aureus
NQEAKAAENTSTENAKQDDATTSDNKEVVSETENNSTTENNSTNPIKKETNTDSQPEAKEESTSSSTQKQQNNVTATTETKPQNIEKENVKPSTDKTATEDTS

SEQ ID NO: 1712004 - protein, 9 aa, Staphylococcus aureus
NQHEARENL

SEQ ID NO: 1712005 - protein, 7 aa, Staphylococcus aureus
NQKGQNH

SEQ ID NO: 1712006 - protein, 9 aa, Staphylococcus aureus
NQKRATHTS

SEQ ID NO: 1712007 - protein, 8 aa, Staphylococcus aureus
NQKSDGNY

SEQ ID NO: 1712008 - protein, 8 aa, Staphylococcus aureus
NQNRPENI

SEQ ID NO: 1712009 - protein, 10 aa, Staphylococcus aureus
NQNTGNTNEA

SEQ ID NO: 1712010 - protein, 10 aa, Staphylococcus aureus
NQPKNTYTKE

SEQ ID NO: 1712011 - protein, 32 aa, Staphylococcus aureus
NQTSDKYEEDSNIDPEKFEKDNKPVYEENNMK

SEQ ID NO: 1712012 - protein, 32 aa, Staphylococcus aureus
NQTTSPTMNPDDVNRATTQVNNTKVALDGDEN

SEQ ID NO: 1712013 - protein, 23 aa, Staphylococcus aureus
NQTTSPTMNPDEVNRATTQVNNT

SEQ ID NO: 1712014 - protein, 29 aa, Staphylococcus aureus
NQVNTTKAALNGAQNLAQAKTNATNTINN

SEQ ID NO: 1712015 - protein, 8 aa, Staphylococcus aureus
NRFAPPEE

SEQ ID NO: 1712016 - protein, 7 aa, Staphylococcus aureus
NRKTEID

SEQ ID NO: 1712017 - protein, 6 aa, Staphylococcus aureus
NRPKHI

SEQ ID NO: 1712018 - protein, 4 aa, Staphylococcus aureus
NRPL

SEQ ID NO: 1712019 - protein, 5 aa, Staphylococcus aureus
NRPQH

SEQ ID NO: 1712020 - protein, 5 aa, Staphylococcus aureus
NRSGQ

SEQ ID NO: 1712021 - protein, 13 aa, Staphylococcus aureus
NRVSQADIDSLTN

SEQ ID NO: 1712022 - protein, 74 aa, Staphylococcus aureus; identical to SEQ ID NO: 1571704

SEQ ID NO: 1712023 - protein, 19 aa, Staphylococcus aureus
NSANNEANKFGSNNKVYND

SEQ ID NO: 1712024 - protein, 10 aa, Staphylococcus aureus
NSDNTNVNDI

SEQ ID NO: 1712025 - protein, 7 aa, Staphylococcus aureus
NSDRARE

SEQ ID NO: 1712026 - protein, 4 aa, Staphylococcus aureus
NSGK

SEQ ID NO: 1712027 - protein, 34 aa, Staphylococcus aureus; identical to SEQ ID NO: 1567180

SEQ ID NO: 1712028 - protein, 35 aa, Staphylococcus aureus
NSIANKDEVKASQPYVDADRDKQNAYNTAVTSAEN

SEQ ID NO: 1712029 - protein, 46 aa, Staphylococcus aureus
NSIQDNAATKNGQNYLDATESNKTNYNNAVDSANGVINATSNPNMD

SEQ ID NO: 1712030 - protein, 47 aa, Staphylococcus aureus; identical to SEQ ID NO: 1641506

SEQ ID NO: 1712031 - protein, 47 aa, Staphylococcus aureus; identical to SEQ ID NO: 1571712

SEQ ID NO: 1712032 - protein, 13 aa, Staphylococcus aureus
NSPAESHTVRTNP

SEQ ID NO: 1712033 - protein, 37 aa, Staphylococcus aureus
NSPKSYQESKYEGEPAQHSQLHENENVANELIDFLWK

SEQ ID NO: 1712034 - protein, 5 aa, Staphylococcus aureus
NSQDH

SEQ ID NO: 1712035 - protein, 27 aa, Staphylococcus aureus
NSSNDLNQAQKDALKQQVQNATTVAGV

SEQ ID NO: 1712036 - protein, 8 aa, Staphylococcus aureus
NSSPYESG

SEQ ID NO: 1712037 - protein, 8 aa, Staphylococcus aureus
NSTGMQGW

SEQ ID NO: 1712038 - protein, 7 aa, Staphylococcus aureus
NSTVTAE

SEQ ID NO: 1712039 - protein, 11 aa, Staphylococcus aureus
NSVKQTAQELN

SEQ ID NO: 1712040 - protein, 21 aa, Staphylococcus aureus
NSVKSDSSYGQNDTLSSYSDI

SEQ ID NO: 1712041 - protein, 9 aa, Staphylococcus aureus
NTDEGSRRL

SEQ ID NO: 1712042 - protein, 32 aa, Staphylococcus aureus
NTDKNNHTGKAAKLDGVRQNYNNTDKVTEQKN

SEQ ID NO: 1712043 - protein, 38 aa, Staphylococcus aureus
NTIKPNSAITITPKAGTGHSASSNPSTLTAPATHTVNK

SEQ ID NO: 1712044 - protein, 38 aa, Staphylococcus aureus
NTIKPNSAITNTPKAGTGHSASSNPSTLTAPATHTVNK

SEQ ID NO: 1712045 - protein, 39 aa, Staphylococcus aureus
NTIKPNSSINITPKAGTGLSASSNPSTLTAPAAHTVNTT

SEQ ID NO: 1712046 - protein, 9 aa, Staphylococcus aureus
NTKDDVKAT

SEQ ID NO: 1712047 - protein, 21 aa, Staphylococcus aureus
NTKDVDALKDKNKVHDTYKYA

SEQ ID NO: 1712048 - protein, 8 aa, Staphylococcus aureus
NTKEPNTI

SEQ ID NO: 1712049 - protein, 4 aa, Staphylococcus aureus
NTLE

SEQ ID NO: 1712050 - protein, 8 aa, Staphylococcus aureus
NTNGSYDD

SEQ ID NO: 1712051 - protein, 34 aa, Staphylococcus aureus; identical to SEQ ID NO: 1571737

SEQ ID NO: 1712052 - protein, 35 aa, Staphylococcus aureus
NTPQKTALKQQVNAAQRVSGVTDLKNSATSLNSAM

SEQ ID NO: 1712053 - protein, 10 aa, Staphylococcus aureus
NTRHSESNKN

SEQ ID NO: 1712054 - protein, 7 aa, Staphylococcus aureus
NTRSAKG

SEQ ID NO: 1712055 - protein, 7 aa, Staphylococcus aureus
NTRTATG

SEQ ID NO: 1712056 - protein, 8 aa, Staphylococcus aureus
NTRTATGY

SEQ ID NO: 1712057 - protein, 7 aa, Staphylococcus aureus
NTTYGSV

SEQ ID NO: 1712058 - protein, 11 aa, Staphylococcus aureus
NTYEPGSTFKS

SEQ ID NO: 1712059 - protein, 18 aa, Staphylococcus aureus
NVASKPAQVQKSVANRGN

SEQ ID NO: 1712060 - protein, 27 aa, Staphylococcus aureus
NVNSTKTALNGDAKLNEAKAAAKQTLG

SEQ ID NO: 1712061 - protein, 18 aa, Staphylococcus aureus
NVNTHGVSTARKVPDIKN

SEQ ID NO: 1712062 - protein, 18 aa, Staphylococcus aureus
NVNTHGVSTARKVPEIKN

SEQ ID NO: 1712063 - protein, 28 aa, Staphylococcus aureus
NVQRAKNELNGNQNVANAKTTAKNALNN

SEQ ID NO: 1712064 - protein, 18 aa, Staphylococcus aureus
NVQSVQAKTEVKQQSEAD

SEQ ID NO: 1712065 - protein, 20 aa, Staphylococcus aureus
NVQSVQAKTEVKQQSESELK

SEQ ID NO: 1712066 - protein, 12 aa, Staphylococcus aureus
NVTPTNDQLTDV

SEQ ID NO: 1712067 - protein, 13 aa, Staphylococcus aureus
NWGPYDRDSWNPV

SEQ ID NO: 1712068 - protein, 29 aa, Staphylococcus aureus
NWKGTNTKDKWTDRSSERYKIDWENEEMT

SEQ ID NO: 1712069 - protein, 17 aa, Staphylococcus aureus
NYGGSGALRKQIESGAP

SEQ ID NO: 1712070 - protein, 10 aa, Staphylococcus aureus
NYKARGVNEY

SEQ ID NO: 1712071 - protein, 27 aa, Staphylococcus aureus
NYKASDKTKDKLRKNSIKQFDPKTGEV

SEQ ID NO: 1712072 - protein, 12 aa, Staphylococcus aureus
NYKDENRATHTS

SEQ ID NO: 1712073 - protein, 18 aa, Staphylococcus aureus
NYKDGDYSYNSEAPTYSA

SEQ ID NO: 1712074 - protein, 8 aa, Staphylococcus aureus
NYKDTHSY

SEQ ID NO: 1712075 - protein, 36 aa, Staphylococcus aureus
NYKDTHSYKDRLNAQQKVNKGHQKRFNKQINKVYNG

SEQ ID NO: 1712076 - protein, 18 aa, Staphylococcus aureus
NYKNGNISSTDNVPSYDA

SEQ ID NO: 1712077 - protein, 9 aa, Staphylococcus aureus
NYKQSRKIS

SEQ ID NO: 1712078 - protein, 64 aa, Staphylococcus aureus
NYNYNNYNNYNNGYSYNKYSRYNNYSNSNQSYNYNNYNSYNTNSYRTGGLGASYSTSSNNVQVT

SEQ ID NO: 1712079 - protein, 12 aa, Staphylococcus aureus
NYSDSAKTFDIN

SEQ ID NO: 1712080 - protein, 7 aa, Staphylococcus aureus
NYSDSTK

SEQ ID NO: 1712081 - protein, 11 aa, Staphylococcus aureus
NYSDSTKSFDI

SEQ ID NO: 1712082 - protein, 11 aa, Staphylococcus aureus
NYSDSTQTFDI

SEQ ID NO: 1712083 - protein, 6 aa, Staphylococcus aureus
PADVYY

SEQ ID NO: 1712084 - protein, 17 aa, Staphylococcus aureus
PAEETKVSPKEIQPAPK

SEQ ID NO: 1712085 - protein, 5 aa, Staphylococcus aureus
PAEQG

SEQ ID NO: 1712086 - protein, 24 aa, Staphylococcus aureus
PAGLKQTGTNTTEDDKDADGGEVD

SEQ ID NO: 1712087 - protein, 24 aa, Staphylococcus aureus
PAGLTQTGTNTTDDDKDADGGEVD

SEQ ID NO: 1712088 - protein, 20 aa, Staphylococcus aureus
PAQELKSPDDIKKELNKKKS

SEQ ID NO: 1712089 - protein, 21 aa, Staphylococcus aureus
PATQVKTDARNTVNEKAREAI

SEQ ID NO: 1712090 - protein, 8 aa, Staphylococcus aureus
PDDEEDAL

SEQ ID NO: 1712091 - protein, 9 aa, Staphylococcus aureus
PDDSPISNR

SEQ ID NO: 1712092 - protein, 23 aa, Staphylococcus aureus
PDFPTMEQNRPSLSDNYTQPSVT

SEQ ID NO: 1712093 - protein, 24 aa, Staphylococcus aureus
PDFPTMEQSGPSLSNNYTNPPLTN

SEQ ID NO: 1712094 - protein, 9 aa, Staphylococcus aureus
PDGHGNAET

SEQ ID NO: 1712095 - protein, 8 aa, Staphylococcus aureus
PDLPKSDQ

SEQ ID NO: 1712096 - protein, 7 aa, Staphylococcus aureus
PDSQLNK

SEQ ID NO: 1712097 - protein, 10 aa, Staphylococcus aureus
PDVNSGGTIG

SEQ ID NO: 1712098 - protein, 63 aa, Staphylococcus aureus
PEAQEAIKASADNQVESIKDTPHATTDELDEANQQINDTLKQGQQNIDNTTQDAAVNDVRNQT

SEQ ID NO: 1712099 - protein, 4 aa, Staphylococcus aureus
PEEF

SEQ ID NO: 1712100 - protein, 15 aa, Staphylococcus aureus
PEEHGQAQGPIEEIT

SEQ ID NO: 1712101 - protein, 12 aa, Staphylococcus aureus
PEEIEKRLSQKK

SEQ ID NO: 1712102 - protein, 5 aa, Staphylococcus aureus
PEEME

SEQ ID NO: 1712103 - protein, 12 aa, Staphylococcus aureus
PEGLEGTREVSQ

SEQ ID NO: 1712104 - protein, 8 aa, Staphylococcus aureus
PEGTGRSA

SEQ ID NO: 1712105 - protein, 4 aa, Staphylococcus aureus
PEIK

SEQ ID NO: 1712106 - protein, 12 aa, Staphylococcus aureus
PFKHTQDKATLS

SEQ ID NO: 1712107 - protein, 11 aa, Staphylococcus aureus
PFKTTQDNATL

SEQ ID NO: 1712108 - protein, 19 aa, Staphylococcus aureus
PFQGSKATTNAEDIGDDAE

SEQ ID NO: 1712109 - protein, 4 aa, Staphylococcus aureus
PFSK

SEQ ID NO: 1712110 - protein, 8 aa, Staphylococcus aureus
PFTTPEGK

SEQ ID NO: 1712111 - protein, 4 aa, Staphylococcus aureus
PGHY

SEQ ID NO: 1712112 - protein, 15 aa, Staphylococcus aureus
PGMKNAKGTVKGAYK

SEQ ID NO: 1712113 - protein, 4 aa, Staphylococcus aureus
PIDS

SEQ ID NO: 1712114 - protein, 5 aa, Staphylococcus aureus
PIDSE

SEQ ID NO: 1712115 - protein, 13 aa, Staphylococcus aureus
PIKKEDKQEVRKV

SEQ ID NO: 1712116 - protein, 4 aa, Staphylococcus aureus
PKDK

SEQ ID NO: 1712117 - protein, 56 aa, Staphylococcus aureus
PKEEPKSKPVVEPMAPKKQQETKPMTEKPITMPKAEPVEQKHRPSRQDNSDEIRRQ

SEQ ID NO: 1712118 - protein, 55 aa, Staphylococcus aureus
PKEEPKSKPVVEPMAPKKQQETKPMTEKPITVPKAEPVEQKHRPSRQDNSGEIRR

SEQ ID NO: 1712119 - protein, 6 aa, Staphylococcus aureus
PKGDDY

SEQ ID NO: 1712120 - protein, 9 aa, Staphylococcus aureus
PKGKNMETR

SEQ ID NO: 1712121 - protein, 16 aa, Staphylococcus aureus
PKIANDKNTSSNSDYT

SEQ ID NO: 1712122 - protein, 8 aa, Staphylococcus aureus
PKIPNTVT

SEQ ID NO: 1712123 - protein, 47 aa, Staphylococcus aureus
PKNKISTAKVDSTFSYSSGGKFDSTKGIGRTSSNSYSKTISYNQQKY

SEQ ID NO: 1712124 - protein, 13 aa, Staphylococcus aureus
PKNQTKSIPKTVS

SEQ ID NO: 1712125 - protein, 29 aa, Staphylococcus aureus
PKQLAGLNGESHDFTTTHQSSTTSNHTHN

SEQ ID NO: 1712126 - protein, 28 aa, Staphylococcus aureus
PKQLAGLNGESHNFSTTHQTPITSNHTH

SEQ ID NO: 1712127 - protein, 10 aa, Staphylococcus aureus
PKSTAPKRLN

SEQ ID NO: 1712128 - protein, 31 aa, Staphylococcus aureus
PKTFKAGSYGSEKGADPQPNTPDDHTPPNQN

SEQ ID NO: 1712129 - protein, 7 aa, Staphylococcus aureus
PKTKKTE

SEQ ID NO: 1712130 - protein, 14 aa, Staphylococcus aureus
PKVTKYSSSSSKYT

SEQ ID NO: 1712131 - protein, 5 aa, Staphylococcus aureus
PKYGV

SEQ ID NO: 1712132 - protein, 47 aa, Staphylococcus aureus
PKYTKREIDKMSEKDKKDKKANENLGLNPSHEGEKDPEKIAEKSPAY

SEQ ID NO: 1712133 - protein, 47 aa, Staphylococcus aureus
PKYTKREIDKMSEKDKKDKKVNENLGLNPSHEGETDPEKIAEKSPAY

SEQ ID NO: 1712134 - protein, 18 aa, Staphylococcus aureus
PMRAGGSVTYSSNGDGTI

SEQ ID NO: 1712135 - protein, 10 aa, Staphylococcus aureus
PNGQGTRNVE

SEQ ID NO: 1712136 - protein, 11 aa, Staphylococcus aureus
PNNGKTTSVTV

SEQ ID NO: 1712137 - protein, 14 aa, Staphylococcus aureus
PNTKKEKQPKRGDD

SEQ ID NO: 1712138 - protein, 5 aa, Staphylococcus aureus
PPPIK

SEQ ID NO: 1712139 - protein, 10 aa, Staphylococcus aureus
PQFNKTPKYV

SEQ ID NO: 1712140 - protein, 7 aa, Staphylococcus aureus
PQGTIQG

SEQ ID NO: 1712141 - protein, 313 aa, Staphylococcus aureus
PQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKAMQNDGANASPVTVSNGSHS

SEQ ID NO: 1712142 - protein, 329 aa, Staphylococcus aureus
PQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTND

SEQ ID NO: 1712143 - protein, 330 aa, Staphylococcus aureus
PQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDM

SEQ ID NO: 1712144 - protein, 362 aa, Staphylococcus aureus
PQNDPDANDTNNGTDNNDATANSNANATPENTGQPNVSETTDNGKADASPTTPNNSDAATGETTVTSATDDAKDKPQANNNSSPDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSM

SEQ ID NO: 1712145 - protein, 335 aa, Staphylococcus aureus
PQNDPNANDTNNGTDNNDATANSNANATPENTGQPNVTESTDNANADTSSTTTNNQNDTTTGETTATSANSSATNDANNKPTANNNSSVDASTDNSATGNGTTDKPEVESTNNGTTDKPATETDNATPAESTTNNNSTTTATNENVPTGSTATAPTTASTEATSSADSKDNASVNDSKQNAEVNNSAESQSTNGKVAQPKSENKAKAEKDGRDSTNQSMVESTTETLPSADITEPKVSSNTSKDKEESTTNQTDAEQHNSDTNVTSNEVVKSPSKADTDVSNKPSTSASSEAKDKMTSTNVSQTDDTATADTNDTQKSVGSAANNKAKDMQTNDM

SEQ ID NO: 1712146 - protein, 7 aa, Staphylococcus aureus
PQNGQQI

SEQ ID NO: 1712147 - protein, 39 aa, Staphylococcus aureus
PQRQQTSRRSSRIQTRSIESRSAEPRSVSSYQNADSSYY

SEQ ID NO: 1712148 - protein, 39 aa, Staphylococcus aureus
PQRQQTSRRSSRIQTRSVEARAAEPRSVSDYQNANSSYY

SEQ ID NO: 1712149 - protein, 7 aa, Staphylococcus aureus
PRDTRAE

SEQ ID NO: 1712150 - protein, 11 aa, Staphylococcus aureus
PRQDPKSQYSG

SEQ ID NO: 1712151 - protein, 106 aa, Staphylococcus aureus
PSAITTTTQAVNAEQNHTANPEQAAKSNTENVSTSPSTKTEQTPKSNIQKATQQTPSVTTTPPPNAQPQSTQPTPKPTTPPSSSVETPQPQSPTTKQAQKKINPKF

SEQ ID NO: 1712152 - protein, 134 aa, Staphylococcus aureus
PSAITTTTQAVNAEQNRTANPEQASKSNTENVSTSLSTKTEQAPKSNTENVSTSLSTKTEQAPKSNIQKATTSPSTKVEATQPTPNSTTPPNAQPQSPQPTPNPTTLPSSNVETQQPQSSTTKQAHKEINPKYK

SEQ ID NO: 1712153 - protein, 12 aa, Staphylococcus aureus
PSEAPRYTQPSQ

SEQ ID NO: 1712154 - protein, 5 aa, Staphylococcus aureus
PSPQP

SEQ ID NO: 1712155 - protein, 6 aa, Staphylococcus aureus
PSYPPI

SEQ ID NO: 1712156 - protein, 10 aa, Staphylococcus aureus
PTAGAEQINQ

SEQ ID NO: 1712157 - protein, 9 aa, Staphylococcus aureus
PTALEDPKD

SEQ ID NO: 1712158 - protein, 67 aa, Staphylococcus aureus
PTAYADTPQKDTTAKTTSHDSKKSNDDETSKDTTSKDIDKADSNNTSNQDNNDKKFKTIDDSTLDSN

SEQ ID NO: 1712159 - protein, 68 aa, Staphylococcus aureus
PTAYADTPQKDTTAKTTSHDSKKSNDDETSKDTTSKDNDKADNNNTSNQDNNDKKFKTIDDSTSDSNN

SEQ ID NO: 1712160 - protein, 68 aa, Staphylococcus aureus
PTAYADTPQKDTTAKTTSHDSKKSTDDETSKDTTSKDTDKADNNNTSNQDNKDKKVKTIDDSTSDSNN

SEQ ID NO: 1712161 - protein, 14 aa, Staphylococcus aureus
PTKEIEDEKIKKEI

SEQ ID NO: 1712162 - protein, 15 aa, Staphylococcus aureus
PTKPIADDKLRKEIE

SEQ ID NO: 1712163 - protein, 14 aa, Staphylococcus aureus
PTKPIDDDKLRKEI

SEQ ID NO: 1712164 - protein, 14 aa, Staphylococcus aureus
PTKPLPNDKLKNEI

SEQ ID NO: 1712165 - protein, 7 aa, Staphylococcus aureus
PTLKAER

SEQ ID NO: 1712166 - protein, 28 aa, Staphylococcus aureus
PTMSKKPQKSDYQPKQLESDHTVDTETM

SEQ ID NO: 1712167 - protein, 16 aa, Staphylococcus aureus
PTNANPNVRRPGGVQE

SEQ ID NO: 1712168 - protein, 15 aa, Staphylococcus aureus
PTNATTNAFRPGGVQ

SEQ ID NO: 1712169 - protein, 24 aa, Staphylococcus aureus
PTNGFGGQTITNSNVRANQSNSTV

SEQ ID NO: 1712170 - protein, 25 aa, Staphylococcus aureus
PTNGFGGQTITNSNVRANQSNSTVV

SEQ ID NO: 1712171 - protein, 4 aa, Staphylococcus aureus
PTSM

SEQ ID NO: 1712172 - protein, 68 aa, Staphylococcus aureus
PTVKPQAKQAIADKVQAQETAIDANNGSTTEEKTAAKQQAQTEKTTADAAIDAAHTNAEVEAAKNAEI

SEQ ID NO: 1712173 - protein, 4 aa, Staphylococcus aureus
PVLT

SEQ ID NO: 1712174 - protein, 28 aa, Staphylococcus aureus
PWRTQSTTTPTTPSKPTTPSKPSTGKLT

SEQ ID NO: 1712175 - protein, 5 aa, Staphylococcus aureus
PYKEQ

SEQ ID NO: 1712176 - protein, 4 aa, Staphylococcus aureus
PYRK

SEQ ID NO: 1712177 - protein, 45 aa, Staphylococcus aureus
QAAETTQDQTTNKNVLDNNKVKATTEQAKAEVKNPTQNISGTQVY

SEQ ID NO: 1712178 - protein, 12 aa, Staphylococcus aureus
QAAKDAVSHDAQ

SEQ ID NO: 1712179 - protein, 31 aa, Staphylococcus aureus; identical to SEQ ID NO: 1642073

SEQ ID NO: 1712180 - protein, 4 aa, Staphylococcus aureus
QAEG

SEQ ID NO: 1712181 - protein, 74 aa, Staphylococcus aureus; identical to SEQ ID NO: 1571861

SEQ ID NO: 1712182 - protein, 11 aa, Staphylococcus aureus
QAINDKTQTLT

SEQ ID NO: 1712183 - protein, 15 aa, Staphylococcus aureus
QAINDKTQTLTDGNY

SEQ ID NO: 1712184 - protein, 21 aa, Staphylococcus aureus
QAKDNLHGDQKLADDKQHAVT

SEQ ID NO: 1712185 - protein, 11 aa, Staphylococcus aureus
QAKQAAKQQLN

SEQ ID NO: 1712186 - protein, 15 aa, Staphylococcus aureus
QAKTNVDQSSTNEYV

SEQ ID NO: 1712187 - protein, 7 aa, Staphylococcus aureus
QANTALN

SEQ ID NO: 1712188 - protein, 10 aa, Staphylococcus aureus
QAVNTSAPRM

SEQ ID NO: 1712189 - protein, 20 aa, Staphylococcus aureus
QAVTTAKDNLHGDQKLARDQ

SEQ ID NO: 1712190 - protein, 14 aa, Staphylococcus aureus
QCDSNQGGGSKKTC

SEQ ID NO: 1712191 - protein, 6 aa, Staphylococcus aureus
QDEHGQ

SEQ ID NO: 1712192 - protein, 17 aa, Staphylococcus aureus
QDGKATGKTATLNESNN

SEQ ID NO: 1712193 - protein, 18 aa, Staphylococcus aureus
QDGKATGKTATLNESNNW

SEQ ID NO: 1712194 - protein, 21 aa, Staphylococcus aureus
QDGKATGKTATLNESNNWTHT

SEQ ID NO: 1712195 - protein, 37 aa, Staphylococcus aureus; identical to SEQ ID NO: 1569350

SEQ ID NO: 1712196 - protein, 37 aa, Staphylococcus aureus
QDKEAAASEQKTTTVEENGNSATDNKVNATQTTTTNV

SEQ ID NO: 1712197 - protein, 9 aa, Staphylococcus aureus
QDPTGPATR

SEQ ID NO: 1712198 - protein, 23 aa, Staphylococcus aureus
QDPTTKGIGDSHQALEYEEPSRK

SEQ ID NO: 1712199 - protein, 14 aa, Staphylococcus aureus
QDSATGKARNGFYK

SEQ ID NO: 1712200 - protein, 17 aa, Staphylococcus aureus
QDYKKSGFKINDRKQSV

SEQ ID NO: 1712201 - protein, 6 aa, Staphylococcus aureus
QEAVDE

SEQ ID NO: 1712202 - protein, 40 aa, Staphylococcus aureus
QENKHEKENTHNINNNGSEANENFNNKKNRIENIEDKQKA

SEQ ID NO: 1712203 - protein, 5 aa, Staphylococcus aureus
QENQN

SEQ ID NO: 1712204 - protein, 7 aa, Staphylococcus aureus
QETHKEM

SEQ ID NO: 1712205 - protein, 10 aa, Staphylococcus aureus
QFEKNRYKVE

SEQ ID NO: 1712206 - protein, 4 aa, Staphylococcus aureus
QFIP

SEQ ID NO: 1712207 - protein, 24 aa, Staphylococcus aureus
QFYKGQKQIAGKPITKDTAEKVEK

SEQ ID NO: 1712208 - protein, 13 aa, Staphylococcus aureus
QGAHANYYPGNPP

SEQ ID NO: 1712209 - protein, 5 aa, Staphylococcus aureus
QGIAD

SEQ ID NO: 1712210 - protein, 35 aa, Staphylococcus aureus
QGIANKAQIKGSENYHDADTDKQTAYDNAVTKAEE

SEQ ID NO: 1712211 - protein, 35 aa, Staphylococcus aureus; identical to SEQ ID NO: 1633180

SEQ ID NO: 1712212 - protein, 12 aa, Staphylococcus aureus
QGITADTTIKDV

SEQ ID NO: 1712213 - protein, 24 aa, Staphylococcus aureus
QGITGNEGRTKGSTNYVNADTQVK

SEQ ID NO: 1712214 - protein, 12 aa, Staphylococcus aureus
QGKVAAEEIVAE

SEQ ID NO: 1712215 - protein, 10 aa, Staphylococcus aureus
QGMTQAQYTE

SEQ ID NO: 1712216 - protein, 10 aa, Staphylococcus aureus
QGSEEREKYV

SEQ ID NO: 1712217 - protein, 5 aa, Staphylococcus aureus
QGSPM

SEQ ID NO: 1712218 - protein, 5 aa, Staphylococcus aureus
QGTIY

SEQ ID NO: 1712219 - protein, 7 aa, Staphylococcus aureus
QGTIYGE

SEQ ID NO: 1712220 - protein, 42 aa, Staphylococcus aureus; identical to SEQ ID NO: 1569361

SEQ ID NO: 1712221 - protein, 42 aa, Staphylococcus aureus
QHPVITPSDVNNALSNVTSKEHALNGEAKLNTAKQEANTALG

SEQ ID NO: 1712222 - protein, 23 aa, Staphylococcus aureus
QIEQAQNVAGVNGVKDKGNTLNT

SEQ ID NO: 1712223 - protein, 7 aa, Staphylococcus aureus
QIGTQGE

SEQ ID NO: 1712224 - protein, 27 aa, Staphylococcus aureus
QIHGQNKGNQSFEEDTEKDKPKYEHGG

SEQ ID NO: 1712225 - protein, 5 aa, Staphylococcus aureus
QISLK

SEQ ID NO: 1712226 - protein, 21 aa, Staphylococcus aureus
QKAYGKDLKKDNNKTKESDSG

SEQ ID NO: 1712227 - protein, 66 aa, Staphylococcus aureus
QKDAEKKVAPKVEAPQIQSPQIEKPKAESPKVEVPQIQSPQIEKPKAESPKVEVPQIQSPKVEVPQ

SEQ ID NO: 1712228 - protein, 9 aa, Staphylococcus aureus
QKDNGTIHA

SEQ ID NO: 1712229 - protein, 10 aa, Staphylococcus aureus
QKHSDKDDKY

SEQ ID NO: 1712230 - protein, 9 aa, Staphylococcus aureus
QKHSNTDDK

SEQ ID NO: 1712231 - protein, 12 aa, Staphylococcus aureus
QKIPDTGELKGA

SEQ ID NO: 1712232 - protein, 110 aa, Staphylococcus aureus
QKQQNGDAQTENRESQTQNSQNSQNGQSLSAPIENEQPNNNQTNQVDASGAQPYTTKHDQPVSQNEQAKKDTADATQTQSAKAESKHEQNESRSANKKGNDNNATHVENH

SEQ ID NO: 1712233 - protein, 8 aa, Staphylococcus aureus
QKRIEDGV

SEQ ID NO: 1712234 - protein, 6 aa, Staphylococcus aureus
QKYDKE

SEQ ID NO: 1712235 - protein, 6 aa, Staphylococcus aureus
QLKGDL

SEQ ID NO: 1712236 - protein, 21 aa, Staphylococcus aureus
QLNTPQKAKLKEQVGQANRLE

SEQ ID NO: 1712237 - protein, 10 aa, Staphylococcus aureus
QNATGLPTDG

SEQ ID NO: 1712238 - protein, 15 aa, Staphylococcus aureus
QNDELTDEEKQAAID

SEQ ID NO: 1712239 - protein, 6 aa, Staphylococcus aureus
QNETNI

SEQ ID NO: 1712240 - protein, 5 aa, Staphylococcus aureus
QNGEK

SEQ ID NO: 1712241 - protein, 35 aa, Staphylococcus aureus; identical to SEQ ID NO: 1642371

SEQ ID NO: 1712242 - protein, 35 aa, Staphylococcus aureus; identical to SEQ ID NO: 1567203

SEQ ID NO: 1712243 - protein, 30 aa, Staphylococcus aureus
QNGINDKANTLASENYHDADSDKKTAYTQA

SEQ ID NO: 1712244 - protein, 17 aa, Staphylococcus aureus
QNNTTATHQNAKVKKAY

SEQ ID NO: 1712245 - protein, 16 aa, Staphylococcus aureus
QNNTTATHQNAKVNRA

SEQ ID NO: 1712246 - protein, 17 aa, Staphylococcus aureus
QNNTTSVHQNSKVNKTY

SEQ ID NO: 1712247 - protein, 12 aa, Staphylococcus aureus
QNRGEDIGNEIS

SEQ ID NO: 1712248 - protein, 7 aa, Staphylococcus aureus
QNSAEAK

SEQ ID NO: 1712249 - protein, 24 aa, Staphylococcus aureus
QNSYTTTVGGTLASGTQASGYAQM

SEQ ID NO: 1712250 - protein, 8 aa, Staphylococcus aureus
QNTNISPY

SEQ ID NO: 1712251 - protein, 27 aa, Staphylococcus aureus
QNVNSTKTALNGDAKLNEAKAAVKQTL

SEQ ID NO: 1712252 - protein, 29 aa, Staphylococcus aureus
QNVQRAKNELNGNQNVANAKTTAKNALNN

SEQ ID NO: 1712253 - protein, 26 aa, Staphylococcus aureus
QNVSSAKNALNGDQNVTNAKNTAKHA

SEQ ID NO: 1712254 - protein, 38 aa, Staphylococcus aureus
QPETKVKPAAREKINQKANELRAKINQDKEATAEERQV

SEQ ID NO: 1712255 - protein, 20 aa, Staphylococcus aureus
QPEVTKDKTTHIGERKGGPY

SEQ ID NO: 1712256 - protein, 20 aa, Staphylococcus aureus
QPEVTKDKTVHVGERKGGPY

SEQ ID NO: 1712257 - protein, 11 aa, Staphylococcus aureus
QPGSSGSPILN

SEQ ID NO: 1712258 - protein, 13 aa, Staphylococcus aureus
QPHVTKKQSATGV

SEQ ID NO: 1712259 - protein, 9 aa, Staphylococcus aureus
QPNERYENL

SEQ ID NO: 1712260 - protein, 5 aa, Staphylococcus aureus
QQAIE

SEQ ID NO: 1712261 - protein, 13 aa, Staphylococcus aureus
QQHDADYHEENMT

SEQ ID NO: 1712262 - protein, 21 aa, Staphylococcus aureus
QQIKQDKKNKKLTVEDKPSTV

SEQ ID NO: 1712263 - protein, 25 aa, Staphylococcus aureus
QQKVNTLSEGHQKRFNKQINKVYNG

SEQ ID NO: 1712264 - protein, 9 aa, Staphylococcus aureus
QQPVQQASK

SEQ ID NO: 1712265 - protein, 16 aa, Staphylococcus aureus
QQQGLTADKYKQNLRT

SEQ ID NO: 1712266 - protein, 5 aa, Staphylococcus aureus
QQRPT

SEQ ID NO: 1712267 - protein, 30 aa, Staphylococcus aureus
QQTAKAEHNVKQVQNTNISPYKGIVRIGSA

SEQ ID NO: 1712268 - protein, 13 aa, Staphylococcus aureus
QQTAKAEHNVTQV

SEQ ID NO: 1712269 - protein, 21 aa, Staphylococcus aureus
QQTAKAEHNVTQVQNTNISPY

SEQ ID NO: 1712270 - protein, 10 aa, Staphylococcus aureus
QQTAKAENSV

SEQ ID NO: 1712271 - protein, 35 aa, Staphylococcus aureus; identical to SEQ ID NO: 1569385

SEQ ID NO: 1712272 - protein, 9 aa, Staphylococcus aureus
QRNKEKLSI

SEQ ID NO: 1712273 - protein, 18 aa, Staphylococcus aureus
QRNPGFNETEIGSYGPAK

SEQ ID NO: 1712274 - protein, 16 aa, Staphylococcus aureus
QRPTFNPETGKDFGKK

SEQ ID NO: 1712275 - protein, 15 aa, Staphylococcus aureus
QRTSKEPSKNAKHQQ

SEQ ID NO: 1712276 - protein, 14 aa, Staphylococcus aureus
QRTSKEPSNNAQHQ

SEQ ID NO: 1712277 - protein, 10 aa, Staphylococcus aureus
QRVDNANDKQ

SEQ ID NO: 1712278 - protein, 11 aa, Staphylococcus aureus
QSDLSTKEERL

SEQ ID NO: 1712279 - protein, 10 aa, Staphylococcus aureus
QSDSEDPRKK

SEQ ID NO: 1712280 - protein, 34 aa, Staphylococcus aureus
QSIADKDATRASSAYVNAEPNKKQAFDEAVQNAE

SEQ ID NO: 1712281 - protein, 34 aa, Staphylococcus aureus; identical to SEQ ID NO: 1642505

SEQ ID NO: 1712282 - protein, 34 aa, Staphylococcus aureus; identical to SEQ ID NO: 1565154

SEQ ID NO: 1712283 - protein, 16 aa, Staphylococcus aureus
QSIADNATTKQNQNYT

SEQ ID NO: 1712284 - protein, 35 aa, Staphylococcus aureus
QSIADNATTKQNQNYTDASQNKKDAYNNAVTTAQG

SEQ ID NO: 1712285 - protein, 35 aa, Staphylococcus aureus; identical to SEQ ID NO: 1567678

SEQ ID NO: 1712286 - protein, 35 aa, Staphylococcus aureus
QSIASKDATKSSEDYQDANADLQTAYNDAVTNAEG

SEQ ID NO: 1712287 - protein, 7 aa, Staphylococcus aureus
QSIDETY

SEQ ID NO: 1712288 - protein, 12 aa, Staphylococcus aureus
QSKVAAEEVIAE

SEQ ID NO: 1712289 - protein, 13 aa, Staphylococcus aureus
QSNDYKIGKPSLN

SEQ ID NO: 1712290 - protein, 14 aa, Staphylococcus aureus
QSNYYRPQNVSRDY

SEQ ID NO: 1712291 - protein, 7 aa, Staphylococcus aureus
QSVNADS

SEQ ID NO: 1712292 - protein, 24 aa, Staphylococcus aureus
QSVTSTENALNGDANLQRAKTEAI

SEQ ID NO: 1712293 - protein, 45 aa, Staphylococcus aureus
QTADATTEEKEQANQQVDAQLTQGNQNIENAQSIDDVNTAKENAI

SEQ ID NO: 1712294 - protein, 9 aa, Staphylococcus aureus
QTANPTMSV

SEQ ID NO: 1712295 - protein, 8 aa, Staphylococcus aureus
QTKVNPDS

SEQ ID NO: 1712296 - protein, 39 aa, Staphylococcus aureus
QTLQQEKDTNEALNQRVKRQSKTVIAEEEKQIRETAQTF

SEQ ID NO: 1712297 - protein, 9 aa, Staphylococcus aureus
QTNKTSGVV

SEQ ID NO: 1712298 - protein, 23 aa, Staphylococcus aureus
QTSYTTTVGGTLASGTQASGYGH

SEQ ID NO: 1712299 - protein, 17 aa, Staphylococcus aureus
QTTKQQIVEQKSEVRQL

SEQ ID NO: 1712300 - protein, 9 aa, Staphylococcus aureus
QTTVNNGLN

SEQ ID NO: 1712301 - protein, 12 aa, Staphylococcus aureus
QTVKNSSQTLNT

SEQ ID NO: 1712302 - protein, 36 aa, Staphylococcus aureus
QVAPTPVQPNSLSELNNNHSDAHATVTETASNTNHH

SEQ ID NO: 1712303 - protein, 10 aa, Staphylococcus aureus
QVKNNNPQLK

SEQ ID NO: 1712304 - protein, 10 aa, Staphylococcus aureus
QVMTPNNKQQ

SEQ ID NO: 1712305 - protein, 25 aa, Staphylococcus aureus
QVNATKAALNGTQNLEKAKQHANTA

SEQ ID NO: 1712306 - protein, 12 aa, Staphylococcus aureus
QVNSAKTNLDGT

SEQ ID NO: 1712307 - protein, 27 aa, Staphylococcus aureus
QVNTTKAALNGTQNLEKAKQHANTSID

SEQ ID NO: 1712308 - protein, 28 aa, Staphylococcus aureus
QVTNAKNALNGDANVRQAKSDAKANLGT

SEQ ID NO: 1712309 - protein, 5 aa, Staphylococcus aureus
QVTSE

SEQ ID NO: 1712310 - protein, 27 aa, Staphylococcus aureus
QVTSTKDALNGDAKLSEAKAAAKQNLG

SEQ ID NO: 1712311 - protein, 5 aa, Staphylococcus aureus
QYKDS

SEQ ID NO: 1712312 - protein, 59 aa, Staphylococcus aureus
QYSEDAKKTQKDYASQSKKDKNEKSNTKNPQLPTQDELKHKSKPAQSFNNDVNQKDIRA

SEQ ID NO: 1712313 - protein, 6 aa, Staphylococcus aureus
QYSTDN

SEQ ID NO: 1712314 - protein, 19 aa, Staphylococcus aureus
QYTPSEDTSYESNGISNKS

SEQ ID NO: 1712315 - protein, 9 aa, Staphylococcus aureus
QYTTSESPT

SEQ ID NO: 1712316 - protein, 22 aa, Staphylococcus aureus
RAETQNDPNISELNKSSQYTGS

SEQ ID NO: 1712317 - protein, 10 aa, Staphylococcus aureus
RDGSSTALDA

SEQ ID NO: 1712318 - protein, 32 aa, Staphylococcus aureus; identical to SEQ ID NO: 1569410

SEQ ID NO: 1712319 - protein, 33 aa, Staphylococcus aureus; identical to SEQ ID NO: 1569411

SEQ ID NO: 1712320 - protein, 32 aa, Staphylococcus aureus; identical to SEQ ID NO: 1642680

SEQ ID NO: 1712321 - protein, 32 aa, Staphylococcus aureus; identical to SEQ ID NO: 1566929

SEQ ID NO: 1712322 - protein, 83 aa, Staphylococcus aureus; identical to SEQ ID NO: 1572021

SEQ ID NO: 1712323 - protein, 82 aa, Staphylococcus aureus
RDSIANETTVKASQNYTDASPNNQSTYNSAVSNAKGIINQTNNPTMDTSAITQATTQVNNAKNGLNGAENLRNAQNIAKQNL

SEQ ID NO: 1712324 - protein, 90 aa, Staphylococcus aureus
RDSIANETTVKASQNYTDASPNNQSTYNSAVSNAKGIINQTNNPTMDTSAITQATTQVNNAKNGLNGAENLRNAQNTAKQNLNTLSHLTN

SEQ ID NO: 1712325 - protein, 16 aa, Staphylococcus aureus
REGYRDGEFKKGDKGK

SEQ ID NO: 1712326 - protein, 10 aa, Staphylococcus aureus
RENAITDKTA

SEQ ID NO: 1712327 - protein, 20 aa, Staphylococcus aureus
REQTEAELRERRSELQRQET

SEQ ID NO: 1712328 - protein, 9 aa, Staphylococcus aureus
RGASGCAPE

SEQ ID NO: 1712329 - protein, 10 aa, Staphylococcus aureus
RGASGYAPEH

SEQ ID NO: 1712330 - protein, 34 aa, Staphylococcus aureus; identical to SEQ ID NO: 1572039

SEQ ID NO: 1712331 - protein, 8 aa, Staphylococcus aureus
RGKAKMSY

SEQ ID NO: 1712332 - protein, 17 aa, Staphylococcus aureus
RGKDGGYLANDRSADVS

SEQ ID NO: 1712333 - protein, 5 aa, Staphylococcus aureus
RGKIV

SEQ ID NO: 1712334 - protein, 7 aa, Staphylococcus aureus
RGQNNQW

SEQ ID NO: 1712335 - protein, 4 aa, Staphylococcus aureus
RHIE

SEQ ID NO: 1712336 - protein, 10 aa, Staphylococcus aureus
RHNNTSPWVK

SEQ ID NO: 1712337 - protein, 20 aa, Staphylococcus aureus
RIANAQNSNLPSKEEINKTA

SEQ ID NO: 1712338 - protein, 14 aa, Staphylococcus aureus
RIASQGHEVTIFEK

SEQ ID NO: 1712339 - protein, 5 aa, Staphylococcus aureus
RIATA

SEQ ID NO: 1712340 - protein, 5 aa, Staphylococcus aureus
RISAH

SEQ ID NO: 1712341 - protein, 8 aa, Staphylococcus aureus
RISKGENI

SEQ ID NO: 1712342 - protein, 10 aa, Staphylococcus aureus
RITKEDNKGI

SEQ ID NO: 1712343 - protein, 11 aa, Staphylococcus aureus
RITKEDNKGII

SEQ ID NO: 1712344 - protein, 6 aa, Staphylococcus aureus
RITVPT

SEQ ID NO: 1712345 - protein, 6 aa, Staphylococcus aureus
RKDKQT

SEQ ID NO: 1712346 - protein, 62 aa, Staphylococcus aureus
RKEQNDTTDKDKSSNNTDDSNNNNNNNGVNNQQQPTTGQNTNQDQGNIQQTPQASNNQNGVV

SEQ ID NO: 1712347 - protein, 62 aa, Staphylococcus aureus
RKEQNDTTDKDKSSNNTDDSNNSNNNNGVNNQQQPTTGQNTNQDQGNIQQTPQASNNQNGVV

SEQ ID NO: 1712348 - protein, 26 aa, Staphylococcus aureus
RKFNPDLAPGTEKVTREGQKGEKTIT

SEQ ID NO: 1712349 - protein, 36 aa, Staphylococcus aureus; identical to SEQ ID NO: 1563075

SEQ ID NO: 1712350 - protein, 46 aa, Staphylococcus aureus
RKFNPDLAPGTEKVTREGQKGEKTITTPTLKNPLTGEIISKGESKE

SEQ ID NO: 1712351 - protein, 7 aa, Staphylococcus aureus
RKGSDTL

SEQ ID NO: 1712352 - protein, 6 aa, Staphylococcus aureus
RKGSEL

SEQ ID NO: 1712353 - protein, 9 aa, Staphylococcus aureus
RKGTNLTYQ

SEQ ID NO: 1712354 - protein, 16 aa, Staphylococcus aureus
RKIDESSEKSKDSKFK

SEQ ID NO: 1712355 - protein, 18 aa, Staphylococcus aureus
RKIDESSEKSKDSKFKIT

SEQ ID NO: 1712356 - protein, 5 aa, Staphylococcus aureus
RKKED

SEQ ID NO: 1712357 - protein, 5 aa, Staphylococcus aureus
RKKSI

SEQ ID NO: 1712358 - protein, 13 aa, Staphylococcus aureus
RKNGNIYISNGWV

SEQ ID NO: 1712359 - protein, 8 aa, Staphylococcus aureus
RLGSDTNL

SEQ ID NO: 1712360 - protein, 7 aa, Staphylococcus aureus
RLGTTKR

SEQ ID NO: 1712361 - protein, 10 aa, Staphylococcus aureus
RLKTRKNPGL

SEQ ID NO: 1712362 - protein, 33 aa, Staphylococcus aureus
RLPGTTTLNDMPSTNTKNDKSFVGGTKLNNKYA

SEQ ID NO: 1712363 - protein, 33 aa, Staphylococcus aureus
RLPGTTTLNDMPSTNTKNDNSFVGGTKLNNKYA

SEQ ID NO: 1712364 - protein, 27 aa, Staphylococcus aureus
RNDGQSNSVTAYGNSNDDFSSTPSNFS

SEQ ID NO: 1712365 - protein, 6 aa, Staphylococcus aureus
RNDLKG

SEQ ID NO: 1712366 - protein, 9 aa, Staphylococcus aureus
RNGNKEEIA

SEQ ID NO: 1712367 - protein, 8 aa, Staphylococcus aureus
RNGSMKAA

SEQ ID NO: 1712368 - protein, 14 aa, Staphylococcus aureus
RNKDLQKQVDNSKD

SEQ ID NO: 1712369 - protein, 9 aa, Staphylococcus aureus
RNTKTTKGE

SEQ ID NO: 1712370 - protein, 9 aa, Staphylococcus aureus
RNTRTTKGE

SEQ ID NO: 1712371 - protein, 18 aa, Staphylococcus aureus
RNVNASETSYKEITQEDL

SEQ ID NO: 1712372 - protein, 21 aa, Staphylococcus aureus
RPEHSTEPEKEPWSQPPSGYK

SEQ ID NO: 1712373 - protein, 42 aa, Staphylococcus aureus
RQALTPDKAPLQTAKTQLEQSINQPTDTTGMTTDSLNAYNQK

SEQ ID NO: 1712374 - protein, 12 aa, Staphylococcus aureus
RQPDANYPGPVS

SEQ ID NO: 1712375 - protein, 4 aa, Staphylococcus aureus
RRPT

SEQ ID NO: 1712376 - protein, 12 aa, Staphylococcus aureus
RRSEQANKEMGL

SEQ ID NO: 1712377 - protein, 23 aa, Staphylococcus aureus
RSDDEREERHPQNDRLSKERVED

SEQ ID NO: 1712378 - protein, 26 aa, Staphylococcus aureus
RSENNTDRSTKPVATAPTSVAPKRVN

SEQ ID NO: 1712379 - protein, 8 aa, Staphylococcus aureus
RSRKIGEI

SEQ ID NO: 1712380 - protein, 4 aa, Staphylococcus aureus
RSSI

SEQ ID NO: 1712381 - protein, 22 aa, Staphylococcus aureus
RTDIDREKEKQIAKMEKRARDI

SEQ ID NO: 1712382 - protein, 7 aa, Staphylococcus aureus
RTGVSAA

SEQ ID NO: 1712383 - protein, 7 aa, Staphylococcus aureus
RTKEDLE

SEQ ID NO: 1712384 - protein, 14 aa, Staphylococcus aureus
RTTFNDVKQNRANK

SEQ ID NO: 1712385 - protein, 5 aa, Staphylococcus aureus
RVAND

SEQ ID NO: 1712386 - protein, 9 aa, Staphylococcus aureus
RVESTDGIH

SEQ ID NO: 1712387 - protein, 13 aa, Staphylococcus aureus
RVNNAKDALNGDA

SEQ ID NO: 1712388 - protein, 14 aa, Staphylococcus aureus
RVNPNGNKLDANEA

SEQ ID NO: 1712389 - protein, 13 aa, Staphylococcus aureus
RVNTAKDALNGDA

SEQ ID NO: 1712390 - protein, 14 aa, Staphylococcus aureus
RVTTVSKDTKNNSR

SEQ ID NO: 1712391 - protein, 9 aa, Staphylococcus aureus
RVYKGTGTM

SEQ ID NO: 1712392 - protein, 16 aa, Staphylococcus aureus
RYDGTKHDYHKHKDGF

SEQ ID NO: 1712393 - protein, 9 aa, Staphylococcus aureus
RYNQNSGVR

SEQ ID NO: 1712394 - protein, 10 aa, Staphylococcus aureus
RYVDENGKLI

SEQ ID NO: 1712395 - protein, 11 aa, Staphylococcus aureus
SAAKPAALETQ

SEQ ID NO: 1712396 - protein, 66 aa, Staphylococcus aureus
SAAKPAALETQYKAAAPKAATTTAPKAKTEATPKVTTFSASAQPRSVAATPKTSLPKYKPQVNSSI

SEQ ID NO: 1712397 - protein, 56 aa, Staphylococcus aureus
SAAKPAALETQYKAAAPKATPVAPKAKTEATPKVTTFSASAQPRSAAAAPKIEEDY

SEQ ID NO: 1712398 - protein, 65 aa, Staphylococcus aureus
SAAKPAALETQYKAAAPNATPVAPKAKTEATPKVTTFSASAQPRSAAAAPKTSLPKYKPQVNSSI

SEQ ID NO: 1712399 - protein, 11 aa, Staphylococcus aureus
SADAKNYQAQG

SEQ ID NO: 1712400 - protein, 9 aa, Staphylococcus aureus
SAFGSNYDR

SEQ ID NO: 1712401 - protein, 13 aa, Staphylococcus aureus
SAGGGTTNSPARL

SEQ ID NO: 1712402 - protein, 5 aa, Staphylococcus aureus
SALEQ

SEQ ID NO: 1712403 - protein, 17 aa, Staphylococcus aureus
SALLPSSTAVDYDENLN

SEQ ID NO: 1712404 - protein, 37 aa, Staphylococcus aureus
SAPQTTNSTAIAKSSAEVQQTQQASIPASQKVNLGNQ

SEQ ID NO: 1712405 - protein, 37 aa, Staphylococcus aureus
SAPQTTNSTAIAKSSAEVQQTQQASMPASQKVNLGNQ

SEQ ID NO: 1712406 - protein, 21 aa, Staphylococcus aureus
SAPTKKPTLPTYTETTTQVPM

SEQ ID NO: 1712407 - protein, 22 aa, Staphylococcus aureus
SAPTKKPTSPTSYTETTTQVPM

SEQ ID NO: 1712408 - protein, 7 aa, Staphylococcus aureus
SATKVKS

SEQ ID NO: 1712409 - protein, 46 aa, Staphylococcus aureus
SATNNPEMNPDTINQKASQVNSAKSALNGDEKLAAAKQTAKTEIGR

SEQ ID NO: 1712410 - protein, 6 aa, Staphylococcus aureus
SAVTNA

SEQ ID NO: 1712411 - protein, 24 aa, Staphylococcus aureus
SDAIKSNAETLVDNNSNSNNENNA

SEQ ID NO: 1712412 - protein, 6 aa, Staphylococcus aureus
SDASYT

SEQ ID NO: 1712413 - protein, 8 aa, Staphylococcus aureus
SDEGLKKE

SEQ ID NO: 1712414 - protein, 5 aa, Staphylococcus aureus
SDGRE

SEQ ID NO: 1712415 - protein, 23 aa, Staphylococcus aureus
SDITENKKDIKFNNKQSAEFSPK

SEQ ID NO: 1712416 - protein, 24 aa, Staphylococcus aureus
SDLKNNQKSPVEPTKENDKKNGLN

SEQ ID NO: 1712417 - protein, 21 aa, Staphylococcus aureus
SDLNQAQKNALTQQVNSAQNV

SEQ ID NO: 1712418 - protein, 18 aa, Staphylococcus aureus
SDNTTTNEEKGKDIEPVR

SEQ ID NO: 1712419 - protein, 8 aa, Staphylococcus aureus
SDPVNAKK

SEQ ID NO: 1712420 - protein, 5 aa, Staphylococcus aureus
SDTDF

SEQ ID NO: 1712421 - protein, 34 aa, Staphylococcus aureus; identical to SEQ ID NO: 1643174

SEQ ID NO: 1712422 - protein, 21 aa, Staphylococcus aureus
SDYKKPEEKTSDTERKLNSKE

SEQ ID NO: 1712423 - protein, 8 aa, Staphylococcus aureus
SDYPGNED

SEQ ID NO: 1712424 - protein, 4 aa, Staphylococcus aureus
SEAI

SEQ ID NO: 1712425 - protein, 8 aa, Staphylococcus aureus
SEENSESV

SEQ ID NO: 1712426 - protein, 7 aa, Staphylococcus aureus
SEITTEE

SEQ ID NO: 1712427 - protein, 9 aa, Staphylococcus aureus
SEKFNSSSL

SEQ ID NO: 1712428 - protein, 43 aa, Staphylococcus aureus
SELNANKNTTNDKIKNEGAVKTSDTSLKLDNKSAISNGNEINQ

SEQ ID NO: 1712429 - protein, 12 aa, Staphylococcus aureus
SELTKAAGADFV

SEQ ID NO: 1712430 - protein, 22 aa, Staphylococcus aureus
SENGNSSGEDNDFNRYGCMILK

SEQ ID NO: 1712431 - protein, 16 aa, Staphylococcus aureus
SEQSKAESTKLLKDNL

SEQ ID NO: 1712432 - protein, 5 aa, Staphylococcus aureus
SERVA

SEQ ID NO: 1712433 - protein, 15 aa, Staphylococcus aureus
SESMAEDLEKIVEKA

SEQ ID NO: 1712434 - protein, 8 aa, Staphylococcus aureus
SEVEKNGY

SEQ ID NO: 1712435 - protein, 9 aa, Staphylococcus aureus
SEVEKNGYY

SEQ ID NO: 1712436 - protein, 11 aa, Staphylococcus aureus
SEVTDENASEY

SEQ ID NO: 1712437 - protein, 11 aa, Staphylococcus aureus
SFDGDYKQNIN

SEQ ID NO: 1712438 - protein, 6 aa, Staphylococcus aureus
SFKPSQ

SEQ ID NO: 1712439 - protein, 5 aa, Staphylococcus aureus
SFSNG

SEQ ID NO: 1712440 - protein, 7 aa, Staphylococcus aureus
SFSQTMK

SEQ ID NO: 1712441 - protein, 11 aa, Staphylococcus aureus
SFVTPNGQVSA

SEQ ID NO: 1712442 - protein, 4 aa, Staphylococcus aureus
SGFD

SEQ ID NO: 1712443 - protein, 24 aa, Staphylococcus aureus
SGFPGDKSDNRQYKGKGKLESFDE

SEQ ID NO: 1712444 - protein, 17 aa, Staphylococcus aureus
SGHAKQNQKSVNKHDKE

SEQ ID NO: 1712445 - protein, 15 aa, Staphylococcus aureus
SGKKDSAVSDKTVRQ

SEQ ID NO: 1712446 - protein, 11 aa, Staphylococcus aureus
SGKKIGGSDTP

SEQ ID NO: 1712447 - protein, 5 aa, Staphylococcus aureus
SGKVE

SEQ ID NO: 1712448 - protein, 46 aa, Staphylococcus aureus
SGTPTVVTTPSEVTAAANQVNSAKQELNGDERLREAKQNANTAIDG

SEQ ID NO: 1712449 - protein, 17 aa, Staphylococcus aureus
SGTVTQGSNPNGEKPTV

SEQ ID NO: 1712450 - protein, 7 aa, Staphylococcus aureus
SGYKEGD

SEQ ID NO: 1712451 - protein, 8 aa, Staphylococcus aureus
SGYREGNT

SEQ ID NO: 1712452 - protein, 11 aa, Staphylococcus aureus
SHAQAAETNQL

SEQ ID NO: 1712453 - protein, 18 aa, Staphylococcus aureus
SHDERKNLNSSQGKNEIT

SEQ ID NO: 1712454 - protein, 4 aa, Staphylococcus aureus
SHDQ

SEQ ID NO: 1712455 - protein, 28 aa, Staphylococcus aureus
SIANKDATKASEDYVDANHDKQTAYNNA

SEQ ID NO: 1712456 - protein, 28 aa, Staphylococcus aureus
SIANNDATKASEDYVDANNDKQTAYNNA

SEQ ID NO: 1712457 - protein, 35 aa, Staphylococcus aureus
SIASKDATKSSEDYQDANADLQNAYNRAVSDAEGI

SEQ ID NO: 1712458 - protein, 11 aa, Staphylococcus aureus
SIDKSAHSNDI

SEQ ID NO: 1712459 - protein, 11 aa, Staphylococcus aureus
SIKGQKTNSWN

SEQ ID NO: 1712460 - protein, 22 aa, Staphylococcus aureus
SIKYSQKSYVSEVEQQSSKTIK

SEQ ID NO: 1712461 - protein, 22 aa, Staphylococcus aureus
SINNAQKAALKSQIEGASTVAG

SEQ ID NO: 1712462 - protein, 34 aa, Staphylococcus aureus; identical to SEQ ID NO: 1643370

SEQ ID NO: 1712463 - protein, 34 aa, Staphylococcus aureus
SINNAQKDALTRSIDGATTVAGVNQETVKATKLN

SEQ ID NO: 1712464 - protein, 23 aa, Staphylococcus aureus
SINNAQKGDLTTKIDQATTVSGV

SEQ ID NO: 1712465 - protein, 10 aa, Staphylococcus aureus
SINSDSNDSV

SEQ ID NO: 1712466 - protein, 30 aa, Staphylococcus aureus; identical to SEQ ID NO: 1566479

SEQ ID NO: 1712467 - protein, 32 aa, Staphylococcus aureus; identical to SEQ ID NO: 1565319

SEQ ID NO: 1712468 - protein, 32 aa, Staphylococcus aureus; identical to SEQ ID NO: 1564853

SEQ ID NO: 1712469 - protein, 13 aa, Staphylococcus aureus
SISKGQKLTEKDK

SEQ ID NO: 1712470 - protein, 13 aa, Staphylococcus aureus
SITKEDKNGTISH

SEQ ID NO: 1712471 - protein, 12 aa, Staphylococcus aureus
SITSTGKKGEGI

SEQ ID NO: 1712472 - protein, 12 aa, Staphylococcus aureus
SITSTGKTGAGI

SEQ ID NO: 1712473 - protein, 8 aa, Staphylococcus aureus
SIVGSRAS

SEQ ID NO: 1712474 - protein, 8 aa, Staphylococcus aureus
SIYSPSSY

SEQ ID NO: 1712475 - protein, 26 aa, Staphylococcus aureus
SIYSSDSSSPVSGKVGEGVTSGGENT

SEQ ID NO: 1712476 - protein, 15 aa, Staphylococcus aureus
SKANGGNATQSEVEQ

SEQ ID NO: 1712477 - protein, 17 aa, Staphylococcus aureus
SKAVGKEKEGEKRLEKH

SEQ ID NO: 1712478 - protein, 14 aa, Staphylococcus aureus
SKDDFKTKKDEVTV

SEQ ID NO: 1712479 - protein, 14 aa, Staphylococcus aureus
SKDIDTKSADMTRT

SEQ ID NO: 1712480 - protein, 10 aa, Staphylococcus aureus
SKDKGQETTL

SEQ ID NO: 1712481 - protein, 15 aa, Staphylococcus aureus
SKDLDTKSADMTRTY

SEQ ID NO: 1712482 - protein, 19 aa, Staphylococcus aureus
SKDNDGKSLKASGLTLDTK

SEQ ID NO: 1712483 - protein, 12 aa, Staphylococcus aureus
SKDSKELESREK

SEQ ID NO: 1712484 - protein, 169 aa, Staphylococcus aureus; identical to SEQ ID NO: 1566945

SEQ ID NO: 1712485 - protein, 14 aa, Staphylococcus aureus
SKEAQKALQEDVKD

SEQ ID NO: 1712486 - protein, 11 aa, Staphylococcus aureus
SKEGIYSDKGQ

SEQ ID NO: 1712487 - protein, 4 aa, Staphylococcus aureus
SKEI

SEQ ID NO: 1712488 - protein, 9 aa, Staphylococcus aureus
SKEKDDETF

SEQ ID NO: 1712489 - protein, 16 aa, Staphylococcus aureus
SKEMKEKLASRSLDLN

SEQ ID NO: 1712490 - protein, 84 aa, Staphylococcus aureus
SKGESKEEITKDPINELTEYGPETIAPGHRDEFDPKLPTGEKEEVPGKPGIKNPETGDVVRPPVDSVTKYGPVKGDSIVEKEEI

SEQ ID NO: 1712491 - protein, 5 aa, Staphylococcus aureus
SKGLT

SEQ ID NO: 1712492 - protein, 5 aa, Staphylococcus aureus
SKHGS

SEQ ID NO: 1712493 - protein, 25 aa, Staphylococcus aureus
SKIEAKKVEELKTPDERKYKRETTN

SEQ ID NO: 1712494 - protein, 32 aa, Staphylococcus aureus
SKITSKKESHTGKWSDINKSQKDIQKTDEYYE

SEQ ID NO: 1712495 - protein, 17 aa, Staphylococcus aureus
SKKNRTALGIKSDCSSC

SEQ ID NO: 1712496 - protein, 9 aa, Staphylococcus aureus
SKKSHAANY

SEQ ID NO: 1712497 - protein, 5 aa, Staphylococcus aureus
SKKVK

SEQ ID NO: 1712498 - protein, 10 aa, Staphylococcus aureus
SKLNKDPIKE

SEQ ID NO: 1712499 - protein, 15 aa, Staphylococcus aureus
SKNVARYENINGENL

SEQ ID NO: 1712500 - protein, 7 aa, Staphylococcus aureus
SKPEIEL

SEQ ID NO: 1712501 - protein, 7 aa, Staphylococcus aureus
SKQAKYT

SEQ ID NO: 1712502 - protein, 26 aa, Staphylococcus aureus
SKQNEKAQNKFVNPNEYAKHKSKMDE

SEQ ID NO: 1712503 - protein, 12 aa, Staphylococcus aureus
SKSDFKPKNNNV

SEQ ID NO: 1712504 - protein, 15 aa, Staphylococcus aureus
SKSIDTKDIAGKSVN

SEQ ID NO: 1712505 - protein, 10 aa, Staphylococcus aureus
SKSNKPGVLD

SEQ ID NO: 1712506 - protein, 12 aa, Staphylococcus aureus
SKSTSPNTTSVS

SEQ ID NO: 1712507 - protein, 18 aa, Staphylococcus aureus
SKTDTTDKNSKEFKTLQE

SEQ ID NO: 1712508 - protein, 7 aa, Staphylococcus aureus
SKVKAER

SEQ ID NO: 1712509 - protein, 21 aa, Staphylococcus aureus
SKVQNTIKTDIKKEDSNTHVY

SEQ ID NO: 1712510 - protein, 15 aa, Staphylococcus aureus
SLEGIQRDTKRWKDE

SEQ ID NO: 1712511 - protein, 6 aa, Staphylococcus aureus
SLESQF

SEQ ID NO: 1712512 - protein, 4 aa, Staphylococcus aureus
SLSS

SEQ ID NO: 1712513 - protein, 16 aa, Staphylococcus aureus
SLTIPKDAENSTESAR

SEQ ID NO: 1712514 - protein, 15 aa, Staphylococcus aureus
SLTTDGHKVNNKDGI

SEQ ID NO: 1712515 - protein, 16 aa, Staphylococcus aureus
SNDTLKKTEDKEKRYP

SEQ ID NO: 1712516 - protein, 7 aa, Staphylococcus aureus
SNEGEVT

SEQ ID NO: 1712517 - protein, 7 aa, Staphylococcus aureus
SNFPEKL

SEQ ID NO: 1712518 - protein, 31 aa, Staphylococcus aureus
SNGEAKASENTQQSSTKHQTTQNNYVTDQQK

SEQ ID NO: 1712519 - protein, 29 aa, Staphylococcus aureus
SNGEAKASENTQQTSTKHQTTQNNYITDQ

SEQ ID NO: 1712520 - protein, 8 aa, Staphylococcus aureus
SNGLKQGR

SEQ ID NO: 1712521 - protein, 7 aa, Staphylococcus aureus
SNGTRDV

SEQ ID NO: 1712522 - protein, 12 aa, Staphylococcus aureus
SNHAKASVTDSV

SEQ ID NO: 1712523 - protein, 22 aa, Staphylococcus aureus
SNKDGKQDSTEKGIKDVTVTLQ

SEQ ID NO: 1712524 - protein, 10 aa, Staphylococcus aureus
SNLSGSKGSL

SEQ ID NO: 1712525 - protein, 14 aa, Staphylococcus aureus
SNNEATDEEQNAAI

SEQ ID NO: 1712526 - protein, 16 aa, Staphylococcus aureus
SNRASAVVSGEENPYV

SEQ ID NO: 1712527 - protein, 17 aa, Staphylococcus aureus
SNRASAVVSGEENPYVS

SEQ ID NO: 1712528 - protein, 24 aa, Staphylococcus aureus
SNSEDSGNITKTENAELRTGPNAA

SEQ ID NO: 1712529 - protein, 13 aa, Staphylococcus aureus
SNSTGKERNGFYK

SEQ ID NO: 1712530 - protein, 5 aa, Staphylococcus aureus
SNYNS

SEQ ID NO: 1712531 - protein, 4 aa, Staphylococcus aureus
SPAA

SEQ ID NO: 1712532 - protein, 5 aa, Staphylococcus aureus
SPAAL

SEQ ID NO: 1712533 - protein, 12 aa, Staphylococcus aureus
SPDTKKAKRNKR

SEQ ID NO: 1712534 - protein, 9 aa, Staphylococcus aureus
SPKNDAITD

SEQ ID NO: 1712535 - protein, 24 aa, Staphylococcus aureus
SPLTNAKQIQTNNTKTAHQSYENI

SEQ ID NO: 1712536 - protein, 22 aa, Staphylococcus aureus
SPNGPSGSAREYFAPDNQLPPL

SEQ ID NO: 1712537 - protein, 59 aa, Staphylococcus aureus
SQAHAAETNQPASVVKQKQQSNNEQTENRESQVQNSQNSINGQSLSATHENEQPNISQA

SEQ ID NO: 1712538 - protein, 58 aa, Staphylococcus aureus; identical to SEQ ID NO: 1568480

SEQ ID NO: 1712539 - protein, 162 aa, Staphylococcus aureus
SQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDV

SEQ ID NO: 1712540 - protein, 5 aa, Staphylococcus aureus
SQLNK

SEQ ID NO: 1712541 - protein, 15 aa, Staphylococcus aureus
SQNAGTLEARAKPLE

SEQ ID NO: 1712542 - protein, 9 aa, Staphylococcus aureus
SQNHIEGNT

SEQ ID NO: 1712543 - protein, 14 aa, Staphylococcus aureus
SQSGLYSKGLKQGR

SEQ ID NO: 1712544 - protein, 13 aa, Staphylococcus aureus
SQSNGYKIGEPSL

SEQ ID NO: 1712545 - protein, 27 aa, Staphylococcus aureus
SQVTNAKGALNGNHNLEQAKSNANTTI

SEQ ID NO: 1712546 - protein, 6 aa, Staphylococcus aureus
SRDFGN

SEQ ID NO: 1712547 - protein, 5 aa, Staphylococcus aureus
SRDVP

SEQ ID NO: 1712548 - protein, 16 aa, Staphylococcus aureus
SRKEEGAGGDFGRQQR

SEQ ID NO: 1712549 - protein, 6 aa, Staphylococcus aureus
SRKMSN

SEQ ID NO: 1712550 - protein, 11 aa, Staphylococcus aureus
SRNVEKDLTKS

SEQ ID NO: 1712551 - protein, 7 aa, Staphylococcus aureus
SRSLKEY

SEQ ID NO: 1712552 - protein, 15 aa, Staphylococcus aureus
SRTKDDKEPQVHIYS

SEQ ID NO: 1712553 - protein, 15 aa, Staphylococcus aureus
SRTTYSDLKNIHILK

SEQ ID NO: 1712554 - protein, 9 aa, Staphylococcus aureus
SRYSSSGKI

SEQ ID NO: 1712555 - protein, 37 aa, Staphylococcus aureus
SSANASQTDNGVNRSGSEDPTVYSATSTKKLHKEPAT

SEQ ID NO: 1712556 - protein, 12 aa, Staphylococcus aureus
SSDNSKSASMGN

SEQ ID NO: 1712557 - protein, 32 aa, Staphylococcus aureus; identical to SEQ ID NO: 1562055

SEQ ID NO: 1712558 - protein, 9 aa, Staphylococcus aureus
SSESKDSVN

SEQ ID NO: 1712559 - protein, 18 aa, Staphylococcus aureus
SSGNNLGGKSDFPASKSN

SEQ ID NO: 1712560 - protein, 11 aa, Staphylococcus aureus
SSGSDAFTNSE

SEQ ID NO: 1712561 - protein, 14 aa, Staphylococcus aureus
SSHFTDRDKRAIRR

SEQ ID NO: 1712562 - protein, 12 aa, Staphylococcus aureus
SSLGKGITASSL

SEQ ID NO: 1712563 - protein, 5 aa, Staphylococcus aureus
SSLGV

SEQ ID NO: 1712564 - protein, 23 aa, Staphylococcus aureus
SSLKDSLKKQGLLDEKGYDKDKL

SEQ ID NO: 1712565 - protein, 9 aa, Staphylococcus aureus
SSNNDIGHH

SEQ ID NO: 1712566 - protein, 10 aa, Staphylococcus aureus
SSNPVAVDDH

SEQ ID NO: 1712567 - protein, 12 aa, Staphylococcus aureus
SSQKNINKNSKK

SEQ ID NO: 1712568 - protein, 43 aa, Staphylococcus aureus
SSTAANALSSKAMDNHPQQSQSSKQQTPKIQKGGNLKPLEQRE

SEQ ID NO: 1712569 - protein, 6 aa, Staphylococcus aureus
SSTEQL

SEQ ID NO: 1712570 - protein, 14 aa, Staphylococcus aureus
SSVGKPEQAKGGNL

SEQ ID NO: 1712571 - protein, 19 aa, Staphylococcus aureus
STAQTVNASEHESKYENVT

SEQ ID NO: 1712572 - protein, 13 aa, Staphylococcus aureus
STDPLTVDNNGNV

SEQ ID NO: 1712573 - protein, 15 aa, Staphylococcus aureus
STEPSVNYDLFGAQG

SEQ ID NO: 1712574 - protein, 27 aa, Staphylococcus aureus
STGANFNTNEASAAAKQLDKSSSSLHH

SEQ ID NO: 1712575 - protein, 28 aa, Staphylococcus aureus
STGANFNTNEASAAAKQLVKSSSSLHHG

SEQ ID NO: 1712576 - protein, 14 aa, Staphylococcus aureus
STGQNTTSVTSTNY

SEQ ID NO: 1712577 - protein, 5 aa, Staphylococcus aureus
STITA

SEQ ID NO: 1712578 - protein, 10 aa, Staphylococcus aureus
STLTPRSFSD

SEQ ID NO: 1712579 - protein, 11 aa, Staphylococcus aureus
STNKKNITAQE

SEQ ID NO: 1712580 - protein, 17 aa, Staphylococcus aureus
STQFPNTPISSSTEAKA

SEQ ID NO: 1712581 - protein, 13 aa, Staphylococcus aureus
STQIDDGTETNYD

SEQ ID NO: 1712582 - protein, 20 aa, Staphylococcus aureus
STQNTKSTARGTRFIKRMME

SEQ ID NO: 1712583 - protein, 107 aa, Staphylococcus aureus
STSAITTTAQAVNAEQNHTANPEQAAKSNTENVSTSLSTQTEQTPKSNIQKATQPAPSGTTQSLPNAQPQSTQPTPSVTTPPSSNVETPQPTSPTTKQAQKEIKPKF

SEQ ID NO: 1712584 - protein, 22 aa, Staphylococcus aureus
STTGLNDPDADPSVRLSPYTRQ

SEQ ID NO: 1712585 - protein, 20 aa, Staphylococcus aureus
STTNNESNKETKSVPEEMEA

SEQ ID NO: 1712586 - protein, 6 aa, Staphylococcus aureus
SVEKPI

SEQ ID NO: 1712587 - protein, 11 aa, Staphylococcus aureus
SVENGKVNGKF

SEQ ID NO: 1712588 - protein, 13 aa, Staphylococcus aureus
SVGESEDAKGGNL

SEQ ID NO: 1712589 - protein, 16 aa, Staphylococcus aureus
SVGGITKANRKKVDYK

SEQ ID NO: 1712590 - protein, 18 aa, Staphylococcus aureus
SVGGITKTNSKKVDHKAE

SEQ ID NO: 1712591 - protein, 18 aa, Staphylococcus aureus
SVINNDQNATTEEKEAAI

SEQ ID NO: 1712592 - protein, 4 aa, Staphylococcus aureus
SVKP

SEQ ID NO: 1712593 - protein, 6 aa, Staphylococcus aureus
SVLTKG

SEQ ID NO: 1712594 - protein, 13 aa, Staphylococcus aureus
SVSTDGASPKLTK

SEQ ID NO: 1712595 - protein, 15 aa, Staphylococcus aureus
SVTNTPNGSNVSTIT

SEQ ID NO: 1712596 - protein, 4 aa, Staphylococcus aureus
SYKS

SEQ ID NO: 1712597 - protein, 13 aa, Staphylococcus aureus
SYRKRYDKQYSRI

SEQ ID NO: 1712598 - protein, 5 aa, Staphylococcus aureus
SYSNN

SEQ ID NO: 1712599 - protein, 6 aa, Staphylococcus aureus
SYTDEL

SEQ ID NO: 1712600 - protein, 6 aa, Staphylococcus aureus
SYTPKR

SEQ ID NO: 1712601 - protein, 8 aa, Staphylococcus aureus
SYVNGKEQ

SEQ ID NO: 1712602 - protein, 9 aa, Staphylococcus aureus
SYYTKPSLE

SEQ ID NO: 1712603 - protein, 43 aa, Staphylococcus aureus; identical to SEQ ID NO: 1569547

SEQ ID NO: 1712604 - protein, 43 aa, Staphylococcus aureus; identical to SEQ ID NO: 1572447

SEQ ID NO: 1712605 - protein, 18 aa, Staphylococcus aureus
TAISNDTQKLKDYYTGTS

SEQ ID NO: 1712606 - protein, 21 aa, Staphylococcus aureus
TAKPTPAPTPKPSTPTTNNKL

SEQ ID NO: 1712607 - protein, 23 aa, Staphylococcus aureus
TAKPTPTPTPTPKPSTPTTNNKL

SEQ ID NO: 1712608 - protein, 9 aa, Staphylococcus aureus
TALTGDEKQ

SEQ ID NO: 1712609 - protein, 4 aa, Staphylococcus aureus
TAQE

SEQ ID NO: 1712610 - protein, 12 aa, Staphylococcus aureus
TAQRNDLTNQIS

SEQ ID NO: 1712611 - protein, 34 aa, Staphylococcus aureus; identical to SEQ ID NO: 1568494

SEQ ID NO: 1712612 - protein, 11 aa, Staphylococcus aureus
TARDAVKQQYE

SEQ ID NO: 1712613 - protein, 5 aa, Staphylococcus aureus
TASTW

SEQ ID NO: 1712614 - protein, 13 aa, Staphylococcus aureus
TASTWKKFEVYEG

SEQ ID NO: 1712615 - protein, 7 aa, Staphylococcus aureus
TATFDND

SEQ ID NO: 1712616 - protein, 18 aa, Staphylococcus aureus
TATQIPNSPLNVSTDAKA

SEQ ID NO: 1712617 - protein, 18 aa, Staphylococcus aureus
TATQTPNSPLNVSTDAKA

SEQ ID NO: 1712618 - protein, 18 aa, Staphylococcus aureus
TATQTSNSPLNVSTDAKA

SEQ ID NO: 1712619 - protein, 7 aa, Staphylococcus aureus
TATRNTA

SEQ ID NO: 1712620 - protein, 14 aa, Staphylococcus aureus
TDADKAKKDAYTNA

SEQ ID NO: 1712621 - protein, 15 aa, Staphylococcus aureus
TDADKAKKDAYTNAV

SEQ ID NO: 1712622 - protein, 33 aa, Staphylococcus aureus
TDAQKSNLTSQIESGTTVSGVQGIQANAGTLNE

SEQ ID NO: 1712623 - protein, 17 aa, Staphylococcus aureus
TDDNDGRPIDNKKKYPV

SEQ ID NO: 1712624 - protein, 32 aa, Staphylococcus aureus
TDDRGTDSLDKDSLKKLKDTGDYQVKRSQPMN

SEQ ID NO: 1712625 - protein, 4 aa, Staphylococcus aureus
TDKG

SEQ ID NO: 1712626 - protein, 40 aa, Staphylococcus aureus
TDKLKEKNIVKDGDTVTIHSKDSTDPEISAKVGENYNGNK

SEQ ID NO: 1712627 - protein, 12 aa, Staphylococcus aureus
TDPKEATAETRE

SEQ ID NO: 1712628 - protein, 15 aa, Staphylococcus aureus
TDPSISNSDDSGQFN

SEQ ID NO: 1712629 - protein, 26 aa, Staphylococcus aureus
TDQAKKGITDATTTAEVEKAKAQGLE

SEQ ID NO: 1712630 - protein, 12 aa, Staphylococcus aureus
TDSNIDKDAHHD

SEQ ID NO: 1712631 - protein, 18 aa, Staphylococcus aureus
TEDKKGYVHNKEKKYPVK

SEQ ID NO: 1712632 - protein, 17 aa, Staphylococcus aureus
TEDSKGYSHNKDTKYPV

SEQ ID NO: 1712633 - protein, 17 aa, Staphylococcus aureus
TEDSKGYSHSKDTKYPV

SEQ ID NO: 1712634 - protein, 17 aa, Staphylococcus aureus
TEHDGNQIDKNNLTDNS

SEQ ID NO: 1712635 - protein, 18 aa, Staphylococcus aureus
TEHDGNQIDKNNLTDNSH

SEQ ID NO: 1712636 - protein, 4 aa, Staphylococcus aureus
TELQ

SEQ ID NO: 1712637 - protein, 14 aa, Staphylococcus aureus
TENQSVNAKGKYEK

SEQ ID NO: 1712638 - protein, 13 aa, Staphylococcus aureus
TEVGNNGNFGASL

SEQ ID NO: 1712639 - protein, 15 aa, Staphylococcus aureus
TEYQTANAPKTATVT

SEQ ID NO: 1712640 - protein, 9 aa, Staphylococcus aureus
TFAPDSDKI

SEQ ID NO: 1712641 - protein, 24 aa, Staphylococcus aureus
TFQSNGEEKVTSSLNGSKTEKNLK

SEQ ID NO: 1712642 - protein, 13 aa, Staphylococcus aureus
TFTPEAPKTITEL

SEQ ID NO: 1712643 - protein, 7 aa, Staphylococcus aureus
TGAGTTV

SEQ ID NO: 1712644 - protein, 114 aa, Staphylococcus aureus
TGANTATTQAANTRQERTPKLEKAPNTNEEKTSASKIEKISQPKQEAQKSLNISATPAPKQEQSQTTTESTTPKTKVTTPPSINTPQPMQSTKSDTPQSPTIKQAQTDMTPKYE

SEQ ID NO: 1712645 - protein, 36 aa, Staphylococcus aureus
TGANTGATQAANTRQERMPKLEKAPNTNEEKTSISK

SEQ ID NO: 1712646 - protein, 16 aa, Staphylococcus aureus
TGDPRVGYKDISKKVK

SEQ ID NO: 1712647 - protein, 14 aa, Staphylococcus aureus
TGDPSKVGHLPGAT

SEQ ID NO: 1712648 - protein, 4 aa, Staphylococcus aureus
TGFA

SEQ ID NO: 1712649 - protein, 10 aa, Staphylococcus aureus
TGFKYTDEGK

SEQ ID NO: 1712650 - protein, 14 aa, Staphylococcus aureus
TGGLNGSKSFSETI

SEQ ID NO: 1712651 - protein, 16 aa, Staphylococcus aureus
TGSDGAIKISTRYIEV

SEQ ID NO: 1712652 - protein, 13 aa, Staphylococcus aureus
TIDQIDKTNNTYR

SEQ ID NO: 1712653 - protein, 26 aa, Staphylococcus aureus
TIHSKDPSDEKVYGKVGDQDSNVKNR

SEQ ID NO: 1712654 - protein, 14 aa, Staphylococcus aureus
TINQKAQALVMRWN

SEQ ID NO: 1712655 - protein, 17 aa, Staphylococcus aureus
TIQSPHSPISMSSNAKA

SEQ ID NO: 1712656 - protein, 13 aa, Staphylococcus aureus
TITTGKKESATTD

SEQ ID NO: 1712657 - protein, 12 aa, Staphylococcus aureus
TKAENNKLDSPR

SEQ ID NO: 1712658 - protein, 14 aa, Staphylococcus aureus
TKAEPSETKAYINV

SEQ ID NO: 1712659 - protein, 14 aa, Staphylococcus aureus
TKDFPSGNSGVDMN

SEQ ID NO: 1712660 - protein, 27 aa, Staphylococcus aureus
TKDKKGYTHDKDKKGYTHDKDKKYPVK

SEQ ID NO: 1712661 - protein, 20 aa, Staphylococcus aureus
TKDYNGKSQVNAGSKNGTLI

SEQ ID NO: 1712662 - protein, 22 aa, Staphylococcus aureus
TKDYSGKSQVNAGSKNGTPISN

SEQ ID NO: 1712663 - protein, 20 aa, Staphylococcus aureus
TKDYSKESRVKEESKYDSPM

SEQ ID NO: 1712664 - protein, 4 aa, Staphylococcus aureus
TKEE

SEQ ID NO: 1712665 - protein, 9 aa, Staphylococcus aureus
TKEKGEDAF

SEQ ID NO: 1712666 - protein, 8 aa, Staphylococcus aureus
TKEQTTFE

SEQ ID NO: 1712667 - protein, 9 aa, Staphylococcus aureus
TKEQTTFEE

SEQ ID NO: 1712668 - protein, 13 aa, Staphylococcus aureus
TKFADGAKAKDRI

SEQ ID NO: 1712669 - protein, 17 aa, Staphylococcus aureus
TKGGNHKDTNPEKEQVD

SEQ ID NO: 1712670 - protein, 15 aa, Staphylococcus aureus
TKGKTYEKEKKYPVK

SEQ ID NO: 1712671 - protein, 11 aa, Staphylococcus aureus
TKGQQTHVNGD

SEQ ID NO: 1712672 - protein, 16 aa, Staphylococcus aureus
TKIGDGDVEKVAKEKP

SEQ ID NO: 1712673 - protein, 17 aa, Staphylococcus aureus
TKIGDGDVEKVAKEKPD

SEQ ID NO: 1712674 - protein, 6 aa, Staphylococcus aureus
TKKAPK

SEQ ID NO: 1712675 - protein, 17 aa, Staphylococcus aureus
TKKDGKYYVKNMTNSIG

SEQ ID NO: 1712676 - protein, 15 aa, Staphylococcus aureus
TKKHVENKAKRNYQV

SEQ ID NO: 1712677 - protein, 4 aa, Staphylococcus aureus
TKKN

SEQ ID NO: 1712678 - protein, 18 aa, Staphylococcus aureus
TKKNAAGEYVLTGEKWGY

SEQ ID NO: 1712679 - protein, 17 aa, Staphylococcus aureus
TKKQVEDKKKDKANYQV

SEQ ID NO: 1712680 - protein, 29 aa, Staphylococcus aureus
TKLEHNNKTLRDTAKKNLDDSKENEVKGA

SEQ ID NO: 1712681 - protein, 26 aa, Staphylococcus aureus
TKLEKESIQDVKNTKKYKNVERSKSY

SEQ ID NO: 1712682 - protein, 7 aa, Staphylococcus aureus
TKNNWKD

SEQ ID NO: 1712683 - protein, 13 aa, Staphylococcus aureus
TKPIQDDKLKKEI

SEQ ID NO: 1712684 - protein, 5 aa, Staphylococcus aureus
TKRYP

SEQ ID NO: 1712685 - protein, 10 aa, Staphylococcus aureus
TKSPDVYPGM

SEQ ID NO: 1712686 - protein, 40 aa, Staphylococcus aureus
TKTKENKANAKSVQQGKVNKPKQQAKTLPDTGMSHNDDLP

SEQ ID NO: 1712687 - protein, 12 aa, Staphylococcus aureus
TKTKISLKNFKF

SEQ ID NO: 1712688 - protein, 22 aa, Staphylococcus aureus
TLASTADASEGYGPREKKPVSI

SEQ ID NO: 1712689 - protein, 33 aa, Staphylococcus aureus; identical to SEQ ID NO: 1566966

SEQ ID NO: 1712690 - protein, 33 aa, Staphylococcus aureus; identical to SEQ ID NO: 1567267

SEQ ID NO: 1712691 - protein, 33 aa, Staphylococcus aureus
TLETDKTKYSWSNSYSNVNGSSTANGDQKKYNL

SEQ ID NO: 1712692 - protein, 9 aa, Staphylococcus aureus
TLSESYDGV

SEQ ID NO: 1712693 - protein, 22 aa, Staphylococcus aureus
TMPGATPQSTQDEISSKIDNQV

SEQ ID NO: 1712694 - protein, 14 aa, Staphylococcus aureus
TNASGFSEKRKTDG

SEQ ID NO: 1712695 - protein, 10 aa, Staphylococcus aureus
TNDGKDLPQS

SEQ ID NO: 1712696 - protein, 9 aa, Staphylococcus aureus
TNGKDMESR

SEQ ID NO: 1712697 - protein, 18 aa, Staphylococcus aureus
TNGLSGGLNGSKSFSETI

SEQ ID NO: 1712698 - protein, 13 aa, Staphylococcus aureus
TNGRNAQIKDTFN

SEQ ID NO: 1712699 - protein, 44 aa, Staphylococcus aureus
TNHDKAATTSTTPPSNDKTAPKSTKAQDASTDKHPNQQDTHQPA

SEQ ID NO: 1712700 - protein, 10 aa, Staphylococcus aureus
TNIDTPKNID

SEQ ID NO: 1712701 - protein, 19 aa, Staphylococcus aureus
TNITNDRTNQQVNDSTNQV

SEQ ID NO: 1712702 - protein, 6 aa, Staphylococcus aureus
TNITSD

SEQ ID NO: 1712703 - protein, 16 aa, Staphylococcus aureus
TNKSGFSEKSKADGIS

SEQ ID NO: 1712704 - protein, 14 aa, Staphylococcus aureus
TNKSGFSEKSKTDG

SEQ ID NO: 1712705 - protein, 9 aa, Staphylococcus aureus
TNLERSNEY

SEQ ID NO: 1712706 - protein, 34 aa, Staphylococcus aureus
TNNQKSAISSQIDRAGHVSEVTAAKNAATELNTQ

SEQ ID NO: 1712707 - protein, 35 aa, Staphylococcus aureus; identical to SEQ ID NO: 1569586

SEQ ID NO: 1712708 - protein, 36 aa, Staphylococcus aureus; identical to SEQ ID NO: 1568524

SEQ ID NO: 1712709 - protein, 36 aa, Staphylococcus aureus
TNNQKSAISTQIDRAGHVSEVTAAKNAATELNTQMG

SEQ ID NO: 1712710 - protein, 162 aa, Staphylococcus aureus
TNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAQPAAPVAANAQTQDPNASNTGEGSINT

SEQ ID NO: 1712711 - protein, 158 aa, Staphylococcus aureus
TNPTTASAAEQNQPAQNQPAQPADVNTQPNANAGAQANPTAQPAAPANQGQPAAQPANQGGQANPAGGAAQPNTQPAGQGNQADPNNAAQAQPGNQAAPANQAGQGNNQATPNNNATPANQTQPANAPAAAQPAAPVAANAQTQDPNASNTREGSINT

SEQ ID NO: 1712712 - protein, 9 aa, Staphylococcus aureus
TNQTGSKKG

SEQ ID NO: 1712713 - protein, 8 aa, Staphylococcus aureus
TNSDQSWQ

SEQ ID NO: 1712714 - protein, 5 aa, Staphylococcus aureus
TNSMD

SEQ ID NO: 1712715 - protein, 40 aa, Staphylococcus aureus
TNTDKHEAKATSAQQGKENKAKQQAKTLPDTGMSHNDDLP

SEQ ID NO: 1712716 - protein, 10 aa, Staphylococcus aureus
TNVQTPNYEK

SEQ ID NO: 1712717 - protein, 12 aa, Staphylococcus aureus
TNVSGQSQDYYE

SEQ ID NO: 1712718 - protein, 19 aa, Staphylococcus aureus
TNVVGSGDGVEVYVHCDDH

SEQ ID NO: 1712719 - protein, 26 aa, Staphylococcus aureus
TPAGYLPTKENGTTDGEKDSNGSSVT

SEQ ID NO: 1712720 - protein, 26 aa, Staphylococcus aureus
TPAGYLPTKVNGTTDGEKDSNGSSVT

SEQ ID NO: 1712721 - protein, 26 aa, Staphylococcus aureus
TPAITQSDKSSKDESFAVGNTKNPKN

SEQ ID NO: 1712722 - protein, 11 aa, Staphylococcus aureus
TPFKETSQNDT

SEQ ID NO: 1712723 - protein, 5 aa, Staphylococcus aureus
TPGHA

SEQ ID NO: 1712724 - protein, 11 aa, Staphylococcus aureus
TPGHKNETSAA

SEQ ID NO: 1712725 - protein, 36 aa, Staphylococcus aureus
TPRLEDKKLKKTESIPTGNNVTQLKQKASVTMPTSQ

SEQ ID NO: 1712726 - protein, 46 aa, Staphylococcus aureus
TPRLEDKKVKETENIPTGNNVTQLKQKASVTMPTSQFKSNNYTYNE

SEQ ID NO: 1712727 - protein, 9 aa, Staphylococcus aureus
TPSFTSNGF

SEQ ID NO: 1712728 - protein, 6 aa, Staphylococcus aureus
TPVPLS

SEQ ID NO: 1712729 - protein, 19 aa, Staphylococcus aureus
TPYSGEKNSKNTMESPKNI

SEQ ID NO: 1712730 - protein, 5 aa, Staphylococcus aureus
TQALQ

SEQ ID NO: 1712731 - protein, 8 aa, Staphylococcus aureus
TQDAESNI

SEQ ID NO: 1712732 - protein, 8 aa, Staphylococcus aureus
TQDRHTQA

SEQ ID NO: 1712733 - protein, 14 aa, Staphylococcus aureus
TQGAHANYYPGNSP

SEQ ID NO: 1712734 - protein, 14 aa, Staphylococcus aureus
TQGRSPQLLNRMTT

SEQ ID NO: 1712735 - protein, 34 aa, Staphylococcus aureus; identical to SEQ ID NO: 1572571

SEQ ID NO: 1712736 - protein, 8 aa, Staphylococcus aureus
TQKEHGVG

SEQ ID NO: 1712737 - protein, 12 aa, Staphylococcus aureus
TQLENKKTNDRL

SEQ ID NO: 1712738 - protein, 7 aa, Staphylococcus aureus
TQQGFKK

SEQ ID NO: 1712739 - protein, 7 aa, Staphylococcus aureus
TQQGFKQ

SEQ ID NO: 1712740 - protein, 17 aa, Staphylococcus aureus
TQTTKQQVQKEKNHVSE

SEQ ID NO: 1712741 - protein, 51 aa, Staphylococcus aureus; identical to SEQ ID NO: 1644541

SEQ ID NO: 1712742 - protein, 15 aa, Staphylococcus aureus
TRANNDSKEAVNKTN

SEQ ID NO: 1712743 - protein, 17 aa, Staphylococcus aureus
TRNESVDSNDSAAVTVT

SEQ ID NO: 1712744 - protein, 26 aa, Staphylococcus aureus
TRNESVDSNDSAAVTVTPQLQATSEG

SEQ ID NO: 1712745 - protein, 13 aa, Staphylococcus aureus
TRNESVDSNDSAS

SEQ ID NO: 1712746 - protein, 7 aa, Staphylococcus aureus
TRTTNGY

SEQ ID NO: 1712747 - protein, 4 aa, Staphylococcus aureus
TSAI

SEQ ID NO: 1712748 - protein, 4 aa, Staphylococcus aureus
TSAK

SEQ ID NO: 1712749 - protein, 16 aa, Staphylococcus aureus
TSEGQAVQAKEKQERV

SEQ ID NO: 1712750 - protein, 10 aa, Staphylococcus aureus
TSEHSYAKEN

SEQ ID NO: 1712751 - protein, 16 aa, Staphylococcus aureus
TSKSNGQNTTSVTSEY

SEQ ID NO: 1712752 - protein, 18 aa, Staphylococcus aureus
TSLEDIEKAETKYDHTKV

SEQ ID NO: 1712753 - protein, 10 aa, Staphylococcus aureus
TSPPVEGRGV

SEQ ID NO: 1712754 - protein, 30 aa, Staphylococcus aureus; identical to SEQ ID NO: 1567277

SEQ ID NO: 1712755 - protein, 20 aa, Staphylococcus aureus
TSTAQTVDASEHESKYENVT

SEQ ID NO: 1712756 - protein, 15 aa, Staphylococcus aureus
TSTGFAGGGATAEDV

SEQ ID NO: 1712757 - protein, 14 aa, Staphylococcus aureus
TSVDSDSSYNQNDY

SEQ ID NO: 1712758 - protein, 21 aa, Staphylococcus aureus
TSVKSDSSYDSNDTLNSYSDI

SEQ ID NO: 1712759 - protein, 9 aa, Staphylococcus aureus
TTAETATSI

SEQ ID NO: 1712760 - protein, 4 aa, Staphylococcus aureus
TTAN

SEQ ID NO: 1712761 - protein, 26 aa, Staphylococcus aureus
TTAQPVKADENSSRLAVTSKDTQELK

SEQ ID NO: 1712762 - protein, 15 aa, Staphylococcus aureus
TTAQPVKAESMDSSL

SEQ ID NO: 1712763 - protein, 25 aa, Staphylococcus aureus
TTAQPVKAIEQSRLSVTSKDTQELK

SEQ ID NO: 1712764 - protein, 14 aa, Staphylococcus aureus
TTAQPVKANEISSR

SEQ ID NO: 1712765 - protein, 22 aa, Staphylococcus aureus
TTAQPVKASTLEARSQATQDLK

SEQ ID NO: 1712766 - protein, 10 aa, Staphylococcus aureus
TTEMKNENMV

SEQ ID NO: 1712767 - protein, 5 aa, Staphylococcus aureus
TTETY

SEQ ID NO: 1712768 - protein, 6 aa, Staphylococcus aureus
TTKKSP

SEQ ID NO: 1712769 - protein, 24 aa, Staphylococcus aureus
TTMNQAKDALNGDEKLAHAKQDAI

SEQ ID NO: 1712770 - protein, 23 aa, Staphylococcus aureus
TTMPGATPQSTQDEISSKIDNQV

SEQ ID NO: 1712771 - protein, 8 aa, Staphylococcus aureus
TTNNSPNL

SEQ ID NO: 1712772 - protein, 9 aa, Staphylococcus aureus
TTNSEQSWQ

SEQ ID NO: 1712773 - protein, 12 aa, Staphylococcus aureus
TTQSAKAEVASA

SEQ ID NO: 1712774 - protein, 8 aa, Staphylococcus aureus
TTRGPNAR

SEQ ID NO: 1712775 - protein, 32 aa, Staphylococcus aureus
TTRKQQIKKSNASLQDEKDVANDKIGKIETKA

SEQ ID NO: 1712776 - protein, 27 aa, Staphylococcus aureus
TTTAAPSSNGRSISNSYASGSNLYTSG

SEQ ID NO: 1712777 - protein, 98 aa, Staphylococcus aureus
TTTTQAAKASTPSSTKVEAPQSTPPSTKVEAPQSKPNATTPSSTKVEAPQQTANATTPPSTKVTTPPSTNTPQPMQSTKSDTPQSPTTKQVPTEINPK

SEQ ID NO: 1712778 - protein, 98 aa, Staphylococcus aureus
TTTTQAANATTLSSTKVEAPQSTPPSTKIEAPQSKPNATTPPSTKVEAPQQTANATTPPSTKVTTPPSTNTPQPMQSTKSDTPQSPTTKQVPTEINPK

SEQ ID NO: 1712779 - protein, 122 aa, Staphylococcus aureus
TTTTQAANATTPSSTKIEAPQQVANATTPSSTKVETPQQTPNAPTPPSTKVEAPQQAANATTPSSTKVEVPKQAANATTPSSTKVEAPQSKPNATTPPSSNVDTSPLQSPTTKQVPTEINPK

SEQ ID NO: 1712780 - protein, 35 aa, Staphylococcus aureus
TTTTQEANATTPSSTKVETPQSPTTKQVPTEINPK

SEQ ID NO: 1712781 - protein, 4 aa, Staphylococcus aureus
TTVA

SEQ ID NO: 1712782 - protein, 5 aa, Staphylococcus aureus
TTVEL

SEQ ID NO: 1712783 - protein, 14 aa, Staphylococcus aureus
TTVSNIQNTDNIAN

SEQ ID NO: 1712784 - protein, 5 aa, Staphylococcus aureus
TTYDE

SEQ ID NO: 1712785 - protein, 13 aa, Staphylococcus aureus
TTYPTMDPNTIQQ

SEQ ID NO: 1712786 - protein, 26 aa, Staphylococcus aureus
TVESGKANAESAKAVDKEMKQREKIG

SEQ ID NO: 1712787 - protein, 4 aa, Staphylococcus aureus
TVGH

SEQ ID NO: 1712788 - protein, 6 aa, Staphylococcus aureus
TVGNTH

SEQ ID NO: 1712789 - protein, 33 aa, Staphylococcus aureus
TVPATSQLTGTVDNNHQHVSATAPNVTSATNKT

SEQ ID NO: 1712790 - protein, 33 aa, Staphylococcus aureus; identical to SEQ ID NO: 1644709

SEQ ID NO: 1712791 - protein, 8 aa, Staphylococcus aureus
TVQENGNY

SEQ ID NO: 1712792 - protein, 12 aa, Staphylococcus aureus
TVSNGSNSANQD

SEQ ID NO: 1712793 - protein, 28 aa, Staphylococcus aureus
TYAYGPRSESFSGNIENTESAKIIFVYI

SEQ ID NO: 1712794 - protein, 16 aa, Staphylococcus aureus
TYGKKATQTAIKTKSF

SEQ ID NO: 1712795 - protein, 9 aa, Staphylococcus aureus
TYNTDRYNA

SEQ ID NO: 1712796 - protein, 68 aa, Staphylococcus aureus
TYSYNNASYNNYTNNSQTATNNYYTGGSGASYSTTSNNVRVTTTAAPSSNGRSISNGYASGSNLYTSG

SEQ ID NO: 1712797 - protein, 12 aa, Staphylococcus aureus
TYSYNNESYNNY

SEQ ID NO: 1712798 - protein, 7 aa, Staphylococcus aureus
VAAANTN

SEQ ID NO: 1712799 - protein, 16 aa, Staphylococcus aureus
VADAPENGFKKGDTVK

SEQ ID NO: 1712800 - protein, 34 aa, Staphylococcus aureus
VADKEQVKRTEDYADADSAKQNAYNSAVSSAETI

SEQ ID NO: 1712801 - protein, 32 aa, Staphylococcus aureus; identical to SEQ ID NO: 1566302

SEQ ID NO: 1712802 - protein, 11 aa, Staphylococcus aureus
VAKENANNTID

SEQ ID NO: 1712803 - protein, 20 aa, Staphylococcus aureus
VALDGDENLAAAKQQANNRL

SEQ ID NO: 1712804 - protein, 40 aa, Staphylococcus aureus; identical to SEQ ID NO: 1566734

SEQ ID NO: 1712805 - protein, 25 aa, Staphylococcus aureus
VATAKQNINAADTNQEVAQAKDQGM

SEQ ID NO: 1712806 - protein, 15 aa, Staphylococcus aureus
VDDEDDNSENQINPD

SEQ ID NO: 1712807 - protein, 28 aa, Staphylococcus aureus
VDNQEKQNDVNQAVQPQNNTNETSKVPA

SEQ ID NO: 1712808 - protein, 27 aa, Staphylococcus aureus
VDQVNTDKAQPNYTEASTDKKEAVDQA

SEQ ID NO: 1712809 - protein, 15 aa, Staphylococcus aureus
VDTKKQPKDKAKANV

SEQ ID NO: 1712810 - protein, 10 aa, Staphylococcus aureus
VEEEYDSSTL

SEQ ID NO: 1712811 - protein, 25 aa, Staphylococcus aureus
VEGAEGHAEGIVETEEDSIHVDFEE

SEQ ID NO: 1712812 - protein, 9 aa, Staphylococcus aureus
VEGETDTIY

SEQ ID NO: 1712813 - protein, 4 aa, Staphylococcus aureus
VEMK

SEQ ID NO: 1712814 - protein, 16 aa, Staphylococcus aureus
VEPGSYSYSNKNAVNL

SEQ ID NO: 1712815 - protein, 8 aa, Staphylococcus aureus
VERQTQEQ

SEQ ID NO: 1712816 - protein, 4 aa, Staphylococcus aureus
VETG

SEQ ID NO: 1712817 - protein, 42 aa, Staphylococcus aureus
VEVSSSSLDDLGDEEEEVEEKEEVQEEETGAKSTVKTPRYEK

SEQ ID NO: 1712818 - protein, 42 aa, Staphylococcus aureus
VEVSSSSLDDLGDEEEEVEEKEEVQEEETGAKSTVTTPRYEK

SEQ ID NO: 1712819 - protein, 6 aa, Staphylococcus aureus
VFEPDE

SEQ ID NO: 1712820 - protein, 39 aa, Staphylococcus aureus
VGGITKTNSKKVDHKAELSITKKDEEGKISRDVSEYKIT

SEQ ID NO: 1712821 - protein, 29 aa, Staphylococcus aureus
VGGSDAQNTSNTSPQAGSASSHTVQSGES

SEQ ID NO: 1712822 - protein, 8 aa, Staphylococcus aureus
VGKEGVDK

SEQ ID NO: 1712823 - protein, 4 aa, Staphylococcus aureus
VGMN

SEQ ID NO: 1712824 - protein, 13 aa, Staphylococcus aureus
VGQGFQPPAEKNA

SEQ ID NO: 1712825 - protein, 9 aa, Staphylococcus aureus
VGRGTTEKI

SEQ ID NO: 1712826 - protein, 14 aa, Staphylococcus aureus
VINSNDAGVNFELT

SEQ ID NO: 1712827 - protein, 11 aa, Staphylococcus aureus
VKDDKAKTREL

SEQ ID NO: 1712828 - protein, 8 aa, Staphylococcus aureus
VKDQETAV

SEQ ID NO: 1712829 - protein, 18 aa, Staphylococcus aureus
VKDYDGQYIGEHKKETKY

SEQ ID NO: 1712830 - protein, 28 aa, Staphylococcus aureus
VKDYTTDINGTTITNKYTPGETSATVTK

SEQ ID NO: 1712831 - protein, 11 aa, Staphylococcus aureus
VKEDKQIKENF

SEQ ID NO: 1712832 - protein, 13 aa, Staphylococcus aureus
VKEHQPDYKDIKV

SEQ ID NO: 1712833 - protein, 13 aa, Staphylococcus aureus
VKKPEAEKTINQD

SEQ ID NO: 1712834 - protein, 11 aa, Staphylococcus aureus
VKKQAAKDEID

SEQ ID NO: 1712835 - protein, 17 aa, Staphylococcus aureus
VKKTESEWTSSKEWKNL

SEQ ID NO: 1712836 - protein, 18 aa, Staphylococcus aureus
VKLEGKDKDKIKDGNNDN

SEQ ID NO: 1712837 - protein, 12 aa, Staphylococcus aureus
VKNGEIDSIYWD

SEQ ID NO: 1712838 - protein, 6 aa, Staphylococcus aureus
VKNTRQ

SEQ ID NO: 1712839 - protein, 23 aa, Staphylococcus aureus
VKPDPPRIDGNSVTYKAGLTNQE

SEQ ID NO: 1712840 - protein, 12 aa, Staphylococcus aureus
VKPVNNSWSTNA

SEQ ID NO: 1712841 - protein, 9 aa, Staphylococcus aureus
VKQPKGKIM

SEQ ID NO: 1712842 - protein, 10 aa, Staphylococcus aureus
VKQTATSLDQ

SEQ ID NO: 1712843 - protein, 14 aa, Staphylococcus aureus
VKTAKAEEKMTDGQ

SEQ ID NO: 1712844 - protein, 13 aa, Staphylococcus aureus
VKTGAKAKADSYV

SEQ ID NO: 1712845 - protein, 6 aa, Staphylococcus aureus
VKTKKK

SEQ ID NO: 1712846 - protein, 4 aa, Staphylococcus aureus
VLEG

SEQ ID NO: 1712847 - protein, 7 aa, Staphylococcus aureus
VLESNRG

SEQ ID NO: 1712848 - protein, 6 aa, Staphylococcus aureus
VLESTN

SEQ ID NO: 1712849 - protein, 19 aa, Staphylococcus aureus
VNADSTKQNVYTTKVTNTE

SEQ ID NO: 1712850 - protein, 50 aa, Staphylococcus aureus; identical to SEQ ID NO: 1567791

SEQ ID NO: 1712851 - protein, 27 aa, Staphylococcus aureus
VNEAKQALNGSDNVQRAKDAAKQVITN

SEQ ID NO: 1712852 - protein, 32 aa, Staphylococcus aureus; identical to SEQ ID NO: 1569639

SEQ ID NO: 1712853 - protein, 9 aa, Staphylococcus aureus
VNKGTPEFK

SEQ ID NO: 1712854 - protein, 25 aa, Staphylococcus aureus
VNNAKTALNGDARLNEAKNTAKQQL

SEQ ID NO: 1712855 - protein, 72 aa, Staphylococcus aureus
VNNENKKKEDEKKSEVKKEATKNNDKPKNEKKNQDINKNNNEQVQNVNNKQPVLNNNSNHNNQQQSNKNNYT

SEQ ID NO: 1712856 - protein, 8 aa, Staphylococcus aureus
VNNNGSVR

SEQ ID NO: 1712857 - protein, 34 aa, Staphylococcus aureus
VNQKAESVKSTKGALDGQQNLQRAKTEATNAITH

SEQ ID NO: 1712858 - protein, 31 aa, Staphylococcus aureus; identical to SEQ ID NO: 1568565

SEQ ID NO: 1712859 - protein, 18 aa, Staphylococcus aureus
VNRATSAVTSNKNALNGY

SEQ ID NO: 1712860 - protein, 12 aa, Staphylococcus aureus
VNTAKNAVNGDA

SEQ ID NO: 1712861 - protein, 25 aa, Staphylococcus aureus
VNTAKSALNGDARLNEAKNTAKQQL

SEQ ID NO: 1712862 - protein, 26 aa, Staphylococcus aureus
VNTAKTALNGDARLNEAKNTAKQQVA

SEQ ID NO: 1712863 - protein, 26 aa, Staphylococcus aureus
VNTAKTALNGDERLNEAKNTAKQQVA

SEQ ID NO: 1712864 - protein, 16 aa, Staphylococcus aureus
VNVDSDATTEEKEAFT

SEQ ID NO: 1712865 - protein, 19 aa, Staphylococcus aureus
VNVKQKGSLADDKELSSIE

SEQ ID NO: 1712866 - protein, 5 aa, Staphylococcus aureus
VPLDP

SEQ ID NO: 1712867 - protein, 10 aa, Staphylococcus aureus
VPNSAVKGDT

SEQ ID NO: 1712868 - protein, 12 aa, Staphylococcus aureus
VQAQKQSPTTYT

SEQ ID NO: 1712869 - protein, 13 aa, Staphylococcus aureus
VQNSNQKKMNKVT

SEQ ID NO: 1712870 - protein, 22 aa, Staphylococcus aureus
VQPAKPTVTETAAGAITIAPGA

SEQ ID NO: 1712871 - protein, 61 aa, Staphylococcus aureus
VQPKAANKTGNAQANQKVDTTQVNGDTRVTQSTTSNNAKPVTKSTNTTAPKTNNNVTSAGY

SEQ ID NO: 1712872 - protein, 61 aa, Staphylococcus aureus
VQPKTANNKTGNAQVSQKVDTAQVNGDTRANQTATTNNTKPVAKSTSTTAPKTNTNVTNAG

SEQ ID NO: 1712873 - protein, 16 aa, Staphylococcus aureus
VQPNYTEASTDKKKQW

SEQ ID NO: 1712874 - protein, 16 aa, Staphylococcus aureus
VQQDEDSIYLYHQKPT

SEQ ID NO: 1712875 - protein, 17 aa, Staphylococcus aureus
VQQEEEKRINNDLDQYD

SEQ ID NO: 1712876 - protein, 17 aa, Staphylococcus aureus
VQQEEEKRINNDLNQYD

SEQ ID NO: 1712877 - protein, 17 aa, Staphylococcus aureus
VQTKNESAEFGSSIGGE

SEQ ID NO: 1712878 - protein, 7 aa, Staphylococcus aureus
VRIEGSK

SEQ ID NO: 1712879 - protein, 26 aa, Staphylococcus aureus
VSASQLDEHKRLQSDSQEISISGGEN

SEQ ID NO: 1712880 - protein, 12 aa, Staphylococcus aureus
VSDYKSNNGTMG

SEQ ID NO: 1712881 - protein, 8 aa, Staphylococcus aureus
VSEVQEKE

SEQ ID NO: 1712882 - protein, 7 aa, Staphylococcus aureus
VSGDISN

SEQ ID NO: 1712883 - protein, 16 aa, Staphylococcus aureus
VSGSSNSTSNSSRPST

SEQ ID NO: 1712884 - protein, 32 aa, Staphylococcus aureus; identical to SEQ ID NO: 1566983

SEQ ID NO: 1712885 - protein, 7 aa, Staphylococcus aureus
VSKGPEV

SEQ ID NO: 1712886 - protein, 7 aa, Staphylococcus aureus
VSNLADN

SEQ ID NO: 1712887 - protein, 108 aa, Staphylococcus aureus
VSPSAITTTTQGANVEQNRTANPEQAPKSNTENVSTSPSTKTEQTPKSNIQKATQPTPSGTTQSLPNAQPQSPQPTPSVTTPPSSNVETQKPQSPTTKQAQKEINPKF

SEQ ID NO: 1712888 - protein, 109 aa, Staphylococcus aureus
VSPSAITTTTQGANVEQNRTANPEQAPKSNTENVSTSPSTKTEQTPKSNIQKATQPTPSGTTQSLPNAQPQSPQPTPSVTTPPSSNVETQKPQSSTTKQAHKEINPKYK

SEQ ID NO: 1712889 - protein, 7 aa, Staphylococcus aureus
VSQMNAG

SEQ ID NO: 1712890 - protein, 43 aa, Staphylococcus aureus
VSSPAANALSSKAMDNHPQQTQTDKQQTPKIQKGGNLKPLEQR

SEQ ID NO: 1712891 - protein, 44 aa, Staphylococcus aureus
VSSPAANALSSKAMDNHTQQTQTDKQQTPKIQKGGNLKPLEQRE

SEQ ID NO: 1712892 - protein, 19 aa, Staphylococcus aureus
VTAANATKSALDQARNGLT

SEQ ID NO: 1712893 - protein, 18 aa, Staphylococcus aureus
VTASDSSDNGNVQHDRNE

SEQ ID NO: 1712894 - protein, 17 aa, Staphylococcus aureus
VTASDSSDSGSVQHDRN

SEQ ID NO: 1712895 - protein, 10 aa, Staphylococcus aureus
VTDKNLPTAN

SEQ ID NO: 1712896 - protein, 18 aa, Staphylococcus aureus
VTEVESQNSKGVKRGVKA

SEQ ID NO: 1712897 - protein, 13 aa, Staphylococcus aureus
VTGYKYTENGKDY

SEQ ID NO: 1712898 - protein, 11 aa, Staphylococcus aureus
VTKPQTTQTVS

SEQ ID NO: 1712899 - protein, 12 aa, Staphylococcus aureus
VTKYSSSSSKYT

SEQ ID NO: 1712900 - protein, 16 aa, Staphylococcus aureus
VTNDTIAEKTIEDGPT

SEQ ID NO: 1712901 - protein, 14 aa, Staphylococcus aureus
VTQAQNNADALNTA

SEQ ID NO: 1712902 - protein, 20 aa, Staphylococcus aureus
VTRKADKDTTSTKNSKFKIT

SEQ ID NO: 1712903 - protein, 20 aa, Staphylococcus aureus
VTRKADRDTTSTKDSKFKIT

SEQ ID NO: 1712904 - protein, 18 aa, Staphylococcus aureus
VTRNESVDSNDSATVTVT

SEQ ID NO: 1712905 - protein, 31 aa, Staphylococcus aureus
VTTHANGQVSYGARPNTKKAKRNKCIQRNNT

SEQ ID NO: 1712906 - protein, 43 aa, Staphylococcus aureus
VTTHANGQVSYGARPTQNKPSKTNAYNVTTHADGTATYGSRVT

SEQ ID NO: 1712907 - protein, 54 aa, Staphylococcus aureus
VTTHANGQVSYGARPTYKKPSETNAYNVTTNQDGTVSYGARPTYKKPSETNAYN

SEQ ID NO: 1712908 - protein, 81 aa, Staphylococcus aureus
VTTHANGQVSYGARPTYNKPSKTNAYNVTTHANGQVSYGARPTYNKPSKTNAYNVTTHANGQVSYGARPTQNKPSETNAYN

SEQ ID NO: 1712909 - protein, 14 aa, Staphylococcus aureus
VTTNNPASKQVDKQ

SEQ ID NO: 1712910 - protein, 11 aa, Staphylococcus aureus
VTTQSVKAEKV

SEQ ID NO: 1712911 - protein, 14 aa, Staphylococcus aureus
VTTQSVKAEKVQST

SEQ ID NO: 1712912 - protein, 21 aa, Staphylococcus aureus
VTYGNDSLTTTFPNGNEDSTV

SEQ ID NO: 1712913 - protein, 42 aa, Staphylococcus aureus; identical to SEQ ID NO: 1572740

SEQ ID NO: 1712914 - protein, 44 aa, Staphylococcus aureus; identical to SEQ ID NO: 1572744

SEQ ID NO: 1712915 - protein, 43 aa, Staphylococcus aureus; identical to SEQ ID NO: 1566135

SEQ ID NO: 1712916 - protein, 19 aa, Staphylococcus aureus
VVSETTDSKGHTTYSDDND

SEQ ID NO: 1712917 - protein, 9 aa, Staphylococcus aureus
VYTDGQEKF

SEQ ID NO: 1712918 - protein, 9 aa, Staphylococcus aureus
WEEQNKADI

SEQ ID NO: 1712919 - protein, 14 aa, Staphylococcus aureus
WGPYGRDSSDSLYG

SEQ ID NO: 1712920 - protein, 4 aa, Staphylococcus aureus
WPGS

SEQ ID NO: 1712921 - protein, 20 aa, Staphylococcus aureus
WSNYGGGNQVTIQEANSNNY

SEQ ID NO: 1712922 - protein, 10 aa, Staphylococcus aureus
YAEKEYKDAL

SEQ ID NO: 1712923 - protein, 20 aa, Staphylococcus aureus
YANTTDTSKFKEVTSNMSGN

SEQ ID NO: 1712924 - protein, 13 aa, Staphylococcus aureus
YAQPGNSESPVLN

SEQ ID NO: 1712925 - protein, 11 aa, Staphylococcus aureus
YDEDDNENDKQ

SEQ ID NO: 1712926 - protein, 17 aa, Staphylococcus aureus
YDEEGYRDSEFKKGDKG

SEQ ID NO: 1712927 - protein, 10 aa, Staphylococcus aureus
YDEPEFKETV

SEQ ID NO: 1712928 - protein, 10 aa, Staphylococcus aureus
YDIPTEKAPK

SEQ ID NO: 1712929 - protein, 10 aa, Staphylococcus aureus
YDIPTNKSPK

SEQ ID NO: 1712930 - protein, 7 aa, Staphylococcus aureus
YDIPTNN

SEQ ID NO: 1712931 - protein, 11 aa, Staphylococcus aureus
YDKDKGVKAGL

SEQ ID NO: 1712932 - protein, 29 aa, Staphylococcus aureus
YDKEDKAKELNKDLDNKIASMKGKTKNFN

SEQ ID NO: 1712933 - protein, 19 aa, Staphylococcus aureus
YDKEGYRDDEFKKGDKGTW

SEQ ID NO: 1712934 - protein, 19 aa, Staphylococcus aureus
YDKEGYRDGEFEKGDKGTW

SEQ ID NO: 1712935 - protein, 17 aa, Staphylococcus aureus
YDKEGYRDGEFKKDDKG

SEQ ID NO: 1712936 - protein, 21 aa, Staphylococcus aureus
YDKEGYRDGEFKKGDKGTWGI

SEQ ID NO: 1712937 - protein, 16 aa, Staphylococcus aureus
YDKEGYRDSEFKKGDK

SEQ ID NO: 1712938 - protein, 19 aa, Staphylococcus aureus
YDKEGYSDDQFDKKDKGTW

SEQ ID NO: 1712939 - protein, 20 aa, Staphylococcus aureus
YDKKANKTGKVRPKYENKEL

SEQ ID NO: 1712940 - protein, 43 aa, Staphylococcus aureus
YDKNNAPNNNHQNQSRTNDNHQHANQRDFNNNQYHSSLSGQYT

SEQ ID NO: 1712941 - protein, 16 aa, Staphylococcus aureus
YDNKTVAKLASKIRYN

SEQ ID NO: 1712942 - protein, 20 aa, Staphylococcus aureus
YDQTANTNSDVTTAKDNGIA

SEQ ID NO: 1712943 - protein, 24 aa, Staphylococcus aureus
YDQYDENNQDMKKKFDATEKEAEK

SEQ ID NO: 1712944 - protein, 14 aa, Staphylococcus aureus
YEKTAKSGAKYADR

SEQ ID NO: 1712945 - protein, 22 aa, Staphylococcus aureus
YESPEEKKEREFEEKLENTPAY

SEQ ID NO: 1712946 - protein, 14 aa, Staphylococcus aureus
YESPEQKKEREFDE

SEQ ID NO: 1712947 - protein, 19 aa, Staphylococcus aureus
YGDGDGDGRTFTSLSGAND

SEQ ID NO: 1712948 - protein, 12 aa, Staphylococcus aureus
YGDPIYKEAKDR

SEQ ID NO: 1712949 - protein, 6 aa, Staphylococcus aureus
YGERTT

SEQ ID NO: 1712950 - protein, 6 aa, Staphylococcus aureus
YGGPNM

SEQ ID NO: 1712951 - protein, 18 aa, Staphylococcus aureus
YGKEGYRDGEFKKDDKGT

SEQ ID NO: 1712952 - protein, 7 aa, Staphylococcus aureus
YGQNAAP

SEQ ID NO: 1712953 - protein, 9 aa, Staphylococcus aureus
YGSNSRTIY

SEQ ID NO: 1712954 - protein, 21 aa, Staphylococcus aureus
YGTESKEAYNTYTVEKERQLD

SEQ ID NO: 1712955 - protein, 6 aa, Staphylococcus aureus
YHGNYN

SEQ ID NO: 1712956 - protein, 13 aa, Staphylococcus aureus
YKARGANENQTLN

SEQ ID NO: 1712957 - protein, 11 aa, Staphylococcus aureus
YKDKNGGYESF

SEQ ID NO: 1712958 - protein, 8 aa, Staphylococcus aureus
YKDKSGTF

SEQ ID NO: 1712959 - protein, 35 aa, Staphylococcus aureus
YKDNPTSQEGKWANQKLKKYKAESKYRKATGQAPI

SEQ ID NO: 1712960 - protein, 15 aa, Staphylococcus aureus
YKDNPTSQEGRWANQ

SEQ ID NO: 1712961 - protein, 10 aa, Staphylococcus aureus
YKDQAETFTG

SEQ ID NO: 1712962 - protein, 15 aa, Staphylococcus aureus
YKGGDISYNPEAPIY

SEQ ID NO: 1712963 - protein, 9 aa, Staphylococcus aureus
YKGQNQMNK

SEQ ID NO: 1712964 - protein, 14 aa, Staphylococcus aureus
YKIPNEQLNKENGH

SEQ ID NO: 1712965 - protein, 7 aa, Staphylococcus aureus
YKITKEE

SEQ ID NO: 1712966 - protein, 29 aa, Staphylococcus aureus
YKMRGEKKDGSDAKRVKETVEVPKNPKNA

SEQ ID NO: 1712967 - protein, 12 aa, Staphylococcus aureus
YKMSNTDKNVKK

SEQ ID NO: 1712968 - protein, 11 aa, Staphylococcus aureus
YKNYKTRTFKS

SEQ ID NO: 1712969 - protein, 10 aa, Staphylococcus aureus
YKQESYRTTI

SEQ ID NO: 1712970 - protein, 9 aa, Staphylococcus aureus
YKSSNKNTN

SEQ ID NO: 1712971 - protein, 9 aa, Staphylococcus aureus
YKTEPKDSK

SEQ ID NO: 1712972 - protein, 8 aa, Staphylococcus aureus
YLNGTDEV

SEQ ID NO: 1712973 - protein, 8 aa, Staphylococcus aureus
YLNGTNEV

SEQ ID NO: 1712974 - protein, 34 aa, Staphylococcus aureus
YNDPSLVKSDTNDAVATNDQSSSDASNQTNTNTS

SEQ ID NO: 1712975 - protein, 111 aa, Staphylococcus aureus
YNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAI

SEQ ID NO: 1712976 - protein, 8 aa, Staphylococcus aureus
YNERGEKL

SEQ ID NO: 1712977 - protein, 10 aa, Staphylococcus aureus
YNKSVANRGN

SEQ ID NO: 1712978 - protein, 15 aa, Staphylococcus aureus
YNPNIHSPKDNKENF

SEQ ID NO: 1712979 - protein, 23 aa, Staphylococcus aureus
YNYNTTQTTTTTTSSISHSGNLY

SEQ ID NO: 1712980 - protein, 15 aa, Staphylococcus aureus
YPDGTTKSVRTDANG

SEQ ID NO: 1712981 - protein, 6 aa, Staphylococcus aureus
YPDYGN

SEQ ID NO: 1712982 - protein, 13 aa, Staphylococcus aureus
YPENTSTDNGKID

SEQ ID NO: 1712983 - protein, 11 aa, Staphylococcus aureus
YPGISAAKQVP

SEQ ID NO: 1712984 - protein, 17 aa, Staphylococcus aureus
YPKYARASYKNAKIPTL

SEQ ID NO: 1712985 - protein, 26 aa, Staphylococcus aureus
YPQNEKVAKKYGEKYGLKPQNAVYNG

SEQ ID NO: 1712986 - protein, 10 aa, Staphylococcus aureus
YPTKEEQKRL

SEQ ID NO: 1712987 - protein, 19 aa, Staphylococcus aureus
YQEDSNNRVRNLESQKDDL

SEQ ID NO: 1712988 - protein, 6 aa, Staphylococcus aureus
YQNEDA

SEQ ID NO: 1712989 - protein, 6 aa, Staphylococcus aureus
YQQDEQ

SEQ ID NO: 1712990 - protein, 59 aa, Staphylococcus aureus
YQSNVGPDASYYSHSNNNQAYNSHDGNGKVNSPNGTSNQNGGSASKATASGHAKDASWL

SEQ ID NO: 1712991 - protein, 59 aa, Staphylococcus aureus
YQSNVGPDASYYSHSNNNQAYNSHDGNGKVNYPNGTSNQNGGPASKATASGHAKDASWL

SEQ ID NO: 1712992 - protein, 59 aa, Staphylococcus aureus
YQSNVGPDASYYSHSNNNQAYNSHNGNGKINYPNGTSNQNGGSASKATASGHAKDASWL

SEQ ID NO: 1712993 - protein, 58 aa, Staphylococcus aureus
YQSNVGPDASYYSHSNNQAYNSHDGNGKVNYPNGTSNQNGGSASKATASGHAKDASWL

SEQ ID NO: 1712994 - protein, 8 aa, Staphylococcus aureus
YSERGEKF

SEQ ID NO: 1712995 - protein, 4 aa, Staphylococcus aureus
YSGF

SEQ ID NO: 1712996 - protein, 12 aa, Staphylococcus aureus
YSKSITAHKEAI

SEQ ID NO: 1712997 - protein, 10 aa, Staphylococcus aureus
YSNDNKTATV

SEQ ID NO: 1712998 - protein, 27 aa, Staphylococcus aureus
YSPTFSKGEKVDLNTKRTKKSQHTSEG

SEQ ID NO: 1712999 - protein, 21 aa, Staphylococcus aureus
YSQESYESTNISVKSEDYYGP

SEQ ID NO: 1713000 - protein, 4 aa, Staphylococcus aureus
YSRG

SEQ ID NO: 1713001 - protein, 9 aa, Staphylococcus aureus
YSSSKSDDM

SEQ ID NO: 1713002 - protein, 4 aa, Staphylococcus aureus
YSTE

SEQ ID NO: 1713003 - protein, 7 aa, Staphylococcus aureus
YSTNPLG

SEQ ID NO: 1713004 - protein, 5 aa, Staphylococcus aureus
YTAGS

SEQ ID NO: 1713005 - protein, 6 aa, Staphylococcus aureus
YTDTKT

SEQ ID NO: 1713006 - protein, 4 aa, Staphylococcus aureus
YTKT

SEQ ID NO: 1713007 - protein, 34 aa, Staphylococcus aureus
YTLDTDKTKYSWSNSYSNVNGSSTANGDQKKYNL

SEQ ID NO: 1713008 - protein, 34 aa, Staphylococcus aureus
YTLDTDKTKYSWSNSYSSVNGSSTANGDQKKYNL

SEQ ID NO: 1713009 - protein, 17 aa, Staphylococcus aureus
YTNKSGFSEKSKADGIS

SEQ ID NO: 1713010 - protein, 16 aa, Staphylococcus aureus
YTNKSGFSEKSKVDGI

SEQ ID NO: 1713011 - protein, 8 aa, Staphylococcus aureus
YTNVSGSF

SEQ ID NO: 1713012 - protein, 24 aa, Staphylococcus aureus
YTPGKEGDALRSMSNPEQYGQPAH

SEQ ID NO: 1713013 - protein, 12 aa, Staphylococcus aureus
YTPTNGDEKVNN

SEQ ID NO: 1713014 - protein, 6 aa, Staphylococcus aureus
YTSYTQ

SEQ ID NO: 1713015 - protein, 10 aa, Staphylococcus aureus
YTTQDEHGRA

SEQ ID NO: 1713016 - protein, 7 aa, Staphylococcus aureus
YTYGGDN

SEQ ID NO: 1713017 - protein, 105 aa, Staphylococcus aureus; identical to SEQ ID NO: 1572850

SEQ ID NO: 1713018 - protein, 101 aa, Staphylococcus aureus; identical to SEQ ID NO: 1565057

SEQ ID NO: 1713019 - protein, 8 aa, Staphylococcus aureus
YYAKQTYD

SEQ ID NO: 1713020 - protein, 9 aa, Staphylococcus aureus
YYAKQTYDY

SEQ ID NO: 1713021 - protein, 12 aa, Staphylococcus aureus
YYEEETSDSDSD

SEQ ID NO: 1713022 - protein, 43 aa, Staphylococcus aureus
YYEEETSDSDSDSDSDSDSDRDSDSDSDSDSDSDSDSDSDSDS

SEQ ID NO: 1713023 - protein, 49 aa, Staphylococcus aureus
YYEEETSDSDSDSDSDSDSDRDSDSDSDSDSDSDSDSDSDSDSDSDSDS

SEQ ID NO: 1713024 - protein, 27 aa, Staphylococcus aureus
YYEEETSDSDSDSDSDSDSDSDSDSDS

SEQ ID NO: 1713025 - protein, 39 aa, Staphylococcus aureus
YYEEETSDSDSDSDSDSDSDSDSDSDSDSDSDSDSDSDS

SEQ ID NO: 1713026 - protein, 50 aa, Staphylococcus aureus
YYEEETSDSDSDSDSDSDSDSDSDSDSDSDSDSDSDSDSDSDSDSDSDSD

SEQ ID NO: 1713027 - protein, 59 aa, Staphylococcus aureus
YYEEETSDSDSDSDSDSDSDSDSDSDSDSDSDSDSDSDSDSDSDSDSDSDSDSDSDSDS

SEQ ID NO: 1713028 - protein, 65 aa, Staphylococcus aureus
YYEEETSDSDSDSDSDSDSDSDSDSDSDSDSDSDSDSDSDSDSDSDSDSDSDSDSDSDSDSDSDS

SEQ ID NO: 1713029 - protein, 168 aa, Staphylococcus aureus
YYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSD

SEQ ID NO: 1713030 - protein, 47 aa, Staphylococcus aureus
YYEEETSDSDSDSDSDSDSDSDSDSDSDSDSDSDSDSDSDSDSESDS

SEQ ID NO: 1713031 - protein, 15 aa, Staphylococcus aureus
YYQQHDADYHEENMT

SEQ ID NO: 1713032 - protein, 8 aa, Staphylococcus aureus
YYTKPSLE

SEQ ID NO: 1713033 - protein, 18 aa, Staphylococcus aureus
LFLLAMYELGKYVTEQVY

SEQ ID NO: 1713034 - protein, 17 aa, Staphylococcus aureus
TLGICLVLLIILIVGYV

SEQ ID NO: 1713035 - protein, 18 aa, Staphylococcus aureus
IPLMNADHIFVVKSDPNA

SEQ ID NO: 1713036 - protein, 17 aa, Staphylococcus aureus
VVTLAFLLVLAGCSGNS

SEQ ID NO: 1713037 - protein, 19 aa, Staphylococcus aureus
YKSSLKLIDDLYEKLNIEK

SEQ ID NO: 1713038 - protein, 24 aa, Staphylococcus aureus
ETYKGQKLKGISFENSNGEWAYKV

SEQ ID NO: 1713039 - protein, 19 aa, Staphylococcus aureus
HKLKHLLVETSVDKKAMES

SEQ ID NO: 1713040 - protein, 27 aa, Staphylococcus aureus
IDLKHPDCAKEYWGRKGRVGIVPLLNN

SEQ ID NO: 1713041 - protein, 18 aa, Staphylococcus aureus
IGAGIGIGDNVLKKLGNH

SEQ ID NO: 1713042 - protein, 18 aa, Staphylococcus aureus
ITSEGAFKYFSKQYGITP

SEQ ID NO: 1713043 - protein, 21 aa, Staphylococcus aureus
KQYGITPGYIWEINTEKQGTP

SEQ ID NO: 1713044 - protein, 25 aa, Staphylococcus aureus
KVEVKGERPTIHFLGQASYENDMNI

SEQ ID NO: 1713045 - protein, 24 aa, Staphylococcus aureus
LAVKNDLHFKKFVTENNIPKEYKK

SEQ ID NO: 1713046 - protein, 26 aa, Staphylococcus aureus
LYTAGQCTWYVFDRRAQAGSPISTYW

SEQ ID NO: 1713047 - protein, 19 aa, Staphylococcus aureus
MNAFQHFAFLDQYKKAHKG

SEQ ID NO: 1713048 - protein, 26 aa, Staphylococcus aureus
NYDRAVELYYYIKGGRVDYGAAHAAK

SEQ ID NO: 1713049 - protein, 23 aa, Staphylococcus aureus
QDPHAWLSLDNGIKYVKTIQQTF

SEQ ID NO: 1713050 - protein, 18 aa, Staphylococcus aureus
SNNYQWYMHNNRLTVSAG

SEQ ID NO: 1713051 - protein, 20 aa, Staphylococcus aureus
VVFDKGYMAPLYGSKKNLVY

SEQ ID NO: 1713052 - protein, 24 aa, Staphylococcus aureus
AQAKALYPKVRMYYERSEPVAEAF

SEQ ID NO: 1713053 - protein, 22 aa, Staphylococcus aureus
ARGLREFPIDITAIVTVADNGG

SEQ ID NO: 1713054 - protein, 17 aa, Staphylococcus aureus
DADAVIINSNFAIEQKL

SEQ ID NO: 1713055 - protein, 23 aa, Staphylococcus aureus
DKVTAQDFVYAWRKTVDPKTGSE

SEQ ID NO: 1713056 - protein, 25 aa, Staphylococcus aureus
DVDGILVPGGFGFRASEGKISAIKY

SEQ ID NO: 1713057 - protein, 24 aa, Staphylococcus aureus
ESVIECRDADSLYEIPLQLSQQNM

SEQ ID NO: 1713058 - protein, 25 aa, Staphylococcus aureus
FDAKNFYFNYPFLFGNDDYIFKKNG

SEQ ID NO: 1713059 - protein, 19 aa, Staphylococcus aureus
FFIACQFHPEFLSRPNRPH

SEQ ID NO: 1713060 - protein, 26 aa, Staphylococcus aureus
GGKPMKPFLGVRGWYLSEYSKHKYWA

SEQ ID NO: 1713061 - protein, 17 aa, Staphylococcus aureus
GKITIGLVGKYVSLQDA

SEQ ID NO: 1713062 - protein, 18 aa, Staphylococcus aureus
GYMAPLYGSKKNLVYDNK

SEQ ID NO: 1713063 - protein, 24 aa, Staphylococcus aureus
HNIYDLKPLKSFVYGRTILLGDAA

SEQ ID NO: 1713064 - protein, 35 aa, Staphylococcus aureus
HSGNLYTAGQCTWYVYDKVGGEIGSTWGNANNWAA

SEQ ID NO: 1713065 - protein, 18 aa, Staphylococcus aureus
IATMGFATFTMAHQADAA

SEQ ID NO: 1713066 - protein, 17 aa, Staphylococcus aureus
IKGANDIVIKKGQDYNL

SEQ ID NO: 1713067 - protein, 22 aa, Staphylococcus aureus
ITNEIKERLLLAGESTNADVVI

SEQ ID NO: 1713068 - protein, 19 aa, Staphylococcus aureus
KEGSNLWFDNMVIPKTAQN

SEQ ID NO: 1713069 - protein, 17 aa, Staphylococcus aureus
KEVELKKPITYEAGATS

SEQ ID NO: 1713070 - protein, 19 aa, Staphylococcus aureus
KGQDYNLLNGISAFDKEDG

SEQ ID NO: 1713071 - protein, 26 aa, Staphylococcus aureus
KIRNAKSAVYTITWKDGSKKEVDLKK

SEQ ID NO: 1713072 - protein, 22 aa, Staphylococcus aureus
KKFTYCTKIIYQAYKFGVSEKS

SEQ ID NO: 1713073 - protein, 25 aa, Staphylococcus aureus
KKNKGKHKLAIALDLDETVLDNSPY

SEQ ID NO: 1713074 - protein, 17 aa, Staphylococcus aureus
LASSVLLAGCTTDKKEI

SEQ ID NO: 1713075 - protein, 19 aa, Staphylococcus aureus
LKDKIALFCDINKESVIEC

SEQ ID NO: 1713076 - protein, 20 aa, Staphylococcus aureus
LYTAGQCTWYVFDKRAKDGH

SEQ ID NO: 1713077 - protein, 20 aa, Staphylococcus aureus
MYVHCTLLPYIKAAGEMKTK

SEQ ID NO: 1713078 - protein, 19 aa, Staphylococcus aureus
MYYERSEPVAEAFGDLDPK

SEQ ID NO: 1713079 - protein, 23 aa, Staphylococcus aureus
NQSMDLLLSKRVDGTFNDSLSYL

SEQ ID NO: 1713080 - protein, 21 aa, Staphylococcus aureus
PEQMRQAIEFVKKHKLKHLLV

SEQ ID NO: 1713081 - protein, 18 aa, Staphylococcus aureus
QLDEWKQLLDIVNNLDGK

SEQ ID NO: 1713082 - protein, 22 aa, Staphylococcus aureus
QSSEGPFGHVAYVESVNSDGSV

SEQ ID NO: 1713083 - protein, 23 aa, Staphylococcus aureus
RQVWEPMGNASIFISNGKNPKQA

SEQ ID NO: 1713084 - protein, 20 aa, Staphylococcus aureus
RRAQLGRSIGSLWGNANNWN

SEQ ID NO: 1713085 - protein, 25 aa, Staphylococcus aureus
SKDELKGFNKQALKAMNYDNKQLAL

SEQ ID NO: 1713086 - protein, 27 aa, Staphylococcus aureus
TKKEYKFPVINARNFLTGIGIEETKQQ

SEQ ID NO: 1713087 - protein, 18 aa, Staphylococcus aureus
VDAARKVVITSYLSFNQV

SEQ ID NO: 1713088 - protein, 23 aa, Staphylococcus aureus
VDHKEIIDELTLLRFDDDEDKWK

SEQ ID NO: 1713089 - protein, 26 aa, Staphylococcus aureus
VEVMGGIEPTVDWLRTALKNKKHVIT

SEQ ID NO: 1713090 - protein, 21 aa, Staphylococcus aureus
VKLRSDAKWSNGDKVTAQDFV

SEQ ID NO: 1713091 - protein, 27 aa, Staphylococcus aureus
VNIDGSILISEMNWIGEYIVSSRTISA

SEQ ID NO: 1713092 - protein, 21 aa, Staphylococcus aureus
VPFFGICLGMQLATVEFSRNV

SEQ ID NO: 1713093 - protein, 20 aa, Staphylococcus aureus
VPYTIAVDGIMAFNQSYLNL

SEQ ID NO: 1713094 - protein, 20 aa, Staphylococcus aureus
YSVAEPFGALGEKLGKGKTL

SEQ ID NO: 1713095 - protein, 18 aa, Staphylococcus aureus
AGAADWVSDGAFSDYADS

SEQ ID NO: 1713096 - protein, 19 aa, Staphylococcus aureus
AGYPFAKDIDIRWIDSSEV

SEQ ID NO: 1713097 - protein, 21 aa, Staphylococcus aureus
AGYTFPLAMLKNEAGINATKD

SEQ ID NO: 1713098 - protein, 23 aa, Staphylococcus aureus
AISKVGKGKAAFIGDSSLVEDSS

SEQ ID NO: 1713099 - protein, 25 aa, Staphylococcus aureus
ALNESFSDVFGYFVDDEDFLMGEDV

SEQ ID NO: 1713100 - protein, 27 aa, Staphylococcus aureus
AMDTKRLAQDPALKYQFLRLDQPQNIS

SEQ ID NO: 1713101 - protein, 18 aa, Staphylococcus aureus
ASFTEMLNKILADKYKNK

SEQ ID NO: 1713102 - protein, 22 aa, Staphylococcus aureus
DELTEFEVAYAPPYSHPKDLIN

SEQ ID NO: 1713103 - protein, 26 aa, Staphylococcus aureus
DFKNKNLRLAIAQAIDKKGYVDSVKN

SEQ ID NO: 1713104 - protein, 24 aa, Staphylococcus aureus
DKKPQRLVVDLPIDYYGQAETIGI

SEQ ID NO: 1713105 - protein, 21 aa, Staphylococcus aureus
DKTSNKWGVTQNIQFDFVKDK

SEQ ID NO: 1713106 - protein, 23 aa, Staphylococcus aureus
DLKEKAMAADFLILGTPNYHGSY

SEQ ID NO: 1713107 - protein, 26 aa, Staphylococcus aureus
DTVSKAIVGGAKFIGNSYVKAGQNTL

SEQ ID NO: 1713108 - protein, 20 aa, Staphylococcus aureus
EFEISKQFWGHLVKSGSIEN

SEQ ID NO: 1713109 - protein, 36 aa, Staphylococcus aureus
EGGRIWTYKDGKPWYFLEEKYPDYGNLVPRDIATRE

SEQ ID NO: 1713110 - protein, 26 aa, Staphylococcus aureus
ENDDLKDIPIHFAIYKQSSEDSITPG

SEQ ID NO: 1713111 - protein, 17 aa, Staphylococcus aureus
FPISGQFLACTNPQVIE

SEQ ID NO: 1713112 - protein, 17 aa, Staphylococcus aureus
FPNQVLKVSGSSNSTSN

SEQ ID NO: 1713113 - protein, 18 aa, Staphylococcus aureus
GASGLFQTMPGWGPTNTV

SEQ ID NO: 1713114 - protein, 27 aa, Staphylococcus aureus
GENLKGWHTGAGMSYLYNSDVKHYRDN

SEQ ID NO: 1713115 - protein, 23 aa, Staphylococcus aureus
GGYAGEILNDLGFKRNKDLQKQV

SEQ ID NO: 1713116 - protein, 25 aa, Staphylococcus aureus
GNKNSRVDFGLAQWGLKQKPNESYI

SEQ ID NO: 1713117 - protein, 19 aa, Staphylococcus aureus
GNPRFINVEIVHTHDYASF

SEQ ID NO: 1713118 - protein, 25 aa, Staphylococcus aureus
GSGFLACGYVAKGRMEEPLQIVSVI

SEQ ID NO: 1713119 - protein, 23 aa, Staphylococcus aureus
GTEHYYEFHTKKGMLLVTTDGKK

SEQ ID NO: 1713120 - protein, 24 aa, Staphylococcus aureus
HSKDLRLGMDSSWMNRKGDGYEGF

SEQ ID NO: 1713121 - protein, 18 aa, Staphylococcus aureus
IDPAVWKSLKAVKDNKVY

SEQ ID NO: 1713122 - protein, 23 aa, Staphylococcus aureus
IEFKGFLGNNIVKFFDYTFASVG

SEQ ID NO: 1713123 - protein, 28 aa, Staphylococcus aureus
IEQSTLKSAFAFGISRAGMFINNEDTFM

SEQ ID NO: 1713124 - protein, 23 aa, Staphylococcus aureus
IEVMKKWIPLMMKGREDNPGIMA

SEQ ID NO: 1713125 - protein, 20 aa, Staphylococcus aureus
IFDVCINQKLGINGENMVYL

SEQ ID NO: 1713126 - protein, 22 aa, Staphylococcus aureus
IIHLLDRMGVMFNRTNEGLLDF

SEQ ID NO: 1713127 - protein, 27 aa, Staphylococcus aureus
ILKEDGYHFIEPGSGFLACGYVAKGRM

SEQ ID NO: 1713128 - protein, 19 aa, Staphylococcus aureus
IVRSLLGIAVPTQIATHDS

SEQ ID NO: 1713129 - protein, 20 aa, Staphylococcus aureus
KAAQMYGINEVYLISHALLE

SEQ ID NO: 1713130 - protein, 20 aa, Staphylococcus aureus
KKEYGFDFGTVRPMQIGLVY

SEQ ID NO: 1713131 - protein, 23 aa, Staphylococcus aureus
KKYKFSKPYTFSSAVLVIRENEK

SEQ ID NO: 1713132 - protein, 18 aa, Staphylococcus aureus
KNIKGMTIGLAMNSVYYY

SEQ ID NO: 1713133 - protein, 21 aa, Staphylococcus aureus
LDEAKRLGFAEADPTDDVEGV

SEQ ID NO: 1713134 - protein, 21 aa, Staphylococcus aureus
LEVREDIYGALKISFKNPTDR

SEQ ID NO: 1713135 - protein, 19 aa, Staphylococcus aureus
LFQTMPGWGPTNTVDQQIN

SEQ ID NO: 1713136 - protein, 19 aa, Staphylococcus aureus
LKYQFLRLDQPQNISIDKI

SEQ ID NO: 1713137 - protein, 19 aa, Staphylococcus aureus
LSFASKYRYPALVRSGFNP

SEQ ID NO: 1713138 - protein, 20 aa, Staphylococcus aureus
LSHLRVIVRSLLGIAVPTQI

SEQ ID NO: 1713139 - protein, 24 aa, Staphylococcus aureus
LSVSFKRTKDILKYLGEHKTSQYL

SEQ ID NO: 1713140 - protein, 17 aa, Staphylococcus aureus
MNGYRRGAYEDMSKGMN

SEQ ID NO: 1713141 - protein, 21 aa, Staphylococcus aureus
NKYGISIAKLKSLNNLTSNLI

SEQ ID NO: 1713142 - protein, 23 aa, Staphylococcus aureus
NNTSHNIPLGWFNVKDLNVQNLG

SEQ ID NO: 1713143 - protein, 29 aa, Staphylococcus aureus
NNVKFLKDRYEAMKAFPMFDNIEYTEDIE

SEQ ID NO: 1713144 - protein, 18 aa, Staphylococcus aureus
PEGWHEWVQAAKAKPVYG

SEQ ID NO: 1713145 - protein, 23 aa, Staphylococcus aureus
PIISKRRFSAFTGSYLEVYLRAN

SEQ ID NO: 1713146 - protein, 18 aa, Staphylococcus aureus
PIKDGAYDIHFVKDGFQY

SEQ ID NO: 1713147 - protein, 21 aa, Staphylococcus aureus
PKDPKRIAVVAPTYAGGLKKL

SEQ ID NO: 1713148 - protein, 20 aa, Staphylococcus aureus
PTDYLSWGVGAVGNPRFINV

SEQ ID NO: 1713149 - protein, 17 aa, Staphylococcus aureus
PTIEVIDPVRFVSNRSS

SEQ ID NO: 1713150 - protein, 24 aa, Staphylococcus aureus
QGDNYRTLLPFKESQARGLLQDNM

SEQ ID NO: 1713151 - protein, 24 aa, Staphylococcus aureus
QKVLPAVVAKAGLLAHPNYSYVGQ

SEQ ID NO: 1713152 - protein, 29 aa, Staphylococcus aureus
RKNGRKSVFLMLNIKKGIFKTHPNLRQAV

SEQ ID NO: 1713153 - protein, 20 aa, Staphylococcus aureus
RTIYKPTWKSEADSYKDATS

SEQ ID NO: 1713154 - protein, 18 aa, Staphylococcus aureus
SNGFKVDRHPTRGSILQT

SEQ ID NO: 1713155 - protein, 25 aa, Staphylococcus aureus
SNPMPPRTAELIIELIENKSLILKK

SEQ ID NO: 1713156 - protein, 22 aa, Staphylococcus aureus
SNRSSGKMGYAIAEALRNRGAI

SEQ ID NO: 1713157 - protein, 17 aa, Staphylococcus aureus
TDSDGAIKISTRYIEVK

SEQ ID NO: 1713158 - protein, 26 aa, Staphylococcus aureus
TGIPESKHLGGFPISGQFLACTNPQV

SEQ ID NO: 1713159 - protein, 19 aa, Staphylococcus aureus
TLVLPTLVSPTAYADTPQK

SEQ ID NO: 1713160 - protein, 17 aa, Staphylococcus aureus
VMARGLREFPIDITAIV

SEQ ID NO: 1713161 - protein, 21 aa, Staphylococcus aureus
VPVTASALLLGACGASATDSK

SEQ ID NO: 1713162 - protein, 17 aa, Staphylococcus aureus
VQKTFAVTKEASLGGNK

SEQ ID NO: 1713163 - protein, 24 aa, Staphylococcus aureus
VTKYEGWEFLGIVKGDDDSARGIV

SEQ ID NO: 1713164 - protein, 18 aa, Staphylococcus aureus
VYLISHALLETGNGTSQL

SEQ ID NO: 1713165 - protein, 24 aa, Staphylococcus aureus
YAKKLNSIIKHYQLTQFDDERMPD

SEQ ID NO: 1713166 - protein, 28 aa, Staphylococcus aureus
YDNDPLREGIKYAKQAGWDTVSKAIVGG

SEQ ID NO: 1713167 - protein, 26 aa, Staphylococcus aureus
YLVKDYNSPTLIGWVKQGDVIYNNAK

SEQ ID NO: 1713168 - protein, 18 aa, Staphylococcus aureus
YLYGSVNGKSGWVSKAYL

SEQ ID NO: 1713169 - protein, 27 aa, Staphylococcus aureus
YRHVDLPASVPLAWGAHRAASIVAEQI

SEQ ID NO: 1713170 - protein, 17 aa, Staphylococcus aureus
ALILKMQGFISSRTTYY

SEQ ID NO: 1713171 - protein, 30 aa, Staphylococcus aureus
ARMDEYVVLRFGWLYGPGTWYGKDGMIYNQ

SEQ ID NO: 1713172 - protein, 22 aa, Staphylococcus aureus
ATGLIGIKLVQRLKEEGHEVAG

SEQ ID NO: 1713173 - protein, 18 aa, Staphylococcus aureus
DAKRIVVLEYSFADALAA

SEQ ID NO: 1713174 - protein, 20 aa, Staphylococcus aureus
EGKVGQFVTGPWNINEYQET

SEQ ID NO: 1713175 - protein, 20 aa, Staphylococcus aureus
EIEPDWNIHVYERLDRPAIE

SEQ ID NO: 1713176 - protein, 19 aa, Staphylococcus aureus
EIKAYLKQVDKIKDDEEPI

SEQ ID NO: 1713177 - protein, 31 aa, Staphylococcus aureus
EKEPWSQPPSGYKWYDPTTFKAGSYGSEKGA

SEQ ID NO: 1713178 - protein, 18 aa, Staphylococcus aureus
ERAHGNETYVLLNNTSHN

SEQ ID NO: 1713179 - protein, 17 aa, Staphylococcus aureus
FDAAYQLAKNGSDIALY

SEQ ID NO: 1713180 - protein, 17 aa, Staphylococcus aureus
GATLLLAGCGSQNLAPL

SEQ ID NO: 1713181 - protein, 22 aa, Staphylococcus aureus
GHIVKVDAGTYWYNDPYTLDFM

SEQ ID NO: 1713182 - protein, 17 aa, Staphylococcus aureus
GKEPAVVAEEFLKKHHY

SEQ ID NO: 1713183 - protein, 19 aa, Staphylococcus aureus
GKPTPGYESTNMWKNLKAT

SEQ ID NO: 1713184 - protein, 21 aa, Staphylococcus aureus
HPFFEYARSFDFIIVSDIGLI

SEQ ID NO: 1713185 - protein, 25 aa, Staphylococcus aureus
HRQAGQPFIDYVICSTQTFNAQVLK

SEQ ID NO: 1713186 - protein, 24 aa, Staphylococcus aureus
IAPKKAEHFHIFMGNDNDALLKEM

SEQ ID NO: 1713187 - protein, 23 aa, Staphylococcus aureus
IATAGLATIAFAGHDAQAAEQNN

SEQ ID NO: 1713188 - protein, 23 aa, Staphylococcus aureus
IKDEVLYWKDVVEEIRRNNPELE

SEQ ID NO: 1713189 - protein, 17 aa, Staphylococcus aureus
IKKAIGQDATVSLFDEF

SEQ ID NO: 1713190 - protein, 17 aa, Staphylococcus aureus
IPAAGLGTRFLPATKAM

SEQ ID NO: 1713191 - protein, 17 aa, Staphylococcus aureus
IYPVFPIPERRRFLYQV

SEQ ID NO: 1713192 - protein, 17 aa, Staphylococcus aureus
KDLKAYYDKGYKTDITN

SEQ ID NO: 1713193 - protein, 20 aa, Staphylococcus aureus
KLKEERIVGTAGGGMVAVTV

SEQ ID NO: 1713194 - protein, 17 aa, Staphylococcus aureus
KLNEKWAQDHSDAKISA

SEQ ID NO: 1713195 - protein, 20 aa, Staphylococcus aureus
KRLESSVRHALEKYDTVILT

SEQ ID NO: 1713196 - protein, 23 aa, Staphylococcus aureus
KYPKGNRGVRFMFKLVDGNDKDL

SEQ ID NO: 1713197 - protein, 18 aa, Staphylococcus aureus
LDAGSWFNKKYPKYARAS

SEQ ID NO: 1713198 - protein, 24 aa, Staphylococcus aureus
LEKINKDIVGWIKLSGTSLNYPVL

SEQ ID NO: 1713199 - protein, 20 aa, Staphylococcus aureus
LLLAGCGSQNLAPLEEKTTD

SEQ ID NO: 1713200 - protein, 18 aa, Staphylococcus aureus
LQNYYNTRIETIKVSEKL

SEQ ID NO: 1713201 - protein, 21 aa, Staphylococcus aureus
LYERGLHPTLIHRSDKINKLM

SEQ ID NO: 1713202 - protein, 30 aa, Staphylococcus aureus; identical to SEQ ID NO: 1670840

SEQ ID NO: 1713203 - protein, 20 aa, Staphylococcus aureus
NKRVDIMLDHGLFREVQQLV

SEQ ID NO: 1713204 - protein, 25 aa, Staphylococcus aureus
NLAIMGRYVLTPEIFDYLKTQKEGA

SEQ ID NO: 1713205 - protein, 24 aa, Staphylococcus aureus
NNLVFPGQVISVGGSDAQNTSNTS

SEQ ID NO: 1713206 - protein, 30 aa, Staphylococcus aureus
NSTAPHVHFQRMSGGIGNQYAVDPTSYLQS

SEQ ID NO: 1713207 - protein, 24 aa, Staphylococcus aureus
PIKETLAASLIRLANWKGDTPLID

SEQ ID NO: 1713208 - protein, 19 aa, Staphylococcus aureus
QGAFEKPQFTYDDVDVSLI

SEQ ID NO: 1713209 - protein, 24 aa, Staphylococcus aureus
QRLKEIRSYAIGLGPDYTDLTEQN

SEQ ID NO: 1713210 - protein, 18 aa, Staphylococcus aureus
QSAPSIGGSGSFNYSKTI

SEQ ID NO: 1713211 - protein, 20 aa, Staphylococcus aureus
RFDKLLAMRGTENAYKLHRE

SEQ ID NO: 1713212 - protein, 18 aa, Staphylococcus aureus
RGAHYKPEFPERNDEEWL

SEQ ID NO: 1713213 - protein, 18 aa, Staphylococcus aureus
RGGEVLYQAFGLKMQPEQ

SEQ ID NO: 1713214 - protein, 23 aa, Staphylococcus aureus
RHALEKYDTVILTGGLGPTKDDL

SEQ ID NO: 1713215 - protein, 19 aa, Staphylococcus aureus
RNDEEWLKTTMASFQGAFE

SEQ ID NO: 1713216 - protein, 26 aa, Staphylococcus aureus
RQHRIPVIFIRLVLDKHFNDVSSSNK

SEQ ID NO: 1713217 - protein, 25 aa, Staphylococcus aureus
SDKFKISQILTFNFIKDKSYDKDTL

SEQ ID NO: 1713218 - protein, 27 aa, Staphylococcus aureus
SESNVKGLGIISHRTINAAAAEELSYI

SEQ ID NO: 1713219 - protein, 21 aa, Staphylococcus aureus
SGLNRRGYRLAQGEAPIKETL

SEQ ID NO: 1713220 - protein, 23 aa, Staphylococcus aureus
SNFNPEFLSVLSHRQDGAKKSKI

SEQ ID NO: 1713221 - protein, 17 aa, Staphylococcus aureus
STNMWKNLKATKEGHIV

SEQ ID NO: 1713222 - protein, 21 aa, Staphylococcus aureus
STRYPNIFMIGATVENDNAKL

SEQ ID NO: 1713223 - protein, 23 aa, Staphylococcus aureus
TKNKEGIGYFGYNFYVQNKDKLK

SEQ ID NO: 1713224 - protein, 17 aa, Staphylococcus aureus
TSALARYLTEHFKTHDI

SEQ ID NO: 1713225 - protein, 18 aa, Staphylococcus aureus
VKGAIKNHIMPMIEKQIT

SEQ ID NO: 1713226 - protein, 20 aa, Staphylococcus aureus
VLAILFVVISACGNKEKEAQ

SEQ ID NO: 1713227 - protein, 18 aa, Staphylococcus aureus
VLSGCSLPGLGSKSTKND

SEQ ID NO: 1713228 - protein, 25 aa, Staphylococcus aureus
VSHTPKRHAAVVFEAGQFGADQHYG

SEQ ID NO: 1713229 - protein, 20 aa, Staphylococcus aureus
YSTELANIFYVRQKEQKGLG

SEQ ID NO: 1713230 - protein, 19 aa, Staphylococcus aureus
AEAKALYLQGYNSAKTQLD

SEQ ID NO: 1713231 - protein, 18 aa, Staphylococcus aureus
AGLGTRFLPATKAMPKEM

SEQ ID NO: 1713232 - protein, 17 aa, Staphylococcus aureus
AGLQYKPQVQRVPGKWT

SEQ ID NO: 1713233 - protein, 23 aa, Staphylococcus aureus
AIYQLKKFIGLCNQSIKYNEDIL

SEQ ID NO: 1713234 - protein, 18 aa, Staphylococcus aureus
ANAAARAGYTVNNTPKAG

SEQ ID NO: 1713235 - protein, 24 aa, Staphylococcus aureus
AQGNYHYTWKGNWHPSQLNQDNGY

SEQ ID NO: 1713236 - protein, 22 aa, Staphylococcus aureus
ASYTLGEPFKIYKFNKKSDGNY

SEQ ID NO: 1713237 - protein, 22 aa, Staphylococcus aureus
DSKSFKFSKLKTEDFSHRAETR

SEQ ID NO: 1713238 - protein, 21 aa, Staphylococcus aureus
DYSCSAFLMYIGIDIDVTDQV

SEQ ID NO: 1713239 - protein, 22 aa, Staphylococcus aureus
ELAMPRPYVFVSPKDFKNGTTK

SEQ ID NO: 1713240 - protein, 22 aa, Staphylococcus aureus
EMNYGHGAGVVTSRTISANQAG

SEQ ID NO: 1713241 - protein, 24 aa, Staphylococcus aureus
ERNFPEYKTEWAPKIKKMIPSYGE

SEQ ID NO: 1713242 - protein, 20 aa, Staphylococcus aureus
ESCQSMQAIGYKELIPVING

SEQ ID NO: 1713243 - protein, 19 aa, Staphylococcus aureus
GGAWFQDPLKIHFEFIDEL

SEQ ID NO: 1713244 - protein, 21 aa, Staphylococcus aureus
KADMLRLNKYGVDGVFTNFAD

SEQ ID NO: 1713245 - protein, 18 aa, Staphylococcus aureus
KGVKWGVKANSFVTPNGQ

SEQ ID NO: 1713246 - protein, 25 aa, Staphylococcus aureus
KKYPYIKRMIWPFQYNISLKTKDSN

SEQ ID NO: 1713247 - protein, 22 aa, Staphylococcus aureus
KNQDPIVLVHGFNGFTDDINPS

SEQ ID NO: 1713248 - protein, 18 aa, Staphylococcus aureus
LKNGHVMIQSFSDESLKK

SEQ ID NO: 1713249 - protein, 17 aa, Staphylococcus aureus
LLDFRRFGGTLHHRTAY

SEQ ID NO: 1713250 - protein, 24 aa, Staphylococcus aureus
LPFKQRVSLELSNNFEASLSGWSA

SEQ ID NO: 1713251 - protein, 25 aa, Staphylococcus aureus
LSKLERNKKGFFLMVEGASIDKSAH

SEQ ID NO: 1713252 - protein, 18 aa, Staphylococcus aureus
LTVSAGDKVKAGDQIAYS

SEQ ID NO: 1713253 - protein, 25 aa, Staphylococcus aureus
LVQDYNSGNKFGWVKEGDVVYNTAK

SEQ ID NO: 1713254 - protein, 18 aa, Staphylococcus aureus
LVRQIVFDIGKMFGNKNS

SEQ ID NO: 1713255 - protein, 24 aa, Staphylococcus aureus
NIMRLNGLNNFFIYPGQKLKVSGT

SEQ ID NO: 1713256 - protein, 24 aa, Staphylococcus aureus
QFVKSIAKDAHRIGQDNDIYASVM

SEQ ID NO: 1713257 - protein, 18 aa, Staphylococcus aureus
RHAEPMPNIPEMRQVWEP

SEQ ID NO: 1713258 - protein, 30 aa, Staphylococcus aureus
RQKADLNMFFPFVITGNLIGKATEKEWREN

SEQ ID NO: 1713259 - protein, 23 aa, Staphylococcus aureus
RVSEMNYGYGPGVVTSRTISASQ

SEQ ID NO: 1713260 - protein, 17 aa, Staphylococcus aureus
SDTSEFEITYGRNMDVT

SEQ ID NO: 1713261 - protein, 19 aa, Staphylococcus aureus
SNLIFPNQVLKVSGSSNST

SEQ ID NO: 1713262 - protein, 17 aa, Staphylococcus aureus
TRIETIKVSEKLSKVDV

SEQ ID NO: 1713263 - protein, 17 aa, Staphylococcus aureus
TSNGTTWSWSYEAANGQ

SEQ ID NO: 1713264 - protein, 18 aa, Staphylococcus aureus
VGASSILIATLLFLSGGQ

SEQ ID NO: 1713265 - protein, 21 aa, Staphylococcus aureus
VRARINGIPAVEVHATKASSF

SEQ ID NO: 1713266 - protein, 17 aa, Staphylococcus aureus
WADAIIVAPATANTIAK

SEQ ID NO: 1713267 - protein, 20 aa, Staphylococcus aureus
YDKVAKALKSYNDIEKDVSK

SEQ ID NO: 1713268 - protein, 24 aa, Staphylococcus aureus
YFLERTYRKPSDFYNMTSLVQGAK

SEQ ID NO: 1713269 - protein, 34 aa, Staphylococcus aureus
YTSGQCTYYVFDRVGGKIGSTWGNASNWANAAAR

SEQ ID NO: 1713270 - protein, 24 aa, Staphylococcus aureus
AEFKKLQEDATWKKLNAVKNNRVD

SEQ ID NO: 1713271 - protein, 27 aa, Staphylococcus aureus
ASAIVKANLWLRTADRIKIVVGRFNAT

SEQ ID NO: 1713272 - protein, 23 aa, Staphylococcus aureus
DPKFKRADAIKVNGDIRKFDKIL

SEQ ID NO: 1713273 - protein, 20 aa, Staphylococcus aureus
EAKIKEPFIINEKDEKKKYI

SEQ ID NO: 1713274 - protein, 20 aa, Staphylococcus aureus
ESYLGRKTIMTELAKDIGLE

SEQ ID NO: 1713275 - protein, 18 aa, Staphylococcus aureus
FDGTGPFKLGEHKKDESA

SEQ ID NO: 1713276 - protein, 25 aa, Staphylococcus aureus
FDYVKEISEQFGFVNIGVKNYEADD

SEQ ID NO: 1713277 - protein, 24 aa, Staphylococcus aureus
FGTIPRGDTGYFFNQAYKKDGAIN

SEQ ID NO: 1713278 - protein, 24 aa, Staphylococcus aureus
GASTHPGAGVPIVLTSAKITVDEM

SEQ ID NO: 1713279 - protein, 26 aa, Staphylococcus aureus
GDYNFPKKPFKYGIHYSEIEDFDNFN

SEQ ID NO: 1713280 - protein, 17 aa, Staphylococcus aureus
GIGVGVAAGFVVALQGR

SEQ ID NO: 1713281 - protein, 17 aa, Staphylococcus aureus
HEIRPTHVAVCWDMGQS

SEQ ID NO: 1713282 - protein, 20 aa, Staphylococcus aureus
IPKFEAYYKSAKNLPDDTMK

SEQ ID NO: 1713283 - protein, 18 aa, Staphylococcus aureus
ISTYWSDAKYWAGNAAND

SEQ ID NO: 1713284 - protein, 24 aa, Staphylococcus aureus
IVRRDLSQMMTFKGDPEFTIVNRL

SEQ ID NO: 1713285 - protein, 23 aa, Staphylococcus aureus
KDEKKKYIAFKMEITAKKDDKDL

SEQ ID NO: 1713286 - protein, 25 aa, Staphylococcus aureus
KLIVVLCAIIVFIALIGLSIRSQSQ

SEQ ID NO: 1713287 - protein, 26 aa, Staphylococcus aureus
KVSKESGFRTSLLMYNHTNKKMTKSV

SEQ ID NO: 1713288 - protein, 18 aa, Staphylococcus aureus
LDPKLWYFAAGSTTTTIK

SEQ ID NO: 1713289 - protein, 19 aa, Staphylococcus aureus
MTIGLAMNSVYYYKKEKDG

SEQ ID NO: 1713290 - protein, 22 aa, Staphylococcus aureus
NKLRNGVKMIVEQVAHTVSQLY

SEQ ID NO: 1713291 - protein, 24 aa, Staphylococcus aureus
NTKDGIKPLLAKKWDVSEDGKTYT

SEQ ID NO: 1713292 - protein, 24 aa, Staphylococcus aureus
QMTWFKNKMSVHWLDKENMSLQMM

SEQ ID NO: 1713293 - protein, 26 aa, Staphylococcus aureus
QNTLYKMRWNPAHPGTHQYATDVDWA

SEQ ID NO: 1713294 - protein, 19 aa, Staphylococcus aureus
QTKVPAVLLELGYISNPTD

SEQ ID NO: 1713295 - protein, 25 aa, Staphylococcus aureus
SEFQLRARLFVDQIVSFVNNSPYEH

SEQ ID NO: 1713296 - protein, 20 aa, Staphylococcus aureus
SPDVYPGMEEQLLASLKKHH

SEQ ID NO: 1713297 - protein, 22 aa, Staphylococcus aureus
VMTSQGFVGRVTKVNKFSSQVD

SEQ ID NO: 1713298 - protein, 30 aa, Staphylococcus aureus
VSFGQRVVSYPVNFVAGTIGDFFKKGDSKE

SEQ ID NO: 1713299 - protein, 24 aa, Staphylococcus aureus
VTTPHQVFLNWFGQDPAFDYFKTM

SEQ ID NO: 1713300 - protein, 18 aa, Staphylococcus aureus
YAYGNCTYYAFDRRAQLG

SEQ ID NO: 1713301 - protein, 27 aa, Staphylococcus aureus
YQIRWNGFYWAGANYKNFKTRTFKSTY

SEQ ID NO: 1713302 - protein, 24 aa, Staphylococcus aureus
YSIRKYKVGIFSTLIGTVLLLSNP

SEQ ID NO: 1713303 - protein, 21 aa, Staphylococcus aureus
AAGLIKLKKDFGLAGTVKDIT

SEQ ID NO: 1713304 - protein, 22 aa, Staphylococcus aureus
AGDSLYKIALEHHLTLNQLYSY

SEQ ID NO: 1713305 - protein, 17 aa, Staphylococcus aureus
ALMTRGLAEISRLGEKL

SEQ ID NO: 1713306 - protein, 19 aa, Staphylococcus aureus
DVLLGGGAKYFGKSNGNLD

SEQ ID NO: 1713307 - protein, 25 aa, Staphylococcus aureus
GSVNGKSGWVSKAYLVDTAKPTPTP

SEQ ID NO: 1713308 - protein, 22 aa, Staphylococcus aureus
KKGKTAQAMFIYELRGDGNINL

SEQ ID NO: 1713309 - protein, 17 aa, Staphylococcus aureus
KMKVGLVSVAITMLYIM

SEQ ID NO: 1713310 - protein, 18 aa, Staphylococcus aureus
KPEFPERNDEEWLKTTMA

SEQ ID NO: 1713311 - protein, 19 aa, Staphylococcus aureus
KTIMTELAKDIGLEQDIVT

SEQ ID NO: 1713312 - protein, 21 aa, Staphylococcus aureus
LRGDGNINLNVHKYSEDKTVD

SEQ ID NO: 1713313 - protein, 22 aa, Staphylococcus aureus
NKKLHSWLKISTLIDNVKVKDK

SEQ ID NO: 1713314 - protein, 34 aa, Staphylococcus aureus; identical to SEQ ID NO: 1662135

SEQ ID NO: 1713315 - protein, 26 aa, Staphylococcus aureus
SVGLPNSRALIWQQFDYNNSRERDTR

SEQ ID NO: 1713316 - protein, 17 aa, Staphylococcus aureus
VLFENISVKECVKDLME

SEQ ID NO: 1713317 - protein, 18 aa, Staphylococcus aureus
VSSVLAFLALNNAAHAQQ

SEQ ID NO: 1713318 - protein, 25 aa, Staphylococcus aureus
DAVGTPLKRCAIVNRHNGTIINIFD

SEQ ID NO: 1713319 - protein, 20 aa, Staphylococcus aureus
DKDKVLGLFADKNMPLAIDA

SEQ ID NO: 1713320 - protein, 19 aa, Staphylococcus aureus
ELKHKSKPAQSFNNDVNQK

SEQ ID NO: 1713321 - protein, 25 aa, Staphylococcus aureus
ENPEDLRVVIDLSNAKAGKYQEKYQ

SEQ ID NO: 1713322 - protein, 20 aa, Staphylococcus aureus
ESQIKWLKSHDAKFLTLKEF

SEQ ID NO: 1713323 - protein, 24 aa, Staphylococcus aureus
KNPDRRVAQQNAFYNVLKNDNLTE

SEQ ID NO: 1713324 - protein, 21 aa, Staphylococcus aureus
KSDLVKYSLPISSITAKGQKL

SEQ ID NO: 1713325 - protein, 20 aa, Staphylococcus aureus
KSLKELPKGATVYVSNNPAE

SEQ ID NO: 1713326 - protein, 18 aa, Staphylococcus aureus
LNNFIYFFSSSKEIKNYS

SEQ ID NO: 1713327 - protein, 25 aa, Staphylococcus aureus
LPVIKKAGLKYGFSLEEKAVTPNSN

SEQ ID NO: 1713328 - protein, 20 aa, Staphylococcus aureus
NGWGPYGRDSFHPTYGNELF

SEQ ID NO: 1713329 - protein, 24 aa, Staphylococcus aureus
RFIAFLLALFFFLSVNNVFGNIFN

SEQ ID NO: 1713330 - protein, 23 aa, Staphylococcus aureus
VRAMKRDGWSFASHSYGHINFEK

SEQ ID NO: 1713331 - protein, 17 aa, Staphylococcus aureus
VRHIFSAIHEIRPTHVA

SEQ ID NO: 1713332 - protein, 20 aa, Staphylococcus aureus
YDVGEKLGFVKTTIEYALKD

SEQ ID NO: 1713333 - protein, 24 aa, Staphylococcus aureus
YYGKLSNGKLAWIKSTDLAKELIK

SEQ ID NO: 1713334 - protein, 25 aa, Staphylococcus aureus
ENAELRTGPNAAYPVIYKVEKGDHF

SEQ ID NO: 1713335 - protein, 17 aa, Staphylococcus aureus
FYNMESLNKEQQKKDNI

SEQ ID NO: 1713336 - protein, 20 aa, Staphylococcus aureus
KEKIEYYVEWALDATAYKEF

SEQ ID NO: 1713337 - protein, 18 aa, Staphylococcus aureus
KIPATGFIITGHVGEENF

SEQ ID NO: 1713338 - protein, 24 aa, Staphylococcus aureus
LIDPFCGSGTIAIEACLIAQNIAP

SEQ ID NO: 1713339 - protein, 17 aa, Staphylococcus aureus
LLLLVFISGCGNDKYVK

SEQ ID NO: 1713340 - protein, 22 aa, Staphylococcus aureus
LMAANNLRGYLIMPNQTLQIPN

SEQ ID NO: 1713341 - protein, 25 aa, Staphylococcus aureus
PMIEMMFGVHFIKGGMYGMAQGLAQ

SEQ ID NO: 1713342 - protein, 21 aa, Staphylococcus aureus
QSGESLWSIAQKYNTSVESIK

SEQ ID NO: 1713343 - protein, 22 aa, Staphylococcus aureus
QTYPRLRVTGASFEAVGLPDCI

SEQ ID NO: 1713344 - protein, 25 aa, Staphylococcus aureus
RAKDGHTISTFWGDAKNWAGQASSN

SEQ ID NO: 1713345 - protein, 19 aa, Staphylococcus aureus
VVALTGYEGVLGYRTNELT

SEQ ID NO: 1713346 - protein, 17 aa, Staphylococcus aureus
YQFTNLKAAKKGSMVYF

SEQ ID NO: 1713347 - protein, 19 aa, Staphylococcus aureus
CLTLSHWFKSKEQVHTNQK

SEQ ID NO: 1713348 - protein, 20 aa, Staphylococcus aureus
DDYQLHWTSTNWKGTNTKDK

SEQ ID NO: 1713349 - protein, 20 aa, Staphylococcus aureus
GEIGSTWGNANNWAAAAQGA

SEQ ID NO: 1713350 - protein, 21 aa, Staphylococcus aureus
GFDGVLIPGGFSFGDYLRSGA

SEQ ID NO: 1713351 - protein, 23 aa, Staphylococcus aureus
IRPTHVAVCWDMGQSTFRNDMFD

SEQ ID NO: 1713352 - protein, 17 aa, Staphylococcus aureus
LLIMLLVVAGCSFGGNH

SEQ ID NO: 1713353 - protein, 25 aa, Staphylococcus aureus
LSTEEERLAAKHLVEQALNQAIDQI

SEQ ID NO: 1713354 - protein, 29 aa, Staphylococcus aureus
SEEGANKSGLAWPSAFKVQLQLPDNEVAQ

SEQ ID NO: 1713355 - protein, 17 aa, Staphylococcus aureus
YKLKPFFNPENVYSKQD

SEQ ID NO: 1713356 - protein, 17 aa, Staphylococcus aureus
AGRGYRRVVPSPQPISI

SEQ ID NO: 1713357 - protein, 19 aa, Staphylococcus aureus
DFGNAHFVVLSKYIKEYES

SEQ ID NO: 1713358 - protein, 18 aa, Staphylococcus aureus
GDEIKAHPNGFYNNGGGL

SEQ ID NO: 1713359 - protein, 20 aa, Staphylococcus aureus
LKKAESLLDEAGWKKGKDSD

SEQ ID NO: 1713360 - protein, 23 aa, Staphylococcus aureus
PTDKKVGWKVIFNNMVNQNWGPY

SEQ ID NO: 1713361 - protein, 18 aa, Staphylococcus aureus
PVPYSVAQIKSFGVPLTS

SEQ ID NO: 1713362 - protein, 21 aa, Staphylococcus aureus
RDIKGDAYLSIHNDALESSNA

SEQ ID NO: 1713363 - protein, 26 aa, Staphylococcus aureus
RLSPYTRQRLGNVIKQGARIEMNVHY

SEQ ID NO: 1713364 - protein, 20 aa, Staphylococcus aureus
SLAVALGVTGYAAGTGHQAH

SEQ ID NO: 1713365 - protein, 24 aa, Staphylococcus aureus
GSMLPKIEAAISFIENNPKGSVLI

SEQ ID NO: 1713366 - protein, 20 aa, Staphylococcus aureus
IEEHKNEIIGNIGDQTTDDG

SEQ ID NO: 1713367 - protein, 19 aa, Staphylococcus aureus
KAKSIGIINEKCLNYSEAI

SEQ ID NO: 1713368 - protein, 25 aa, Staphylococcus aureus
LKNKRTLIVVIAFVLFIIFLFLLLN

SEQ ID NO: 1713369 - protein, 19 aa, Staphylococcus aureus
NANGMTVYWYHDNQRALAD

SEQ ID NO: 1713370 - protein, 17 aa, Staphylococcus aureus
PTNSGLYTTVYDKTGKA

SEQ ID NO: 1713371 - protein, 21 aa, Staphylococcus aureus
VAPYSGVTWMGAGTGFVVGNH

SEQ ID NO: 1713372 - protein, 30 aa, Staphylococcus aureus
ATASGHAKDASWLTSRKQLQPYGQYHGGGA

SEQ ID NO: 1713373 - protein, 20 aa, Staphylococcus aureus
DQLIILTAIDYVYINFNTEN

SEQ ID NO: 1713374 - protein, 20 aa, Staphylococcus aureus
DTPEAVILSGFDPIRREIAR

SEQ ID NO: 1713375 - protein, 28 aa, Staphylococcus aureus
GVEKAFAIQAGREIRVIVSPEEIDDLKS

SEQ ID NO: 1713376 - protein, 19 aa, Staphylococcus aureus
IGSAQKFSTGLLLKQLEEE

SEQ ID NO: 1713377 - protein, 17 aa, Staphylococcus aureus
KPIPLKDLMLHQSGLYK

SEQ ID NO: 1713378 - protein, 30 aa, Staphylococcus aureus; identical to SEQ ID NO: 1658363

SEQ ID NO: 1713379 - protein, 27 aa, Staphylococcus aureus
NQGPAFPFAECGAMSQAYIGYQLQESL

SEQ ID NO: 1713380 - protein, 17 aa, Staphylococcus aureus
AKELLATAVQRLAADHT

SEQ ID NO: 1713381 - protein, 18 aa, Staphylococcus aureus
AKPLKFYNMESLNKEQQK

SEQ ID NO: 1713382 - protein, 17 aa, Staphylococcus aureus
EKRARDIIEDKYLSERT

SEQ ID NO: 1713383 - protein, 19 aa, Staphylococcus aureus
EVESKIVYAKDVKQVLNYV

SEQ ID NO: 1713384 - protein, 17 aa, Staphylococcus aureus
GKPLVVIYGDYKCPYCK

SEQ ID NO: 1713385 - protein, 19 aa, Staphylococcus aureus
GYEGFKKEYGFDFGTVRPM

SEQ ID NO: 1713386 - protein, 19 aa, Staphylococcus aureus
LNAILGFLVLTGVIQDPTT

SEQ ID NO: 1713387 - protein, 21 aa, Staphylococcus aureus
NLFEFKYKLKPFFNPENVYSK

SEQ ID NO: 1713388 - protein, 17 aa, Staphylococcus aureus
NNQAYWFITINSKENNH

SEQ ID NO: 1713389 - protein, 25 aa, Staphylococcus aureus
PNDEMKGRIIGREGRNIRTLETLTG

SEQ ID NO: 1713390 - protein, 18 aa, Staphylococcus aureus
QFKHGLSSFIEALEQDVK

SEQ ID NO: 1713391 - protein, 23 aa, Staphylococcus aureus
SFLIDSMAGFLLIGLITLLLIPM

SEQ ID NO: 1713392 - protein, 25 aa, Staphylococcus aureus
GKYQFLQSTWDSVAPAKYKGVSPAN

SEQ ID NO: 1713393 - protein, 20 aa, Staphylococcus aureus
NRLNGGFFGQVFTVYYNDKY

SEQ ID NO: 1713394 - protein, 17 aa, Staphylococcus aureus
NVLTKLQSEYNFDKFNF

SEQ ID NO: 1713395 - protein, 17 aa, Staphylococcus aureus
QAQTFKIQQQQFVKKPI

SEQ ID NO: 1713396 - protein, 30 aa, Staphylococcus aureus; identical to SEQ ID NO: 1578250

SEQ ID NO: 1713397 - protein, 22 aa, Staphylococcus aureus
VDGITALHRTYFVFPENKKVLY

SEQ ID NO: 1713398 - protein, 21 aa, Staphylococcus aureus
VNRHNGTIINIFDDMSEKDKE

SEQ ID NO: 1713399 - protein, 19 aa, Staphylococcus aureus
VVFSQRQAQTFKIQQQQFV

SEQ ID NO: 1713400 - protein, 21 aa, Staphylococcus aureus
YKENLRTAAYHKELLSDKIKI

SEQ ID NO: 1713401 - protein, 18 aa, Staphylococcus aureus
KSSKTFVGGTKFDDQHAS

SEQ ID NO: 1713402 - protein, 21 aa, Staphylococcus aureus
LQDFWHHLADDLVKTEKVTDT

SEQ ID NO: 1713403 - protein, 25 aa, Staphylococcus aureus
MSFANCALPYVIGEVVEDRKYALAY

SEQ ID NO: 1713404 - protein, 35 aa, Staphylococcus aureus
PTFKAEPGDLVVFSGRFGGGYGHTAIVLNGDYDGK

SEQ ID NO: 1713405 - protein, 18 aa, Staphylococcus aureus
QCTYHVFNRRAEIGKGIS

SEQ ID NO: 1713406 - protein, 20 aa, Staphylococcus aureus
RLLIAFAVLFSADFTYQSVE

SEQ ID NO: 1713407 - protein, 25 aa, Staphylococcus aureus
SSYAKCLIYKLTQEIVHVATIDNVH

SEQ ID NO: 1713408 - protein, 17 aa, Staphylococcus aureus
YNYTFDYEGFTYHFESD

SEQ ID NO: 1713409 - protein, 32 aa, Staphylococcus aureus
EDYTSYFPKYAYRNGVGRPEGIVVHDTANDRS

SEQ ID NO: 1713410 - protein, 24 aa, Staphylococcus aureus
FFKGKKGIKRKVIETHDDVKQVDY

SEQ ID NO: 1713411 - protein, 20 aa, Staphylococcus aureus
GEHKTSQYLIGFAAETEDIE

SEQ ID NO: 1713412 - protein, 21 aa, Staphylococcus aureus
GMKICLMLYLLIFLSSCGTNN

SEQ ID NO: 1713413 - protein, 19 aa, Staphylococcus aureus
HSRSDAMILTTFNQSKHQI

SEQ ID NO: 1713414 - protein, 19 aa, Staphylococcus aureus
IPYRLNEEIDAINGNEITF

SEQ ID NO: 1713415 - protein, 22 aa, Staphylococcus aureus
LSISIGMFLALGMSNKAYADEI

SEQ ID NO: 1713416 - protein, 20 aa, Staphylococcus aureus
LSPHYVEFPIKPGTTLTKEK

SEQ ID NO: 1713417 - protein, 22 aa, Staphylococcus aureus
NHLYGHGLKGYGAKDIPYANNF

SEQ ID NO: 1713418 - protein, 19 aa, Staphylococcus aureus
QAEFKKMGIKLNINGETSD

SEQ ID NO: 1713419 - protein, 23 aa, Staphylococcus aureus
SKNQCTWWAFKRRAQVGKPVSNR

SEQ ID NO: 1713420 - protein, 31 aa, Staphylococcus aureus
TLENRGWDFDGSYGWQCFDLVNVYWNHLYGH

SEQ ID NO: 1713421 - protein, 19 aa, Staphylococcus aureus
YKGEMMDLSRGRAISRENE

SEQ ID NO: 1713422 - protein, 24 aa, Staphylococcus aureus
DTKRWKDEVEPIVGKTDMFVFPHG

SEQ ID NO: 1713423 - protein, 27 aa, Staphylococcus aureus
DYVKRVKQSNLWKSKDNGFYDLTREGA

SEQ ID NO: 1713424 - protein, 18 aa, Staphylococcus aureus
GKEIKKAIGQDATVSLFD

SEQ ID NO: 1713425 - protein, 26 aa, Staphylococcus aureus
HLTEREKRVIKREHVREAQKLVDNYK

SEQ ID NO: 1713426 - protein, 17 aa, Staphylococcus aureus
IGESIKDVLTKYKNPMY

SEQ ID NO: 1713427 - protein, 19 aa, Staphylococcus aureus
LPSMVALTLVGSAVTAHQV

SEQ ID NO: 1713428 - protein, 19 aa, Staphylococcus aureus
NKYSLPYFFGTVGILYNKE

SEQ ID NO: 1713429 - protein, 17 aa, Staphylococcus aureus
QSLGFTITTNKNMVTIQ

SEQ ID NO: 1713430 - protein, 23 aa, Staphylococcus aureus
TKVRFKLENLYKIYNKDTGNIQK

SEQ ID NO: 1713431 - protein, 20 aa, Staphylococcus aureus
TKYHNVFGIAAYDNDPLREG

SEQ ID NO: 1713432 - protein, 17 aa, Staphylococcus aureus
YYTDITWQLDESNKIST

SEQ ID NO: 1713433 - protein, 22 aa, Staphylococcus aureus
EKSQTKLNEWHNINEKSALLPS

SEQ ID NO: 1713434 - protein, 20 aa, Staphylococcus aureus
ENTYDGTGFVIARTSDTDIT

SEQ ID NO: 1713435 - protein, 17 aa, Staphylococcus aureus
FLSHDLIFPIEYKSYNE

SEQ ID NO: 1713436 - protein, 27 aa, Staphylococcus aureus
FWFDLFPKKELVPFVPYKFLNIYGDNK

SEQ ID NO: 1713437 - protein, 23 aa, Staphylococcus aureus
HSDAPKLYVSNVMTQPGETDGYS

SEQ ID NO: 1713438 - protein, 18 aa, Staphylococcus aureus
KELKEMYKTGLWEFETHT

SEQ ID NO: 1713439 - protein, 23 aa, Staphylococcus aureus
LRRYLQEEYNIYGFNDTNKGRNY

SEQ ID NO: 1713440 - protein, 23 aa, Staphylococcus aureus
NFGGCCMYGGLTFNSSENERDKL

SEQ ID NO: 1713441 - protein, 20 aa, Staphylococcus aureus
NQVISPRFGTLTNMIAIGQM

SEQ ID NO: 1713442 - protein, 19 aa, Staphylococcus aureus
DDLKSYRLARDIKNQIEDE

SEQ ID NO: 1713443 - protein, 17 aa, Staphylococcus aureus
DGLPVSFLKIYEDNKII

SEQ ID NO: 1713444 - protein, 17 aa, Staphylococcus aureus
IARRYFLERTYRKPSDF

SEQ ID NO: 1713445 - protein, 22 aa, Staphylococcus aureus
LALSLFLAACGQDSDQQKDSNK

SEQ ID NO: 1713446 - protein, 17 aa, Staphylococcus aureus
LTGFILILLLEGIFTNS

SEQ ID NO: 1713447 - protein, 17 aa, Staphylococcus aureus
NTSFWFDLFPKKELVPF

SEQ ID NO: 1713448 - protein, 20 aa, Staphylococcus aureus
SERTKRLKLKQLLNSQNVEK

SEQ ID NO: 1713449 - protein, 17 aa, Staphylococcus aureus
ASHAVLMYAPKSFLDFQ

SEQ ID NO: 1713450 - protein, 20 aa, Staphylococcus aureus
FNLTSYYTDITWQLDESNKI

SEQ ID NO: 1713451 - protein, 27 aa, Staphylococcus aureus
GGKVGVFSHAMVRTSMFDSGDAKNYQA

SEQ ID NO: 1713452 - protein, 27 aa, Staphylococcus aureus
KDKGYEWNPQPIKSMKHSGSYMTEKMA

SEQ ID NO: 1713453 - protein, 17 aa, Staphylococcus aureus
NASSDFGNAHFVVLSKY

SEQ ID NO: 1713454 - protein, 25 aa, Staphylococcus aureus
NIPKEYKKPVELMMNYFKALNSTIA

SEQ ID NO: 1713455 - protein, 17 aa, Staphylococcus aureus
NPGVTPLIFPGDVISLV

SEQ ID NO: 1713456 - protein, 22 aa, Staphylococcus aureus
VDYAGYPWPGYDDIVSEIIDSN

SEQ ID NO: 1713457 - protein, 17 aa, Staphylococcus aureus
YEARPRFNKPSETNAYN

SEQ ID NO: 1713458 - protein, 23 aa, Staphylococcus aureus
YKARHWLTKEKKLYEFDGSAFES

SEQ ID NO: 1713459 - protein, 19 aa, Staphylococcus aureus
ASLALGILTTGMITTTAQP

SEQ ID NO: 1713460 - protein, 23 aa, Staphylococcus aureus
ENKVKSVLYFNRGISDIDLRLSK

SEQ ID NO: 1713461 - protein, 21 aa, Staphylococcus aureus
GVTPLIFPGDVISLVPQNKVK

SEQ ID NO: 1713462 - protein, 25 aa, Staphylococcus aureus
IVNRLPKSMPQYHVGHIQQIRQIQA

SEQ ID NO: 1713463 - protein, 20 aa, Staphylococcus aureus
KKNPKRVVVLEYSFADYLAA

SEQ ID NO: 1713464 - protein, 19 aa, Staphylococcus aureus
PKYKLELVKFNNWPDLMDA

SEQ ID NO: 1713465 - protein, 17 aa, Staphylococcus aureus
RYTLHRFNEEYALEPQQ

SEQ ID NO: 1713466 - protein, 20 aa, Staphylococcus aureus
SLAVGLGIVAGNAGHEAHAS

SEQ ID NO: 1713467 - protein, 22 aa, Staphylococcus aureus
VHADKSGKVVLINGDTDAKKVK

SEQ ID NO: 1713468 - protein, 18 aa, Staphylococcus aureus
VLGIIFLFLVISITAGCG

SEQ ID NO: 1713469 - protein, 24 aa, Staphylococcus aureus
AQGNYHYTWTGNWNPSQLTQNNTY

SEQ ID NO: 1713470 - protein, 25 aa, Staphylococcus aureus
DVIPDAYCCVLVLRGELLDQHKDVA

SEQ ID NO: 1713471 - protein, 25 aa, Staphylococcus aureus
EEHNGNYKYVFSFKDPNANGKYSIV

SEQ ID NO: 1713472 - protein, 25 aa, Staphylococcus aureus
FDEPAYLPRFVFGHYMKSYLSMFTK

SEQ ID NO: 1713473 - protein, 17 aa, Staphylococcus aureus
FVLEDKGKAAEEAGYVA

SEQ ID NO: 1713474 - protein, 18 aa, Staphylococcus aureus
HRLKEVDLNDVLKGMINH

SEQ ID NO: 1713475 - protein, 26 aa, Staphylococcus aureus
LKYDLARPTEMGIFQSMIEHLKENLN

SEQ ID NO: 1713476 - protein, 27 aa, Staphylococcus aureus
LMPDKILDLKYKLRVNNVPTPRTVTFN

SEQ ID NO: 1713477 - protein, 24 aa, Staphylococcus aureus
MIEHLKENLNWIWNSLSIEDQHQF

SEQ ID NO: 1713478 - protein, 22 aa, Staphylococcus aureus
NANGKYSIVTVDYTGQAMVTDP

SEQ ID NO: 1713479 - protein, 19 aa, Staphylococcus aureus
RGVINSRQFLSHDLIFPIE

SEQ ID NO: 1713480 - protein, 26 aa, Staphylococcus aureus
RLAAEGKPVLGVCNGFQILTEIGLLP

SEQ ID NO: 1713481 - protein, 18 aa, Staphylococcus aureus
TNNKEFTVTTSLKNNGNF

SEQ ID NO: 1713482 - protein, 25 aa, Staphylococcus aureus
VDVKSWGEKTFYHFDVPDEHDTEMS

SEQ ID NO: 1713483 - protein, 20 aa, Staphylococcus aureus
VKDEQRAGVDANYYAKQTYD

SEQ ID NO: 1713484 - protein, 17 aa, Staphylococcus aureus
VLMLAVIVFAAACGNSS

SEQ ID NO: 1713485 - protein, 19 aa, Staphylococcus aureus
YSGEGDLAIVKFSPNEQNK

SEQ ID NO: 1713486 - protein, 17 aa, Staphylococcus aureus
YSTHYLLLEELRKQLKI

SEQ ID NO: 1713487 - protein, 23 aa, Staphylococcus aureus
DSELPPLVQSGFNPSFIATVSHE

SEQ ID NO: 1713488 - protein, 17 aa, Staphylococcus aureus
FEPRTAAIKDFWEKVGL

SEQ ID NO: 1713489 - protein, 24 aa, Staphylococcus aureus
FSAVLVLSGCGSMHSSGKDLNISL

SEQ ID NO: 1713490 - protein, 21 aa, Staphylococcus aureus
GAYDIHFVKDGFQYNFTSNGT

SEQ ID NO: 1713491 - protein, 17 aa, Staphylococcus aureus
GRVDYGAAHAAKYGHER

SEQ ID NO: 1713492 - protein, 21 aa, Staphylococcus aureus
GRVKISLKDGSFYNLDLRSKL

SEQ ID NO: 1713493 - protein, 22 aa, Staphylococcus aureus
HFVAKGPEVNRFITQNKVNHHF

SEQ ID NO: 1713494 - protein, 19 aa, Staphylococcus aureus
HYFYNCYPKNANANGSGQT

SEQ ID NO: 1713495 - protein, 24 aa, Staphylococcus aureus
IFEGRLSYDPSIYVYVPAVADKSL

SEQ ID NO: 1713496 - protein, 20 aa, Staphylococcus aureus
ITHAHAYGGPIAAMDSVEAT

SEQ ID NO: 1713497 - protein, 17 aa, Staphylococcus aureus
KAFYFLLRDDDYFAKVV

SEQ ID NO: 1713498 - protein, 21 aa, Staphylococcus aureus
KEKYKLHSDYAKAYKKAVNSE

SEQ ID NO: 1713499 - protein, 24 aa, Staphylococcus aureus
KKGDTLSAIALKYKTTVSNIQNTN

SEQ ID NO: 1713500 - protein, 18 aa, Staphylococcus aureus
KNVTGYRYSKGGKHYLIF

SEQ ID NO: 1713501 - protein, 23 aa, Staphylococcus aureus
KVMSEFIKFVLEDKGKAAEEAGY

SEQ ID NO: 1713502 - protein, 25 aa, Staphylococcus aureus
LIVVPIVFATLLFKTSQDAFESSQD

SEQ ID NO: 1713503 - protein, 19 aa, Staphylococcus aureus
LRDDVKFHDGTPFDADAVK

SEQ ID NO: 1713504 - protein, 23 aa, Staphylococcus aureus
MPTPELKTGSGIDWSDEALTQQI

SEQ ID NO: 1713505 - protein, 26 aa, Staphylococcus aureus
NRRAEIGKGISTYWWNANNWDNAAAA

SEQ ID NO: 1713506 - protein, 27 aa, Staphylococcus aureus
PRTAAIKDFWEKVGLKTNVKLVEFGKY

SEQ ID NO: 1713507 - protein, 19 aa, Staphylococcus aureus
QLLKVARTKLALQPNERYE

SEQ ID NO: 1713508 - protein, 23 aa, Staphylococcus aureus
QMKSGVRFFDIRGRASADNMISV

SEQ ID NO: 1713509 - protein, 21 aa, Staphylococcus aureus
SGFSPDFATVITMDRKASKQQ

SEQ ID NO: 1713510 - protein, 17 aa, Staphylococcus aureus
SQLDKAKSIGIINEKCL

SEQ ID NO: 1713511 - protein, 18 aa, Staphylococcus aureus
THANGQVSYGARPTQKKP

SEQ ID NO: 1713512 - protein, 23 aa, Staphylococcus aureus
TNSEIKALAKMYLTNDVEIKTAQ

SEQ ID NO: 1713513 - protein, 18 aa, Staphylococcus aureus
TVVQAGWSNYGGGNQVTI

SEQ ID NO: 1713514 - protein, 17 aa, Staphylococcus aureus
WLIKKGFNIYNRYTLHR

SEQ ID NO: 1713515 - protein, 24 aa, Staphylococcus aureus
WNSTLRWPGSYSVSIQNVDDNNNT

SEQ ID NO: 1713516 - protein, 26 aa, Staphylococcus aureus
YHNKDLDFAFGLSMTSKNVARYESIN

SEQ ID NO: 1713517 - protein, 19 aa, Staphylococcus aureus
DAPAGKGPDIFFLAHDNTG

SEQ ID NO: 1713518 - protein, 24 aa, Staphylococcus aureus
FKKAAPKAKIVYVGADEKNLIGSM

SEQ ID NO: 1713519 - protein, 24 aa, Staphylococcus aureus
FQQRSYEGLDVFFVQEKRDKHDIF

SEQ ID NO: 1713520 - protein, 18 aa, Staphylococcus aureus
GKGPDIFFLAHDNTGSAY

SEQ ID NO: 1713521 - protein, 24 aa, Staphylococcus aureus
IQPETKVKPAAREKINQKANELRA

SEQ ID NO: 1713522 - protein, 19 aa, Staphylococcus aureus
KANENLGLNPSHEGETDPE

SEQ ID NO: 1713523 - protein, 20 aa, Staphylococcus aureus
KDGKVIVIGIQLYKDREKMY

SEQ ID NO: 1713524 - protein, 17 aa, Staphylococcus aureus
KKTNHVKAMRWPFQYNI

SEQ ID NO: 1713525 - protein, 22 aa, Staphylococcus aureus
KLRKHLIEKYGLYKTISKDGRV

SEQ ID NO: 1713526 - protein, 18 aa, Staphylococcus aureus
KNNLRFKFRGIKIQVLLP

SEQ ID NO: 1713527 - protein, 19 aa, Staphylococcus aureus
KRKDIYVKWQKYMNDELPG

SEQ ID NO: 1713528 - protein, 18 aa, Staphylococcus aureus
LKAAKKGSMVYFKVGNET

SEQ ID NO: 1713529 - protein, 23 aa, Staphylococcus aureus
NDELPGLPMFQGKSITIVNDKVR

SEQ ID NO: 1713530 - protein, 23 aa, Staphylococcus aureus
NTLKNRALTDIGVTSTTAMVNSI

SEQ ID NO: 1713531 - protein, 21 aa, Staphylococcus aureus
PRDTISYIPKVGYYDKITHAH

SEQ ID NO: 1713532 - protein, 25 aa, Staphylococcus aureus
QQADYTFASLDIFNDLKRRAQTILD

SEQ ID NO: 1713533 - protein, 23 aa, Staphylococcus aureus
RNGSMKAAENFLDPNKASSLLSS

SEQ ID NO: 1713534 - protein, 18 aa, Staphylococcus aureus
RQLWNMLVLARVITIGAY

SEQ ID NO: 1713535 - protein, 18 aa, Staphylococcus aureus
SDWLSTNFGVRFRYNALG

SEQ ID NO: 1713536 - protein, 20 aa, Staphylococcus aureus
SLTDGTVVQAGWSNYGGGNQ

SEQ ID NO: 1713537 - protein, 19 aa, Staphylococcus aureus
SNNGLSMVPWGTKNQVILT

SEQ ID NO: 1713538 - protein, 26 aa, Staphylococcus aureus
STFGPKGRFGGLVYDTLGFNAVDKKV

SEQ ID NO: 1713539 - protein, 23 aa, Staphylococcus aureus
TTPRYEKAYEIPKEQLKEKDGHH

SEQ ID NO: 1713540 - protein, 18 aa, Staphylococcus aureus
VLAVMFLLAACGNNSDKE

SEQ ID NO: 1713541 - protein, 24 aa, Staphylococcus aureus
VNVAKTGTAHLFKVPTDADRLDLQ

SEQ ID NO: 1713542 - protein, 22 aa, Staphylococcus aureus
VPESKLGNIVPEYKEINNRVNV

SEQ ID NO: 1713543 - protein, 22 aa, Staphylococcus aureus
WYMHNNRLTVSAGDKVKAGDQI

SEQ ID NO: 1713544 - protein, 35 aa, Staphylococcus aureus; identical to SEQ ID NO: 1654649

SEQ ID NO: 1713545 - protein, 20 aa, Staphylococcus aureus
AENRNGTVFSYGGVTKKNQD

SEQ ID NO: 1713546 - protein, 27 aa, Staphylococcus aureus
AKLDNGQEVIIIWNPWDNGFMTQDAKN

SEQ ID NO: 1713547 - protein, 17 aa, Staphylococcus aureus
ATLALGLLTTGVITSEG

SEQ ID NO: 1713548 - protein, 19 aa, Staphylococcus aureus
DIVEYPGKEDLAIVHVHET

SEQ ID NO: 1713549 - protein, 18 aa, Staphylococcus aureus
DKGLHSIKDIINKAKQDG

SEQ ID NO: 1713550 - protein, 25 aa, Staphylococcus aureus
DRKTNHKSIGWGVEAHKIMNNGWGP

SEQ ID NO: 1713551 - protein, 21 aa, Staphylococcus aureus
ELDFRIRQTLIKSKKLYNNSY

SEQ ID NO: 1713552 - protein, 25 aa, Staphylococcus aureus
ESKGKITYLKGEAMQYDLSTTGGNS

SEQ ID NO: 1713553 - protein, 21 aa, Staphylococcus aureus
FKARKNPGLDIFVVKEAENRN

SEQ ID NO: 1713554 - protein, 17 aa, Staphylococcus aureus
FKFIAGVGPNNFTDISA

SEQ ID NO: 1713555 - protein, 19 aa, Staphylococcus aureus
GPVMWGFFGHCSIAIDDKT

SEQ ID NO: 1713556 - protein, 19 aa, Staphylococcus aureus
HPMGGIQIIPETNQVISPR

SEQ ID NO: 1713557 - protein, 23 aa, Staphylococcus aureus
IASSLSCAILLLSAATTQANSAH

SEQ ID NO: 1713558 - protein, 20 aa, Staphylococcus aureus
IASSNAQMWKDITLSNKTYI

SEQ ID NO: 1713559 - protein, 20 aa, Staphylococcus aureus
IDLSKRLPSTDANRYVKKPQ

SEQ ID NO: 1713560 - protein, 18 aa, Staphylococcus aureus
IDSSEAMNGYRRGAYEDM

SEQ ID NO: 1713561 - protein, 24 aa, Staphylococcus aureus
IDYIKRVSKSKIWTSDDNAAYDLT

SEQ ID NO: 1713562 - protein, 18 aa, Staphylococcus aureus
ISIALIFHRLQTKTHSID

SEQ ID NO: 1713563 - protein, 17 aa, Staphylococcus aureus
IVTKGPVMWGFFGHCSI

SEQ ID NO: 1713564 - protein, 18 aa, Staphylococcus aureus
KDLMLHQSGLYKYKSSKD

SEQ ID NO: 1713565 - protein, 19 aa, Staphylococcus aureus
KDLYFAGASTHPGAGVPIV

SEQ ID NO: 1713566 - protein, 25 aa, Staphylococcus aureus
KDSKIKVIMKDGGYYTFELNKKLQT

SEQ ID NO: 1713567 - protein, 18 aa, Staphylococcus aureus
KIDDWIYSIEVLANKDYE

SEQ ID NO: 1713568 - protein, 24 aa, Staphylococcus aureus
KIEFKIKKGIKWHDGNELKIDDWI

SEQ ID NO: 1713569 - protein, 19 aa, Staphylococcus aureus
KRMIWPFQYNIGLTTKDPN

SEQ ID NO: 1713570 - protein, 21 aa, Staphylococcus aureus
KVPMKIFPAVHYSMGGLYVDY

SEQ ID NO: 1713571 - protein, 19 aa, Staphylococcus aureus
LDFKLRQYLIQNFDLYKKF

SEQ ID NO: 1713572 - protein, 28 aa, Staphylococcus aureus
LDITYATLFPRTGIYAERKHNAFVNRNF

SEQ ID NO: 1713573 - protein, 26 aa, Staphylococcus aureus
LNTYYKRTIKISGQKAMYALKSKDFK

SEQ ID NO: 1713574 - protein, 22 aa, Staphylococcus aureus
MSLNGLNNFFIYPGQKLKVTGN

SEQ ID NO: 1713575 - protein, 23 aa, Staphylococcus aureus
NAEQSRSAFAFSKKADDETVQKF

SEQ ID NO: 1713576 - protein, 22 aa, Staphylococcus aureus
NAVKNTRIEVVNGDEVSRPGPR

SEQ ID NO: 1713577 - protein, 20 aa, Staphylococcus aureus
NSPARLMPDKILDLKYKLRV

SEQ ID NO: 1713578 - protein, 25 aa, Staphylococcus aureus
PKKGGFFEEIERTFKEISEELNEEE

SEQ ID NO: 1713579 - protein, 18 aa, Staphylococcus aureus
PLLARGNFNPEFISVLSH

SEQ ID NO: 1713580 - protein, 19 aa, Staphylococcus aureus
PSVRGTMIDVTFKYLTKDK

SEQ ID NO: 1713581 - protein, 18 aa, Staphylococcus aureus
QNINILKEDGYHFIEPGS

SEQ ID NO: 1713582 - protein, 26 aa, Staphylococcus aureus
RSMDEFKIDWNRHGFWGYWSGENHVD

SEQ ID NO: 1713583 - protein, 20 aa, Staphylococcus aureus
SKLAKEWMEFLKSDKAKEIL

SEQ ID NO: 1713584 - protein, 28 aa, Staphylococcus aureus
SREVKYTYGYKTGGDFSINRGGLTGNIT

SEQ ID NO: 1713585 - protein, 21 aa, Staphylococcus aureus
TDQLWWSYRETFTGGVTPAAK

SEQ ID NO: 1713586 - protein, 18 aa, Staphylococcus aureus
THGLDVFAVPELVDLDGR

SEQ ID NO: 1713587 - protein, 21 aa, Staphylococcus aureus
TKFMAASAVFTMGFLSVPTAG

SEQ ID NO: 1713588 - protein, 19 aa, Staphylococcus aureus
VFGSESWGNINQLRNKYVD

SEQ ID NO: 1713589 - protein, 20 aa, Staphylococcus aureus
VRYEIELNYYSPKSKKDTST

SEQ ID NO: 1713590 - protein, 23 aa, Staphylococcus aureus
WKNKGYPVSIVYPIEGTMLNVDG

SEQ ID NO: 1713591 - protein, 19 aa, Staphylococcus aureus
YNPKEARAHWDKAKKELGK

SEQ ID NO: 1713592 - protein, 26 aa, Staphylococcus aureus
DGDISVGAFFRARLGNEVLENLIEPL

SEQ ID NO: 1713593 - protein, 18 aa, Staphylococcus aureus
FTCLSSNHYGYWNWHIRD

SEQ ID NO: 1713594 - protein, 18 aa, Staphylococcus aureus
HANVILPNNDRHQITDTT

SEQ ID NO: 1713595 - protein, 19 aa, Staphylococcus aureus
HDFIPGYYQFHIYPVFPIP

SEQ ID NO: 1713596 - protein, 18 aa, Staphylococcus aureus
IMMNEYRAKAALKKNDFV

SEQ ID NO: 1713597 - protein, 23 aa, Staphylococcus aureus
KDKAETFTGGFPVYEGNKPVLTL

SEQ ID NO: 1713598 - protein, 18 aa, Staphylococcus aureus
KDQETIDSFALSQETFTG

SEQ ID NO: 1713599 - protein, 19 aa, Staphylococcus aureus
KGQSEPIVLVIFTNKDNKS

SEQ ID NO: 1713600 - protein, 17 aa, Staphylococcus aureus
KNDEISLTFAPDDEDEA

SEQ ID NO: 1713601 - protein, 17 aa, Staphylococcus aureus
KSLIFKTKVTSLEDIDK

SEQ ID NO: 1713602 - protein, 26 aa, Staphylococcus aureus
KVPENVSHLKIQFVPKNDAITDARGI

SEQ ID NO: 1713603 - protein, 23 aa, Staphylococcus aureus
LRKQLKIKPGHFSYHEMSPAEMP

SEQ ID NO: 1713604 - protein, 18 aa, Staphylococcus aureus
LSFLRPNILDQYYGAGNL

SEQ ID NO: 1713605 - protein, 19 aa, Staphylococcus aureus
MPNIPEMRQVWEPMGNASI

SEQ ID NO: 1713606 - protein, 27 aa, Staphylococcus aureus
NHVKAMRWPFQYNIGLKTNDKYVSLIN

SEQ ID NO: 1713607 - protein, 17 aa, Staphylococcus aureus
NYLKTLENRGWDFDGSY

SEQ ID NO: 1713608 - protein, 27 aa, Staphylococcus aureus
QQIKEIIYRKLATIEVFEDIKSHIVSE

SEQ ID NO: 1713609 - protein, 18 aa, Staphylococcus aureus
SDTSEFEISYGRNLDITY

SEQ ID NO: 1713610 - protein, 17 aa, Staphylococcus aureus
VALLYSCSKQNEKAQNK

SEQ ID NO: 1713611 - protein, 24 aa, Staphylococcus aureus
VIHACVLLFIIISIALIFHRLQTK

SEQ ID NO: 1713612 - protein, 23 aa, Staphylococcus aureus
VNGKSGWVSKAYLAVPAAPKKAV

SEQ ID NO: 1713613 - protein, 17 aa, Staphylococcus aureus
VVMGVGLVNTSAEAASG

SEQ ID NO: 1713614 - protein, 20 aa, Staphylococcus aureus
WYSHIQVYGPESWGNINQLR

SEQ ID NO: 1713615 - protein, 17 aa, Staphylococcus aureus
YCKELDEKVMPKLRKNY

SEQ ID NO: 1713616 - protein, 24 aa, Staphylococcus aureus
YYQNAKKTLGIWFVVDHNRVVEVT

SEQ ID NO: 1713617 - protein, 26 aa, Staphylococcus aureus
AGESLNIIASRYGVSVDQLMAANNLR

SEQ ID NO: 1713618 - protein, 19 aa, Staphylococcus aureus
EKNFGVYFTPQLKEFIQNN

SEQ ID NO: 1713619 - protein, 25 aa, Staphylococcus aureus
FNEKLTYRTASDVVINNAQPEVTLT

SEQ ID NO: 1713620 - protein, 23 aa, Staphylococcus aureus
FQFTGLTPREMIYFGQTQGRSPQ

SEQ ID NO: 1713621 - protein, 18 aa, Staphylococcus aureus
FSNSTLWQKDNGTIHATL

SEQ ID NO: 1713622 - protein, 18 aa, Staphylococcus aureus
GALAVASSLFTWDNKADA

SEQ ID NO: 1713623 - protein, 17 aa, Staphylococcus aureus
GLTIGKDKGYEWNPQPI

SEQ ID NO: 1713624 - protein, 21 aa, Staphylococcus aureus
HATLLQFSWYSHIQVYGPESW

SEQ ID NO: 1713625 - protein, 19 aa, Staphylococcus aureus
KGNVCGMMPHPERALETLL

SEQ ID NO: 1713626 - protein, 23 aa, Staphylococcus aureus
KNNRFVEKVSIEKAIVRHDERVK

SEQ ID NO: 1713627 - protein, 23 aa, Staphylococcus aureus
KRGPSLYSIIPMIEMMFGVHFIK

SEQ ID NO: 1713628 - protein, 18 aa, Staphylococcus aureus
KTVKINLPEHVTKAQPSE

SEQ ID NO: 1713629 - protein, 17 aa, Staphylococcus aureus
KVVKGVKKYFSFSQSNG

SEQ ID NO: 1713630 - protein, 25 aa, Staphylococcus aureus
NKAYDYKYFYSYKVVKGVKKYFSFS

SEQ ID NO: 1713631 - protein, 19 aa, Staphylococcus aureus
NNWHVHWSVIANDLKYGGE

SEQ ID NO: 1713632 - protein, 25 aa, Staphylococcus aureus
NRNDELLFYRNTRIATVENPELSFA

SEQ ID NO: 1713633 - protein, 27 aa, Staphylococcus aureus
NTPVFSHQNLYTWGQCTYHVFNRRAEI

SEQ ID NO: 1713634 - protein, 25 aa, Staphylococcus aureus
NVLNCKPDFWKTLKYKKDKVTYYVY

SEQ ID NO: 1713635 - protein, 19 aa, Staphylococcus aureus
NYDTLLLGIEMSRKTLYSR

SEQ ID NO: 1713636 - protein, 17 aa, Staphylococcus aureus
QFTENYDTLLLGIEMSR

SEQ ID NO: 1713637 - protein, 18 aa, Staphylococcus aureus
QKLSTITLLMAGVITLNG

SEQ ID NO: 1713638 - protein, 21 aa, Staphylococcus aureus
RGNFNPEFISVLSHKQNDTKK

SEQ ID NO: 1713639 - protein, 24 aa, Staphylococcus aureus
RIIHSELLRFAGIGESKVETILID

SEQ ID NO: 1713640 - protein, 17 aa, Staphylococcus aureus
SAHLPSVRGTMIDVTFK

SEQ ID NO: 1713641 - protein, 17 aa, Staphylococcus aureus
SRNDVAFVYPKGQSEPI

SEQ ID NO: 1713642 - protein, 18 aa, Staphylococcus aureus
SSLFVATLTTATLVSSPA

SEQ ID NO: 1713643 - protein, 28 aa, Staphylococcus aureus
VIIVLIGALGFAIYAAINHSTSSSNNQE

SEQ ID NO: 1713644 - protein, 25 aa, Staphylococcus aureus
VNKLRDGYLLSDKKYKDWTEHNQDQ

SEQ ID NO: 1713645 - protein, 25 aa, Staphylococcus aureus
VSEVVKSSFGYHIIKADKPTDFNSE

SEQ ID NO: 1713646 - protein, 24 aa, Staphylococcus aureus
VTTEKDNGIAVLEQDVITPTVKPQ

SEQ ID NO: 1713647 - protein, 19 aa, Staphylococcus aureus
VYGPESWGNINQLRNKSVD

SEQ ID NO: 1713648 - protein, 17 aa, Staphylococcus aureus
WGPYGRDSYDPTYGNEL

SEQ ID NO: 1713649 - protein, 20 aa, Staphylococcus aureus
YGDGDGRTFTSLSGANDVVA

SEQ ID NO: 1713650 - protein, 18 aa, Staphylococcus aureus
ATEKEWRENDGLVSVISS

SEQ ID NO: 1713651 - protein, 17 aa, Staphylococcus aureus
ATLALGILTTGVFTAES

SEQ ID NO: 1713652 - protein, 19 aa, Staphylococcus aureus
DGQRLIVTYEVDWKNKTVK

SEQ ID NO: 1713653 - protein, 32 aa, Staphylococcus aureus; identical to SEQ ID NO: 1582192

SEQ ID NO: 1713654 - protein, 25 aa, Staphylococcus aureus
EFEETSALPGRKSGSLVGISQIDSS

SEQ ID NO: 1713655 - protein, 25 aa, Staphylococcus aureus
ENVRNFLKQNIEDIHFANDDQPNNP

SEQ ID NO: 1713656 - protein, 18 aa, Staphylococcus aureus
FPAVHYSMGGLYVDYDQM

SEQ ID NO: 1713657 - protein, 25 aa, Staphylococcus aureus
GNDNIKVILPKVQVKPAARQSVGVK

SEQ ID NO: 1713658 - protein, 17 aa, Staphylococcus aureus
IALSLIFSLSVTPIANA

SEQ ID NO: 1713659 - protein, 17 aa, Staphylococcus aureus
IKGGRVDYGAAHAAKYG

SEQ ID NO: 1713660 - protein, 18 aa, Staphylococcus aureus
ISLLLGILATGVNTTTEK

SEQ ID NO: 1713661 - protein, 26 aa, Staphylococcus aureus
ITDVDLRLSKQAKYTVNFKNGTKKVI

SEQ ID NO: 1713662 - protein, 26 aa, Staphylococcus aureus
KAKYKDAWPLKASVVNFRADHTRIYA

SEQ ID NO: 1713663 - protein, 18 aa, Staphylococcus aureus
KDGFSIDEFFFIQKEEVS

SEQ ID NO: 1713664 - protein, 26 aa, Staphylococcus aureus
KGDGLNAINPIAPVTVVKQAARDAVS

SEQ ID NO: 1713665 - protein, 24 aa, Staphylococcus aureus
KIGSEYNGAVYFTPQIKDFIQKHI

SEQ ID NO: 1713666 - protein, 23 aa, Staphylococcus aureus
KLNISQILTFNFIKDKSYDKDTL

SEQ ID NO: 1713667 - protein, 20 aa, Staphylococcus aureus
KRSVKSYMLEQGIRLSRAKR

SEQ ID NO: 1713668 - protein, 20 aa, Staphylococcus aureus
KSAHDRYLFVQSPNGPTGSA

SEQ ID NO: 1713669 - protein, 18 aa, Staphylococcus aureus
KSGSLVGISQIDSSHLTE

SEQ ID NO: 1713670 - protein, 17 aa, Staphylococcus aureus
KSVKWGVKANEFVTPDG

SEQ ID NO: 1713671 - protein, 20 aa, Staphylococcus aureus
PSVLAHYWGGNKMNIRQDLE

SEQ ID NO: 1713672 - protein, 21 aa, Staphylococcus aureus
QKANELRAKINQDKEATAEER

SEQ ID NO: 1713673 - protein, 18 aa, Staphylococcus aureus
SMAALAILTSVTGINAAV

SEQ ID NO: 1713674 - protein, 27 aa, Staphylococcus aureus
SWSAHISLWGAESWGNINQLKDRYVDV

SEQ ID NO: 1713675 - protein, 23 aa, Staphylococcus aureus
TKDEVLPALAYFTFSPKNYEDKS

SEQ ID NO: 1713676 - protein, 18 aa, Staphylococcus aureus
VLEYSFADYLAALDMKPV

SEQ ID NO: 1713677 - protein, 21 aa, Staphylococcus aureus
VPYTGAYGVVLLEGISQMMPM

SEQ ID NO: 1713678 - protein, 26 aa, Staphylococcus aureus
WGGVPNEFNGAVFINENVRNFLKQNI

SEQ ID NO: 1713679 - protein, 25 aa, Staphylococcus aureus
YNLDLRSKLKFKYMGEVIESKQIKD

SEQ ID NO: 1713680 - protein, 24 aa, Staphylococcus aureus
YRYSKGGKHYLIFDKNRKFTRVQI

SEQ ID NO: 1713681 - protein, 35 aa, Staphylococcus aureus
YTSGQCTYYVFDRVGGKIGSTWGNASNWANAAASS

SEQ ID NO: 1713682 - protein, 21 aa, Staphylococcus aureus
ARAGIEDIIIVTGRHKRAIED

SEQ ID NO: 1713683 - protein, 22 aa, Staphylococcus aureus
EREHRRKGSIFMDFRNELKNLN

SEQ ID NO: 1713684 - protein, 24 aa, Staphylococcus aureus
FNDLKRRAQTILDENRNNVPLNKR

SEQ ID NO: 1713685 - protein, 18 aa, Staphylococcus aureus
IAQYRSRLFVAVRNRIMK

SEQ ID NO: 1713686 - protein, 18 aa, Staphylococcus aureus
IDLDELYDELQIAEFNDK

SEQ ID NO: 1713687 - protein, 25 aa, Staphylococcus aureus
MPSNTEILYELGLGKYIVGVSTVDD

SEQ ID NO: 1713688 - protein, 18 aa, Staphylococcus aureus
MTKAIQFADIYLMALPTK

SEQ ID NO: 1713689 - protein, 18 aa, Staphylococcus aureus
PAYDEFKNSPKVNVSNLT

SEQ ID NO: 1713690 - protein, 17 aa, Staphylococcus aureus
VLLFCYSQNHIATADVG

SEQ ID NO: 1713691 - protein, 24 aa, Staphylococcus aureus
AERRTSGDYDLMFNQTWGLLYDPQ

SEQ ID NO: 1713692 - protein, 26 aa, Staphylococcus aureus
GHTFATSLPAKFVVKDVQPAKPTVTE

SEQ ID NO: 1713693 - protein, 24 aa, Staphylococcus aureus
GLTALTILTSLGFAENISNQPHSI

SEQ ID NO: 1713694 - protein, 17 aa, Staphylococcus aureus
KIRPKAYIASWKDIEPA

SEQ ID NO: 1713695 - protein, 24 aa, Staphylococcus aureus
LVTPDHIVRAAARDAVKQQYEAKK

SEQ ID NO: 1713696 - protein, 18 aa, Staphylococcus aureus
NFKDCKDALYQAAKDLYD

SEQ ID NO: 1713697 - protein, 26 aa, Staphylococcus aureus
TSRIIGHDAREEWRKNDGVVPVISSL

SEQ ID NO: 1713698 - protein, 17 aa, Staphylococcus aureus
AKPDLILAHESQKATAN

SEQ ID NO: 1713699 - protein, 22 aa, Staphylococcus aureus
DEKNKRLKQRQLYPGAPKGQFK

SEQ ID NO: 1713700 - protein, 28 aa, Staphylococcus aureus
EVLFPDKSLKLSYKVNVANIDTPKNIDF

SEQ ID NO: 1713701 - protein, 21 aa, Staphylococcus aureus
GDPHALKAFPSAINQDNYPNG

SEQ ID NO: 1713702 - protein, 20 aa, Staphylococcus aureus
GIYKDWKPGQKVHLVGHSMG

SEQ ID NO: 1713703 - protein, 18 aa, Staphylococcus aureus
KSKPVVEPMAPKKQQETK

SEQ ID NO: 1713704 - protein, 22 aa, Staphylococcus aureus
LKELLSPTLAKFIVTTAEEHDY

SEQ ID NO: 1713705 - protein, 18 aa, Staphylococcus aureus
LKLYPTKNLDDFYDKEGF

SEQ ID NO: 1713706 - protein, 21 aa, Staphylococcus aureus
LKVLSAPSLDYGLIGFVSHDY

SEQ ID NO: 1713707 - protein, 28 aa, Staphylococcus aureus
LPYAELALGAGMAFLIRRFTKKDQQTEE

SEQ ID NO: 1713708 - protein, 18 aa, Staphylococcus aureus
NEANKFGSNNKVYNDYSI

SEQ ID NO: 1713709 - protein, 20 aa, Staphylococcus aureus
NGNLWAKDNFTPKDKMPVTV

SEQ ID NO: 1713710 - protein, 27 aa, Staphylococcus aureus
NNPAEQGRFLKFFVDAGLIKIKKGVKI

SEQ ID NO: 1713711 - protein, 18 aa, Staphylococcus aureus
REHVREAQKLVDNYKDTH

SEQ ID NO: 1713712 - protein, 18 aa, Staphylococcus aureus
TKNLDDFYDKEGFRDQEF

SEQ ID NO: 1713713 - protein, 18 aa, Staphylococcus aureus
TMNVPVDYYVRVNMKAFV

SEQ ID NO: 1713714 - protein, 23 aa, Staphylococcus aureus
TNSKQGATNLVIKDAKKNTELAT

SEQ ID NO: 1713715 - protein, 18 aa, Staphylococcus aureus
VFAVPELVDLDGRIFSVS

SEQ ID NO: 1713716 - protein, 24 aa, Staphylococcus aureus
VPTDADRLDLQFIPDNTAVADASR

SEQ ID NO: 1713717 - protein, 17 aa, Staphylococcus aureus
VQLVKFDDYWQGKPALD

SEQ ID NO: 1713718 - protein, 24 aa, Staphylococcus aureus
VTVSEGFNPEFLAVMSHDKKDKGK

SEQ ID NO: 1713719 - protein, 22 aa, Staphylococcus aureus
VVLLEGISQMMPMIKETPFNDK

SEQ ID NO: 1713720 - protein, 20 aa, Staphylococcus aureus
WKPGQKVHLVGHSMGGQTIR

SEQ ID NO: 1713721 - protein, 43 aa, Staphylococcus aureus
DAITDARGIYQLRDGYKYYDFVDSIGLHSGSHVYVERRTMEPT

SEQ ID NO: 1713722 - protein, 25 aa, Staphylococcus aureus
DILKNRPGIHYAPPILEKNKDGQRL

SEQ ID NO: 1713723 - protein, 17 aa, Staphylococcus aureus
ETRGMVLYINRNTRTTK

SEQ ID NO: 1713724 - protein, 21 aa, Staphylococcus aureus
GIRLSRAKRRFMYKEEAMKAL

SEQ ID NO: 1713725 - protein, 19 aa, Staphylococcus aureus
HGKFWNKWFYVRKWKHKIL

SEQ ID NO: 1713726 - protein, 28 aa, Staphylococcus aureus
HHHHGGYDPHVWLDPKINQTFAKEIKDE

SEQ ID NO: 1713727 - protein, 29 aa, Staphylococcus aureus
HHHHGGYDPHVWLDPKINQTFAKEIKDEL

SEQ ID NO: 1713728 - protein, 20 aa, Staphylococcus aureus
KEAYQPALAELAMPRPYVFV

SEQ ID NO: 1713729 - protein, 21 aa, Staphylococcus aureus
KKGETNFAFTDDRGTDSLDKD

SEQ ID NO: 1713730 - protein, 19 aa, Staphylococcus aureus
KSPYHRIVSLMPSNTEILY

SEQ ID NO: 1713731 - protein, 22 aa, Staphylococcus aureus
KVIKGKTKFANAVVKVDSELGE

SEQ ID NO: 1713732 - protein, 26 aa, Staphylococcus aureus
LKSWIDDGFMPLIYKGEMMDLSRGRA

SEQ ID NO: 1713733 - protein, 21 aa, Staphylococcus aureus
NGWCAGYTMSALLNATYNTNK

SEQ ID NO: 1713734 - protein, 18 aa, Staphylococcus aureus
PGKKVHLVGHSMGGQTIR

SEQ ID NO: 1713735 - protein, 18 aa, Staphylococcus aureus
QFNKTPKYVKYRDAGTGI

SEQ ID NO: 1713736 - protein, 24 aa, Staphylococcus aureus
QKASERKTAIEAMNDSTTEEQQAA

SEQ ID NO: 1713737 - protein, 18 aa, Staphylococcus aureus
SINTTLTFDDPAISTDEN

SEQ ID NO: 1713738 - protein, 17 aa, Staphylococcus aureus
SMKKGETNFAFTDDRGT

SEQ ID NO: 1713739 - protein, 24 aa, Staphylococcus aureus
SQALAKEKEKALAAIDQAQTNSQV

SEQ ID NO: 1713740 - protein, 18 aa, Staphylococcus aureus
TSLALGLLTTGVITTTTQ

SEQ ID NO: 1713741 - protein, 25 aa, Staphylococcus aureus
VDAVLKRFNVALSDIEAVITEKENS

SEQ ID NO: 1713742 - protein, 28 aa, Staphylococcus aureus
VEKAKAQGLEAFDNIQIDSTEKQKAIEE

SEQ ID NO: 1713743 - protein, 18 aa, Staphylococcus aureus
AAAQPAAPVAANAQTQDP

SEQ ID NO: 1713744 - protein, 25 aa, Staphylococcus aureus
AKYKDAWPLKASVVNFRADHTRIYA

SEQ ID NO: 1713745 - protein, 18 aa, Staphylococcus aureus
APADHPWRTMPRNAMTVH

SEQ ID NO: 1713746 - protein, 18 aa, Staphylococcus aureus
DGLVTKLQAALIDNQAAI

SEQ ID NO: 1713747 - protein, 30 aa, Staphylococcus aureus; identical to SEQ ID NO: 1580004

SEQ ID NO: 1713748 - protein, 28 aa, Staphylococcus aureus
EVAEAIERINAAKVSGVKAIEATTTAQD

SEQ ID NO: 1713749 - protein, 26 aa, Staphylococcus aureus
FMNVIPNRFIYKIALVGKDEKKYKDG

SEQ ID NO: 1713750 - protein, 20 aa, Staphylococcus aureus
GIRLSRAKRRFMYKEEAMKA

SEQ ID NO: 1713751 - protein, 21 aa, Staphylococcus aureus
GLRILDPNGYWNSTLRWPGSY

SEQ ID NO: 1713752 - protein, 26 aa, Staphylococcus aureus
GYYQSLKDSFNYGYKYLTDTYKSYKE

SEQ ID NO: 1713753 - protein, 41 aa, Staphylococcus aureus
ITTNKDGYKYYSFIDNVGLFSGSHLYVKNRDLAPKATNNKE

SEQ ID NO: 1713754 - protein, 17 aa, Staphylococcus aureus
LGVTGYAAGTGHQAHAA

SEQ ID NO: 1713755 - protein, 19 aa, Staphylococcus aureus
LKADQFKYEVTLPQGVTYV

SEQ ID NO: 1713756 - protein, 21 aa, Staphylococcus aureus
LKELLSPTLAKFIVTTAEEHD

SEQ ID NO: 1713757 - protein, 21 aa, Staphylococcus aureus
LKPLEQREHANVILPNNDRHQ

SEQ ID NO: 1713758 - protein, 30 aa, Staphylococcus aureus; identical to SEQ ID NO: 1670166

SEQ ID NO: 1713759 - protein, 25 aa, Staphylococcus aureus
MGGQTIRLMEEFLRNGNKEEIAYHK

SEQ ID NO: 1713760 - protein, 20 aa, Staphylococcus aureus
NKADALKAITALKLQMDEEL

SEQ ID NO: 1713761 - protein, 26 aa, Staphylococcus aureus
NNPAEQGRFLKFFVDAGLIKIKKGVK

SEQ ID NO: 1713762 - protein, 23 aa, Staphylococcus aureus
QIKPKVRRKRAALDSIEENNKNQ

SEQ ID NO: 1713763 - protein, 18 aa, Staphylococcus aureus
QMDEELKTARTNADVDAV

SEQ ID NO: 1713764 - protein, 28 aa, Staphylococcus aureus
VQPLNKYPVVFVHGFLGLVGDNAPALYP

SEQ ID NO: 1713765 - protein, 18 aa, Staphylococcus aureus
WRTMPRNAMTVHYSGMTL

SEQ ID NO: 1713766 - protein, 24 aa, Staphylococcus aureus
WVQAAKAKPVYGAKEFLKYADKKG

SEQ ID NO: 1713767 - protein, 19 aa, Staphylococcus aureus
ALYMSVLLLIIFIGGCGNM

SEQ ID NO: 1713768 - protein, 27 aa, Staphylococcus aureus
ASTDVKTNARAELLTEMQNKITEILNN

SEQ ID NO: 1713769 - protein, 20 aa, Staphylococcus aureus
DGRIHPGRIEDMVEKARKEV

SEQ ID NO: 1713770 - protein, 19 aa, Staphylococcus aureus
EAYQPALAELAMPRPYVFV

SEQ ID NO: 1713771 - protein, 25 aa, Staphylococcus aureus
EWVQAAKAKPVYGAKEFLKYADKKG

SEQ ID NO: 1713772 - protein, 18 aa, Staphylococcus aureus
GFGMPDMNAISMDTSPAF

SEQ ID NO: 1713773 - protein, 25 aa, Staphylococcus aureus
GIYKDWKPGQKVHLVGHSMGGQTIR

SEQ ID NO: 1713774 - protein, 27 aa, Staphylococcus aureus
GYYQSLKDSFNYGYKYLTDTYKSYKEK

SEQ ID NO: 1713775 - protein, 17 aa, Staphylococcus aureus
HANGQVSYGARPTQNKP

SEQ ID NO: 1713776 - protein, 24 aa, Staphylococcus aureus
IRIDGGVMAYTWPGEMLSDDSWKR

SEQ ID NO: 1713777 - protein, 19 aa, Staphylococcus aureus
KELDFKLRKQLIEKHNLYG

SEQ ID NO: 1713778 - protein, 25 aa, Staphylococcus aureus
KGIQGWKDYKELMGKVELADYRFTK

SEQ ID NO: 1713779 - protein, 19 aa, Staphylococcus aureus
KVAKEKPDLIIVYSTDKDI

SEQ ID NO: 1713780 - protein, 19 aa, Staphylococcus aureus
NGFGMPDMNAISMDTSPAF

SEQ ID NO: 1713781 - protein, 41 aa, Staphylococcus aureus; identical to SEQ ID NO: 1576530

SEQ ID NO: 1713782 - protein, 24 aa, Staphylococcus aureus
QAKGNVAALGRVNANDSTDHGNFN

SEQ ID NO: 1713783 - protein, 26 aa, Staphylococcus aureus
QLTAEEKTEALAMIKQITDQAKQGIT

SEQ ID NO: 1713784 - protein, 23 aa, Staphylococcus aureus
QNVTIPAIEAIVPQNDPDANDTN

SEQ ID NO: 1713785 - protein, 25 aa, Staphylococcus aureus
SEINSFVPSMHWIAANPKDLNDYKY

SEQ ID NO: 1713786 - protein, 23 aa, Staphylococcus aureus
SMKKGETNFAFTDDRGTDSLDKD

SEQ ID NO: 1713787 - protein, 20 aa, Staphylococcus aureus
VAAHHPKLPITMTSRSAHLP

SEQ ID NO: 1713788 - protein, 17 aa, Staphylococcus aureus
VDEILAIKLPAEATKVS

SEQ ID NO: 1713789 - protein, 18 aa, Staphylococcus aureus
VEAIKTKAINDINQTTPA

SEQ ID NO: 1713790 - protein, 17 aa, Staphylococcus aureus
VVSVLAATMFVVSSHEA

SEQ ID NO: 1713791 - protein, 20 aa, Staphylococcus aureus
ASLALGMLATGVITSNVQSV

SEQ ID NO: 1713792 - protein, 26 aa, Staphylococcus aureus
ATTAKAAALEEFDEVVQAQIDQAPLN

SEQ ID NO: 1713793 - protein, 24 aa, Staphylococcus aureus
DANVKPAAKQAIADKVQAQETAID

SEQ ID NO: 1713794 - protein, 19 aa, Staphylococcus aureus
ELVSELANPFMAIYDTDAK

SEQ ID NO: 1713795 - protein, 24 aa, Staphylococcus aureus
HKAHGGEISPLFTGGHNNMVASIT

SEQ ID NO: 1713796 - protein, 19 aa, Staphylococcus aureus
IAQYRSRLVVAVRNRIMKM

SEQ ID NO: 1713797 - protein, 25 aa, Staphylococcus aureus
IREIEPVINRKASAREQLTTLFNDK

SEQ ID NO: 1713798 - protein, 22 aa, Staphylococcus aureus
KVEKELPNTGSEGMDLPLKEFA

SEQ ID NO: 1713799 - protein, 37 aa, Staphylococcus aureus
KVNGYSLINNGKIGFVNSELRRSDMFDKNNPQNYQAK

SEQ ID NO: 1713800 - protein, 21 aa, Staphylococcus aureus
KVPTLKAERLAMINITAGANS

SEQ ID NO: 1713801 - protein, 24 aa, Staphylococcus aureus
LINEKYLIKMGKVAPWGTQSTTTP

SEQ ID NO: 1713802 - protein, 17 aa, Staphylococcus aureus
LYISFLILVISFTAGCG

SEQ ID NO: 1713803 - protein, 25 aa, Staphylococcus aureus
NFTKSIAIEYGRDGIRANAIAPGTI

SEQ ID NO: 1713804 - protein, 19 aa, Staphylococcus aureus
NGNLWAKDNFTPKNKMPVT

SEQ ID NO: 1713805 - protein, 25 aa, Staphylococcus aureus
PVVKPNAKKAIRDKATKQREIINAT

SEQ ID NO: 1713806 - protein, 18 aa, Staphylococcus aureus
QPAPKVCTPIKKEETHES

SEQ ID NO: 1713807 - protein, 23 aa, Staphylococcus aureus
TIKRIKDNILNFDAYIEPGNSGS

SEQ ID NO: 1713808 - protein, 18 aa, Staphylococcus aureus
TSLALGLLTTGAITVTTQ

SEQ ID NO: 1713809 - protein, 20 aa, Staphylococcus aureus
VGEQFFKDNFGLKVKATNVV

SEQ ID NO: 1713810 - protein, 19 aa, Staphylococcus aureus
ATEKEWRENDGLVSVISSQ

SEQ ID NO: 1713811 - protein, 24 aa, Staphylococcus aureus
EGKAFRENQKWMTPLGRLGKPEEV

SEQ ID NO: 1713812 - protein, 22 aa, Staphylococcus aureus
EKGNDIGPVRAAYEEGLNNINA

SEQ ID NO: 1713813 - protein, 21 aa, Staphylococcus aureus
EKNKRLKQRQLYPGAPKGQFK

SEQ ID NO: 1713814 - protein, 21 aa, Staphylococcus aureus
EKRSVKSYMLEQGIRLSRAKR

SEQ ID NO: 1713815 - protein, 23 aa, Staphylococcus aureus
ERRTSGDYDLMFNQTWGLLYDPQ

SEQ ID NO: 1713816 - protein, 17 aa, Staphylococcus aureus
FVPYKFLNIYGDNKVVD

SEQ ID NO: 1713817 - protein, 21 aa, Staphylococcus aureus
KKATARNEITAILNNKLQEIQ

SEQ ID NO: 1713818 - protein, 25 aa, Staphylococcus aureus
LDFKIRKLLIKKYKLYEGSADKGRI

SEQ ID NO: 1713819 - protein, 19 aa, Staphylococcus aureus
LGALCVSQIWESNRASAVV

SEQ ID NO: 1713820 - protein, 17 aa, Staphylococcus aureus
MYKTGLWEFETHTHDLH

SEQ ID NO: 1713821 - protein, 25 aa, Staphylococcus aureus
NAVTPKVVKKQAAKDEIDQLQATQT

SEQ ID NO: 1713822 - protein, 28 aa, Staphylococcus aureus
NDAKAFFSYEWKGLEIAKNLADQAKKDD

SEQ ID NO: 1713823 - protein, 25 aa, Staphylococcus aureus
NSNWLKYPSEYHVDFQVKRNRKTEI

SEQ ID NO: 1713824 - protein, 20 aa, Staphylococcus aureus
RAGIEDIIIVTGRHKRAIED

SEQ ID NO: 1713825 - protein, 22 aa, Staphylococcus aureus
TADPFSVAVEMNKDALQQQVNS

SEQ ID NO: 1713826 - protein, 21 aa, Staphylococcus aureus
VKPDSELIINFTTMQTNSKQG

SEQ ID NO: 1713827 - protein, 19 aa, Staphylococcus aureus
VNPDIDVFVVREGNGRQAD

SEQ ID NO: 1713828 - protein, 19 aa, Staphylococcus aureus
VNRNFVVRYEVNWKTHEIK

SEQ ID NO: 1713829 - protein, 19 aa, Staphylococcus aureus
VQNYRKVSNRNKADALKAI

SEQ ID NO: 1713830 - protein, 34 aa, Staphylococcus aureus
VQQLHANPVKKPAGKKELDQAAADKKTQIEQTPN

SEQ ID NO: 1713831 - protein, 22 aa, Staphylococcus aureus
AVRKIMFALNRFMGNKYSNIDL

SEQ ID NO: 1713832 - protein, 40 aa, Staphylococcus aureus
DEFKPFREVSDSMPYPHGQCTWYVYNRMKQFGTSISGDLG

SEQ ID NO: 1713833 - protein, 21 aa, Staphylococcus aureus
GNIQKGCIFFHSHNHQDQSFY

SEQ ID NO: 1713834 - protein, 20 aa, Staphylococcus aureus
IENFKFFVQYGNFKDFKDYK

SEQ ID NO: 1713835 - protein, 19 aa, Staphylococcus aureus
IENRKANGYTLYTDDKQTT

SEQ ID NO: 1713836 - protein, 24 aa, Staphylococcus aureus
KDLYQSIWKKICVNGTANALSTVL

SEQ ID NO: 1713837 - protein, 18 aa, Staphylococcus aureus
KITNPLLHEFGTKQYPDE

SEQ ID NO: 1713838 - protein, 17 aa, Staphylococcus aureus
LDFRIRQTLIKNKKLYN

SEQ ID NO: 1713839 - protein, 20 aa, Staphylococcus aureus
LPQNQKPVFSFYSEAKAYSI

SEQ ID NO: 1713840 - protein, 19 aa, Staphylococcus aureus
LQTWVWYSHIQVFGSESWG

SEQ ID NO: 1713841 - protein, 29 aa, Staphylococcus aureus
MAQRTGVSASTWAAIIARESNGQVNAYNP

SEQ ID NO: 1713842 - protein, 20 aa, Staphylococcus aureus
PMPNIPEMRQVWEPMGNASI

SEQ ID NO: 1713843 - protein, 26 aa, Staphylococcus aureus
QINPELIKSAAKPAALETQYKAAAPK

SEQ ID NO: 1713844 - protein, 21 aa, Staphylococcus aureus
RKIPINLWVNGKHKTISTDKI

SEQ ID NO: 1713845 - protein, 18 aa, Staphylococcus aureus
RNTNLNWWDYEIGTPRAL

SEQ ID NO: 1713846 - protein, 18 aa, Staphylococcus aureus
SIKINHFCVVPQINSFKV

SEQ ID NO: 1713847 - protein, 19 aa, Staphylococcus aureus
SKLAKEWMEFLKSDKAKEI

SEQ ID NO: 1713848 - protein, 18 aa, Staphylococcus aureus
SNIQIPYTITVNGTSQNI

SEQ ID NO: 1713849 - protein, 18 aa, Staphylococcus aureus
SPYHRIVSLMPSNTEILY

SEQ ID NO: 1713850 - protein, 21 aa, Staphylococcus aureus
VWYSHIQVFGSESWGNINQLR

SEQ ID NO: 1713851 - protein, 18 aa, Staphylococcus aureus
AATTLALGTLIGATVVGT

SEQ ID NO: 1713852 - protein, 24 aa, Staphylococcus aureus
DDYKNIPCNLWIDGHQTEIELTAV

SEQ ID NO: 1713853 - protein, 18 aa, Staphylococcus aureus
DFIPGYYQFHIYPVFPIP

SEQ ID NO: 1713854 - protein, 18 aa, Staphylococcus aureus
DFKLRKYLIDNYGLYGEM

SEQ ID NO: 1713855 - protein, 17 aa, Staphylococcus aureus
DGDGRTFTNLSGANDVV

SEQ ID NO: 1713856 - protein, 22 aa, Staphylococcus aureus
DGNKLYSINAGFRKYPSTKESL

SEQ ID NO: 1713857 - protein, 20 aa, Staphylococcus aureus
EIDLGDKLQFERMGDVLNSK

SEQ ID NO: 1713858 - protein, 17 aa, Staphylococcus aureus
FGSNNKVYNDYSIEEHN

SEQ ID NO: 1713859 - protein, 20 aa, Staphylococcus aureus
FKVIPPYGHNSHRMHVPSFQ

SEQ ID NO: 1713860 - protein, 20 aa, Staphylococcus aureus
GDAPVAPIYQKGVAHLTNPQ

SEQ ID NO: 1713861 - protein, 25 aa, Staphylococcus aureus
GPSFEYKKVTGYGFIEGKDRFIDFI

SEQ ID NO: 1713862 - protein, 24 aa, Staphylococcus aureus
HECSLLKHNIHLVSGHPMAGSHKS

SEQ ID NO: 1713863 - protein, 22 aa, Staphylococcus aureus
HTSVKGKVALSINNKFINFEER

SEQ ID NO: 1713864 - protein, 25 aa, Staphylococcus aureus
IDLSEKLSFDRMFDVMDSKQIKNIE

SEQ ID NO: 1713865 - protein, 23 aa, Staphylococcus aureus
KDLYQSIWKKICVNGTANALSTV

SEQ ID NO: 1713866 - protein, 23 aa, Staphylococcus aureus
KDVPYTGAYGVVLLEGISQMMPM

SEQ ID NO: 1713867 - protein, 18 aa, Staphylococcus aureus
KSKPVVEPMAPKKQPETK

SEQ ID NO: 1713868 - protein, 20 aa, Staphylococcus aureus
KTKFANAVVKVYSDLGDAQL

SEQ ID NO: 1713869 - protein, 20 aa, Staphylococcus aureus
LASLDVVRYVAAHHPKLPIT

SEQ ID NO: 1713870 - protein, 26 aa, Staphylococcus aureus
MKVYRCSYPGAGKKAADWVKKNYENT

SEQ ID NO: 1713871 - protein, 27 aa, Staphylococcus aureus
MKVYRCSYPGAGKKAAEWVKKNYENTN

SEQ ID NO: 1713872 - protein, 18 aa, Staphylococcus aureus
MQLKEVMEAMKPHIDNET

SEQ ID NO: 1713873 - protein, 18 aa, Staphylococcus aureus
NAEIAKIEAIQPATTTKD

SEQ ID NO: 1713874 - protein, 19 aa, Staphylococcus aureus
NYDTLLIGIEMSRKTLYSR

SEQ ID NO: 1713875 - protein, 18 aa, Staphylococcus aureus
QLRKRYDIPTNKAPKLLL

SEQ ID NO: 1713876 - protein, 27 aa, Staphylococcus aureus
RIIHSELLRFAGIGESKVETVLIDLID

SEQ ID NO: 1713877 - protein, 26 aa, Staphylococcus aureus
SKGIQGWKDYKELMGKVELADYRFTK

SEQ ID NO: 1713878 - protein, 17 aa, Staphylococcus aureus
SSLFVATLTTATLVSSP

SEQ ID NO: 1713879 - protein, 19 aa, Staphylococcus aureus
WKVKIDADTGAVVEKTNLV

SEQ ID NO: 1713880 - protein, 28 aa, Staphylococcus aureus
YRDNFWATADMKRLAGTTTLENEEPKGT

SEQ ID NO: 1713881 - protein, 17 aa, Staphylococcus aureus
APVAPIYQKGVAHLTNP

SEQ ID NO: 1713882 - protein, 22 aa, Staphylococcus aureus
DAPAGKGPDIFFLAHDNTGSAY

SEQ ID NO: 1713883 - protein, 23 aa, Staphylococcus aureus
DVVKSSFGYHIIKADKPTDFNSE

SEQ ID NO: 1713884 - protein, 24 aa, Staphylococcus aureus
EEKTSCLYGGVTIHDGNQLDEEKV

SEQ ID NO: 1713885 - protein, 17 aa, Staphylococcus aureus
EVGKLVVFLASDESSFI

SEQ ID NO: 1713886 - protein, 21 aa, Staphylococcus aureus
EYRAKAALKKNDFVSMADAKV

SEQ ID NO: 1713887 - protein, 27 aa, Staphylococcus aureus
FENELKAILPFHRSLRVANYDNQSYAA

SEQ ID NO: 1713888 - protein, 20 aa, Staphylococcus aureus
FIQPSIKFMNIIDGNSVNNL

SEQ ID NO: 1713889 - protein, 21 aa, Staphylococcus aureus
FTGLTPREMIYFGQTQGRSPQ

SEQ ID NO: 1713890 - protein, 18 aa, Staphylococcus aureus
GKNIDIYGLYYGNKCVGL

SEQ ID NO: 1713891 - protein, 18 aa, Staphylococcus aureus
HGKFWNKWFYVRKWKHKI

SEQ ID NO: 1713892 - protein, 19 aa, Staphylococcus aureus
IDSSEAMNGYRRGAYEDMS

SEQ ID NO: 1713893 - protein, 23 aa, Staphylococcus aureus
KDKSRPYVVTTLFSTKDNFTKDN

SEQ ID NO: 1713894 - protein, 18 aa, Staphylococcus aureus
KGNVCGMMPHPERALETL

SEQ ID NO: 1713895 - protein, 21 aa, Staphylococcus aureus
KLRRYLQEEYNIYGHNNTGKG

SEQ ID NO: 1713896 - protein, 17 aa, Staphylococcus aureus
KPYRLFLKYSDKQQTII

SEQ ID NO: 1713897 - protein, 21 aa, Staphylococcus aureus
LASLDVVRYVAAHHPKLPITM

SEQ ID NO: 1713898 - protein, 19 aa, Staphylococcus aureus
LQTWVWYTHIQVFGPESWG

SEQ ID NO: 1713899 - protein, 18 aa, Staphylococcus aureus
PILDRFNPFLKTEYSYAK

SEQ ID NO: 1713900 - protein, 24 aa, Staphylococcus aureus
PSNTEILYELGLGKYIVGVSTVDD

SEQ ID NO: 1713901 - protein, 17 aa, Staphylococcus aureus
QNINILKEDGYHFIEPG

SEQ ID NO: 1713902 - protein, 18 aa, Staphylococcus aureus
RNYLLKHKNLYEFNSSPY

SEQ ID NO: 1713903 - protein, 23 aa, Staphylococcus aureus
SLTDGTVVQAGWSNYGGGNQVTI

SEQ ID NO: 1713904 - protein, 20 aa, Staphylococcus aureus
SNFKDCKDALYQAAKDLYDE

SEQ ID NO: 1713905 - protein, 25 aa, Staphylococcus aureus
SPLGKLRAGLDLIKKPIQMQDGDIS

SEQ ID NO: 1713906 - protein, 22 aa, Staphylococcus aureus
TKANEQKALIAQTADATTEEKE

SEQ ID NO: 1713907 - protein, 28 aa, Staphylococcus aureus
VIILLIGALGFAIYAAINHSTSSNHNNE

SEQ ID NO: 1713908 - protein, 23 aa, Staphylococcus aureus
VNGKSGWISKAYLAVPAAPKKAV

SEQ ID NO: 1713909 - protein, 18 aa, Staphylococcus aureus
VQNYRKVSDRNKADALKA

SEQ ID NO: 1713910 - protein, 17 aa, Staphylococcus aureus
VSLVLGILATGVNTVTE

SEQ ID NO: 1713911 - protein, 20 aa, Staphylococcus aureus
WYTHIQVFGPESWGNINQLR

SEQ ID NO: 1713912 - protein, 23 aa, Staphylococcus aureus
YKDREKMYYFAYEIKDGKAEINR

SEQ ID NO: 1713913 - protein, 17 aa, Staphylococcus aureus
YNLDPKLWYFAAGSTTT

SEQ ID NO: 1713914 - protein, 24 aa, Staphylococcus aureus
YRYSKGGKHYLIFDKNRKFTRIQI

SEQ ID NO: 1713915 - protein, 36 aa, Staphylococcus aureus
YTSGQCTYYVFDRVGGKIGSTWGNASNWASAAASSG

SEQ ID NO: 1713916 - protein, 18 aa, Staphylococcus aureus
DANDAWKKLTDKLKEKQI

SEQ ID NO: 1713917 - protein, 32 aa, Staphylococcus aureus
DTNVFPYHGVVAFKDATGFVIGKNTIITNKHV

SEQ ID NO: 1713918 - protein, 19 aa, Staphylococcus aureus
DVAKGKYYAGLSYEQDART

SEQ ID NO: 1713919 - protein, 19 aa, Staphylococcus aureus
ELDFRVRQTLIKNKKLYNG

SEQ ID NO: 1713920 - protein, 23 aa, Staphylococcus aureus
ESINTGKVLYAFYQKPELVKTAI

SEQ ID NO: 1713921 - protein, 17 aa, Staphylococcus aureus
FGASLKADQFKYEVTLP

SEQ ID NO: 1713922 - protein, 19 aa, Staphylococcus aureus
GKNIDIYGLYFGNKCVGLT

SEQ ID NO: 1713923 - protein, 23 aa, Staphylococcus aureus
GNFKEMKNINALRHGKNNLRFKY

SEQ ID NO: 1713924 - protein, 19 aa, Staphylococcus aureus
HKGVGWKVEAHLINNMGHD

SEQ ID NO: 1713925 - protein, 18 aa, Staphylococcus aureus
IDLKSGIYTADLINTSDI

SEQ ID NO: 1713926 - protein, 17 aa, Staphylococcus aureus
ISASPIFKSNNNSELSK

SEQ ID NO: 1713927 - protein, 18 aa, Staphylococcus aureus
ISKFKGKKLDIFGIDYNG

SEQ ID NO: 1713928 - protein, 17 aa, Staphylococcus aureus
ITRIASSNAQMWKDITL

SEQ ID NO: 1713929 - protein, 19 aa, Staphylococcus aureus
KANELRAQINQDKEATAEE

SEQ ID NO: 1713930 - protein, 25 aa, Staphylococcus aureus
KANGKARTGWLIVDYAGYPWPGYDD

SEQ ID NO: 1713931 - protein, 25 aa, Staphylococcus aureus
KDGRIKISLKDGSFYNLDLRTKLKF

SEQ ID NO: 1713932 - protein, 18 aa, Staphylococcus aureus
KKGFTHYTLQPSVDGVHA

SEQ ID NO: 1713933 - protein, 26 aa, Staphylococcus aureus
KKGMKQARKGVGYKAAIEVHTTLFSR

SEQ ID NO: 1713934 - protein, 22 aa, Staphylococcus aureus
KNNRFVEKVSIEKAIVRHDERV

SEQ ID NO: 1713935 - protein, 17 aa, Staphylococcus aureus
KNVRSVFGFVSNPSLQV

SEQ ID NO: 1713936 - protein, 24 aa, Staphylococcus aureus
KRGPSLYSIIPMIEMMFGVHFIKG

SEQ ID NO: 1713937 - protein, 24 aa, Staphylococcus aureus
KVPMKIFPAVHYSMGGLYVDYDQM

SEQ ID NO: 1713938 - protein, 20 aa, Staphylococcus aureus
LNPYYKRMIMMNQYRAKAAL

SEQ ID NO: 1713939 - protein, 18 aa, Staphylococcus aureus
NFTWLDGKSAEFKDLKVE

SEQ ID NO: 1713940 - protein, 17 aa, Staphylococcus aureus
NGMHAGHAMAVVGNAKL

SEQ ID NO: 1713941 - protein, 17 aa, Staphylococcus aureus
NGPCKSKYMYGGATLSG

SEQ ID NO: 1713942 - protein, 20 aa, Staphylococcus aureus
PPVEGRGVINSRQFLSHDLI

SEQ ID NO: 1713943 - protein, 19 aa, Staphylococcus aureus
PVEGRGVINSRQFLSHDLI

SEQ ID NO: 1713944 - protein, 24 aa, Staphylococcus aureus
QPHFSLSGKWLWQKPNGSIHATLQ

SEQ ID NO: 1713945 - protein, 20 aa, Staphylococcus aureus
QTYAKFKAIATPEQLAKVKV

SEQ ID NO: 1713946 - protein, 20 aa, Staphylococcus aureus
RASKELKNVTGYRYSKGGKH

SEQ ID NO: 1713947 - protein, 25 aa, Staphylococcus aureus
RVNNVPTPRTVTFNDTLTYKTYTQD

SEQ ID NO: 1713948 - protein, 18 aa, Staphylococcus aureus
RYSTHYLLLEALREQLKI

SEQ ID NO: 1713949 - protein, 18 aa, Staphylococcus aureus
TESGRTYLWDSAKDLDNK

SEQ ID NO: 1713950 - protein, 25 aa, Staphylococcus aureus
TGIKKGWLYGYSEIDSSHFTDRDKR

SEQ ID NO: 1713951 - protein, 17 aa, Staphylococcus aureus
TKKNVRSVFGFVSNPSL

SEQ ID NO: 1713952 - protein, 17 aa, Staphylococcus aureus
VFHLSALQDMNRIPIDI

SEQ ID NO: 1713953 - protein, 18 aa, Staphylococcus aureus
VICATQLWHSNHANALVT

SEQ ID NO: 1713954 - protein, 24 aa, Staphylococcus aureus
VIRRDHVKEAQSLINDYKDTQSYE

SEQ ID NO: 1713955 - protein, 17 aa, Staphylococcus aureus
VKDLKPSKEDNKDDKKD

SEQ ID NO: 1713956 - protein, 17 aa, Staphylococcus aureus
VVMGVGIANTSAEAASG

SEQ ID NO: 1713957 - protein, 18 aa, Staphylococcus aureus
WGNASNWASAAASSGYTV

SEQ ID NO: 1713958 - protein, 23 aa, Staphylococcus aureus
YFTCLSSNHYGYWNWHIRDVAEA

SEQ ID NO: 1713959 - protein, 20 aa, Staphylococcus aureus
AEGLKLKFNETSWDSMFAGL

SEQ ID NO: 1713960 - protein, 23 aa, Staphylococcus aureus
AKDLVLKAKEKAYQDILNAQTTN

SEQ ID NO: 1713961 - protein, 19 aa, Staphylococcus aureus
ALKSRAMVLYINRNTRTAK

SEQ ID NO: 1713962 - protein, 19 aa, Staphylococcus aureus
AQEKFLQHDLLFKINGSKI

SEQ ID NO: 1713963 - protein, 18 aa, Staphylococcus aureus
ASKIKVTMKDGGYYTFEL

SEQ ID NO: 1713964 - protein, 18 aa, Staphylococcus aureus
ASLALGILTTGMITTTAQ

SEQ ID NO: 1713965 - protein, 21 aa, Staphylococcus aureus
DKGKSRFIVHYKRSMDDFKLD

SEQ ID NO: 1713966 - protein, 25 aa, Staphylococcus aureus
DVIPDAYCCVLVLRGELLDQHKAVA

SEQ ID NO: 1713967 - protein, 25 aa, Staphylococcus aureus
EEHNGNYKYVFSFKDPNVNGKYSIV

SEQ ID NO: 1713968 - protein, 22 aa, Staphylococcus aureus
EEKLSALYEVDWKTHDVKFVKV

SEQ ID NO: 1713969 - protein, 22 aa, Staphylococcus aureus
EEKLSALYEVDWKTHDVKLIKT

SEQ ID NO: 1713970 - protein, 18 aa, Staphylococcus aureus
EKFYPTKYLLIYNDNKTV

SEQ ID NO: 1713971 - protein, 24 aa, Staphylococcus aureus
ENGKARTGWLIVDYAGYPWPGYDD

SEQ ID NO: 1713972 - protein, 19 aa, Staphylococcus aureus
EQSKSAFAFSKKVDDETVQ

SEQ ID NO: 1713973 - protein, 27 aa, Staphylococcus aureus
ETDPIYKREYKHFYTPEEAQRAQENSD

SEQ ID NO: 1713974 - protein, 18 aa, Staphylococcus aureus
FIITGCDWQRASKEPSNN

SEQ ID NO: 1713975 - protein, 22 aa, Staphylococcus aureus
FKIRKQLVEKYGLYKGTTKYGK

SEQ ID NO: 1713976 - protein, 19 aa, Staphylococcus aureus
FKVIPSYGHNSHRMHVPSF

SEQ ID NO: 1713977 - protein, 17 aa, Staphylococcus aureus
FNLKTSKTPKLLFKGSG

SEQ ID NO: 1713978 - protein, 17 aa, Staphylococcus aureus
FYNCYPKNANANGSGQT

SEQ ID NO: 1713979 - protein, 21 aa, Staphylococcus aureus
GADPMTFLGLGGIGDLIVTCT

SEQ ID NO: 1713980 - protein, 17 aa, Staphylococcus aureus
GALAVASSLFTWDNKAD

SEQ ID NO: 1713981 - protein, 24 aa, Staphylococcus aureus
GFNAGKILFHLNDGSSFSYDLFDT

SEQ ID NO: 1713982 - protein, 25 aa, Staphylococcus aureus
GISDIDLRLSKQAEYTVHFKNGTKR

SEQ ID NO: 1713983 - protein, 21 aa, Staphylococcus aureus
GRLIEKTCMYGGVTEHDGNQI

SEQ ID NO: 1713984 - protein, 24 aa, Staphylococcus aureus
ICVKSCSLLFMLNGNPKPEQLNKA

SEQ ID NO: 1713985 - protein, 18 aa, Staphylococcus aureus
IENFKFFVQYGSFKGIEN

SEQ ID NO: 1713986 - protein, 25 aa, Staphylococcus aureus
IKDLYRYYSSESFEFSNISGKVENY

SEQ ID NO: 1713987 - protein, 30 aa, Staphylococcus aureus
IMAQRTGVPASTWAAIIARESNGQVNAYNP

SEQ ID NO: 1713988 - protein, 17 aa, Staphylococcus aureus
INGDIIVEKGLKPGDKL

SEQ ID NO: 1713989 - protein, 17 aa, Staphylococcus aureus
IRIKRINGDIIVEKGLK

SEQ ID NO: 1713990 - protein, 18 aa, Staphylococcus aureus
ISELPISYEENLSLHEND

SEQ ID NO: 1713991 - protein, 26 aa, Staphylococcus aureus
ITDVDLRLSKQAKFTVNFKNGTKKVI

SEQ ID NO: 1713992 - protein, 20 aa, Staphylococcus aureus
ITLKALIEASMTYSDNTANN

SEQ ID NO: 1713993 - protein, 19 aa, Staphylococcus aureus
IVICVLLVLITISQILKHF

SEQ ID NO: 1713994 - protein, 19 aa, Staphylococcus aureus
KAEKDGRDSTNQSMVESTT

SEQ ID NO: 1713995 - protein, 24 aa, Staphylococcus aureus
KDGQRFIVVYEVDWKNKTVKVVEK

SEQ ID NO: 1713996 - protein, 20 aa, Staphylococcus aureus
KETVDLPVIGIVKRDYDHSD

SEQ ID NO: 1713997 - protein, 23 aa, Staphylococcus aureus
KKVDAKHGFSINELFFIQKEEVS

SEQ ID NO: 1713998 - protein, 20 aa, Staphylococcus aureus
KNGGKYTFELHKKLQEHRMA

SEQ ID NO: 1713999 - protein, 19 aa, Staphylococcus aureus
KSDIFTRNLFSVKDIKKID

SEQ ID NO: 1714000 - protein, 23 aa, Staphylococcus aureus
KYKKGLEGQNVFVVKELIDPNGR

SEQ ID NO: 1714001 - protein, 18 aa, Staphylococcus aureus
KYKLELVKFNNWPDLMDA

SEQ ID NO: 1714002 - protein, 17 aa, Staphylococcus aureus
LAKVKVLIDQYVADGNR

SEQ ID NO: 1714003 - protein, 21 aa, Staphylococcus aureus
LDTIVSLFLKECAEYDIDFKK

SEQ ID NO: 1714004 - protein, 18 aa, Staphylococcus aureus
LFISVIILGIFIIGCDSS

SEQ ID NO: 1714005 - protein, 20 aa, Staphylococcus aureus
LKELDFKLRKHLIDKHDLYK

SEQ ID NO: 1714006 - protein, 21 aa, Staphylococcus aureus
LKNKPGIHYGQPILEQNKDGQ

SEQ ID NO: 1714007 - protein, 18 aa, Staphylococcus aureus
LRSGAMASVAPVISEVKR

SEQ ID NO: 1714008 - protein, 17 aa, Staphylococcus aureus
LSKYGVIIDDLSLPIRA

SEQ ID NO: 1714009 - protein, 17 aa, Staphylococcus aureus
LVLLIILIVGYVIMTKT

SEQ ID NO: 1714010 - protein, 28 aa, Staphylococcus aureus
MAVMLFLTGCGKSQEKATLEKDIDNLQK

SEQ ID NO: 1714011 - protein, 25 aa, Staphylococcus aureus
NASWLKYPSEYHVDFQVQRNPKTEI

SEQ ID NO: 1714012 - protein, 17 aa, Staphylococcus aureus
NHHFAVPGYHGHKVVTP

SEQ ID NO: 1714013 - protein, 24 aa, Staphylococcus aureus
NIMRLNGLNNFFIYPGQKLKVTGN

SEQ ID NO: 1714014 - protein, 24 aa, Staphylococcus aureus
NNEANKFGNGHKVYNDYSIEEHNG

SEQ ID NO: 1714015 - protein, 20 aa, Staphylococcus aureus
NNRHVHWSVVANDLKYGNEI

SEQ ID NO: 1714016 - protein, 21 aa, Staphylococcus aureus
NRNDEFLFYRNTRLSTVENPE

SEQ ID NO: 1714017 - protein, 18 aa, Staphylococcus aureus
NTTLKSWIDDGFLPLIYK

SEQ ID NO: 1714018 - protein, 18 aa, Staphylococcus aureus
PDMYKRVMDLGVHCSVVG

SEQ ID NO: 1714019 - protein, 24 aa, Staphylococcus aureus
PELIDIKGGIYSVGGITKKNVRSV

SEQ ID NO: 1714020 - protein, 20 aa, Staphylococcus aureus
PKYEDLRAYYTKPSFEFEKQ

SEQ ID NO: 1714021 - protein, 20 aa, Staphylococcus aureus
PQINSFKVIPSYGHNSHRMH

SEQ ID NO: 1714022 - protein, 19 aa, Staphylococcus aureus
QAVIKKIHEPFVIYDGITN

SEQ ID NO: 1714023 - protein, 25 aa, Staphylococcus aureus
QNAAPVARQIYPFNGNKSQALQQLP

SEQ ID NO: 1714024 - protein, 24 aa, Staphylococcus aureus
QNAAPVARQIYPFNGNKTQALQQL

SEQ ID NO: 1714025 - protein, 28 aa, Staphylococcus aureus
QSFKPSQIKGAILFGGFYNMQTVRETEF

SEQ ID NO: 1714026 - protein, 17 aa, Staphylococcus aureus
RQLWNMLVLARVITIGA

SEQ ID NO: 1714027 - protein, 25 aa, Staphylococcus aureus
RRAEIGKGISTYWWNANNWDNAAAA

SEQ ID NO: 1714028 - protein, 19 aa, Staphylococcus aureus
SDWLSTNFGVRFRYNALGD

SEQ ID NO: 1714029 - protein, 25 aa, Staphylococcus aureus
SIDNIKKVLLFLSRNTSSSGIQTEE

SEQ ID NO: 1714030 - protein, 26 aa, Staphylococcus aureus
SMDDFKLDWNKHGFWGYWSGENHVDQ

SEQ ID NO: 1714031 - protein, 18 aa, Staphylococcus aureus
SSAYPELVSELANPFMAI

SEQ ID NO: 1714032 - protein, 20 aa, Staphylococcus aureus
TKFMAASAVFTMGFLSVPTA

SEQ ID NO: 1714033 - protein, 30 aa, Staphylococcus aureus
TVIAEKSVAYGPIWRLFKVPENVSHLKIQF

SEQ ID NO: 1714034 - protein, 22 aa, Staphylococcus aureus
TYNYKYFYTYKVVKGVKKHFSF

SEQ ID NO: 1714035 - protein, 21 aa, Staphylococcus aureus
VDPKDGFSIKELFFIQKEEVS

SEQ ID NO: 1714036 - protein, 18 aa, Staphylococcus aureus
VFVVKELIDPNGRLSTVG

SEQ ID NO: 1714037 - protein, 19 aa, Staphylococcus aureus
VGDYSTPLTERVFGKDQRT

SEQ ID NO: 1714038 - protein, 18 aa, Staphylococcus aureus
VIILGIFIIGCDSSSDTA

SEQ ID NO: 1714039 - protein, 22 aa, Staphylococcus aureus
VLKEKYKLHGEYAKAYKKAVNS

SEQ ID NO: 1714040 - protein, 24 aa, Staphylococcus aureus
VTVSEGFNPEFLAVMSHDKNDKGK

SEQ ID NO: 1714041 - protein, 21 aa, Staphylococcus aureus
WYMHNNRLTVSAGDKVKAGDQ

SEQ ID NO: 1714042 - protein, 20 aa, Staphylococcus aureus
YGEGVHRHVDVFIVLEQNKY

SEQ ID NO: 1714043 - protein, 20 aa, Staphylococcus aureus
YKDLYFAGASTHPGAGVPIV

SEQ ID NO: 1714044 - protein, 18 aa, Staphylococcus aureus
YNPKEARAHWDKAKKELG

SEQ ID NO: 1714045 - protein, 27 aa, Staphylococcus aureus
YQAQGNVIALGRIRGNDTNDHGDFNGI

SEQ ID NO: 1714046 - protein, 18 aa, Staphylococcus aureus
YYQYKGLIDKTVLTTIGS

SEQ ID NO: 1714047 - protein, 19 aa, Staphylococcus aureus
ADADASAKEIARTDLGRYF

SEQ ID NO: 1714048 - protein, 23 aa, Staphylococcus aureus
AELIHWISILPVIIFNKGPRVVK

SEQ ID NO: 1714049 - protein, 24 aa, Staphylococcus aureus
AGKTFRENQKWMTPLGRLGKPEEV

SEQ ID NO: 1714050 - protein, 18 aa, Staphylococcus aureus
AKDRISVIGYPKGAQTKY

SEQ ID NO: 1714051 - protein, 27 aa, Staphylococcus aureus
AKLNNGQEVIIIWNPWDNGFMTQDAKN

SEQ ID NO: 1714052 - protein, 19 aa, Staphylococcus aureus
ALYISVMILIFAIAGCGKS

SEQ ID NO: 1714053 - protein, 23 aa, Staphylococcus aureus
APLDTLVSLFLKECAEYDIDFEK

SEQ ID NO: 1714054 - protein, 20 aa, Staphylococcus aureus
APLPIAQPLVKIPQGTIQGE

SEQ ID NO: 1714055 - protein, 21 aa, Staphylococcus aureus
ARPTEMGIFQSIIEYLKENLN

SEQ ID NO: 1714056 - protein, 18 aa, Staphylococcus aureus
ASIALGLVTTGASIVTTQ

SEQ ID NO: 1714057 - protein, 19 aa, Staphylococcus aureus
ASLALGMLATGVITSNIQS

SEQ ID NO: 1714058 - protein, 18 aa, Staphylococcus aureus
DFKLRQYLIQDFDLYKKF

SEQ ID NO: 1714059 - protein, 22 aa, Staphylococcus aureus
DGKIRITMKGGGYYTFELNKKL

SEQ ID NO: 1714060 - protein, 17 aa, Staphylococcus aureus
DKFKKALQQQGLTADKY

SEQ ID NO: 1714061 - protein, 17 aa, Staphylococcus aureus
DKNYKDWTEHNQDQIKK

SEQ ID NO: 1714062 - protein, 18 aa, Staphylococcus aureus
DVIYRKLATIEVFEDIKS

SEQ ID NO: 1714063 - protein, 24 aa, Staphylococcus aureus
DYDYEGLDVFVVREGSGKQAENIS

SEQ ID NO: 1714064 - protein, 21 aa, Staphylococcus aureus
EALNIKGMVLKLNRNTRSAKG

SEQ ID NO: 1714065 - protein, 24 aa, Staphylococcus aureus
EEKTSCLYGGVTIYDGNQLDEERV

SEQ ID NO: 1714066 - protein, 18 aa, Staphylococcus aureus
EEVAEANAAVDAAQTEGL

SEQ ID NO: 1714067 - protein, 23 aa, Staphylococcus aureus
EIEEFKFFVQYGNFKELENYKDG

SEQ ID NO: 1714068 - protein, 24 aa, Staphylococcus aureus
EIENFKFFVQYGDFKDINDYKDGD

SEQ ID NO: 1714069 - protein, 20 aa, Staphylococcus aureus
EIENFKLFSQYGEFKSLNTD

SEQ ID NO: 1714070 - protein, 23 aa, Staphylococcus aureus
EIMKSRGMYLFLNRNTRTAKGYF

SEQ ID NO: 1714071 - protein, 25 aa, Staphylococcus aureus
ERIEKAPNLKLAITAGVGSDHVDLA

SEQ ID NO: 1714072 - protein, 24 aa, Staphylococcus aureus
ESNLLKHNIHLVSGHPMAGSHKSG

SEQ ID NO: 1714073 - protein, 29 aa, Staphylococcus aureus
ESREVKYTYGYKTGGDFSINRGGLTGNIT

SEQ ID NO: 1714074 - protein, 18 aa, Staphylococcus aureus
ETLIKNKILYHENRNKGK

SEQ ID NO: 1714075 - protein, 28 aa, Staphylococcus aureus
ETMRYLKRLSWYISILILIVVIAGCGKG

SEQ ID NO: 1714076 - protein, 21 aa, Staphylococcus aureus
EVASALKAGQLAKINVSTSAI

SEQ ID NO: 1714077 - protein, 24 aa, Staphylococcus aureus
FAVPESKLGIIVPEYKEINNRVNV

SEQ ID NO: 1714078 - protein, 25 aa, Staphylococcus aureus
FDEPAYLPRFVFGHYMKSYLSMYTK

SEQ ID NO: 1714079 - protein, 28 aa, Staphylococcus aureus
FESDGTHFAWNYHATGANGADMSAQAPA

SEQ ID NO: 1714080 - protein, 18 aa, Staphylococcus aureus
FGPESWGNINQLRDKYVD

SEQ ID NO: 1714081 - protein, 17 aa, Staphylococcus aureus
FGPESWGNINQLRNKYV

SEQ ID NO: 1714082 - protein, 24 aa, Staphylococcus aureus
FIAVISVLLAFHLKQHYDQTTNEN

SEQ ID NO: 1714083 - protein, 24 aa, Staphylococcus aureus
FKKAAPKAKIVYVGADEKNLISSM

SEQ ID NO: 1714084 - protein, 23 aa, Staphylococcus aureus
FKLRKHLIEKYGLYKTLSKDGRI

SEQ ID NO: 1714085 - protein, 17 aa, Staphylococcus aureus
FLILLVVIVSSYYGESF

SEQ ID NO: 1714086 - protein, 17 aa, Staphylococcus aureus
FNKTPKYVKYRDAGTGI

SEQ ID NO: 1714087 - protein, 24 aa, Staphylococcus aureus
FSKSHGCKIVKPALNIKNVNYQYA

SEQ ID NO: 1714088 - protein, 17 aa, Staphylococcus aureus
FVLEDKGKAAEEGGYVA

SEQ ID NO: 1714089 - protein, 17 aa, Staphylococcus aureus
GDVISLVPQNKVKQTKT

SEQ ID NO: 1714090 - protein, 28 aa, Staphylococcus aureus
GDYLEKSRCIPINLWVNGNLKTISTDKV

SEQ ID NO: 1714091 - protein, 18 aa, Staphylococcus aureus
GFNPEFLTYLSNEKSNEK

SEQ ID NO: 1714092 - protein, 28 aa, Staphylococcus aureus
GLSYSGYCLKNKYIYGGVTLAGDYLEKS

SEQ ID NO: 1714093 - protein, 20 aa, Staphylococcus aureus
GNIQKGCIFFHSNNHQNQSF

SEQ ID NO: 1714094 - protein, 21 aa, Staphylococcus aureus
GNPSTWFYPLGEKKVERTTPK

SEQ ID NO: 1714095 - protein, 21 aa, Staphylococcus aureus
GPRVVKYINIFYAMIANVPII

SEQ ID NO: 1714096 - protein, 19 aa, Staphylococcus aureus
GQFLIKMGIQPEVTKDKTA

SEQ ID NO: 1714097 - protein, 18 aa, Staphylococcus aureus
GTKNSAQFEKMVILTENK

SEQ ID NO: 1714098 - protein, 33 aa, Staphylococcus aureus
HPSQSLIIKHHFAVPGYHAHKFVTPGHASIKIN

SEQ ID NO: 1714099 - protein, 27 aa, Staphylococcus aureus
HQINPELIKSAAKPAALETQYKAAAPK

SEQ ID NO: 1714100 - protein, 22 aa, Staphylococcus aureus
HTSVKGKVALSINNKFINFEES

SEQ ID NO: 1714101 - protein, 18 aa, Staphylococcus aureus
IALSLIFSLSITPIANAE

SEQ ID NO: 1714102 - protein, 25 aa, Staphylococcus aureus
IDLSEKLSFDRMFDVLDSKQIKNIE

SEQ ID NO: 1714103 - protein, 19 aa, Staphylococcus aureus
IEIIFSRSKEEAFIMLTAL

SEQ ID NO: 1714104 - protein, 24 aa, Staphylococcus aureus
IIEYLKENLNWIWNSLSIEDQHQF

SEQ ID NO: 1714105 - protein, 24 aa, Staphylococcus aureus
IIITKGPVMWGFFGHCSIAIDDKT

SEQ ID NO: 1714106 - protein, 17 aa, Staphylococcus aureus
IKEQFGRIDVLFNNAGV

SEQ ID NO: 1714107 - protein, 28 aa, Staphylococcus aureus
ITDSSKKKALNWWDYEIGTPRSLTNTLI

SEQ ID NO: 1714108 - protein, 19 aa, Staphylococcus aureus
KANENLGLNPSHEGETNPE

SEQ ID NO: 1714109 - protein, 19 aa, Staphylococcus aureus
KDFVNNVGLEITKPTGHNT

SEQ ID NO: 1714110 - protein, 18 aa, Staphylococcus aureus
KFDQTFFNSYGFANTYAF

SEQ ID NO: 1714111 - protein, 18 aa, Staphylococcus aureus
KGTWVISSVMVKQPKGEI

SEQ ID NO: 1714112 - protein, 23 aa, Staphylococcus aureus
KKKVKDALEWLHKNAYGKEPDNK

SEQ ID NO: 1714113 - protein, 18 aa, Staphylococcus aureus
KLATIEVFEDIKSHIVSE

SEQ ID NO: 1714114 - protein, 17 aa, Staphylococcus aureus
KNLEDFYDKEGFRDEEF

SEQ ID NO: 1714115 - protein, 17 aa, Staphylococcus aureus
KSISASPIFKSNNNSEL

SEQ ID NO: 1714116 - protein, 23 aa, Staphylococcus aureus
KVMSEFIKFVLEDKGKAAEEGGY

SEQ ID NO: 1714117 - protein, 18 aa, Staphylococcus aureus
KVSNRNKADALKAITALK

SEQ ID NO: 1714118 - protein, 26 aa, Staphylococcus aureus
LEELLRNGNREEIEYQKKHGGEISPL

SEQ ID NO: 1714119 - protein, 18 aa, Staphylococcus aureus
LGALCVSQIWESNHASAV

SEQ ID NO: 1714120 - protein, 19 aa, Staphylococcus aureus
LGISFLFLVISITAGCGMG

SEQ ID NO: 1714121 - protein, 26 aa, Staphylococcus aureus
LINEKYLIKMGKVAPWGTQFTTTPTT

SEQ ID NO: 1714122 - protein, 21 aa, Staphylococcus aureus
LKILNPNGYWNSTLRWPGSYS

SEQ ID NO: 1714123 - protein, 19 aa, Staphylococcus aureus
LKNVTGYRYSKGGKHYLIF

SEQ ID NO: 1714124 - protein, 29 aa, Staphylococcus aureus
LKRGQRQMELIKILFQKAQEVDSIDKLDN

SEQ ID NO: 1714125 - protein, 20 aa, Staphylococcus aureus
LKYDLARPTEMGIFQSIIEY

SEQ ID NO: 1714126 - protein, 17 aa, Staphylococcus aureus
LQEDRMADIVKVIDIDR

SEQ ID NO: 1714127 - protein, 19 aa, Staphylococcus aureus
LQMDEELKTARTNADVDAV

SEQ ID NO: 1714128 - protein, 22 aa, Staphylococcus aureus
LREGDSRQATNYSIGGVTKTNS

SEQ ID NO: 1714129 - protein, 27 aa, Staphylococcus aureus
LSYSGYCLKNKYMYGGVTLAGDYLEKS

SEQ ID NO: 1714130 - protein, 23 aa, Staphylococcus aureus
LTTEKFLDIDLLFKNFTWLDGKS

SEQ ID NO: 1714131 - protein, 17 aa, Staphylococcus aureus
LYISILILIVMVAGCGK

SEQ ID NO: 1714132 - protein, 26 aa, Staphylococcus aureus
MAIMLFLTGCGKSQEKATLEKDIDNL

SEQ ID NO: 1714133 - protein, 24 aa, Staphylococcus aureus
MDRYTNQWNRLHWIGNNYKNQNTV

SEQ ID NO: 1714134 - protein, 17 aa, Staphylococcus aureus
MKGGGYYTFELNKKLQP

SEQ ID NO: 1714135 - protein, 26 aa, Staphylococcus aureus
MKNGGKYTFELHKKLQQHRMADVIDG

SEQ ID NO: 1714136 - protein, 20 aa, Staphylococcus aureus
MKNGGYYTFELNKKLQPHRM

SEQ ID NO: 1714137 - protein, 25 aa, Staphylococcus aureus
MLNRKKEDLEFIIDKFFKKIQQERP

SEQ ID NO: 1714138 - protein, 23 aa, Staphylococcus aureus
MPTPELKTGSGIDWSDEALTDQI

SEQ ID NO: 1714139 - protein, 26 aa, Staphylococcus aureus
MTNGQLWKKVKDSLIDSNIISGNENE

SEQ ID NO: 1714140 - protein, 23 aa, Staphylococcus aureus
MVGYSEIYSSHFTDRDKRAIRRD

SEQ ID NO: 1714141 - protein, 23 aa, Staphylococcus aureus
NDLKLDYINYWIGKYRSHPYNKK

SEQ ID NO: 1714142 - protein, 24 aa, Staphylococcus aureus
NFTKSIAIEYGRDGIRSNAIAPGT

SEQ ID NO: 1714143 - protein, 26 aa, Staphylococcus aureus
NGDISVGAFFRARLGNEVLENLIEPL

SEQ ID NO: 1714144 - protein, 27 aa, Staphylococcus aureus
NHIKSMRWPFQYNIGLKTNDKYVSLIN

SEQ ID NO: 1714145 - protein, 29 aa, Staphylococcus aureus
NISPYKGIVRIGSATGFVVGKNTILTNKH

SEQ ID NO: 1714146 - protein, 18 aa, Staphylococcus aureus
NKAFYFLLRDDDYFAKVV

SEQ ID NO: 1714147 - protein, 19 aa, Staphylococcus aureus
NKMNLPIDFNQVVIGGDSA

SEQ ID NO: 1714148 - protein, 18 aa, Staphylococcus aureus
NKTVKVVEKYSDQNKPYK

SEQ ID NO: 1714149 - protein, 24 aa, Staphylococcus aureus
NLNDEYVVSPGWTKDEQAKAFEEY

SEQ ID NO: 1714150 - protein, 22 aa, Staphylococcus aureus
NPSVLAHYWGGNKMNIRQDLEE

SEQ ID NO: 1714151 - protein, 24 aa, Staphylococcus aureus
NRKKVDYKTGISITKEDKKGTISH

SEQ ID NO: 1714152 - protein, 17 aa, Staphylococcus aureus
NSKSISASPIFKSNNNS

SEQ ID NO: 1714153 - protein, 31 aa, Staphylococcus aureus
NYDRAVELYYYIKGGRVDYGAAHAAKYGHER

SEQ ID NO: 1714154 - protein, 24 aa, Staphylococcus aureus
PDSELPPLVQSGFNPSFIATVSHE

SEQ ID NO: 1714155 - protein, 20 aa, Staphylococcus aureus
PEEVAKLVVFLASDDSSFIT

SEQ ID NO: 1714156 - protein, 22 aa, Staphylococcus aureus
PNVNGKYSIVTVDYTGQAMVTD

SEQ ID NO: 1714157 - protein, 21 aa, Staphylococcus aureus
QASIRIHHFCAVPQINSFKVI

SEQ ID NO: 1714158 - protein, 17 aa, Staphylococcus aureus
QATNYSIGGVTKTNSQP

SEQ ID NO: 1714159 - protein, 24 aa, Staphylococcus aureus
QELKKYYSGTGYNFQNVSGYREKD

SEQ ID NO: 1714160 - protein, 22 aa, Staphylococcus aureus
QERPESIPALTSEKNHNQTMAL

SEQ ID NO: 1714161 - protein, 18 aa, Staphylococcus aureus
QLLKVARTKLALQPNERY

SEQ ID NO: 1714162 - protein, 19 aa, Staphylococcus aureus
QPKPGTKFLNMIEGNTVNN

SEQ ID NO: 1714163 - protein, 20 aa, Staphylococcus aureus
QTYAKFKAIATPEQLAKVKA

SEQ ID NO: 1714164 - protein, 21 aa, Staphylococcus aureus
RKIPINLWINGKHKTISTDKI

SEQ ID NO: 1714165 - protein, 21 aa, Staphylococcus aureus
RKSEALKERFINRQKSKNESV

SEQ ID NO: 1714166 - protein, 20 aa, Staphylococcus aureus
RLWLYLVLLAVFIGACGMKK

SEQ ID NO: 1714167 - protein, 22 aa, Staphylococcus aureus
RQLRYIYDVYFDRDDCITVPTD

SEQ ID NO: 1714168 - protein, 32 aa, Staphylococcus aureus
RVETNGIATLKGVQPHIVIKPEAQQAIKATAE

SEQ ID NO: 1714169 - protein, 18 aa, Staphylococcus aureus
SANLPSVRGTMIDVTFKY

SEQ ID NO: 1714170 - protein, 20 aa, Staphylococcus aureus
SLAVGLGIVAGNAGHEAQAS

SEQ ID NO: 1714171 - protein, 18 aa, Staphylococcus aureus
SMAALAILTSVTGISAAV

SEQ ID NO: 1714172 - protein, 23 aa, Staphylococcus aureus
SNRPKKRSRRAAPADPNATPADP

SEQ ID NO: 1714173 - protein, 26 aa, Staphylococcus aureus
STFGPKGRFGGLVYDTLGFNAVDKNV

SEQ ID NO: 1714174 - protein, 18 aa, Staphylococcus aureus
SVRGTMIDVTFKYLTKDK

SEQ ID NO: 1714175 - protein, 26 aa, Staphylococcus aureus
TDARNAVNDKAREAITNINATPGATR

SEQ ID NO: 1714176 - protein, 27 aa, Staphylococcus aureus
TENRVTNGIYDFVCEIDTLYAAYFNHS

SEQ ID NO: 1714177 - protein, 18 aa, Staphylococcus aureus
THANGQVSYGARPTYKKP

SEQ ID NO: 1714178 - protein, 25 aa, Staphylococcus aureus
TIRIDGGVMAYTWPGEMLSDDSWKR

SEQ ID NO: 1714179 - protein, 47 aa, Staphylococcus aureus
TKSSLEFKNELGIIIKKWTTIRFMNIVPDYFIYKIALVGKDDKKYGE

SEQ ID NO: 1714180 - protein, 17 aa, Staphylococcus aureus
TLGICLVLLIILIGGCI

SEQ ID NO: 1714181 - protein, 21 aa, Staphylococcus aureus
TMGVLCATQLWQTNNAKALVT

SEQ ID NO: 1714182 - protein, 17 aa, Staphylococcus aureus
TQFIVDEILAIKLPAEA

SEQ ID NO: 1714183 - protein, 25 aa, Staphylococcus aureus
TQPHLSFSGKWLWQNPNGTIHATLQ

SEQ ID NO: 1714184 - protein, 19 aa, Staphylococcus aureus
TRSAKGFYYVNAIKKDENG

SEQ ID NO: 1714185 - protein, 17 aa, Staphylococcus aureus
TSLINFLPIQSLLSALK

SEQ ID NO: 1714186 - protein, 17 aa, Staphylococcus aureus
TVNDLYLIVKKLSQGDV

SEQ ID NO: 1714187 - protein, 24 aa, Staphylococcus aureus
TVNRSNNGLSMVPWGTKNQVILTG

SEQ ID NO: 1714188 - protein, 17 aa, Staphylococcus aureus
TYDEFKKAPKVNVSNLA

SEQ ID NO: 1714189 - protein, 17 aa, Staphylococcus aureus
VAKEKPDLIIVYSTDKD

SEQ ID NO: 1714190 - protein, 22 aa, Staphylococcus aureus
VEELYSELDLIVGEVQDKSDKK

SEQ ID NO: 1714191 - protein, 18 aa, Staphylococcus aureus
VGYKEIEIIFSRSKEEAF

SEQ ID NO: 1714192 - protein, 20 aa, Staphylococcus aureus
VKDDQRAGVDANYYAKQTYD

SEQ ID NO: 1714193 - protein, 19 aa, Staphylococcus aureus
VKKHFSFSKSHGCKIVKPA

SEQ ID NO: 1714194 - protein, 35 aa, Staphylococcus aureus
VSTTEKFLDFDLLFKSINWLDGISAEFKDLKVEFS

SEQ ID NO: 1714195 - protein, 19 aa, Staphylococcus aureus
VVAVMFLLAACGNNSDKEQ

SEQ ID NO: 1714196 - protein, 19 aa, Staphylococcus aureus
WFSHIQVFGPESWGNINQL

SEQ ID NO: 1714197 - protein, 24 aa, Staphylococcus aureus
WNSTLRWPGSYSVSIQNVDDNNNS

SEQ ID NO: 1714198 - protein, 26 aa, Staphylococcus aureus
WSAHIRLWGAESWGNVNQLRDRYVDV

SEQ ID NO: 1714199 - protein, 31 aa, Staphylococcus aureus
YDTPIPDWYLGSILNRLGDQIYYAKELTNKY

SEQ ID NO: 1714200 - protein, 18 aa, Staphylococcus aureus
YGSPKIKNITLKFNGDPN

SEQ ID NO: 1714201 - protein, 24 aa, Staphylococcus aureus
YNLDLRTKLKFKHMGEVIDSKQIK

SEQ ID NO: 1714202 - protein, 25 aa, Staphylococcus aureus
YQKKHGGEISPLFKGNNDNMISSIT

SEQ ID NO: 1714203 - protein, 19 aa, Staphylococcus aureus
YTFELHKKLQEHRMADVID

SEQ ID NO: 1714204 - protein, 18 aa, Staphylococcus aureus
YYGKYTIELDKKLQEDRM

SEQ ID NO: 1714205 - protein, 24 aa, Staphylococcus aureus
YYTQLPLTFSNRWLYQYDDGNIYV

SEQ ID NO: 1714206 - protein, 30 aa, Staphylococcus aureus
ALDSIALVAPEHIVRAAARDAVKQQYEAKK

SEQ ID NO: 1714207 - protein, 40 aa, Staphylococcus aureus
DEFKPFREVSDNMPYPHGQCTWYVYNRMKQFGTSISGDLG

SEQ ID NO: 1714208 - protein, 21 aa, Staphylococcus aureus
DGNQLYSINAGFRKYPSTKES

SEQ ID NO: 1714209 - protein, 19 aa, Staphylococcus aureus
DGTNVQWSNGAGAGANKPL

SEQ ID NO: 1714210 - protein, 17 aa, Staphylococcus aureus
DHVKEAQNLINDYKYTQ

SEQ ID NO: 1714211 - protein, 24 aa, Staphylococcus aureus
DITRIASSNAQMWKDITLSNKTYI

SEQ ID NO: 1714212 - protein, 23 aa, Staphylococcus aureus
DLERVKNEEIFKIENITDSTQTK

SEQ ID NO: 1714213 - protein, 26 aa, Staphylococcus aureus
DLSLPIRAGYSLEIKVPLNAIKIPKS

SEQ ID NO: 1714214 - protein, 20 aa, Staphylococcus aureus
DPHALKAFPSAINQDNYPNG

SEQ ID NO: 1714215 - protein, 17 aa, Staphylococcus aureus
DPNGRLSTVGGVTKKNN

SEQ ID NO: 1714216 - protein, 25 aa, Staphylococcus aureus
DTNDFPITWFYPLGEKKVERTTPKL

SEQ ID NO: 1714217 - protein, 19 aa, Staphylococcus aureus
DVKFLRIVNENDFKAEFTD

SEQ ID NO: 1714218 - protein, 23 aa, Staphylococcus aureus
EIEDFKFFVQYGDFKDINDYKDG

SEQ ID NO: 1714219 - protein, 21 aa, Staphylococcus aureus
EIENFKFFVQYGDFKDLSKYK

SEQ ID NO: 1714220 - protein, 21 aa, Staphylococcus aureus
EIENFKFFVQYGNFKDLSKYK

SEQ ID NO: 1714221 - protein, 21 aa, Staphylococcus aureus
EIVKGPEYLTMENKTLQGEIV

SEQ ID NO: 1714222 - protein, 20 aa, Staphylococcus aureus
EKKKFTAPIKTFAPKSDEIL

SEQ ID NO: 1714223 - protein, 20 aa, Staphylococcus aureus
ELVSELANPFMAIYYTDAKS

SEQ ID NO: 1714224 - protein, 25 aa, Staphylococcus aureus
ERGISDLDLKFAKQAKYTVYFKNGK

SEQ ID NO: 1714225 - protein, 17 aa, Staphylococcus aureus
ERTVYKVYFKDGSSKFV

SEQ ID NO: 1714226 - protein, 26 aa, Staphylococcus aureus
FNTTPKYIKFRHDYNIVEYNDGTFEY

SEQ ID NO: 1714227 - protein, 25 aa, Staphylococcus aureus
GNNNIKVILPKVQVKPAARQSVSAK

SEQ ID NO: 1714228 - protein, 19 aa, Staphylococcus aureus
GQFLIKMGIQPEVTKDKTT

SEQ ID NO: 1714229 - protein, 25 aa, Staphylococcus aureus
HNKGLDFAFGLSMTSKNVARYESIN

SEQ ID NO: 1714230 - protein, 18 aa, Staphylococcus aureus
IENFKFFAQYGNFKDLTK

SEQ ID NO: 1714231 - protein, 19 aa, Staphylococcus aureus
IENRKANDYKLYKDDTQTT

SEQ ID NO: 1714232 - protein, 24 aa, Staphylococcus aureus
IPKEYKKPVELMMNYFKALNSTIA

SEQ ID NO: 1714233 - protein, 26 aa, Staphylococcus aureus
ISDIDLRLSKQAKYTVHFKNGTKRVV

SEQ ID NO: 1714234 - protein, 18 aa, Staphylococcus aureus
KANDYKLYKDDTQTTNSD

SEQ ID NO: 1714235 - protein, 18 aa, Staphylococcus aureus
KKFKNRAVDVYGLSYSGY

SEQ ID NO: 1714236 - protein, 20 aa, Staphylococcus aureus
KKGGNLKPLEQREHANVILP

SEQ ID NO: 1714237 - protein, 20 aa, Staphylococcus aureus
KKNPKRIVVLEYSFADYLAA

SEQ ID NO: 1714238 - protein, 19 aa, Staphylococcus aureus
KLKKTWLDVNYGYDQYDEN

SEQ ID NO: 1714239 - protein, 19 aa, Staphylococcus aureus
KLRNIWLDVNYGYDKYDEN

SEQ ID NO: 1714240 - protein, 20 aa, Staphylococcus aureus
KNGGKRVIHLNSNIYTANLV

SEQ ID NO: 1714241 - protein, 20 aa, Staphylococcus aureus
KNPKLLFKGAGNIKGSSVGY

SEQ ID NO: 1714242 - protein, 18 aa, Staphylococcus aureus
KNPYVSKALELKDKSNKS

SEQ ID NO: 1714243 - protein, 18 aa, Staphylococcus aureus
KPELVAIAEEASNRPKKR

SEQ ID NO: 1714244 - protein, 19 aa, Staphylococcus aureus
KTPKPLAGLNGESHDFTTT

SEQ ID NO: 1714245 - protein, 18 aa, Staphylococcus aureus
KTRYKQIVKTSVNSDSSY

SEQ ID NO: 1714246 - protein, 24 aa, Staphylococcus aureus
KVGSEYNGAVYFTPQIKDFIQKHI

SEQ ID NO: 1714247 - protein, 22 aa, Staphylococcus aureus
KVIDLKAGIYTANLINTGDIKN

SEQ ID NO: 1714248 - protein, 21 aa, Staphylococcus aureus
LEIKVPLNAIKIPKSVLTKGN

SEQ ID NO: 1714249 - protein, 18 aa, Staphylococcus aureus
LKHAKKAYYTVYFKNGGK

SEQ ID NO: 1714250 - protein, 19 aa, Staphylococcus aureus
LNAKLRLALASDQGITKHD

SEQ ID NO: 1714251 - protein, 19 aa, Staphylococcus aureus
LRDDVKFHDGTTFDADAVK

SEQ ID NO: 1714252 - protein, 20 aa, Staphylococcus aureus
LRRYLQEEYNIYGHNNNGKG

SEQ ID NO: 1714253 - protein, 23 aa, Staphylococcus aureus
LYPGLSKDVFKSKASKVTVVKQE

SEQ ID NO: 1714254 - protein, 18 aa, Staphylococcus aureus
METRGMVLYINRNTRTTK

SEQ ID NO: 1714255 - protein, 23 aa, Staphylococcus aureus
NERIRKEMMDDLNSIIDDFFMDT

SEQ ID NO: 1714256 - protein, 17 aa, Staphylococcus aureus
NEVKASIAPVVAVLVGF

SEQ ID NO: 1714257 - protein, 26 aa, Staphylococcus aureus
NIPNGYKYYSLYDEKNRWMGYFNSND

SEQ ID NO: 1714258 - protein, 18 aa, Staphylococcus aureus
NKWLKSRGIIASESMAED

SEQ ID NO: 1714259 - protein, 17 aa, Staphylococcus aureus
NNIGYHFLNESKITVKK

SEQ ID NO: 1714260 - protein, 39 aa, Staphylococcus aureus
NSALEQLKAQRINPVVKKNALEAIREVVNKQIEIIKNAD

SEQ ID NO: 1714261 - protein, 20 aa, Staphylococcus aureus
NYYYQCYFSADNMELNDGRL

SEQ ID NO: 1714262 - protein, 20 aa, Staphylococcus aureus
PIDDKGYFNFDFKTKRFDNL

SEQ ID NO: 1714263 - protein, 18 aa, Staphylococcus aureus
PSQSRTKVSPSLNKSDQT

SEQ ID NO: 1714264 - protein, 24 aa, Staphylococcus aureus
QIKPKVRRKRAALDNIDESNNNQL

SEQ ID NO: 1714265 - protein, 24 aa, Staphylococcus aureus
QKKHGGEISPLFKGNNDNMISSIT

SEQ ID NO: 1714266 - protein, 22 aa, Staphylococcus aureus
QMKSGVRFFDIRGRASADNMIS

SEQ ID NO: 1714267 - protein, 18 aa, Staphylococcus aureus
RASHAVLMYAPKSFLDFQ

SEQ ID NO: 1714268 - protein, 39 aa, Staphylococcus aureus; identical to SEQ ID NO: 1662196

SEQ ID NO: 1714269 - protein, 19 aa, Staphylococcus aureus
SGFNPEFLTYLSNEKSNEK

SEQ ID NO: 1714270 - protein, 24 aa, Staphylococcus aureus
SGFRNEYYYLTAIPYTLDEYKRYF

SEQ ID NO: 1714271 - protein, 17 aa, Staphylococcus aureus
SKESFGITEGVKSVSMH

SEQ ID NO: 1714272 - protein, 26 aa, Staphylococcus aureus
SNWIDEGFMPLIYKGEMMDLSRGRAI

SEQ ID NO: 1714273 - protein, 20 aa, Staphylococcus aureus
SRAAEPRSVSDYQNANSSYY

SEQ ID NO: 1714274 - protein, 26 aa, Staphylococcus aureus
SSNAKLPVIFWMHGGGYIAGDKQYKN

SEQ ID NO: 1714275 - protein, 25 aa, Staphylococcus aureus
SVENRKANGYKLFKDDIEITTSDVN

SEQ ID NO: 1714276 - protein, 26 aa, Staphylococcus aureus
TEINPKFKDLRAYYTKPSLEFKNEIG

SEQ ID NO: 1714277 - protein, 28 aa, Staphylococcus aureus
TKMDAYKEVRQAATARKAQNATVSNATD

SEQ ID NO: 1714278 - protein, 22 aa, Staphylococcus aureus
TKVKDALEWLHKNAYGKEPDKK

SEQ ID NO: 1714279 - protein, 24 aa, Staphylococcus aureus
TMNVPVDYYVRVNMKAFVEAVNEL

SEQ ID NO: 1714280 - protein, 31 aa, Staphylococcus aureus
TNNFPYNGVVSFKDATGFVIGKNTIITNKHV

SEQ ID NO: 1714281 - protein, 27 aa, Staphylococcus aureus
TNNQLRKAMKFDQSFKPSQIKGAILFG

SEQ ID NO: 1714282 - protein, 17 aa, Staphylococcus aureus
TQDLFMNDYLRVYTNDD

SEQ ID NO: 1714283 - protein, 22 aa, Staphylococcus aureus
VADTKAKVLDKINAIQTQAKVK

SEQ ID NO: 1714284 - protein, 25 aa, Staphylococcus aureus
VDVKSWGEKTFYHFDVPDEHDTEIS

SEQ ID NO: 1714285 - protein, 18 aa, Staphylococcus aureus
VKAKGMFILTKKDDNTYE

SEQ ID NO: 1714286 - protein, 27 aa, Staphylococcus aureus
VKASIAPVVAVLVGFIAKQGLKKAIQK

SEQ ID NO: 1714287 - protein, 22 aa, Staphylococcus aureus
VKPKANQAIEAKAEDTKESIDH

SEQ ID NO: 1714288 - protein, 25 aa, Staphylococcus aureus
VNKLRDGYLLSDKNYKDWTEHNQDQ

SEQ ID NO: 1714289 - protein, 18 aa, Staphylococcus aureus
VVALVCIIALSACGKEQT

SEQ ID NO: 1714290 - protein, 22 aa, Staphylococcus aureus
VVLLEGISQMMPMIKETPFNDS

SEQ ID NO: 1714291 - protein, 17 aa, Staphylococcus aureus
VYFKDGSSKFVDLKAAK

SEQ ID NO: 1714292 - protein, 17 aa, Staphylococcus aureus
WKGASSIKNLGSKKTRS

SEQ ID NO: 1714293 - protein, 25 aa, Staphylococcus aureus
YFNFDFKTKRFDNLELKEGNDISLT

SEQ ID NO: 1714294 - protein, 26 aa, Staphylococcus aureus
YHNKDLDFAFGLSMTSKNIARYENIN

SEQ ID NO: 1714295 - protein, 28 aa, Staphylococcus aureus
YRDNFWATADMKRLAGTTTLDNEEPKST

SEQ ID NO: 1714296 - protein, 23 aa, Staphylococcus aureus
AELIHWISILPVIIFNKGSRLVK

SEQ ID NO: 1714297 - protein, 21 aa, Staphylococcus aureus
AGESLNIIANRYGVSVDQLMA

SEQ ID NO: 1714298 - protein, 27 aa, Staphylococcus aureus
AKEIARTDLGRYFDRFADKLDKTQTNT

SEQ ID NO: 1714299 - protein, 24 aa, Staphylococcus aureus
ASNRPKKRSRRAAPADPNATPADP

SEQ ID NO: 1714300 - protein, 19 aa, Staphylococcus aureus
CLVLLIILIVGYVIMTKTN

SEQ ID NO: 1714301 - protein, 19 aa, Staphylococcus aureus
DGRIHPGRIEDMVEKARKE

SEQ ID NO: 1714302 - protein, 23 aa, Staphylococcus aureus
EIENFKFFVQYGDFKDINDYKDG

SEQ ID NO: 1714303 - protein, 21 aa, Staphylococcus aureus
EIENFKFFVQYGNFKDLENYK

SEQ ID NO: 1714304 - protein, 23 aa, Staphylococcus aureus
EIENLKFFVQYGNFKDINDYKDG

SEQ ID NO: 1714305 - protein, 18 aa, Staphylococcus aureus
ELDFKLRKQLIENHNLYG

SEQ ID NO: 1714306 - protein, 18 aa, Staphylococcus aureus
ERYVPYTIAVNGTSTPNL

SEQ ID NO: 1714307 - protein, 25 aa, Staphylococcus aureus
FSAVLVLSGCGSMHSSGKDLNISLP

SEQ ID NO: 1714308 - protein, 22 aa, Staphylococcus aureus
FSNVVSNEFAFLHPHKITTNDL

SEQ ID NO: 1714309 - protein, 26 aa, Staphylococcus aureus
FTVTTSLKNNGNFGASFNTDDFVYKV

SEQ ID NO: 1714310 - protein, 17 aa, Staphylococcus aureus
GEDSWKTLTSKLKEKGL

SEQ ID NO: 1714311 - protein, 17 aa, Staphylococcus aureus
GGKSLPNFLESFKDDKY

SEQ ID NO: 1714312 - protein, 19 aa, Staphylococcus aureus
IATKVKFPVTINGFSNVVS

SEQ ID NO: 1714313 - protein, 30 aa, Staphylococcus aureus
IDEILAIKLPAEVIKASPKVGQPAPKVCTP

SEQ ID NO: 1714314 - protein, 19 aa, Staphylococcus aureus
IHSNLKFESHKEEKNSNWL

SEQ ID NO: 1714315 - protein, 23 aa, Staphylococcus aureus
INAVKNTRIEVVNGDEVSRPGPR

SEQ ID NO: 1714316 - protein, 18 aa, Staphylococcus aureus
INGFSNVVSNEFAFLHPH

SEQ ID NO: 1714317 - protein, 25 aa, Staphylococcus aureus
ISPFGKLRAGFDLFKKPTQMQNGDI

SEQ ID NO: 1714318 - protein, 18 aa, Staphylococcus aureus
KGIMPNWEPGKKVHLVGH

SEQ ID NO: 1714319 - protein, 25 aa, Staphylococcus aureus
KIRFLKLKVGKIINVAKVDIIAFDK

SEQ ID NO: 1714320 - protein, 22 aa, Staphylococcus aureus
KISQLNLLFVKDIKKIDVDVKT

SEQ ID NO: 1714321 - protein, 27 aa, Staphylococcus aureus
KKGMKEARKGVGYKAEIEVHTTLFSKS

SEQ ID NO: 1714322 - protein, 17 aa, Staphylococcus aureus
KLQENRMADVIDGTNID

SEQ ID NO: 1714323 - protein, 24 aa, Staphylococcus aureus
KNGGKYTFELHKKLQENRMADVID

SEQ ID NO: 1714324 - protein, 31 aa, Staphylococcus aureus
KSWIDDGFLPLIYKGEMMDLSRGRAISRENE

SEQ ID NO: 1714325 - protein, 20 aa, Staphylococcus aureus
KTFLEERGHEFIILADNGED

SEQ ID NO: 1714326 - protein, 17 aa, Staphylococcus aureus
LASGCSGVFDTPEDSKE

SEQ ID NO: 1714327 - protein, 18 aa, Staphylococcus aureus
LCTSIIISGCSFISKNQT

SEQ ID NO: 1714328 - protein, 19 aa, Staphylococcus aureus
LIDPNGRLSTVGGVTKKNN

SEQ ID NO: 1714329 - protein, 23 aa, Staphylococcus aureus
LKLYPTKNLDGFYDKEGFRDQEF

SEQ ID NO: 1714330 - protein, 18 aa, Staphylococcus aureus
LSDLKFKGDSRVSYSDIT

SEQ ID NO: 1714331 - protein, 25 aa, Staphylococcus aureus
LTNVTGYKYGNKVTFIDNSQQIDVT

SEQ ID NO: 1714332 - protein, 26 aa, Staphylococcus aureus
MAVMLFLTGCGKSQEKATLEKDIDNL

SEQ ID NO: 1714333 - protein, 17 aa, Staphylococcus aureus
MYKTGLWEFETHTHDMH

SEQ ID NO: 1714334 - protein, 23 aa, Staphylococcus aureus
NDIELKFAKQAKYTVHFKNGKTQ

SEQ ID NO: 1714335 - protein, 17 aa, Staphylococcus aureus
NKQEFLKDIEEIQLKNS

SEQ ID NO: 1714336 - protein, 22 aa, Staphylococcus aureus
NNGWCAGYTMSALLNATYNTNK

SEQ ID NO: 1714337 - protein, 28 aa, Staphylococcus aureus
QKEINPKFKGLRSYYTKSSLEFKNELGI

SEQ ID NO: 1714338 - protein, 28 aa, Staphylococcus aureus
RGTFLMTKMMLPLMMTKGGSIVNTSSFS

SEQ ID NO: 1714339 - protein, 26 aa, Staphylococcus aureus
RGTILMTKMMLPLMMNQGGSIVNTSS

SEQ ID NO: 1714340 - protein, 19 aa, Staphylococcus aureus
RIKDNILNFDAYIEPGNSG

SEQ ID NO: 1714341 - protein, 19 aa, Staphylococcus aureus
RNKWLKSRGIIASESMAED

SEQ ID NO: 1714342 - protein, 17 aa, Staphylococcus aureus
RVKSEIFSLTRNGNLWA

SEQ ID NO: 1714343 - protein, 21 aa, Staphylococcus aureus
RYGKTYKGIMPNWEPGKKVHL

SEQ ID NO: 1714344 - protein, 20 aa, Staphylococcus aureus
SFTAGCGMGKEAEIKKSFEK

SEQ ID NO: 1714345 - protein, 17 aa, Staphylococcus aureus
SGCSGVFDTPEDSKETQ

SEQ ID NO: 1714346 - protein, 19 aa, Staphylococcus aureus
SLLTACGANQHKENNSKSN

SEQ ID NO: 1714347 - protein, 27 aa, Staphylococcus aureus
SPVFNEKNEVIGIHWGGVPNEFNGAVF

SEQ ID NO: 1714348 - protein, 20 aa, Staphylococcus aureus
SRLVKYINIFYAMIANVPII

SEQ ID NO: 1714349 - protein, 24 aa, Staphylococcus aureus
TIEALEYMNAYLFKQLVKNNGVEG

SEQ ID NO: 1714350 - protein, 23 aa, Staphylococcus aureus
TKDEVMPALAYFTFSPKNYEDKS

SEQ ID NO: 1714351 - protein, 23 aa, Staphylococcus aureus
TKLNNKYASIGMDFENQDKTLTA

SEQ ID NO: 1714352 - protein, 46 aa, Staphylococcus aureus
TKPSLEFKNEIGIILKKWTTIRFMNIVPDYFIYKIALVGKDDKKYD

SEQ ID NO: 1714353 - protein, 19 aa, Staphylococcus aureus
TLLQLSWFSHIQVFGPESW

SEQ ID NO: 1714354 - protein, 25 aa, Staphylococcus aureus
VDAVLKRFNVALGDIEAVITEKENS

SEQ ID NO: 1714355 - protein, 19 aa, Staphylococcus aureus
VDLKAGIHTADLINTSDIK

SEQ ID NO: 1714356 - protein, 21 aa, Staphylococcus aureus
VHADKSGKVVLINGDTDAKKV

SEQ ID NO: 1714357 - protein, 26 aa, Staphylococcus aureus
VKIYHLGEMDMKIVALFPEAVEGQEN

SEQ ID NO: 1714358 - protein, 34 aa, Staphylococcus aureus
VPEKPKRVAVLTGFYVGDFIKLGIKPIAVSDITK

SEQ ID NO: 1714359 - protein, 21 aa, Staphylococcus aureus
VPVDYYVRVNMKAFVEAVNEL

SEQ ID NO: 1714360 - protein, 19 aa, Staphylococcus aureus
YKAEDYWFTDPITLEHLRS

SEQ ID NO: 1714361 - protein, 18 aa, Staphylococcus aureus
YKVQLPEGVEYVNNSLTK

SEQ ID NO: 1714362 - protein, 17 aa, Staphylococcus aureus
DEIKAHPNGFYNNGGGL

SEQ ID NO: 1714363 - protein, 17 aa, Staphylococcus aureus
DLSKRLKSTDANRYVKN

SEQ ID NO: 1714364 - protein, 17 aa, Staphylococcus aureus
ELIKAKQQIAGAVTNAD

SEQ ID NO: 1714365 - protein, 18 aa, Staphylococcus aureus
EPVINKKATAREQLTTLF

SEQ ID NO: 1714366 - protein, 21 aa, Staphylococcus aureus
ETEFPRIQLFMKSYTGEEDWE

SEQ ID NO: 1714367 - protein, 28 aa, Staphylococcus aureus
FENELKAILPFHRSLRVANYDNQAYAAV

SEQ ID NO: 1714368 - protein, 21 aa, Staphylococcus aureus
GADPMTFLGLGGIGDLIVTCI

SEQ ID NO: 1714369 - protein, 22 aa, Staphylococcus aureus
GAYDIHFVKDGFQYNFTSNGTT

SEQ ID NO: 1714370 - protein, 26 aa, Staphylococcus aureus
GEHAKELRAKLDLILGDTDNPHKITN

SEQ ID NO: 1714371 - protein, 17 aa, Staphylococcus aureus
HNLPESEKAIYDKVIST

SEQ ID NO: 1714372 - protein, 21 aa, Staphylococcus aureus
HSDAPKLYVSNVMTQPGETDG

SEQ ID NO: 1714373 - protein, 17 aa, Staphylococcus aureus
IKRIKDNILNFDAYIEP

SEQ ID NO: 1714374 - protein, 23 aa, Staphylococcus aureus
ILNSKYEAIGVIYAGNKPSGEST

SEQ ID NO: 1714375 - protein, 25 aa, Staphylococcus aureus
IQPETKIKPAAREKINQKANELRAQ

SEQ ID NO: 1714376 - protein, 27 aa, Staphylococcus aureus
KDKEEFEAFKKRSPKYNPGMNDQAEMD

SEQ ID NO: 1714377 - protein, 18 aa, Staphylococcus aureus
KKKMDILNIHTAKASEVN

SEQ ID NO: 1714378 - protein, 17 aa, Staphylococcus aureus
KNIGYHFLDKPKITVKK

SEQ ID NO: 1714379 - protein, 31 aa, Staphylococcus aureus
KRVESNGIATLKGVEPHIVVKPEAQEAIKAS

SEQ ID NO: 1714380 - protein, 21 aa, Staphylococcus aureus
KSLIYRYDATLGTQITTNDIL

SEQ ID NO: 1714381 - protein, 17 aa, Staphylococcus aureus
KTVKINLPEHVSKAEPS

SEQ ID NO: 1714382 - protein, 23 aa, Staphylococcus aureus
LDQRVINHYGSLIPLTPLDSSLL

SEQ ID NO: 1714383 - protein, 22 aa, Staphylococcus aureus
LGADPMTFLGLGGIGDLIVTCT

SEQ ID NO: 1714384 - protein, 18 aa, Staphylococcus aureus
LKLYPTKNLEDFYDKEGF

SEQ ID NO: 1714385 - protein, 18 aa, Staphylococcus aureus
LSNEGMVLYLDRNTRTAK

SEQ ID NO: 1714386 - protein, 17 aa, Staphylococcus aureus
LYVSNVMTQPGETDGYS

SEQ ID NO: 1714387 - protein, 30 aa, Staphylococcus aureus
NDTVIGEKVVAYGPIWRLLKVPENVSHLKI

SEQ ID NO: 1714388 - protein, 24 aa, Staphylococcus aureus
NVEVPVKVYPVANAKAPSRDVKGQ

SEQ ID NO: 1714389 - protein, 22 aa, Staphylococcus aureus
PELIDIKGGIYSVGGITKKNVR

SEQ ID NO: 1714390 - protein, 26 aa, Staphylococcus aureus
PVFNEKNEVIGIHWGGVPNEFNGAVF

SEQ ID NO: 1714391 - protein, 20 aa, Staphylococcus aureus
PYTGAYGVVLLEGISQMMPM

SEQ ID NO: 1714392 - protein, 20 aa, Staphylococcus aureus
QKGGNLKPLEQREHANVILP

SEQ ID NO: 1714393 - protein, 26 aa, Staphylococcus aureus
QLAYKELEQAVALIRTMPQRQQTSRR

SEQ ID NO: 1714394 - protein, 24 aa, Staphylococcus aureus
RGISDLDLKFAKQAKYTVYFKNGK

SEQ ID NO: 1714395 - protein, 23 aa, Staphylococcus aureus
RKVVKELPNTGSEEMDLPLKELA

SEQ ID NO: 1714396 - protein, 22 aa, Staphylococcus aureus
RTAKGYYFVRTFYRKDKLPDRK

SEQ ID NO: 1714397 - protein, 25 aa, Staphylococcus aureus
RVNNVPTPRTVTFNDTLTYKTYSQD

SEQ ID NO: 1714398 - protein, 19 aa, Staphylococcus aureus
RYADKHINDNYGLERISKT

SEQ ID NO: 1714399 - protein, 19 aa, Staphylococcus aureus
SKYAYVLYPGLSKSDFKSK

SEQ ID NO: 1714400 - protein, 23 aa, Staphylococcus aureus
SNRPKKRSRRAAPTDPNATPADP

SEQ ID NO: 1714401 - protein, 19 aa, Staphylococcus aureus
TDARNAVNEKAREAITNIN

SEQ ID NO: 1714402 - protein, 28 aa, Staphylococcus aureus
TEGAVFIKGGDGFDFGHVERFIQNPPHG

SEQ ID NO: 1714403 - protein, 18 aa, Staphylococcus aureus
THANGQVSYGARPTQNKP

SEQ ID NO: 1714404 - protein, 22 aa, Staphylococcus aureus
TPRYEKAYEIPKEQLKEKDGHH

SEQ ID NO: 1714405 - protein, 24 aa, Staphylococcus aureus
TQEKRINLYFKYNLNNYSSMKVTS

SEQ ID NO: 1714406 - protein, 25 aa, Staphylococcus aureus
TVLPEIQHNIKFFKNDDGQNIADKP

SEQ ID NO: 1714407 - protein, 25 aa, Staphylococcus aureus
VDIFALKDYETWRTYMLAQETFTGG

SEQ ID NO: 1714408 - protein, 24 aa, Staphylococcus aureus
VILTVCLIGLLILATNEDALAKVH

SEQ ID NO: 1714409 - protein, 17 aa, Staphylococcus aureus
VMGGWYHSAHALDSLSK

SEQ ID NO: 1714410 - protein, 23 aa, Staphylococcus aureus
VPVKHVIPEIVAHSHYTVQGQDF

SEQ ID NO: 1714411 - protein, 26 aa, Staphylococcus aureus
VTVVDNLPGYTLINGGKVGVFSHAMV

SEQ ID NO: 1714412 - protein, 20 aa, Staphylococcus aureus
VTYDAANRIITIKSTGGGTG

SEQ ID NO: 1714413 - protein, 23 aa, Staphylococcus aureus
VVLLEGISQMMPMIKESPFKTTQ

SEQ ID NO: 1714414 - protein, 18 aa, Staphylococcus aureus
VWLIKKGFNIYNRYTLHR

SEQ ID NO: 1714415 - protein, 21 aa, Staphylococcus aureus
WKTLTSKLKEKGLVTDGQTVT

SEQ ID NO: 1714416 - protein, 18 aa, Staphylococcus aureus
WYHSAHALDSLSKSPENW

SEQ ID NO: 1714417 - protein, 20 aa, Staphylococcus aureus
YDKEGYRDGEFEKGDKGMWT

SEQ ID NO: 1714418 - protein, 18 aa, Staphylococcus aureus
YPNSKLDIITPVDMSSNA

SEQ ID NO: 1714419 - protein, 25 aa, Staphylococcus aureus
YQAQGNVIALGRIKGNDTNDHGDFN

SEQ ID NO: 1714420 - protein, 19 aa, Staphylococcus aureus
YTFELHKKLQEHRMADVIE

SEQ ID NO: 1714421 - protein, 25 aa, Staphylococcus aureus
DAQGNYHYTWTGNWNPSQLTQNNTY

SEQ ID NO: 1714422 - protein, 39 aa, Staphylococcus aureus
DEFKPFREVSDSMPYPHGQCTWYVYNRMKQFGTSISGDL

SEQ ID NO: 1714423 - protein, 23 aa, Staphylococcus aureus
ECNLLKHNIHLVSGHPMAGSHKS

SEQ ID NO: 1714424 - protein, 21 aa, Staphylococcus aureus
EKSQTKLNEWHNINEKSALLP

SEQ ID NO: 1714425 - protein, 20 aa, Staphylococcus aureus
FIQPSIKFMNIIDGNSVNNI

SEQ ID NO: 1714426 - protein, 26 aa, Staphylococcus aureus
FTVTTSLKNNGNFGASFNTDDFVYKI

SEQ ID NO: 1714427 - protein, 22 aa, Staphylococcus aureus
HPSQSLIIKHHFAVPGYHAHKF

SEQ ID NO: 1714428 - protein, 25 aa, Staphylococcus aureus
IANRPTDGGLSWSDDHKSLIYRYDA

SEQ ID NO: 1714429 - protein, 24 aa, Staphylococcus aureus
IASSLSCALLLLSAANTEANSANK

SEQ ID NO: 1714430 - protein, 26 aa, Staphylococcus aureus
IKHHFAVPGYHAHKFVTPGHASIKIN

SEQ ID NO: 1714431 - protein, 17 aa, Staphylococcus aureus
IKNGTAMPTNLAGGSTT

SEQ ID NO: 1714432 - protein, 28 aa, Staphylococcus aureus
ISPYKGILRVGAATGFVVGKNTILTNRH

SEQ ID NO: 1714433 - protein, 23 aa, Staphylococcus aureus
ITVELKEKGMFVIKKKDDKAYKC

SEQ ID NO: 1714434 - protein, 19 aa, Staphylococcus aureus
KADALKAITALKLQMDEEL

SEQ ID NO: 1714435 - protein, 17 aa, Staphylococcus aureus
KANERVAIVGYPAPYKN

SEQ ID NO: 1714436 - protein, 26 aa, Staphylococcus aureus
KEEFEAFKKRSPKYNPGMSDHDKTDG

SEQ ID NO: 1714437 - protein, 22 aa, Staphylococcus aureus
KKKDDKAYKCSFYNPETTNTAS

SEQ ID NO: 1714438 - protein, 18 aa, Staphylococcus aureus
KYSLPYFFGTVGILYNKE

SEQ ID NO: 1714439 - protein, 22 aa, Staphylococcus aureus
LALSLFLAACGQDSDQQKDGNK

SEQ ID NO: 1714440 - protein, 18 aa, Staphylococcus aureus
LCNLFILTACSASVDKTS

SEQ ID NO: 1714441 - protein, 21 aa, Staphylococcus aureus
LKIKEALDWMHKNVYGKNPSQ

SEQ ID NO: 1714442 - protein, 25 aa, Staphylococcus aureus
LLKKKIDEYELYKKWYKSSNKNTNM

SEQ ID NO: 1714443 - protein, 17 aa, Staphylococcus aureus
LNWWDYEIGTPRALTNT

SEQ ID NO: 1714444 - protein, 30 aa, Staphylococcus aureus
LTFLFVCSLIVCGFFAYKIYFPTDAENKSE

SEQ ID NO: 1714445 - protein, 18 aa, Staphylococcus aureus
MLGICLVLLIILIVGYVI

SEQ ID NO: 1714446 - protein, 24 aa, Staphylococcus aureus
NVLNCKPDFWKTLKYKKDKVTYYV

SEQ ID NO: 1714447 - protein, 17 aa, Staphylococcus aureus
PNFDKLVEETKKAVKEA

SEQ ID NO: 1714448 - protein, 29 aa, Staphylococcus aureus
PSVTVVDNLPGFTLINGGKVGVFSHAMVR

SEQ ID NO: 1714449 - protein, 20 aa, Staphylococcus aureus
QAVIKKIHEPFVIYDGITNG

SEQ ID NO: 1714450 - protein, 19 aa, Staphylococcus aureus
QKLSTITLLMTGVIALNNG

SEQ ID NO: 1714451 - protein, 23 aa, Staphylococcus aureus
QRHLTFSNKWLWQKDNGTIHATL

SEQ ID NO: 1714452 - protein, 19 aa, Staphylococcus aureus
QVISPRFGTLTNMIAIGQM

SEQ ID NO: 1714453 - protein, 19 aa, Staphylococcus aureus
RLLKHDLLFHDMFVNVASK

SEQ ID NO: 1714454 - protein, 18 aa, Staphylococcus aureus
SDIFTPNLFSAKDIKKID

SEQ ID NO: 1714455 - protein, 25 aa, Staphylococcus aureus
SDKLKISQILTFNFIKDKSYDKDTL

SEQ ID NO: 1714456 - protein, 18 aa, Staphylococcus aureus
SIAALTILTSVTGVSTTM

SEQ ID NO: 1714457 - protein, 17 aa, Staphylococcus aureus
SNDLLGLTHERYSYIFD

SEQ ID NO: 1714458 - protein, 18 aa, Staphylococcus aureus
STDLAKELIKYNQIGMTL

SEQ ID NO: 1714459 - protein, 17 aa, Staphylococcus aureus
THQGKLSAFSFNDQTGQ

SEQ ID NO: 1714460 - protein, 18 aa, Staphylococcus aureus
TKNLEDFYDKEGFRDQEF

SEQ ID NO: 1714461 - protein, 18 aa, Staphylococcus aureus
VLGINLLFLVISITAGCG

SEQ ID NO: 1714462 - protein, 26 aa, Staphylococcus aureus
WGGVPNQFNGAVFINENVRNFLKQNI

SEQ ID NO: 1714463 - protein, 17 aa, Staphylococcus aureus
WWDYEIGTPRALTNTLL

SEQ ID NO: 1714464 - protein, 24 aa, Staphylococcus aureus
YNPGVTPLIFPGDVISLVPQNKVK

SEQ ID NO: 1714465 - protein, 23 aa, Staphylococcus aureus
AELIHWISILPVIIFNKGPRLVK

SEQ ID NO: 1714466 - protein, 19 aa, Staphylococcus aureus
AKNGFSINELFFIQKEEVS

SEQ ID NO: 1714467 - protein, 25 aa, Staphylococcus aureus
DDFVYKIQLPEGVEYVNNSLTKDFP

SEQ ID NO: 1714468 - protein, 18 aa, Staphylococcus aureus
DGSGYPVGTYINASSKGA

SEQ ID NO: 1714469 - protein, 32 aa, Staphylococcus aureus
DTNIFPYNGVVSFKDATGFVIGKNTIITNKHV

SEQ ID NO: 1714470 - protein, 18 aa, Staphylococcus aureus
DTTLKSWIDDGFMPLIYK

SEQ ID NO: 1714471 - protein, 26 aa, Staphylococcus aureus
DYVKRVKQSNLWKSKDNGFYDLTREG

SEQ ID NO: 1714472 - protein, 26 aa, Staphylococcus aureus
ENELKAILPFHRSLRVANYDNQSYAA

SEQ ID NO: 1714473 - protein, 26 aa, Staphylococcus aureus
ESKGKITYLKGEAMQYDLSTTGGNSG

SEQ ID NO: 1714474 - protein, 23 aa, Staphylococcus aureus
FESDGTHFAWNYHATGTNGADMS

SEQ ID NO: 1714475 - protein, 17 aa, Staphylococcus aureus
FVYKVQLPEGVEYVNNS

SEQ ID NO: 1714476 - protein, 28 aa, Staphylococcus aureus
GLVLIMFVLCGFIFPLTVTALGQVLFPE

SEQ ID NO: 1714477 - protein, 20 aa, Staphylococcus aureus
GQFLIKMGIQPEVTKDKTTH

SEQ ID NO: 1714478 - protein, 18 aa, Staphylococcus aureus
GWGPYGRDSYHSTYGNEM

SEQ ID NO: 1714479 - protein, 23 aa, Staphylococcus aureus
GYENPDLGTFFLMDTTSRIIGHD

SEQ ID NO: 1714480 - protein, 18 aa, Staphylococcus aureus
IDPNGRLSTVGGVTKKNN

SEQ ID NO: 1714481 - protein, 17 aa, Staphylococcus aureus
ISKFKGKKMDIFGIDYN

SEQ ID NO: 1714482 - protein, 17 aa, Staphylococcus aureus
KFSIRKYTVGTFSTVIA

SEQ ID NO: 1714483 - protein, 27 aa, Staphylococcus aureus
KGATVSDYYYWKIIDSLEAQFTGAIDL

SEQ ID NO: 1714484 - protein, 18 aa, Staphylococcus aureus
KNYQGMTNLIIKNADNDT

SEQ ID NO: 1714485 - protein, 19 aa, Staphylococcus aureus
KVIPYAGSADLAIVEVEED

SEQ ID NO: 1714486 - protein, 17 aa, Staphylococcus aureus
KVQVKPAARQSVGVKAE

SEQ ID NO: 1714487 - protein, 19 aa, Staphylococcus aureus
KYHNVFGIAAYDNDPLREG

SEQ ID NO: 1714488 - protein, 20 aa, Staphylococcus aureus
KYNHKEILKEIGKLTNNEDK

SEQ ID NO: 1714489 - protein, 21 aa, Staphylococcus aureus
KYSGEGDLAIVKFSPNEQNKH

SEQ ID NO: 1714490 - protein, 25 aa, Staphylococcus aureus
LDKRTNFKKIGWDVEAHKIMNNGWG

SEQ ID NO: 1714491 - protein, 25 aa, Staphylococcus aureus
LKDLARASDYFSEAGATPATKAFGR

SEQ ID NO: 1714492 - protein, 18 aa, Staphylococcus aureus
LKPYLKGVDYIGENDVER

SEQ ID NO: 1714493 - protein, 22 aa, Staphylococcus aureus
LQGEIVQGPDFLTMEQNRPSLS

SEQ ID NO: 1714494 - protein, 18 aa, Staphylococcus aureus
MHIDGDLKGSSVGYKRLE

SEQ ID NO: 1714495 - protein, 39 aa, Staphylococcus aureus
NAVKEGKAKINAVKTFSEYKKDALAKIEDAYNAKVNEAD

SEQ ID NO: 1714496 - protein, 19 aa, Staphylococcus aureus
NAYGVYFTPEIKKFIAENI

SEQ ID NO: 1714497 - protein, 28 aa, Staphylococcus aureus
NYDRAVELYYYIKGGRVDYGAAHAAKYG

SEQ ID NO: 1714498 - protein, 20 aa, Staphylococcus aureus
PEAQEAIKASADNQVESIKD

SEQ ID NO: 1714499 - protein, 17 aa, Staphylococcus aureus
PMGGIQIIPETNQVISP

SEQ ID NO: 1714500 - protein, 36 aa, Staphylococcus aureus
QNFLEYHKMPVLSRGNFNPEFIGVLSRKQNAAKKSK

SEQ ID NO: 1714501 - protein, 19 aa, Staphylococcus aureus
SGDTSEFEITYGRNMDVTH

SEQ ID NO: 1714502 - protein, 18 aa, Staphylococcus aureus
TNNKEFTVTTSLKNNGNS

SEQ ID NO: 1714503 - protein, 18 aa, Staphylococcus aureus
YAGSYSYECHGGETNKTQ

SEQ ID NO: 1714504 - protein, 18 aa, Staphylococcus aureus
YDKEGFRDQEFEKGDKGN

SEQ ID NO: 1714505 - protein, 24 aa, Staphylococcus aureus
YKDREKMYYFAYEIKDGKAEINRE

SEQ ID NO: 1714506 - protein, 21 aa, Staphylococcus aureus
ASPKVGQPAPKVCTPIKKEDK

SEQ ID NO: 1714507 - protein, 33 aa, Staphylococcus aureus
EDYTSYFPKYAYRNGVGRPEGIVVHDTANDRST

SEQ ID NO: 1714508 - protein, 17 aa, Staphylococcus aureus
ESWKTRTVKNYGESETK

SEQ ID NO: 1714509 - protein, 18 aa, Staphylococcus aureus
EYNELHQSLKEAVDEFNS

SEQ ID NO: 1714510 - protein, 17 aa, Staphylococcus aureus
FEMTIHLKGFEANQTLE

SEQ ID NO: 1714511 - protein, 21 aa, Staphylococcus aureus
FKIRQHLVKNYGLYKGTTKYG

SEQ ID NO: 1714512 - protein, 26 aa, Staphylococcus aureus
FYYQHSKKSLGIWFVVDHNRVVEVTV

SEQ ID NO: 1714513 - protein, 19 aa, Staphylococcus aureus
GEHKTSQYLIGFAAETEDI

SEQ ID NO: 1714514 - protein, 17 aa, Staphylococcus aureus
GKEIKKAIGQDATVSLF

SEQ ID NO: 1714515 - protein, 17 aa, Staphylococcus aureus
IDRENADSGTFNYVKGI

SEQ ID NO: 1714516 - protein, 18 aa, Staphylococcus aureus
IFLLAMYELGKYVTEQVY

SEQ ID NO: 1714517 - protein, 21 aa, Staphylococcus aureus
IKKRKNPGLDIFVVKEAENRN

SEQ ID NO: 1714518 - protein, 20 aa, Staphylococcus aureus
ITKKNVRSVFGFVSNPSLQV

SEQ ID NO: 1714519 - protein, 19 aa, Staphylococcus aureus
KDLHRYYSSESFEFSNISG

SEQ ID NO: 1714520 - protein, 23 aa, Staphylococcus aureus
KKKVKDALEWLHKNAYGKEPDKK

SEQ ID NO: 1714521 - protein, 18 aa, Staphylococcus aureus
KPELVAIAEQASNRPKKR

SEQ ID NO: 1714522 - protein, 19 aa, Staphylococcus aureus
KVIPPYGHNSHRMHVPSFQ

SEQ ID NO: 1714523 - protein, 25 aa, Staphylococcus aureus
LDFKIRKLLIEKYRLYKGTSDKGRI

SEQ ID NO: 1714524 - protein, 30 aa, Staphylococcus aureus
LNTYYKRTIKISGLKAMYALKSKDFKKMSE

SEQ ID NO: 1714525 - protein, 20 aa, Staphylococcus aureus
LPSMVALTLVGSAVTAHQVQ

SEQ ID NO: 1714526 - protein, 40 aa, Staphylococcus aureus
NAVKEGKAKINAVKTFSEYKKDALAKIEDAYNAKVNEADN

SEQ ID NO: 1714527 - protein, 26 aa, Staphylococcus aureus
NENVRNFLKQNIEDINFANDDHPNNP

SEQ ID NO: 1714528 - protein, 19 aa, Staphylococcus aureus
PNKTACMYGGVTLHDNNRL

SEQ ID NO: 1714529 - protein, 17 aa, Staphylococcus aureus
QGDIKIRGYQDLLQPIL

SEQ ID NO: 1714530 - protein, 25 aa, Staphylococcus aureus
QKKHGGEISPLFKGNHDNMISSITT

SEQ ID NO: 1714531 - protein, 25 aa, Staphylococcus aureus
QLAYKELEQAVALIRTMPQRQQTSR

SEQ ID NO: 1714532 - protein, 19 aa, Staphylococcus aureus
RLLKHDLLFHDMFLNDAWK

SEQ ID NO: 1714533 - protein, 32 aa, Staphylococcus aureus; identical to SEQ ID NO: 1672412

SEQ ID NO: 1714534 - protein, 25 aa, Staphylococcus aureus
RYGKTYKGIMPNWEPGKKVHLVGHS

SEQ ID NO: 1714535 - protein, 21 aa, Staphylococcus aureus
SGFSPDFATVITMDRKATKQQ

SEQ ID NO: 1714536 - protein, 18 aa, Staphylococcus aureus
SNGSAIPDATITWVSGQA

SEQ ID NO: 1714537 - protein, 27 aa, Staphylococcus aureus
SPVFNEKNEVIGIHWGGVPNQFNGAVF

SEQ ID NO: 1714538 - protein, 26 aa, Staphylococcus aureus
TIVNRLPKSMPQYHVGHIQQIRQIQA

SEQ ID NO: 1714539 - protein, 25 aa, Staphylococcus aureus
VGFIAKQGLKKAIQKYGKTVVTSMI

SEQ ID NO: 1714540 - protein, 21 aa, Staphylococcus aureus
VRSGFNPEFLTYISNEKSNEK

SEQ ID NO: 1714541 - protein, 18 aa, Staphylococcus aureus
DAKNTWNSLTEKLKGLGL

SEQ ID NO: 1714542 - protein, 19 aa, Staphylococcus aureus
DAPVAPIYQKGVAHLTNPQ

SEQ ID NO: 1714543 - protein, 23 aa, Staphylococcus aureus
DESKRNAYTQAVTAAEGILNKQT

SEQ ID NO: 1714544 - protein, 20 aa, Staphylococcus aureus
DGNQLYSINAGFRKYPSTKE

SEQ ID NO: 1714545 - protein, 27 aa, Staphylococcus aureus
DLSEYYKGRGFELTNVTGYKYGNKVTF

SEQ ID NO: 1714546 - protein, 22 aa, Staphylococcus aureus
DQRVINHYGSLIPLTPLDSSLL

SEQ ID NO: 1714547 - protein, 24 aa, Staphylococcus aureus
DRYTNFWNQLHWIGNNYKDENRAT

SEQ ID NO: 1714548 - protein, 26 aa, Staphylococcus aureus
DTKAPIANVKFKLSKKDGSVVKDNQK

SEQ ID NO: 1714549 - protein, 23 aa, Staphylococcus aureus
EDTTHVRWFLNINNEKRYVSKDI

SEQ ID NO: 1714550 - protein, 22 aa, Staphylococcus aureus
EEKLSALYEVDWKTHNVKFVKV

SEQ ID NO: 1714551 - protein, 26 aa, Staphylococcus aureus
ESSYAKCLIYKLTQEIVHVATIDNVH

SEQ ID NO: 1714552 - protein, 17 aa, Staphylococcus aureus
FKDPNANGKYSIVTVDY

SEQ ID NO: 1714553 - protein, 22 aa, Staphylococcus aureus
FKYEVTLPQGVTYVNDSLTTTF

SEQ ID NO: 1714554 - protein, 27 aa, Staphylococcus aureus
GHNAKELRAKLDIILGDAKDPVRITNE

SEQ ID NO: 1714555 - protein, 17 aa, Staphylococcus aureus
GKMSGHDPNLFVGYKPY

SEQ ID NO: 1714556 - protein, 26 aa, Staphylococcus aureus
GKYQFLQSTWDSVAPAKYKGVSPANA

SEQ ID NO: 1714557 - protein, 20 aa, Staphylococcus aureus
GSIHSNLKFESHRNETNASW

SEQ ID NO: 1714558 - protein, 17 aa, Staphylococcus aureus
HANGQVSYGARPTYKKP

SEQ ID NO: 1714559 - protein, 24 aa, Staphylococcus aureus
HKDTEDFYITLKIIDVKQPEGDQR

SEQ ID NO: 1714560 - protein, 18 aa, Staphylococcus aureus
IHSNLKFESHKEEKNSNW

SEQ ID NO: 1714561 - protein, 17 aa, Staphylococcus aureus
ISLIILSLLISITMSNA

SEQ ID NO: 1714562 - protein, 25 aa, Staphylococcus aureus
KANGKARTGWLIVDYAGYTWPGYDD

SEQ ID NO: 1714563 - protein, 18 aa, Staphylococcus aureus
KFGSNNKVYNDYSIEEHN

SEQ ID NO: 1714564 - protein, 18 aa, Staphylococcus aureus
KIIPYAGSEDLAIVQVEE

SEQ ID NO: 1714565 - protein, 23 aa, Staphylococcus aureus
KLSDVSGFAEFEVQGRNLTQTNT

SEQ ID NO: 1714566 - protein, 22 aa, Staphylococcus aureus
KSRRIPINLWVNGEHQTISTDK

SEQ ID NO: 1714567 - protein, 26 aa, Staphylococcus aureus
KTDAARAIDALPHLNNAQKADVKSKI

SEQ ID NO: 1714568 - protein, 18 aa, Staphylococcus aureus
KVSDRNKADALKAITALK

SEQ ID NO: 1714569 - protein, 26 aa, Staphylococcus aureus
LEELLRNGSREEIEYQKKHGGEISPL

SEQ ID NO: 1714570 - protein, 19 aa, Staphylococcus aureus
LKDLMLHQSGLYKYKSSKD

SEQ ID NO: 1714571 - protein, 21 aa, Staphylococcus aureus
LQDFWHHLADDLVKTEKLTDT

SEQ ID NO: 1714572 - protein, 23 aa, Staphylococcus aureus
MDRYTNQWNRLHWVGNNYKNQNT

SEQ ID NO: 1714573 - protein, 21 aa, Staphylococcus aureus
MSGHDPNLFVGYKPYSQNPRD

SEQ ID NO: 1714574 - protein, 18 aa, Staphylococcus aureus
NERIKKEMIDDLNSIIDD

SEQ ID NO: 1714575 - protein, 22 aa, Staphylococcus aureus
NEYRAKAALKKNDFVSMADAKV

SEQ ID NO: 1714576 - protein, 25 aa, Staphylococcus aureus
NGDTIKVAWPTSGTVKIEGYSKTVS

SEQ ID NO: 1714577 - protein, 24 aa, Staphylococcus aureus
NLYTWGQCTYHVFNRRAEIGKGIS

SEQ ID NO: 1714578 - protein, 19 aa, Staphylococcus aureus
PKITNPLLHEFGTKQYPDE

SEQ ID NO: 1714579 - protein, 22 aa, Staphylococcus aureus
PQGYGSLNSFSINYKTKITNEQ

SEQ ID NO: 1714580 - protein, 20 aa, Staphylococcus aureus
QKGGNLKPLEQRERANVILP

SEQ ID NO: 1714581 - protein, 18 aa, Staphylococcus aureus
QPAPKVCTPIKKEDKQEV

SEQ ID NO: 1714582 - protein, 23 aa, Staphylococcus aureus
QYPDEYRYGFYVKPTLNRLNGGF

SEQ ID NO: 1714583 - protein, 18 aa, Staphylococcus aureus
RANVILPNNDRHQITDTT

SEQ ID NO: 1714584 - protein, 27 aa, Staphylococcus aureus
RLATEGKPVLGVCNGFQILTEIGLLPG

SEQ ID NO: 1714585 - protein, 43 aa, Staphylococcus aureus
RNIELVGNLLPGDYFGTIRFGRKEQLFEIRVKPHTPRITTTAE

SEQ ID NO: 1714586 - protein, 25 aa, Staphylococcus aureus
SKQAGHPVFYVYAGNQGNASVNLGG

SEQ ID NO: 1714587 - protein, 23 aa, Staphylococcus aureus
TDGQLWKNVRDALKEANIIDKTD

SEQ ID NO: 1714588 - protein, 23 aa, Staphylococcus aureus
TDSKNLVPLNGFRGTEPEETGDV

SEQ ID NO: 1714589 - protein, 17 aa, Staphylococcus aureus
TSLINFLPIHSLLSALK

SEQ ID NO: 1714590 - protein, 24 aa, Staphylococcus aureus
TVEGGPTLRLFKVPDNVRNLKIQF

SEQ ID NO: 1714591 - protein, 18 aa, Staphylococcus aureus
VATMWESKGKITYLKGEA

SEQ ID NO: 1714592 - protein, 18 aa, Staphylococcus aureus
VDYAGYTWPGYDDIVSEI

SEQ ID NO: 1714593 - protein, 18 aa, Staphylococcus aureus
VESKIVYAKDVKQVLNYV

SEQ ID NO: 1714594 - protein, 30 aa, Staphylococcus aureus; identical to SEQ ID NO: 1578899

SEQ ID NO: 1714595 - protein, 20 aa, Staphylococcus aureus
VPVDYYVRVNMKAFVEAVNE

SEQ ID NO: 1714596 - protein, 17 aa, Staphylococcus aureus
VVALICIIALSACGKEQ

SEQ ID NO: 1714597 - protein, 28 aa, Staphylococcus aureus
WMKVYRCSYPGAGKKAAEWVKKNYENTN

SEQ ID NO: 1714598 - protein, 25 aa, Staphylococcus aureus
WNSLTEKLKGLGLLQNGQKVSIYSS

SEQ ID NO: 1714599 - protein, 17 aa, Staphylococcus aureus
YKVKKIIPYAGSEDLAI

SEQ ID NO: 1714600 - protein, 48 aa, Staphylococcus aureus
YTKPSLEFEKQFGFMLKPWTTVRFMNVIPDWFIYKIALVGKDDKKYKD

SEQ ID NO: 1714601 - protein, 18 aa, Staphylococcus aureus
ADNMTLDSGFYKTPKYSL

SEQ ID NO: 1714602 - protein, 18 aa, Staphylococcus aureus
AEFKKMGIKLNINGETSD

SEQ ID NO: 1714603 - protein, 33 aa, Staphylococcus aureus
AGANKPLPEMWPYGVNDSRSWDYKIRNRSGQVI

SEQ ID NO: 1714604 - protein, 20 aa, Staphylococcus aureus
ALKIKGMLLKIDRNTRSAKG

SEQ ID NO: 1714605 - protein, 25 aa, Staphylococcus aureus
ALQALAKEKEKALAAIDQAQTNSQV

SEQ ID NO: 1714606 - protein, 23 aa, Staphylococcus aureus
ANIYYKSIIKITITVKVGTNLQT

SEQ ID NO: 1714607 - protein, 18 aa, Staphylococcus aureus
ASDYFKLSNGSAIPDATI

SEQ ID NO: 1714608 - protein, 19 aa, Staphylococcus aureus
ASIKINHFCVVPQINSFKV

SEQ ID NO: 1714609 - protein, 19 aa, Staphylococcus aureus
ASLALGMLATGVITSNVQS

SEQ ID NO: 1714610 - protein, 26 aa, Staphylococcus aureus
DKKNGSLAISGRVSMNQAYNSDITFK

SEQ ID NO: 1714611 - protein, 25 aa, Staphylococcus aureus
DLINEKYLIKMGKVAPWGTQSTTTP

SEQ ID NO: 1714612 - protein, 20 aa, Staphylococcus aureus
DVFVVKELIDPNGRLSTVGG

SEQ ID NO: 1714613 - protein, 24 aa, Staphylococcus aureus
EDLYNKLDMILGYKDEERKKKRAT

SEQ ID NO: 1714614 - protein, 24 aa, Staphylococcus aureus
EELLRNGNREEIEYQKKHGGEISP

SEQ ID NO: 1714615 - protein, 17 aa, Staphylococcus aureus
EEYKKSLDDLIWSFPNL

SEQ ID NO: 1714616 - protein, 18 aa, Staphylococcus aureus
EKTKDVSAQKVWEGTQKV

SEQ ID NO: 1714617 - protein, 17 aa, Staphylococcus aureus
ELDYRLRERAIKQHGLY

SEQ ID NO: 1714618 - protein, 19 aa, Staphylococcus aureus
EQLKCDLELNKLENQILML

SEQ ID NO: 1714619 - protein, 20 aa, Staphylococcus aureus
EYYNRPFFEYTNQSGYKEEG

SEQ ID NO: 1714620 - protein, 23 aa, Staphylococcus aureus
FKIRKHLIDHYGLYGEMSSGTVT

SEQ ID NO: 1714621 - protein, 20 aa, Staphylococcus aureus
GGVWSHGIGKHYVWSYYSHN

SEQ ID NO: 1714622 - protein, 19 aa, Staphylococcus aureus
GSEGIWMPIDDKGYFNFDF

SEQ ID NO: 1714623 - protein, 24 aa, Staphylococcus aureus
GYENEYFYISAIPYNLAEYRDYFE

SEQ ID NO: 1714624 - protein, 24 aa, Staphylococcus aureus
HDRNELQAFFDANYHDYRFIDREN

SEQ ID NO: 1714625 - protein, 17 aa, Staphylococcus aureus
HKAELSITKKDEKGKIS

SEQ ID NO: 1714626 - protein, 22 aa, Staphylococcus aureus
HTSVKGKVALSINNKFINFETN

SEQ ID NO: 1714627 - protein, 21 aa, Staphylococcus aureus
IEANDAWKKLVDKLKEKHIVK

SEQ ID NO: 1714628 - protein, 17 aa, Staphylococcus aureus
IENFKFFAQYGSFKDLS

SEQ ID NO: 1714629 - protein, 18 aa, Staphylococcus aureus
IESQCEVIALDATLQQRP

SEQ ID NO: 1714630 - protein, 21 aa, Staphylococcus aureus
IKKTPVVSLEYDFEHKQRIDN

SEQ ID NO: 1714631 - protein, 22 aa, Staphylococcus aureus
IPRDTISYIPKVGYYDKITHAH

SEQ ID NO: 1714632 - protein, 21 aa, Staphylococcus aureus
KDVSAQKVWEGTQKVKPTIYF

SEQ ID NO: 1714633 - protein, 20 aa, Staphylococcus aureus
KEVIDLGDKLQFERMGDVLN

SEQ ID NO: 1714634 - protein, 19 aa, Staphylococcus aureus
KKLQENRMADVIDGTNIDN

SEQ ID NO: 1714635 - protein, 20 aa, Staphylococcus aureus
KKLVDKLKEKHIVKVGDKVT

SEQ ID NO: 1714636 - protein, 22 aa, Staphylococcus aureus
KKSLDDLIWSFPNLDNERFDNP

SEQ ID NO: 1714637 - protein, 22 aa, Staphylococcus aureus
KQLRKRYDIPTSKAPKLLLKGS

SEQ ID NO: 1714638 - protein, 22 aa, Staphylococcus aureus
KRAEERKARFLDNQKIKKTPVV

SEQ ID NO: 1714639 - protein, 19 aa, Staphylococcus aureus
LENQILMLGKTFYQNYRDD

SEQ ID NO: 1714640 - protein, 20 aa, Staphylococcus aureus
LKELDFKLRKQLIEKNNLYG

SEQ ID NO: 1714641 - protein, 21 aa, Staphylococcus aureus
LKELDFKLRKQLIEQHNLYGN

SEQ ID NO: 1714642 - protein, 21 aa, Staphylococcus aureus
LNTAMKGLRDSIANEATIKAG

SEQ ID NO: 1714643 - protein, 25 aa, Staphylococcus aureus
LPNGEIKARSSISMNNVTYTTQDEH

SEQ ID NO: 1714644 - protein, 25 aa, Staphylococcus aureus
LQTWVWYSHIQVFGSESWGNINQLR

SEQ ID NO: 1714645 - protein, 22 aa, Staphylococcus aureus
LREGDSRQATNYSIGGVTKSNS

SEQ ID NO: 1714646 - protein, 18 aa, Staphylococcus aureus
LYSKLDLIMGYKDEERAN

SEQ ID NO: 1714647 - protein, 30 aa, Staphylococcus aureus
MAQRTGVSASTWAAIIARESNGQVNAYNPS

SEQ ID NO: 1714648 - protein, 21 aa, Staphylococcus aureus
MPIDDKGYFNFDFKTKRFDDL

SEQ ID NO: 1714649 - protein, 25 aa, Staphylococcus aureus
MSFANCALPYVIGEVVEDRRYALAY

SEQ ID NO: 1714650 - protein, 18 aa, Staphylococcus aureus
NAKEAIATKANERKTAIA

SEQ ID NO: 1714651 - protein, 17 aa, Staphylococcus aureus
NALYASGAYIMTQKNAY

SEQ ID NO: 1714652 - protein, 25 aa, Staphylococcus aureus
NKPILERKNVTGFKYTDEGKHYLEV

SEQ ID NO: 1714653 - protein, 22 aa, Staphylococcus aureus
PAYYKLYGDKIVGFDTNDFPIT

SEQ ID NO: 1714654 - protein, 25 aa, Staphylococcus aureus
PKKGGFFEEIERTFKKISEELNEEE

SEQ ID NO: 1714655 - protein, 21 aa, Staphylococcus aureus
PKVSGALALIIDKYHLEKHPD

SEQ ID NO: 1714656 - protein, 28 aa, Staphylococcus aureus
PTEINPKFKDLRAYYTKPSLEFKNEIGI

SEQ ID NO: 1714657 - protein, 26 aa, Staphylococcus aureus
QINPELIKSAAKPAALETQYKTAAPK

SEQ ID NO: 1714658 - protein, 17 aa, Staphylococcus aureus
QSEEFLKEIEDIKKDNP

SEQ ID NO: 1714659 - protein, 40 aa, Staphylococcus aureus
QTGDGYQWVIKFNKGHAPHENMIYWFALPAGQTPVGRTEF

SEQ ID NO: 1714660 - protein, 20 aa, Staphylococcus aureus
RDKGTWIINSGMYIQLKGGA

SEQ ID NO: 1714661 - protein, 18 aa, Staphylococcus aureus
RYTLHRFNEEYALEPQQL

SEQ ID NO: 1714662 - protein, 19 aa, Staphylococcus aureus
SDIFTPNLFSAKDIKKIDI

SEQ ID NO: 1714663 - protein, 19 aa, Staphylococcus aureus
SERTKRLKLKQLLNSQNVE

SEQ ID NO: 1714664 - protein, 19 aa, Staphylococcus aureus
SQLDKAKSIGIINEKCLNY

SEQ ID NO: 1714665 - protein, 29 aa, Staphylococcus aureus
TASGHAKDASWLTSRKQLQPYGQYHGGGA

SEQ ID NO: 1714666 - protein, 24 aa, Staphylococcus aureus
TDSELWKNVRDALKDANIIDKTDK

SEQ ID NO: 1714667 - protein, 25 aa, Staphylococcus aureus
TITIRPEDYVVFIPPVGNQIRALIF

SEQ ID NO: 1714668 - protein, 24 aa, Staphylococcus aureus
VAPNNKFTMYRVFGSKKTELLWVS

SEQ ID NO: 1714669 - protein, 23 aa, Staphylococcus aureus
VINAKYDVIYNGHTFATSLPAKF

SEQ ID NO: 1714670 - protein, 24 aa, Staphylococcus aureus
VIRRDHVKEAQSLVENYKDTQSAD

SEQ ID NO: 1714671 - protein, 21 aa, Staphylococcus aureus
VLPQNQKPVFSFYSEAKAYSI

SEQ ID NO: 1714672 - protein, 17 aa, Staphylococcus aureus
WDATMYSFGTIPRGDTG

SEQ ID NO: 1714673 - protein, 25 aa, Staphylococcus aureus
YFNFDFKTKRFDDLELKKNDEISLT

SEQ ID NO: 1714674 - protein, 23 aa, Staphylococcus aureus
YKEAMKKYQQRFMAEDEALKKFF

SEQ ID NO: 1714675 - protein, 21 aa, Staphylococcus aureus
YNGPCKTKYMYGGATLSGQYL

SEQ ID NO: 1714676 - protein, 48 aa, Staphylococcus aureus
YTKPSLEFKNEIGIILKKWTTIRFMNVVPDYFIYKIALVGKDDKKYGE

SEQ ID NO: 1714677 - protein, 21 aa, Staphylococcus aureus
ADDSWKKKTVKKYGETETKSP

SEQ ID NO: 1714678 - protein, 19 aa, Staphylococcus aureus
AKPLKFYNMESLNKEQQKK

SEQ ID NO: 1714679 - protein, 25 aa, Staphylococcus aureus
ALYYLEDYIIYAIGLTNKYEYGDNI

SEQ ID NO: 1714680 - protein, 20 aa, Staphylococcus aureus
DRLLKHDLLFHDMFVNDDWK

SEQ ID NO: 1714681 - protein, 25 aa, Staphylococcus aureus
DTNGFPITWFYPLGEKKVERKAPKL

SEQ ID NO: 1714682 - protein, 17 aa, Staphylococcus aureus
DVAYLLHDGKNEIREIE

SEQ ID NO: 1714683 - protein, 25 aa, Staphylococcus aureus
DYERKAEERKARFLDKQKNKKTPVV

SEQ ID NO: 1714684 - protein, 25 aa, Staphylococcus aureus
EHAKELRAKLDLILGDTDNPHKITN

SEQ ID NO: 1714685 - protein, 19 aa, Staphylococcus aureus
EIENFKFFAQYSNFKDLMN

SEQ ID NO: 1714686 - protein, 23 aa, Staphylococcus aureus
EIENFKFFVQYGDFKNLKNYKDG

SEQ ID NO: 1714687 - protein, 24 aa, Staphylococcus aureus
EIENFKFFVQYGNFKDINDYKDGD

SEQ ID NO: 1714688 - protein, 17 aa, Staphylococcus aureus
EKFKAQGGTLIYKTWKD

SEQ ID NO: 1714689 - protein, 19 aa, Staphylococcus aureus
ESPGVPKVYTFIGKGDASY

SEQ ID NO: 1714690 - protein, 26 aa, Staphylococcus aureus
FESDGTHFAWNYHATGANGANMSAQA

SEQ ID NO: 1714691 - protein, 23 aa, Staphylococcus aureus
FIGKGDASYTISFKTQGPTIDKL

SEQ ID NO: 1714692 - protein, 21 aa, Staphylococcus aureus
FKYEVTLPQGVTYVNDSLTTT

SEQ ID NO: 1714693 - protein, 27 aa, Staphylococcus aureus
GENLKGWHTGAGMSYLYNSDVKHYHDN

SEQ ID NO: 1714694 - protein, 17 aa, Staphylococcus aureus
GGIYSVGGITKKNVRSV

SEQ ID NO: 1714695 - protein, 27 aa, Staphylococcus aureus
GGKVGVFSHAMVRTSMFDSGDNKNYQA

SEQ ID NO: 1714696 - protein, 24 aa, Staphylococcus aureus
GQNAAPVARQIYPFNGNKNQALQQ

SEQ ID NO: 1714697 - protein, 18 aa, Staphylococcus aureus
GYEGFKKEYGFDFGTVRP

SEQ ID NO: 1714698 - protein, 22 aa, Staphylococcus aureus
GYENPDLGTFFLMDTTSRIIGH

SEQ ID NO: 1714699 - protein, 17 aa, Staphylococcus aureus
GYLAKSYAQVRNYVTES

SEQ ID NO: 1714700 - protein, 23 aa, Staphylococcus aureus
HGYSKVHVPYAITVNGTSQNILS

SEQ ID NO: 1714701 - protein, 20 aa, Staphylococcus aureus
HKGVGWKVEAHLINNMGHDH

SEQ ID NO: 1714702 - protein, 18 aa, Staphylococcus aureus
HTQFIVDEILAIKLPAEA

SEQ ID NO: 1714703 - protein, 25 aa, Staphylococcus aureus
IEIEETSALPGRKTGSLVGLSQIDS

SEQ ID NO: 1714704 - protein, 17 aa, Staphylococcus aureus
IKPEAQQAIKASAENQV

SEQ ID NO: 1714705 - protein, 22 aa, Staphylococcus aureus
KAFSHKFFVSKTWINNAPTKED

SEQ ID NO: 1714706 - protein, 20 aa, Staphylococcus aureus
KAPKPLAGLNGESHDFTTTH

SEQ ID NO: 1714707 - protein, 21 aa, Staphylococcus aureus
KAQQLDGAMGQLETSIRDKDT

SEQ ID NO: 1714708 - protein, 27 aa, Staphylococcus aureus
KDKGYEWNPQPIKSMKHSASYMTEKMA

SEQ ID NO: 1714709 - protein, 23 aa, Staphylococcus aureus
KEAKDRLLEKVLREDQYLLERKK

SEQ ID NO: 1714710 - protein, 18 aa, Staphylococcus aureus
KEDEARAGASAVPGANIN

SEQ ID NO: 1714711 - protein, 25 aa, Staphylococcus aureus
KENPRTDLKMANFHKYNLEELSMKE

SEQ ID NO: 1714712 - protein, 18 aa, Staphylococcus aureus
KEYNELQDALKRALDDFH

SEQ ID NO: 1714713 - protein, 27 aa, Staphylococcus aureus
KIANRPTDGGLSWSDDHKSLIYRYDAT

SEQ ID NO: 1714714 - protein, 21 aa, Staphylococcus aureus
KITHAHAYGGPIAAMDSVEAT

SEQ ID NO: 1714715 - protein, 19 aa, Staphylococcus aureus
KITNPLLHEFGTKKYPDEY

SEQ ID NO: 1714716 - protein, 17 aa, Staphylococcus aureus
KKSELQGTALGNLKQIY

SEQ ID NO: 1714717 - protein, 17 aa, Staphylococcus aureus
KMMKRILVVFLMLAIVL

SEQ ID NO: 1714718 - protein, 19 aa, Staphylococcus aureus
KNKHHMFESTGKILSIDGN

SEQ ID NO: 1714719 - protein, 19 aa, Staphylococcus aureus
KNTNLNWWDYEIGTPKSLT

SEQ ID NO: 1714720 - protein, 26 aa, Staphylococcus aureus
KRVNKLVLGISFLFLIISIFAGCGTG

SEQ ID NO: 1714721 - protein, 23 aa, Staphylococcus aureus
KSESLKLNGKRSTTITSDKYEEN

SEQ ID NO: 1714722 - protein, 24 aa, Staphylococcus aureus
KTESGRKYLWSGAETLETNSSHMT

SEQ ID NO: 1714723 - protein, 18 aa, Staphylococcus aureus
KVAKEKPDLIIVYSTDKD

SEQ ID NO: 1714724 - protein, 22 aa, Staphylococcus aureus
LCISLLILIIFVTSCDGDNKII

SEQ ID NO: 1714725 - protein, 26 aa, Staphylococcus aureus
LDQRVINHYGSLIPLTPLDSSLLRKE

SEQ ID NO: 1714726 - protein, 29 aa, Staphylococcus aureus
LDSGFYKTPKYSLGDYVWYDSNKDGKQDS

SEQ ID NO: 1714727 - protein, 25 aa, Staphylococcus aureus
LEDLSRASDYFSEAGATPATKAFGR

SEQ ID NO: 1714728 - protein, 20 aa, Staphylococcus aureus
LESRGAVLEINRNTRTAKGH

SEQ ID NO: 1714729 - protein, 19 aa, Staphylococcus aureus
LKEKHIVKVGDKVTIHSKD

SEQ ID NO: 1714730 - protein, 18 aa, Staphylococcus aureus
LLSVALLYSCSKQNEKAQ

SEQ ID NO: 1714731 - protein, 17 aa, Staphylococcus aureus
LMATILLSGCSTTNNES

SEQ ID NO: 1714732 - protein, 17 aa, Staphylococcus aureus
LSIPRDTISYIPKVGYY

SEQ ID NO: 1714733 - protein, 26 aa, Staphylococcus aureus
MKNGGKYTFELHKKLQENRMADVIDG

SEQ ID NO: 1714734 - protein, 20 aa, Staphylococcus aureus
NADADASAKEIARTDLGRYF

SEQ ID NO: 1714735 - protein, 25 aa, Staphylococcus aureus
NVEVPVKVYPVANAKAPSRDVKGQN

SEQ ID NO: 1714736 - protein, 20 aa, Staphylococcus aureus
PELVSELANPFMAIYDTDAK

SEQ ID NO: 1714737 - protein, 22 aa, Staphylococcus aureus
PLDTLVSLFLKECADYDIDFKK

SEQ ID NO: 1714738 - protein, 17 aa, Staphylococcus aureus
PNPYKNKHHMFESTGKI

SEQ ID NO: 1714739 - protein, 19 aa, Staphylococcus aureus
PYSGVTWMGAGTGFVVGNH

SEQ ID NO: 1714740 - protein, 19 aa, Staphylococcus aureus
QAKDALRQMTHLSDAQKQS

SEQ ID NO: 1714741 - protein, 20 aa, Staphylococcus aureus
QLKIKPGHFSYHEMSPAEMP

SEQ ID NO: 1714742 - protein, 22 aa, Staphylococcus aureus
REHRRKGSIFMDFRNELKILNH

SEQ ID NO: 1714743 - protein, 19 aa, Staphylococcus aureus
RSFYSIRKSTLGVASVIVS

SEQ ID NO: 1714744 - protein, 18 aa, Staphylococcus aureus
RSLKEYRKYYEPLIHKND

SEQ ID NO: 1714745 - protein, 18 aa, Staphylococcus aureus
SGYAHIQNATGLPTDGFT

SEQ ID NO: 1714746 - protein, 17 aa, Staphylococcus aureus
SIAALTILTSVTGVGTT

SEQ ID NO: 1714747 - protein, 18 aa, Staphylococcus aureus
SVNYDLFGAQGQYSNTLL

SEQ ID NO: 1714748 - protein, 24 aa, Staphylococcus aureus
TNSEIKALAKMYLTNDVEIKTAQL

SEQ ID NO: 1714749 - protein, 17 aa, Staphylococcus aureus
TPLDSSLLRKEQNDTTD

SEQ ID NO: 1714750 - protein, 22 aa, Staphylococcus aureus
VDGITALHRTYFIFPENKNVLY

SEQ ID NO: 1714751 - protein, 19 aa, Staphylococcus aureus
VFATLLFKTSQDAFESSQD

SEQ ID NO: 1714752 - protein, 26 aa, Staphylococcus aureus
VKIYHLGEMDMKIVALFPEAVEGQDN

SEQ ID NO: 1714753 - protein, 18 aa, Staphylococcus aureus
VKPTIYFKLYKQDDNQNT

SEQ ID NO: 1714754 - protein, 18 aa, Staphylococcus aureus
VLPATSFAKINSEIKQVS

SEQ ID NO: 1714755 - protein, 19 aa, Staphylococcus aureus
VNINKGRLTKSFTSNLNNM

SEQ ID NO: 1714756 - protein, 18 aa, Staphylococcus aureus
VNRNFVVRYEVNWKTHEI

SEQ ID NO: 1714757 - protein, 20 aa, Staphylococcus aureus
YDKEGYRDGEFEKGDKGMWV

SEQ ID NO: 1714758 - protein, 17 aa, Staphylococcus aureus
YHTVPYTISVDGITALH

SEQ ID NO: 1714759 - protein, 22 aa, Staphylococcus aureus
YKENLRTAAYHKELLSDKIKIS

SEQ ID NO: 1714760 - protein, 23 aa, Staphylococcus aureus
ATKANEQKALIAQTADATTEEKE

SEQ ID NO: 1714761 - protein, 22 aa, Staphylococcus aureus
ATTKIWQNGHVDITPNNPSGHL

SEQ ID NO: 1714762 - protein, 18 aa, Staphylococcus aureus
CLVLLIILIVGYVIMTKT

SEQ ID NO: 1714763 - protein, 20 aa, Staphylococcus aureus
DDEGFKMFLDEQRAFNPNFD

SEQ ID NO: 1714764 - protein, 19 aa, Staphylococcus aureus
DEKSFRKYFAKGYSYNSTG

SEQ ID NO: 1714765 - protein, 27 aa, Staphylococcus aureus
DHIKAMRWPFQYNIGLKTNDPNVDLIN

SEQ ID NO: 1714766 - protein, 26 aa, Staphylococcus aureus
DKAKRDAYTNAVSRAETILNKTQGAN

SEQ ID NO: 1714767 - protein, 17 aa, Staphylococcus aureus
DLDELYDELQIAEFNDK

SEQ ID NO: 1714768 - protein, 18 aa, Staphylococcus aureus
DLDHARQALTPDKAPLQT

SEQ ID NO: 1714769 - protein, 22 aa, Staphylococcus aureus
DLYQSIWKKICVNGTANALSTV

SEQ ID NO: 1714770 - protein, 23 aa, Staphylococcus aureus
EIEEFKFFVQYGNFKELENYKED

SEQ ID NO: 1714771 - protein, 23 aa, Staphylococcus aureus
EIENFKFFVQYGNFKDLSKYKDG

SEQ ID NO: 1714772 - protein, 19 aa, Staphylococcus aureus
EIVQGPDFLTMEQSGPSLS

SEQ ID NO: 1714773 - protein, 21 aa, Staphylococcus aureus
EKAQAEAGGRPNYKTTGYSQS

SEQ ID NO: 1714774 - protein, 19 aa, Staphylococcus aureus
EKKKFTAPIKTFAPDSDKI

SEQ ID NO: 1714775 - protein, 17 aa, Staphylococcus aureus
ELDFKLRKQLIEQHNLY

SEQ ID NO: 1714776 - protein, 27 aa, Staphylococcus aureus
FESDGTHFAWNYHATGANGANMSAQAP

SEQ ID NO: 1714777 - protein, 17 aa, Staphylococcus aureus
FFVQYGNFKDLSKYKDG

SEQ ID NO: 1714778 - protein, 21 aa, Staphylococcus aureus
FYDKEGYRDGEFEKDDKGTWL

SEQ ID NO: 1714779 - protein, 26 aa, Staphylococcus aureus
FYYQHSKKALGIWFVVDHNRVVEVTV

SEQ ID NO: 1714780 - protein, 21 aa, Staphylococcus aureus
GMKICLMLYLLIFLSSCSTNN

SEQ ID NO: 1714781 - protein, 18 aa, Staphylococcus aureus
GPIGATLKAIKALSPSLR

SEQ ID NO: 1714782 - protein, 20 aa, Staphylococcus aureus
GSNLDKAAVENALSQVTNAK

SEQ ID NO: 1714783 - protein, 18 aa, Staphylococcus aureus
GSSVGYKEIEFIFIENKK

SEQ ID NO: 1714784 - protein, 23 aa, Staphylococcus aureus
GTNNYFGYYSFREAPKTQIYTVK

SEQ ID NO: 1714785 - protein, 20 aa, Staphylococcus aureus
GTQLYHIVATNAYHKDTEDF

SEQ ID NO: 1714786 - protein, 20 aa, Staphylococcus aureus
IENFKFFVQYGNFKNFEKYN

SEQ ID NO: 1714787 - protein, 20 aa, Staphylococcus aureus
IENRKANGYTLYTDDKQTTN

SEQ ID NO: 1714788 - protein, 19 aa, Staphylococcus aureus
INVTAHILIDGETTPITKT

SEQ ID NO: 1714789 - protein, 20 aa, Staphylococcus aureus
IPYRLNEEINAINGNEITFK

SEQ ID NO: 1714790 - protein, 25 aa, Staphylococcus aureus
IQNPPHGATVAWHDNPDTWKNTVGN

SEQ ID NO: 1714791 - protein, 18 aa, Staphylococcus aureus
IRKYTVGTFSTVIATLVF

SEQ ID NO: 1714792 - protein, 21 aa, Staphylococcus aureus
KEIPNGIELSIKFSDNKINTV

SEQ ID NO: 1714793 - protein, 19 aa, Staphylococcus aureus
KELDFKLRKQLIEQHNLYG

SEQ ID NO: 1714794 - protein, 23 aa, Staphylococcus aureus
KGPRLVKYINIFYAMIANVPIII

SEQ ID NO: 1714795 - protein, 23 aa, Staphylococcus aureus
KGTWLIRSEMKIQLKGENLESRG

SEQ ID NO: 1714796 - protein, 18 aa, Staphylococcus aureus
KLSTITLLMAGVITLNGG

SEQ ID NO: 1714797 - protein, 33 aa, Staphylococcus aureus
KLYYAAGGRALEYNQLFMYSQLYVESTQDYQQR

SEQ ID NO: 1714798 - protein, 17 aa, Staphylococcus aureus
KRYPVKMEHNKIIPTKP

SEQ ID NO: 1714799 - protein, 19 aa, Staphylococcus aureus
KSSEKYRDADTNKQQEYDN

SEQ ID NO: 1714800 - protein, 18 aa, Staphylococcus aureus
KYAKKAYYTVYFKNGGKR

SEQ ID NO: 1714801 - protein, 21 aa, Staphylococcus aureus
LCISLLILIIFATSCGSNKIT

SEQ ID NO: 1714802 - protein, 22 aa, Staphylococcus aureus
LCISLLILIIFVTSCDGDNKIT

SEQ ID NO: 1714803 - protein, 17 aa, Staphylococcus aureus
LDSIALVTPDHIVRAAA

SEQ ID NO: 1714804 - protein, 18 aa, Staphylococcus aureus
LEEYPVIWEWDVTIKVTT

SEQ ID NO: 1714805 - protein, 18 aa, Staphylococcus aureus
LIDSRYLNSALYYLEDYI

SEQ ID NO: 1714806 - protein, 17 aa, Staphylococcus aureus
LLISVIILTIFIMGCDS

SEQ ID NO: 1714807 - protein, 18 aa, Staphylococcus aureus
LNASSDFGNAHFVVLSKY

SEQ ID NO: 1714808 - protein, 18 aa, Staphylococcus aureus
LNTAMGQLQHGIDDENAT

SEQ ID NO: 1714809 - protein, 24 aa, Staphylococcus aureus
LQALAKEKEKALAAIDQAQTNSQV

SEQ ID NO: 1714810 - protein, 33 aa, Staphylococcus aureus; identical to SEQ ID NO: 1594626

SEQ ID NO: 1714811 - protein, 20 aa, Staphylococcus aureus
LSNGSAIPDATITWVSGQAP

SEQ ID NO: 1714812 - protein, 21 aa, Staphylococcus aureus
LVSTLVLSACGNDENQEESKK

SEQ ID NO: 1714813 - protein, 18 aa, Staphylococcus aureus
MGNIKSFALYISILLLIV

SEQ ID NO: 1714814 - protein, 37 aa, Staphylococcus aureus
MPDKILDLRYKLRVNNVPTPRTVTFNETLTYKTYTQD

SEQ ID NO: 1714815 - protein, 22 aa, Staphylococcus aureus
NAVNEKAREAITNINATPGATR

SEQ ID NO: 1714816 - protein, 38 aa, Staphylococcus aureus
NDAITDARGIYQLKDGYKYYSFVDSIGLHSGSHVFVER

SEQ ID NO: 1714817 - protein, 23 aa, Staphylococcus aureus
NGEYGREVLKMYADNKTINSDKL

SEQ ID NO: 1714818 - protein, 18 aa, Staphylococcus aureus
NKTQCSYGGVTLSDNNKY

SEQ ID NO: 1714819 - protein, 17 aa, Staphylococcus aureus
NTEVLKFASGAQVNDRL

SEQ ID NO: 1714820 - protein, 20 aa, Staphylococcus aureus
NVPLNKRVSQAYIDSLTNQM

SEQ ID NO: 1714821 - protein, 25 aa, Staphylococcus aureus
PATKAFGRQTFEYINGERPTESPGV

SEQ ID NO: 1714822 - protein, 19 aa, Staphylococcus aureus
PDATITWVSGQAPNKNNTT

SEQ ID NO: 1714823 - protein, 17 aa, Staphylococcus aureus
PILDRFNPFLKTEYSYA

SEQ ID NO: 1714824 - protein, 25 aa, Staphylococcus aureus
PITKTATYKVVRTVPKQVFETARGV

SEQ ID NO: 1714825 - protein, 17 aa, Staphylococcus aureus
PNSAITITPKAGTGHSA

SEQ ID NO: 1714826 - protein, 20 aa, Staphylococcus aureus
PTPIELPLKVKVHGKDSPLK

SEQ ID NO: 1714827 - protein, 24 aa, Staphylococcus aureus
PVGNQIRALIFYNNVVASNMSNAV

SEQ ID NO: 1714828 - protein, 18 aa, Staphylococcus aureus
PWVKEASAANVAGIAGTN

SEQ ID NO: 1714829 - protein, 24 aa, Staphylococcus aureus
QDGKRPEKVSVNLLANGEKVETVD

SEQ ID NO: 1714830 - protein, 23 aa, Staphylococcus aureus
QELNGDERLRVAKQNANTAIDAL

SEQ ID NO: 1714831 - protein, 19 aa, Staphylococcus aureus
QLKIKPGHFSYHEMSPAEM

SEQ ID NO: 1714832 - protein, 36 aa, Staphylococcus aureus; identical to SEQ ID NO: 1671880

SEQ ID NO: 1714833 - protein, 18 aa, Staphylococcus aureus
RKHAVLVKKYSRKMSNAI

SEQ ID NO: 1714834 - protein, 19 aa, Staphylococcus aureus
RPTSIPTLAPKEEKETNIK

SEQ ID NO: 1714835 - protein, 25 aa, Staphylococcus aureus
SANAIIQKPIRSVQEVQTALTNVNR

SEQ ID NO: 1714836 - protein, 25 aa, Staphylococcus aureus
SANTNAFRPGGVNPLNEYQLSQLFT

SEQ ID NO: 1714837 - protein, 27 aa, Staphylococcus aureus
SIGILSISIGMFLALGMSNKAYADEID

SEQ ID NO: 1714838 - protein, 24 aa, Staphylococcus aureus
SIGLHSGSHVFVERRTMDPTATNN

SEQ ID NO: 1714839 - protein, 23 aa, Staphylococcus aureus
SKKFINKDIDIFAGNYGYGCHGG

SEQ ID NO: 1714840 - protein, 26 aa, Staphylococcus aureus
SNDAKAFFSYEWKGLEIAKKLADQAK

SEQ ID NO: 1714841 - protein, 34 aa, Staphylococcus aureus
SNLNNMNFLRWVNFPQDYTVTWTNAKIANRPTDG

SEQ ID NO: 1714842 - protein, 21 aa, Staphylococcus aureus
TIEALEYMNSYLFKQLVKNNG

SEQ ID NO: 1714843 - protein, 17 aa, Staphylococcus aureus
TKNSAQFEKMVILTENK

SEQ ID NO: 1714844 - protein, 18 aa, Staphylococcus aureus
TLGICLVLLIILIVGYVI

SEQ ID NO: 1714845 - protein, 25 aa, Staphylococcus aureus
TQPHFSLSGKWLWQKPNGSIHATLQ

SEQ ID NO: 1714846 - protein, 30 aa, Staphylococcus aureus; identical to SEQ ID NO: 1577286

SEQ ID NO: 1714847 - protein, 30 aa, Staphylococcus aureus
TVPKQVFETARGVLYPGVSDMYDAKQYVKP

SEQ ID NO: 1714848 - protein, 26 aa, Staphylococcus aureus
VGLNAKYYRGDEVSFTMGVSDRHSGL

SEQ ID NO: 1714849 - protein, 17 aa, Staphylococcus aureus
VKLLECIIEEDKDMMKK

SEQ ID NO: 1714850 - protein, 17 aa, Staphylococcus aureus
VLLFCYSQNHIATANVG

SEQ ID NO: 1714851 - protein, 18 aa, Staphylococcus aureus
VLYPGLSKDVFKTKKDEV

SEQ ID NO: 1714852 - protein, 17 aa, Staphylococcus aureus
VSDRNKADALKAITALK

SEQ ID NO: 1714853 - protein, 19 aa, Staphylococcus aureus
VTADMKRLSGTTTLDNEIL

SEQ ID NO: 1714854 - protein, 21 aa, Staphylococcus aureus
VVNDKAREAITNINATTGATR

SEQ ID NO: 1714855 - protein, 17 aa, Staphylococcus aureus
WWDYEIGTPKSLTNTLI

SEQ ID NO: 1714856 - protein, 18 aa, Staphylococcus aureus
YEIGTPKSLTNTLILLND

SEQ ID NO: 1714857 - protein, 33 aa, Staphylococcus aureus
YKIRNRSGQVIYDWPTVHINSLKDLARASDYFS

SEQ ID NO: 1714858 - protein, 17 aa, Staphylococcus aureus
YLNSALYYLEDYIIYAI

SEQ ID NO: 1714859 - protein, 17 aa, Staphylococcus aureus
YNLPTTPWNTLKASDAK

SEQ ID NO: 1714860 - protein, 23 aa, Staphylococcus aureus
YQAQGNVIALGRIHGTDTNDHGD

SEQ ID NO: 1714861 - protein, 20 aa, Staphylococcus aureus
YSGLCNTKYMYGGITLANQN

SEQ ID NO: 1714862 - protein, 19 aa, Staphylococcus aureus
YTFELNKKLQTHRMGDVID

SEQ ID NO: 1714863 - protein, 27 aa, Staphylococcus aureus
AKEIARTDLGRYFDRFADKLDKTQTNA

SEQ ID NO: 1714864 - protein, 27 aa, Staphylococcus aureus
AKGDGLNAINPIAPVTVVKQAARDAVS

SEQ ID NO: 1714865 - protein, 21 aa, Staphylococcus aureus
ANGAGAFTIDHVVKNNSTHNA

SEQ ID NO: 1714866 - protein, 20 aa, Staphylococcus aureus
ARQGLTLDRQPAFTTLHGAS

SEQ ID NO: 1714867 - protein, 21 aa, Staphylococcus aureus
ASVIVSTLFLITSQHQAQAAE

SEQ ID NO: 1714868 - protein, 21 aa, Staphylococcus aureus
DAIEFAKKHRKEFEKVGEQFF

SEQ ID NO: 1714869 - protein, 17 aa, Staphylococcus aureus
DDIPPTINNPVGLNAKY

SEQ ID NO: 1714870 - protein, 17 aa, Staphylococcus aureus
DFKLRKYLIDNYGLYGE

SEQ ID NO: 1714871 - protein, 19 aa, Staphylococcus aureus
DITRIASSNAQMWKDITLS

SEQ ID NO: 1714872 - protein, 32 aa, Staphylococcus aureus
DQFLQHTILFKGFFTDHSWYNDLLVDFDSKDI

SEQ ID NO: 1714873 - protein, 24 aa, Staphylococcus aureus
EHDIGPREQVNFQLLDKNNETQYY

SEQ ID NO: 1714874 - protein, 19 aa, Staphylococcus aureus
ELKNLDGLYRQKVTDKGVY

SEQ ID NO: 1714875 - protein, 19 aa, Staphylococcus aureus
EVIDLGDKLQFERMGDVLN

SEQ ID NO: 1714876 - protein, 18 aa, Staphylococcus aureus
FIDRENADSGTFNYVKGI

SEQ ID NO: 1714877 - protein, 25 aa, Staphylococcus aureus
FINANRDAISFAEGDISVTNTPNGS

SEQ ID NO: 1714878 - protein, 24 aa, Staphylococcus aureus
FKIRKHLIDHYGLYGEMSSGTVTV

SEQ ID NO: 1714879 - protein, 17 aa, Staphylococcus aureus
GDVISLVPQNKVKQTKA

SEQ ID NO: 1714880 - protein, 19 aa, Staphylococcus aureus
GKEEEARAGASAVPGANIN

SEQ ID NO: 1714881 - protein, 18 aa, Staphylococcus aureus
GLTPDLAPLQAAKTQLQN

SEQ ID NO: 1714882 - protein, 17 aa, Staphylococcus aureus
GSSVGYKEIEFIFIENK

SEQ ID NO: 1714883 - protein, 25 aa, Staphylococcus aureus
HKAHGGEISPLFTGGHNNMVASITT

SEQ ID NO: 1714884 - protein, 20 aa, Staphylococcus aureus
HSGLKSTTITTLPSGWTSNL

SEQ ID NO: 1714885 - protein, 26 aa, Staphylococcus aureus
IDLSEKLSFERMFDVMDSKQIKNIEV

SEQ ID NO: 1714886 - protein, 18 aa, Staphylococcus aureus
ITRIASSNAQMWKDITLS

SEQ ID NO: 1714887 - protein, 23 aa, Staphylococcus aureus
KAFSHKFFVSKTWINNAPTKEDI

SEQ ID NO: 1714888 - protein, 22 aa, Staphylococcus aureus
KDAIEFAKKHRKEFEKVGEQFF

SEQ ID NO: 1714889 - protein, 23 aa, Staphylococcus aureus
KEKEIPNGIDLSIKFSDNKINTV

SEQ ID NO: 1714890 - protein, 40 aa, Staphylococcus aureus
KNSALEQLKAQRINPEVKKNALEAIREVVNKQIEIIKNAD

SEQ ID NO: 1714891 - protein, 17 aa, Staphylococcus aureus
KNTDHIKAMRWPFQYNI

SEQ ID NO: 1714892 - protein, 17 aa, Staphylococcus aureus
KPLIFKTKVTSLEDIDK

SEQ ID NO: 1714893 - protein, 26 aa, Staphylococcus aureus
KRVNKLVLGISLLFLVISITAGCGMG

SEQ ID NO: 1714894 - protein, 31 aa, Staphylococcus aureus
KSDRGISDIDLRLSKQAKYTVYFKNGTKKVI

SEQ ID NO: 1714895 - protein, 22 aa, Staphylococcus aureus
KVIDLKAGIYTADLINTSEIKA

SEQ ID NO: 1714896 - protein, 19 aa, Staphylococcus aureus
LIESQCEVIALDATLQQRP

SEQ ID NO: 1714897 - protein, 20 aa, Staphylococcus aureus
LKELDFKLRKQLIEQHNLYG

SEQ ID NO: 1714898 - protein, 19 aa, Staphylococcus aureus
LKYAKKAYYTVYFKNGGKR

SEQ ID NO: 1714899 - protein, 21 aa, Staphylococcus aureus
LPTDGFTYKWNNAATGTNDAN

SEQ ID NO: 1714900 - protein, 25 aa, Staphylococcus aureus
LSDLKFTGDPRVGYKDISKKVKSVL

SEQ ID NO: 1714901 - protein, 17 aa, Staphylococcus aureus
LVIKRNGNVVTTFTRHN

SEQ ID NO: 1714902 - protein, 18 aa, Staphylococcus aureus
MVFIMLLNIITPLFNKNE

SEQ ID NO: 1714903 - protein, 18 aa, Staphylococcus aureus
NEAINIYFVPSDLVNPTI

SEQ ID NO: 1714904 - protein, 17 aa, Staphylococcus aureus
NERIKKEMIDDLNSIID

SEQ ID NO: 1714905 - protein, 19 aa, Staphylococcus aureus
NESTLHLSFEKGIKGTVDK

SEQ ID NO: 1714906 - protein, 17 aa, Staphylococcus aureus
NGLRQVVNRTYRIGTTK

SEQ ID NO: 1714907 - protein, 23 aa, Staphylococcus aureus
NTLKNRALNDIGVTSTTAMVNSI

SEQ ID NO: 1714908 - protein, 20 aa, Staphylococcus aureus
PRNIPINLWVNGKQNTISTD

SEQ ID NO: 1714909 - protein, 18 aa, Staphylococcus aureus
PTNSGLYTTVYDKTGKAT

SEQ ID NO: 1714910 - protein, 18 aa, Staphylococcus aureus
QNATGLPTDGFTYKWNNA

SEQ ID NO: 1714911 - protein, 17 aa, Staphylococcus aureus
QTQIIKILSKVKPDPPR

SEQ ID NO: 1714912 - protein, 17 aa, Staphylococcus aureus
QYHVGHIQQIRQIQAHI

SEQ ID NO: 1714913 - protein, 39 aa, Staphylococcus aureus; identical to SEQ ID NO: 1672034

SEQ ID NO: 1714914 - protein, 27 aa, Staphylococcus aureus
RGTFLMTKMMLPLMMTKGGSIVNTSSF

SEQ ID NO: 1714915 - protein, 23 aa, Staphylococcus aureus
RNDYKARGVNEYQTLNYKTNLER

SEQ ID NO: 1714916 - protein, 32 aa, Staphylococcus aureus
RQKVTDKGVYVWKDRKDYFVGLLGKDIEKYPQ

SEQ ID NO: 1714917 - protein, 20 aa, Staphylococcus aureus
SFTAGCGIGKEAEVKKSFEK

SEQ ID NO: 1714918 - protein, 18 aa, Staphylococcus aureus
SIAALTILTSVTGVGTTI

SEQ ID NO: 1714919 - protein, 20 aa, Staphylococcus aureus
SNIESKIFIKGYTITNKSVT

SEQ ID NO: 1714920 - protein, 27 aa, Staphylococcus aureus
SYSPVPEDHAYIRFPVSDGTQELKIVS

SEQ ID NO: 1714921 - protein, 23 aa, Staphylococcus aureus
TADPFSVAVEMNKDALQQQVNSQ

SEQ ID NO: 1714922 - protein, 19 aa, Staphylococcus aureus
TDANGIANIKALPSGDYIL

SEQ ID NO: 1714923 - protein, 27 aa, Staphylococcus aureus
TDIPLDPSALVYLVIPTSQTRDGGSEA

SEQ ID NO: 1714924 - protein, 18 aa, Staphylococcus aureus
TLKELIEASMTYSDNTAN

SEQ ID NO: 1714925 - protein, 17 aa, Staphylococcus aureus
TLLKATTTVPGLRNNIA

SEQ ID NO: 1714926 - protein, 17 aa, Staphylococcus aureus
TTTVPGLRNNIAGNEKA

SEQ ID NO: 1714927 - protein, 20 aa, Staphylococcus aureus
VKTPSNKVLGFYPTSANTNA

SEQ ID NO: 1714928 - protein, 27 aa, Staphylococcus aureus
YTVGTFSTVIATLVFLGLNTSQAQAAE

SEQ ID NO: 1714929 - protein, 17 aa, Staphylococcus aureus
YTYVIKNGNGYYYVTPN

SEQ ID NO: 1714930 - protein, 21 aa, Staphylococcus aureus
AAKRVPVTVNVYQFEFPQTSY

SEQ ID NO: 1714931 - protein, 21 aa, Staphylococcus aureus
AKVKDRISVIGYPKGAQTKYK

SEQ ID NO: 1714932 - protein, 18 aa, Staphylococcus aureus
ANQAIEVKAEDTKESIDQ

SEQ ID NO: 1714933 - protein, 24 aa, Staphylococcus aureus
AVYKAQLYLSSYGPKQYVEHLNQN

SEQ ID NO: 1714934 - protein, 22 aa, Staphylococcus aureus
CDLELNKLENQILMLGKTFYQN

SEQ ID NO: 1714935 - protein, 26 aa, Staphylococcus aureus
CKGSFLIDSMAGFLLIGLITLLLIPM

SEQ ID NO: 1714936 - protein, 17 aa, Staphylococcus aureus
CKTKYMYGGATLSGQYL

SEQ ID NO: 1714937 - protein, 23 aa, Staphylococcus aureus
DDMSMMVGIVLSGFEYRAQKEKY

SEQ ID NO: 1714938 - protein, 23 aa, Staphylococcus aureus
DFKIRKLLIKKYKLYEGSADKGR

SEQ ID NO: 1714939 - protein, 19 aa, Staphylococcus aureus
DGAMQRLQSAIANKDQTKA

SEQ ID NO: 1714940 - protein, 17 aa, Staphylococcus aureus
DIFTPNLFSAKDIKKID

SEQ ID NO: 1714941 - protein, 19 aa, Staphylococcus aureus
DKEGYRDGEFEKGDKGMWV

SEQ ID NO: 1714942 - protein, 19 aa, Staphylococcus aureus
DLDHARQALTPDKAPLQTA

SEQ ID NO: 1714943 - protein, 26 aa, Staphylococcus aureus
DLSEYYKGRGFELTNVTGYKYGNKVT

SEQ ID NO: 1714944 - protein, 18 aa, Staphylococcus aureus
DMTPKYEDLRAYYTKPSF

SEQ ID NO: 1714945 - protein, 22 aa, Staphylococcus aureus
DRNELQAFFDANYHDYRFIDRE

SEQ ID NO: 1714946 - protein, 37 aa, Staphylococcus aureus; identical to SEQ ID NO: 1577650

SEQ ID NO: 1714947 - protein, 17 aa, Staphylococcus aureus
EAGATPATKAFGRQTFE

SEQ ID NO: 1714948 - protein, 24 aa, Staphylococcus aureus
EAVRKIMFALNRFMGNKYSNIDLG

SEQ ID NO: 1714949 - protein, 17 aa, Staphylococcus aureus
EELRKQLKIKPGHFSYH

SEQ ID NO: 1714950 - protein, 23 aa, Staphylococcus aureus
EEVAEADAAVDAAQKQGLHDIQV

SEQ ID NO: 1714951 - protein, 20 aa, Staphylococcus aureus
EGKSKFVVHYKRSMDEFKID

SEQ ID NO: 1714952 - protein, 19 aa, Staphylococcus aureus
EIGSTWGNANNWAAAAQGA

SEQ ID NO: 1714953 - protein, 18 aa, Staphylococcus aureus
ELDYRLRERAIKQHGLYS

SEQ ID NO: 1714954 - protein, 19 aa, Staphylococcus aureus
FKKEFKPVMHLKGDAFNQQ

SEQ ID NO: 1714955 - protein, 31 aa, Staphylococcus aureus
GDNAPALYPNYWGGNKFKVIEELRKQGYNVH

SEQ ID NO: 1714956 - protein, 19 aa, Staphylococcus aureus
GESLWSIAQKYNTSVESIK

SEQ ID NO: 1714957 - protein, 19 aa, Staphylococcus aureus
GFDGVLIPGGFSFGDYLRS

SEQ ID NO: 1714958 - protein, 30 aa, Staphylococcus aureus
GLASLDVVRYVAAHHPKLPITMTSRSANLP

SEQ ID NO: 1714959 - protein, 19 aa, Staphylococcus aureus
GVVSVLAATMFVVSSHEAQ

SEQ ID NO: 1714960 - protein, 21 aa, Staphylococcus aureus
GYENPDLGTFFLMATTSRIIG

SEQ ID NO: 1714961 - protein, 17 aa, Staphylococcus aureus
GYRKLEIDFSKRENSKL

SEQ ID NO: 1714962 - protein, 18 aa, Staphylococcus aureus
GYYGHVMFVERVNNDGSI

SEQ ID NO: 1714963 - protein, 22 aa, Staphylococcus aureus
HESIGYLADCYGFVQKGIQNMN

SEQ ID NO: 1714964 - protein, 17 aa, Staphylococcus aureus
HIDGDLKGSSVGYRKLE

SEQ ID NO: 1714965 - protein, 18 aa, Staphylococcus aureus
HPMGGIQIIPETNQVISP

SEQ ID NO: 1714966 - protein, 18 aa, Staphylococcus aureus
IAIRGRIPVQLARKKFPY

SEQ ID NO: 1714967 - protein, 18 aa, Staphylococcus aureus
IKNLEDFYGKEGYRDGEF

SEQ ID NO: 1714968 - protein, 23 aa, Staphylococcus aureus
KDKKGNDVVLVYKKVKDGFDVQV

SEQ ID NO: 1714969 - protein, 25 aa, Staphylococcus aureus
KEEFEAFKKRSPKYNPGMNNHDETD

SEQ ID NO: 1714970 - protein, 17 aa, Staphylococcus aureus
KNLDDFYDKEGFRDQEF

SEQ ID NO: 1714971 - protein, 21 aa, Staphylococcus aureus
KSRRIPINLWVNGEHQTISTD

SEQ ID NO: 1714972 - protein, 21 aa, Staphylococcus aureus
LCISLLILSIFVTSCDGDNKI

SEQ ID NO: 1714973 - protein, 20 aa, Staphylococcus aureus
LDMYPIKNLEDFYGKEGYRD

SEQ ID NO: 1714974 - protein, 17 aa, Staphylococcus aureus
LKAAKKGSMVYFKVGNE

SEQ ID NO: 1714975 - protein, 23 aa, Staphylococcus aureus
LKPLEQRERANVILPNNDRHQIT

SEQ ID NO: 1714976 - protein, 17 aa, Staphylococcus aureus
LKVKGMVLYMNRNTKTT

SEQ ID NO: 1714977 - protein, 23 aa, Staphylococcus aureus
LMAANNLRGYLIMPNQTLQIPNG

SEQ ID NO: 1714978 - protein, 17 aa, Staphylococcus aureus
LRKRYDIPTNKAPKLLL

SEQ ID NO: 1714979 - protein, 18 aa, Staphylococcus aureus
LTLSHWFKSKEQVHTNQK

SEQ ID NO: 1714980 - protein, 18 aa, Staphylococcus aureus
LYISVMILMFAIAGCGKG

SEQ ID NO: 1714981 - protein, 18 aa, Staphylococcus aureus
MESRGMVLYINRNTRTTK

SEQ ID NO: 1714982 - protein, 18 aa, Staphylococcus aureus
MHIDGDLKGSSVGYKKLE

SEQ ID NO: 1714983 - protein, 17 aa, Staphylococcus aureus
NAKQAIRDKAAKQREII

SEQ ID NO: 1714984 - protein, 27 aa, Staphylococcus aureus
NANTNAFRPGGVQELNEYQLSQLFTDQ

SEQ ID NO: 1714985 - protein, 17 aa, Staphylococcus aureus
NEKRYPVKMVDNKIIPT

SEQ ID NO: 1714986 - protein, 17 aa, Staphylococcus aureus
NKHHMYQSTGTVLSING

SEQ ID NO: 1714987 - protein, 17 aa, Staphylococcus aureus
NLKEYRKYYEPLIHKKD

SEQ ID NO: 1714988 - protein, 17 aa, Staphylococcus aureus
NLKEYRKYYEPLIHKND

SEQ ID NO: 1714989 - protein, 21 aa, Staphylococcus aureus
NLYTWGQCTYHVFNRRAEIGK

SEQ ID NO: 1714990 - protein, 28 aa, Staphylococcus aureus
NRKGMIPNRLNKFSIRKYSVGTASILVG

SEQ ID NO: 1714991 - protein, 17 aa, Staphylococcus aureus
PAPYKNKHHMYQSTGTV

SEQ ID NO: 1714992 - protein, 42 aa, Staphylococcus aureus; identical to SEQ ID NO: 1671425

SEQ ID NO: 1714993 - protein, 22 aa, Staphylococcus aureus
PLDTLVSLFLKECAEYDIDFKK

SEQ ID NO: 1714994 - protein, 26 aa, Staphylococcus aureus
PVVKPNAKKAIRDKATKQREIINATP

SEQ ID NO: 1714995 - protein, 28 aa, Staphylococcus aureus
QRLNGLRQVVNRTYRIGTTKRVEVSQGN

SEQ ID NO: 1714996 - protein, 17 aa, Staphylococcus aureus
QSGESLWSIAQKYNTSV

SEQ ID NO: 1714997 - protein, 21 aa, Staphylococcus aureus
QTYAKFKAIATPEQLAKVKVL

SEQ ID NO: 1714998 - protein, 17 aa, Staphylococcus aureus
RDNEKRYPVKMVDNKII

SEQ ID NO: 1714999 - protein, 26 aa, Staphylococcus aureus
RLATEGKPVLGVCNGFQILTEIGLLP

SEQ ID NO: 1715000 - protein, 22 aa, Staphylococcus aureus
SGLRILDPNGYWNSTLRWPGSY

SEQ ID NO: 1715001 - protein, 19 aa, Staphylococcus aureus
SIHSNLKFESHRNETNASW

SEQ ID NO: 1715002 - protein, 23 aa, Staphylococcus aureus
SQLDKAKSIGIINEKCLNYSEAI

SEQ ID NO: 1715003 - protein, 25 aa, Staphylococcus aureus
SSQERKTNWVKCGLGTVGGAGTGGL

SEQ ID NO: 1715004 - protein, 21 aa, Staphylococcus aureus
SVGYKRLEIDFSKEGRDISVI

SEQ ID NO: 1715005 - protein, 23 aa, Staphylococcus aureus
SVQWGIKANSFITSLGKMSGHDP

SEQ ID NO: 1715006 - protein, 25 aa, Staphylococcus aureus
TVPVKHVIPEIVAHSHYTVQGQDFP

SEQ ID NO: 1715007 - protein, 19 aa, Staphylococcus aureus
VAAHHPKLPITMTSRSAHL

SEQ ID NO: 1715008 - protein, 18 aa, Staphylococcus aureus
VEAAKKAAIAKIEAIQPA

SEQ ID NO: 1715009 - protein, 17 aa, Staphylococcus aureus
VIWEWDVTIKVTTNKGI

SEQ ID NO: 1715010 - protein, 17 aa, Staphylococcus aureus
VKPEAQEAIKASADNQV

SEQ ID NO: 1715011 - protein, 17 aa, Staphylococcus aureus
VLIPGGFSFGDYLRSGA

SEQ ID NO: 1715012 - protein, 24 aa, Staphylococcus aureus
VTVSEGFNPEFLAVMSHDKKDEGK

SEQ ID NO: 1715013 - protein, 21 aa, Staphylococcus aureus
WKKLTDKLKEKQIVKNGDTVT

SEQ ID NO: 1715014 - protein, 23 aa, Staphylococcus aureus
YKGQPMTFRLLLVDTPETKHPKK

SEQ ID NO: 1715015 - protein, 21 aa, Staphylococcus aureus
YNDGEVIIMTYMPFKDSNTKV

SEQ ID NO: 1715016 - protein, 19 aa, Staphylococcus aureus
YNGPCKTKYMYGGATLSGQ

SEQ ID NO: 1715017 - protein, 18 aa, Staphylococcus aureus
YRKYYEPLIHKKDKEFKE

SEQ ID NO: 1715018 - protein, 18 aa, Staphylococcus aureus
YRKYYEPLIHKNDKEFKE

SEQ ID NO: 1715019 - protein, 50 aa, Staphylococcus aureus
YYTKPSLEFEKQFGFMLKPWTTVRFMNVIPDWFIYKIALVGKDDKKYKDG

SEQ ID NO: 1715020 - protein, 17 aa, Staphylococcus aureus
ADTKSKVLDKINAIQTQ

SEQ ID NO: 1715021 - protein, 31 aa, Staphylococcus aureus
AITKKGMISNRLNKFSIRKYTVGTASILVGT

SEQ ID NO: 1715022 - protein, 24 aa, Staphylococcus aureus
AKDLVLKAKEKAYQDILNAQTTND

SEQ ID NO: 1715023 - protein, 20 aa, Staphylococcus aureus
AKKAAIAKIEAIQPATTTKD

SEQ ID NO: 1715024 - protein, 18 aa, Staphylococcus aureus
ALDQARNGLTVDKAPLEN

SEQ ID NO: 1715025 - protein, 17 aa, Staphylococcus aureus
AQQAIKASAENQVESIK

SEQ ID NO: 1715026 - protein, 20 aa, Staphylococcus aureus
ARQGLTLDRQPALTTLHGAS

SEQ ID NO: 1715027 - protein, 24 aa, Staphylococcus aureus
ATKAFGRQNFEYINGQKPAESPGV

SEQ ID NO: 1715028 - protein, 18 aa, Staphylococcus aureus
DKEGYRDGEFEKGDKGTW

SEQ ID NO: 1715029 - protein, 23 aa, Staphylococcus aureus
DKGTWLIRSEMKIQLKGENLESR

SEQ ID NO: 1715030 - protein, 19 aa, Staphylococcus aureus
DKPELVAIAEQASNRPKKR

SEQ ID NO: 1715031 - protein, 18 aa, Staphylococcus aureus
DLKSYRLARDIKNQIEDE

SEQ ID NO: 1715032 - protein, 18 aa, Staphylococcus aureus
DMNYSVKISNFIAKDLDQ

SEQ ID NO: 1715033 - protein, 18 aa, Staphylococcus aureus
EFYKGNFSNTLGYNGNLL

SEQ ID NO: 1715034 - protein, 21 aa, Staphylococcus aureus
ENNQKLPVRLVSYSPVPEDHA

SEQ ID NO: 1715035 - protein, 19 aa, Staphylococcus aureus
EPGKKVHLVGHSMGGQTIR

SEQ ID NO: 1715036 - protein, 23 aa, Staphylococcus aureus
EREHRRKGSIFMDFRNELKNLNH

SEQ ID NO: 1715037 - protein, 27 aa, Staphylococcus aureus
ERIEKAPNLKLAITAGVGSDHVDLAAA

SEQ ID NO: 1715038 - protein, 23 aa, Staphylococcus aureus
EYIVELYDGVYLQEEYTGAFSKM

SEQ ID NO: 1715039 - protein, 20 aa, Staphylococcus aureus
FHWHGLEIDGKVDGGPSQVI

SEQ ID NO: 1715040 - protein, 17 aa, Staphylococcus aureus
FKLRKQLIEKNNLYGNV

SEQ ID NO: 1715041 - protein, 26 aa, Staphylococcus aureus
FSKQAGHPVFYVYAGNQGNASVNLGG

SEQ ID NO: 1715042 - protein, 18 aa, Staphylococcus aureus
GGRVDYGAAHAAKYGHER

SEQ ID NO: 1715043 - protein, 26 aa, Staphylococcus aureus
GHNAKELRAKLDIILGDAKDPVRITN

SEQ ID NO: 1715044 - protein, 32 aa, Staphylococcus aureus
GKAFACSMAGLYACAHYCGVWAIVNPIAGGVC

SEQ ID NO: 1715045 - protein, 18 aa, Staphylococcus aureus
GKIRLRLLNGSNARDLNL

SEQ ID NO: 1715046 - protein, 22 aa, Staphylococcus aureus
GTWVIRSEMKIQLKGENLESRG

SEQ ID NO: 1715047 - protein, 20 aa, Staphylococcus aureus
GYGLPESFLKIYKDNKTVDS

SEQ ID NO: 1715048 - protein, 23 aa, Staphylococcus aureus
HDRNELQAFFDANYHDYRFIDRE

SEQ ID NO: 1715049 - protein, 24 aa, Staphylococcus aureus
HKDTEDFYISLKIVDVKQPEGDQR

SEQ ID NO: 1715050 - protein, 17 aa, Staphylococcus aureus
HTHYFYNCYPKNANANG

SEQ ID NO: 1715051 - protein, 23 aa, Staphylococcus aureus
IASSLSCVLLLLSAANTEANSAN

SEQ ID NO: 1715052 - protein, 18 aa, Staphylococcus aureus
IISLFLLVFSANFSNAYA

SEQ ID NO: 1715053 - protein, 22 aa, Staphylococcus aureus
IKRIKDNILNFDAYIEPGNSGS

SEQ ID NO: 1715054 - protein, 26 aa, Staphylococcus aureus
IQNPPHGATVAWHDSPDTWKNTVGNT

SEQ ID NO: 1715055 - protein, 33 aa, Staphylococcus aureus
KEGDTFTFKYGQYFRPGSVRLPSQTQNLYNAQG

SEQ ID NO: 1715056 - protein, 17 aa, Staphylococcus aureus
KEKTIKFEVKQEAATLW

SEQ ID NO: 1715057 - protein, 18 aa, Staphylococcus aureus
KIDAEFLSGRVLKYKPNL

SEQ ID NO: 1715058 - protein, 19 aa, Staphylococcus aureus
KLVKETREAIANADESWKT

SEQ ID NO: 1715059 - protein, 20 aa, Staphylococcus aureus
KNTGTYMFHCHILEHEDNGM

SEQ ID NO: 1715060 - protein, 20 aa, Staphylococcus aureus
KPLEQREHANVILPNNDRHQ

SEQ ID NO: 1715061 - protein, 19 aa, Staphylococcus aureus
KVSNRNKADALKAITALKL

SEQ ID NO: 1715062 - protein, 18 aa, Staphylococcus aureus
LENQVLMIGYTFYHSNKN

SEQ ID NO: 1715063 - protein, 17 aa, Staphylococcus aureus
LITLFSIMFMVPNDTFA

SEQ ID NO: 1715064 - protein, 17 aa, Staphylococcus aureus
LKLSNNQSFEYIASEGG

SEQ ID NO: 1715065 - protein, 17 aa, Staphylococcus aureus
LNGKRSTTITSDKYEEN

SEQ ID NO: 1715066 - protein, 23 aa, Staphylococcus aureus
LNNEPSFTYDLFYTGTGQAESFL

SEQ ID NO: 1715067 - protein, 24 aa, Staphylococcus aureus
LNTAMGNLKHALAEKDNTKRSVNY

SEQ ID NO: 1715068 - protein, 25 aa, Staphylococcus aureus
LPDDIPPTINNPVGLNAKYYRGDEV

SEQ ID NO: 1715069 - protein, 17 aa, Staphylococcus aureus
LRDKYRVGTSSTAANPV

SEQ ID NO: 1715070 - protein, 17 aa, Staphylococcus aureus
LSNNQSFEYIASEGGHL

SEQ ID NO: 1715071 - protein, 25 aa, Staphylococcus aureus
LSPYTRQRLGNVIKQGARIEMNVHY

SEQ ID NO: 1715072 - protein, 17 aa, Staphylococcus aureus
LSVALLYSCSKQNEKAQ

SEQ ID NO: 1715073 - protein, 19 aa, Staphylococcus aureus
MKHPFHIHGTQFKVLSVDG

SEQ ID NO: 1715074 - protein, 29 aa, Staphylococcus aureus
NAKTGKYELGEAFKIYKFNGEEDNSYYYP

SEQ ID NO: 1715075 - protein, 25 aa, Staphylococcus aureus
NELLSPRYVEFPIKPGTTLTKEKIE

SEQ ID NO: 1715076 - protein, 17 aa, Staphylococcus aureus
NGALYHRLKEVDLNDVL

SEQ ID NO: 1715077 - protein, 17 aa, Staphylococcus aureus
NGGKYTFELHKKLQEHR

SEQ ID NO: 1715078 - protein, 27 aa, Staphylococcus aureus
NKLDSPRIIPINLIINGKHQTVTTKSV

SEQ ID NO: 1715079 - protein, 25 aa, Staphylococcus aureus
NLAPSARKEIVIDLSKMKEEKVNLV

SEQ ID NO: 1715080 - protein, 19 aa, Staphylococcus aureus
NNEANKFGSNNKVYNDYSI

SEQ ID NO: 1715081 - protein, 18 aa, Staphylococcus aureus
NPSGHLINPTQAMDIAYT

SEQ ID NO: 1715082 - protein, 23 aa, Staphylococcus aureus
NRPVTYAGFKWNGKAFACSMAGL

SEQ ID NO: 1715083 - protein, 24 aa, Staphylococcus aureus
NTLNTAMGALRTSIQNDNTTKTSQ

SEQ ID NO: 1715084 - protein, 21 aa, Staphylococcus aureus
PKYEDLRAYYTKPSFEFEKQF

SEQ ID NO: 1715085 - protein, 17 aa, Staphylococcus aureus
PNQFILLTIDKKDVSSV

SEQ ID NO: 1715086 - protein, 17 aa, Staphylococcus aureus
PSGHLINPTQAMDIAYT

SEQ ID NO: 1715087 - protein, 17 aa, Staphylococcus aureus
PSIELKNLDGLYRQKVT

SEQ ID NO: 1715088 - protein, 29 aa, Staphylococcus aureus
PTVNVVNNLPGFTLINGGKVGVFSHAMVR

SEQ ID NO: 1715089 - protein, 24 aa, Staphylococcus aureus
QATTKIWQNGHIDITPNNPSGHLI

SEQ ID NO: 1715090 - protein, 17 aa, Staphylococcus aureus
QDGTVSYGARPTQNKPS

SEQ ID NO: 1715091 - protein, 17 aa, Staphylococcus aureus
QEAATLWYHPHPSPNTA

SEQ ID NO: 1715092 - protein, 17 aa, Staphylococcus aureus
QFILLTIDKKDVSSVED

SEQ ID NO: 1715093 - protein, 17 aa, Staphylococcus aureus
QGLTLDRQPALTTLHGA

SEQ ID NO: 1715094 - protein, 19 aa, Staphylococcus aureus
QHMNFQFVGTYGPNKDVVG

SEQ ID NO: 1715095 - protein, 24 aa, Staphylococcus aureus
RAKDGHTISTFWGDAKNWEGQASS

SEQ ID NO: 1715096 - protein, 26 aa, Staphylococcus aureus
SANAIIQKPIRTVQEVQSALTNVNRV

SEQ ID NO: 1715097 - protein, 20 aa, Staphylococcus aureus
SFYYKCEKISENISECLYGG

SEQ ID NO: 1715098 - protein, 17 aa, Staphylococcus aureus
SKDNGFYDLTREGATDL

SEQ ID NO: 1715099 - protein, 20 aa, Staphylococcus aureus
SNIESKIFIKGYTITNKSVI

SEQ ID NO: 1715100 - protein, 18 aa, Staphylococcus aureus
SPARLMPDKILDLRYKLR

SEQ ID NO: 1715101 - protein, 19 aa, Staphylococcus aureus
SSVFYYKTGDMLPEDTTHV

SEQ ID NO: 1715102 - protein, 24 aa, Staphylococcus aureus
SVQWGIKANSFITSLGKMSGHDPN

SEQ ID NO: 1715103 - protein, 20 aa, Staphylococcus aureus
TIKNGTAMPTNLAGGSTTTI

SEQ ID NO: 1715104 - protein, 17 aa, Staphylococcus aureus
TKKNIGYHFLNKPKITV

SEQ ID NO: 1715105 - protein, 17 aa, Staphylococcus aureus
TLGICLVLLIILIGGCV

SEQ ID NO: 1715106 - protein, 24 aa, Staphylococcus aureus
TVLPEIQHNIKFFKNDDTQNIAEK

SEQ ID NO: 1715107 - protein, 18 aa, Staphylococcus aureus
VAKGKYYAGLSYEQDART

SEQ ID NO: 1715108 - protein, 19 aa, Staphylococcus aureus
VFAVPELVDLDGRIFSVSG

SEQ ID NO: 1715109 - protein, 17 aa, Staphylococcus aureus
VKISNFIAKDLDQIKDK

SEQ ID NO: 1715110 - protein, 25 aa, Staphylococcus aureus
VKKGDTLSAIALKYKTTVSNIQNTN

SEQ ID NO: 1715111 - protein, 19 aa, Staphylococcus aureus
VLGISFLFLIISIFAGCGT

SEQ ID NO: 1715112 - protein, 28 aa, Staphylococcus aureus
VNISGIPLDPSALVYLVAPTNQTTNGGS

SEQ ID NO: 1715113 - protein, 23 aa, Staphylococcus aureus
VRYVAAHHPKLPITMTSRSANLP

SEQ ID NO: 1715114 - protein, 19 aa, Staphylococcus aureus
YGTSSKFYSGFDKGSVVFH

SEQ ID NO: 1715115 - protein, 17 aa, Staphylococcus aureus
YSVKISNFIAKDLDQIK

SEQ ID NO: 1715116 - protein, 17 aa, Staphylococcus aureus
ADKRELITAKNHLDDPV

SEQ ID NO: 1715117 - protein, 20 aa, Staphylococcus aureus
ADQVPVGRTDFVTVNSDGTN

SEQ ID NO: 1715118 - protein, 21 aa, Staphylococcus aureus
ADVKSKINAASNIAGVNTVKQ

SEQ ID NO: 1715119 - protein, 28 aa, Staphylococcus aureus
AETNYDYTKLVFAKPIYNDPSLVKSDTN

SEQ ID NO: 1715120 - protein, 25 aa, Staphylococcus aureus
AFFKGKKGIKRKVIETHDDVKQVDY

SEQ ID NO: 1715121 - protein, 26 aa, Staphylococcus aureus
AFINANRDAISFAEGDISVTNTPNGS

SEQ ID NO: 1715122 - protein, 19 aa, Staphylococcus aureus
ALDQARNGLTVDKAPLENA

SEQ ID NO: 1715123 - protein, 19 aa, Staphylococcus aureus
AMTGLKRGVANHNQVVQSD

SEQ ID NO: 1715124 - protein, 20 aa, Staphylococcus aureus
AMTGLKRGVANHNQVVQSDN

SEQ ID NO: 1715125 - protein, 26 aa, Staphylococcus aureus
ASKQAGHPVFYVYAGNQGNASVNLGG

SEQ ID NO: 1715126 - protein, 19 aa, Staphylococcus aureus
ATVKPKANQAIEVKAEDTK

SEQ ID NO: 1715127 - protein, 20 aa, Staphylococcus aureus
AVNEKAREAITNINATPGAT

SEQ ID NO: 1715128 - protein, 24 aa, Staphylococcus aureus
AVYKAQLYLSPYGPKQYVEHLNQN

SEQ ID NO: 1715129 - protein, 26 aa, Staphylococcus aureus
DAYNEVKQAATARKAQNATVSNATNE

SEQ ID NO: 1715130 - protein, 23 aa, Staphylococcus aureus
DDAKRTAYSQAVNAAATILNKTA

SEQ ID NO: 1715131 - protein, 19 aa, Staphylococcus aureus
DHKAELSITKKDEKGKISH

SEQ ID NO: 1715132 - protein, 24 aa, Staphylococcus aureus
DKGTWLIRSEMKIQLKGENLESRG

SEQ ID NO: 1715133 - protein, 22 aa, Staphylococcus aureus
DPHLGHALAVVGNAKINDQEKL

SEQ ID NO: 1715134 - protein, 23 aa, Staphylococcus aureus
EIENFKFFVQYGNFKDFKDYKNG

SEQ ID NO: 1715135 - protein, 25 aa, Staphylococcus aureus
EKAQAEAGGRPNYRTTGYSQSNATT

SEQ ID NO: 1715136 - protein, 45 aa, Staphylococcus aureus; identical to SEQ ID NO: 1580824

SEQ ID NO: 1715137 - protein, 19 aa, Staphylococcus aureus
ESPGVPKVYTFIGQGDASY

SEQ ID NO: 1715138 - protein, 17 aa, Staphylococcus aureus
EYNELHQSLKEAVDEFN

SEQ ID NO: 1715139 - protein, 36 aa, Staphylococcus aureus
FASNLANMNFLRWVNFPQDYTVTWTNAKIANRPTDG

SEQ ID NO: 1715140 - protein, 19 aa, Staphylococcus aureus
FIDRENADSGTFNYVKGIF

SEQ ID NO: 1715141 - protein, 17 aa, Staphylococcus aureus
FKHGLSSFIEALEQDVK

SEQ ID NO: 1715142 - protein, 17 aa, Staphylococcus aureus
FKYKLKPFFNPENVYSK

SEQ ID NO: 1715143 - protein, 22 aa, Staphylococcus aureus
FSRYGHGELDVYKALNVANQKA

SEQ ID NO: 1715144 - protein, 25 aa, Staphylococcus aureus
GAGQEVYKIGNYVWEDTNKNGVQEL

SEQ ID NO: 1715145 - protein, 24 aa, Staphylococcus aureus
GIYKPKYNLGDYVWEDTNKNGIQD

SEQ ID NO: 1715146 - protein, 17 aa, Staphylococcus aureus
GNKEEIAYHKAHGGEIS

SEQ ID NO: 1715147 - protein, 17 aa, Staphylococcus aureus
GQGDASYTISFKTQGPT

SEQ ID NO: 1715148 - protein, 22 aa, Staphylococcus aureus
HKSLIYRYDATLGTQITTNDIL

SEQ ID NO: 1715149 - protein, 18 aa, Staphylococcus aureus
HTQFIIDEILAIKLPAEV

SEQ ID NO: 1715150 - protein, 20 aa, Staphylococcus aureus
HTQFIIDEILAIKLPAEVIK

SEQ ID NO: 1715151 - protein, 25 aa, Staphylococcus aureus
IFNDLKRRAQTILDENRNNVPLNKR

SEQ ID NO: 1715152 - protein, 22 aa, Staphylococcus aureus
IKKRKNPGLDIFVVKEAENRNG

SEQ ID NO: 1715153 - protein, 17 aa, Staphylococcus aureus
INAASNIAGVNTVKQQG

SEQ ID NO: 1715154 - protein, 18 aa, Staphylococcus aureus
KADKRELITAKNHLDDPV

SEQ ID NO: 1715155 - protein, 22 aa, Staphylococcus aureus
KEKPMANVLVTLTYPDGTTKSV

SEQ ID NO: 1715156 - protein, 36 aa, Staphylococcus aureus; identical to SEQ ID NO: 1577465

SEQ ID NO: 1715157 - protein, 33 aa, Staphylococcus aureus; identical to SEQ ID NO: 1581141

SEQ ID NO: 1715158 - protein, 20 aa, Staphylococcus aureus
KFSNFKGKKLDVFGISYNGQ

SEQ ID NO: 1715159 - protein, 22 aa, Staphylococcus aureus
KLRKYLQEEYNIYGHNGTKKGE

SEQ ID NO: 1715160 - protein, 17 aa, Staphylococcus aureus
KNLEDFYDKEGFRDQEF

SEQ ID NO: 1715161 - protein, 21 aa, Staphylococcus aureus
KNQCTWWAFKRRAQVGKPVSN

SEQ ID NO: 1715162 - protein, 26 aa, Staphylococcus aureus
KNSNWLKYPSEYHVDFQVKRNRKTEI

SEQ ID NO: 1715163 - protein, 20 aa, Staphylococcus aureus
KPDSELIINFTTMQTNSKQG

SEQ ID NO: 1715164 - protein, 20 aa, Staphylococcus aureus
KTAYDQAVAAAKAILNKQTG

SEQ ID NO: 1715165 - protein, 21 aa, Staphylococcus aureus
KVGEQFFKDNFGLKVKATNVV

SEQ ID NO: 1715166 - protein, 20 aa, Staphylococcus aureus
KVLSAPSLDYGLIGFVSHDY

SEQ ID NO: 1715167 - protein, 23 aa, Staphylococcus aureus
LDQRVINHYGSLIPLTPLDNSLL

SEQ ID NO: 1715168 - protein, 25 aa, Staphylococcus aureus
LEELLRNGSREEIEYQKKHSGEISP

SEQ ID NO: 1715169 - protein, 18 aa, Staphylococcus aureus
LGKMYKTYFFKKGESKSS

SEQ ID NO: 1715170 - protein, 26 aa, Staphylococcus aureus
LISPLGKLRAGFDLLKKPTQMQDGDI

SEQ ID NO: 1715171 - protein, 21 aa, Staphylococcus aureus
LKKAESLLDEAGWKKGKDSDV

SEQ ID NO: 1715172 - protein, 19 aa, Staphylococcus aureus
MCISLLIVIIFVTSCGGGN

SEQ ID NO: 1715173 - protein, 26 aa, Staphylococcus aureus
MGGQTIRLMEEFLRNGNKEEIAYHKA

SEQ ID NO: 1715174 - protein, 18 aa, Staphylococcus aureus
MTQLKQGIANKAQIKGSE

SEQ ID NO: 1715175 - protein, 18 aa, Staphylococcus aureus
NAYNQAVSNAETILNKQT

SEQ ID NO: 1715176 - protein, 24 aa, Staphylococcus aureus
NDGSGYPVGTYINASSKGAPYNLP

SEQ ID NO: 1715177 - protein, 17 aa, Staphylococcus aureus
NIDLGLTQWGFKQLPNE

SEQ ID NO: 1715178 - protein, 19 aa, Staphylococcus aureus
NKPELVAIAEPASNRPKKR

SEQ ID NO: 1715179 - protein, 24 aa, Staphylococcus aureus
NKVKKGDTMTINYDKNVIPSDLTD

SEQ ID NO: 1715180 - protein, 19 aa, Staphylococcus aureus
NLFEFKYKLKPFFNPENVY

SEQ ID NO: 1715181 - protein, 25 aa, Staphylococcus aureus
NNLITYTFTDYVDRFNSVQMGINYS

SEQ ID NO: 1715182 - protein, 20 aa, Staphylococcus aureus
NNPSGHLINPTQAMDIAYTE

SEQ ID NO: 1715183 - protein, 19 aa, Staphylococcus aureus
NYHDYRFIDRENADSGTFN

SEQ ID NO: 1715184 - protein, 22 aa, Staphylococcus aureus
PAADESLKDAIKNPAVENKEHD

SEQ ID NO: 1715185 - protein, 17 aa, Staphylococcus aureus
PASITAYNNSIRALQSD

SEQ ID NO: 1715186 - protein, 23 aa, Staphylococcus aureus
PAYYKLYGDKIVGFDTNDFPITW

SEQ ID NO: 1715187 - protein, 24 aa, Staphylococcus aureus
PDDIPPTINNPVGINAKYYRGDEV

SEQ ID NO: 1715188 - protein, 24 aa, Staphylococcus aureus
PKKGGFFEEIERTFKEISEELNEE

SEQ ID NO: 1715189 - protein, 19 aa, Staphylococcus aureus
PNQFILLTIDKKDVSSVED

SEQ ID NO: 1715190 - protein, 19 aa, Staphylococcus aureus
PTGNGASASDYFKLSNGSA

SEQ ID NO: 1715191 - protein, 18 aa, Staphylococcus aureus
PYSGVTWMGAGTGFVVGN

SEQ ID NO: 1715192 - protein, 23 aa, Staphylococcus aureus
QEKLIYWNPWDTELSIQDADSSL

SEQ ID NO: 1715193 - protein, 27 aa, Staphylococcus aureus
QFDNSWCAGFSMAALLNATKNTDTYNA

SEQ ID NO: 1715194 - protein, 26 aa, Staphylococcus aureus
QKEALKAQVTSAGRVSAANGVEHTAT

SEQ ID NO: 1715195 - protein, 24 aa, Staphylococcus aureus
QKKHSGEISPLFKGNNDNMISSIT

SEQ ID NO: 1715196 - protein, 18 aa, Staphylococcus aureus
QPLRINLTSNENFTDKDW

SEQ ID NO: 1715197 - protein, 20 aa, Staphylococcus aureus
QYYHFFSIKDPADVYYTKKK

SEQ ID NO: 1715198 - protein, 21 aa, Staphylococcus aureus
REHRRKGSIFMDFRNELKILN

SEQ ID NO: 1715199 - protein, 21 aa, Staphylococcus aureus
RLLIAFAVLFSADFIYQSVEQ

SEQ ID NO: 1715200 - protein, 17 aa, Staphylococcus aureus
RSGAMASVAPIISEVKR

SEQ ID NO: 1715201 - protein, 20 aa, Staphylococcus aureus
RSGFNPEFLTYISNEKSNEK

SEQ ID NO: 1715202 - protein, 19 aa, Staphylococcus aureus
RTKIQEIDRVLASHPDVAT

SEQ ID NO: 1715203 - protein, 20 aa, Staphylococcus aureus
RTKIQEIDRVLASHPDVATI

SEQ ID NO: 1715204 - protein, 26 aa, Staphylococcus aureus
SANAIIQKPIRSVQEVQTALTNVNRV

SEQ ID NO: 1715205 - protein, 21 aa, Staphylococcus aureus
SRYGHGELDVYKALNVANQKA

SEQ ID NO: 1715206 - protein, 19 aa, Staphylococcus aureus
SVGYKRLEIDFSKEDRDIS

SEQ ID NO: 1715207 - protein, 17 aa, Staphylococcus aureus
SVGYRKLEIDFSKRENS

SEQ ID NO: 1715208 - protein, 25 aa, Staphylococcus aureus
TDGQLWKKVKDSLHDSDIILSNEYE

SEQ ID NO: 1715209 - protein, 17 aa, Staphylococcus aureus
TSAQRVANVTSIQQTAN

SEQ ID NO: 1715210 - protein, 24 aa, Staphylococcus aureus
TTAKAAALEEFDEVVQAQIDQAPL

SEQ ID NO: 1715211 - protein, 26 aa, Staphylococcus aureus
TTTIKQRALNRMAVNTVAAPQQGTNV

SEQ ID NO: 1715212 - protein, 17 aa, Staphylococcus aureus
VAKGKYYAGLSYEQDAR

SEQ ID NO: 1715213 - protein, 26 aa, Staphylococcus aureus
VDRFNSVQMGINYSIYMDADTIPVSK

SEQ ID NO: 1715214 - protein, 25 aa, Staphylococcus aureus
VGINAKYYRGDEVNFTMGVSDRHSG

SEQ ID NO: 1715215 - protein, 25 aa, Staphylococcus aureus
VGLPNSRALIWQQFDYNNSRERDTR

SEQ ID NO: 1715216 - protein, 17 aa, Staphylococcus aureus
VKAKGMFILKKKDDNTY

SEQ ID NO: 1715217 - protein, 30 aa, Staphylococcus aureus; identical to SEQ ID NO: 1578689

SEQ ID NO: 1715218 - protein, 27 aa, Staphylococcus aureus
VLFPDKSLKLSYKVNVANIDTPKNIDF

SEQ ID NO: 1715219 - protein, 17 aa, Staphylococcus aureus
VMILMFAIAGCGKGNET

SEQ ID NO: 1715220 - protein, 20 aa, Staphylococcus aureus
VNINKGRLTKSFTSNLNNMN

SEQ ID NO: 1715221 - protein, 20 aa, Staphylococcus aureus
VPDLIRLSKTFLIESRELTT

SEQ ID NO: 1715222 - protein, 21 aa, Staphylococcus aureus
VPDLIRLSKTFLIESRELTTV

SEQ ID NO: 1715223 - protein, 27 aa, Staphylococcus aureus
VQPLNKYPVVFVHGFLGLVGDNAPALY

SEQ ID NO: 1715224 - protein, 23 aa, Staphylococcus aureus
VTIKPLRDKYRVGTSSTAANPVR

SEQ ID NO: 1715225 - protein, 18 aa, Staphylococcus aureus
VTVNADGTNVQWSNGAGA

SEQ ID NO: 1715226 - protein, 23 aa, Staphylococcus aureus
VVLLEGISQMMPMIKETPFNDKT

SEQ ID NO: 1715227 - protein, 24 aa, Staphylococcus aureus
VVNAKYDVIYNGHTFATSLPAKFV

SEQ ID NO: 1715228 - protein, 17 aa, Staphylococcus aureus
VVYNIPELHVAQIKMTK

SEQ ID NO: 1715229 - protein, 19 aa, Staphylococcus aureus
VVYNIPELHVAQIKMTKMH

SEQ ID NO: 1715230 - protein, 30 aa, Staphylococcus aureus
YAAGGRALEYNQLFMYSQLYVESTQDHQQR

SEQ ID NO: 1715231 - protein, 18 aa, Staphylococcus aureus
YHDYRFIDRENADSGTFN

SEQ ID NO: 1715232 - protein, 20 aa, Staphylococcus aureus
YKGEMMDLSRGRAISRENET

SEQ ID NO: 1715233 - protein, 19 aa, Staphylococcus aureus
YKQAVAKAEALLNKQSGTN

SEQ ID NO: 1715234 - protein, 17 aa, Staphylococcus aureus
YNIPELHVAQIKMTKMH

SEQ ID NO: 1715235 - protein, 17 aa, Staphylococcus aureus
YNLPTTPWNTLKASDSK

SEQ ID NO: 1715236 - protein, 18 aa, Staphylococcus aureus
AADYFKLSNGSAIPDATI

SEQ ID NO: 1715237 - protein, 22 aa, Staphylococcus aureus
AAKRVPVTVNVYQFEFPQTTYT

SEQ ID NO: 1715238 - protein, 23 aa, Staphylococcus aureus
ADVKSKINAASNIAGVNTVKQQG

SEQ ID NO: 1715239 - protein, 17 aa, Staphylococcus aureus
AEHSKTINVVRGQNNQW

SEQ ID NO: 1715240 - protein, 22 aa, Staphylococcus aureus
AESPGVPKVYTFIGQGDASYTI

SEQ ID NO: 1715241 - protein, 22 aa, Staphylococcus aureus
AKVKDRISVIGYPKGAQTKYKM

SEQ ID NO: 1715242 - protein, 31 aa, Staphylococcus aureus
ALDSIALVAPEHIVRAAARDAVKQQYEAKKQ

SEQ ID NO: 1715243 - protein, 21 aa, Staphylococcus aureus
ANGAGAFTIDHVVKSNSTHNA

SEQ ID NO: 1715244 - protein, 25 aa, Staphylococcus aureus
ASQALAKEKEKALAAIDQAQTNSQV

SEQ ID NO: 1715245 - protein, 17 aa, Staphylococcus aureus
ASYTISFKTQGPTVNKL

SEQ ID NO: 1715246 - protein, 27 aa, Staphylococcus aureus
ATSSDVLKLKANYTIDDSVKEGDTFTF

SEQ ID NO: 1715247 - protein, 19 aa, Staphylococcus aureus
ATTTVPGLRNNIAGNEKAQ

SEQ ID NO: 1715248 - protein, 19 aa, Staphylococcus aureus
CSVVFSLFFFLLLFLVIFF

SEQ ID NO: 1715249 - protein, 23 aa, Staphylococcus aureus
DDAKRTAYSQAVNAAATILNKTS

SEQ ID NO: 1715250 - protein, 17 aa, Staphylococcus aureus
DEAEFKFIAGVGPNNFT

SEQ ID NO: 1715251 - protein, 18 aa, Staphylococcus aureus
DEQKRNAYNQAVSAAETI

SEQ ID NO: 1715252 - protein, 18 aa, Staphylococcus aureus
DEQKRNAYNQAVSNAETI

SEQ ID NO: 1715253 - protein, 19 aa, Staphylococcus aureus
DGKFITISFVYDKDGTVWT

SEQ ID NO: 1715254 - protein, 20 aa, Staphylococcus aureus
DGTNVQWSHGAGAGANKPLQ

SEQ ID NO: 1715255 - protein, 26 aa, Staphylococcus aureus
DHIKAMRWPFQYNIGLKTNDPNVDLI

SEQ ID NO: 1715256 - protein, 25 aa, Staphylococcus aureus
DILKNRPGIHYAPPILEKNKEGQRL

SEQ ID NO: 1715257 - protein, 17 aa, Staphylococcus aureus
DKDATKATVNFTDADQA

SEQ ID NO: 1715258 - protein, 26 aa, Staphylococcus aureus
DKEEFEAFKKRSPKYNPGMNDQAEMD

SEQ ID NO: 1715259 - protein, 18 aa, Staphylococcus aureus
DKTGGYWKITMNDGSTYQ

SEQ ID NO: 1715260 - protein, 19 aa, Staphylococcus aureus
DKTGGYWKITMNDGSTYQS

SEQ ID NO: 1715261 - protein, 17 aa, Staphylococcus aureus
DKVKSGDYFTIKYSDTV

SEQ ID NO: 1715262 - protein, 26 aa, Staphylococcus aureus
DNKNGSLAITGRVSMNQAFNSDITFK

SEQ ID NO: 1715263 - protein, 17 aa, Staphylococcus aureus
DRFNPLLKEKVSYAKVP

SEQ ID NO: 1715264 - protein, 23 aa, Staphylococcus aureus
DTKRWKDEVEPIVGKTDMFVFPH

SEQ ID NO: 1715265 - protein, 24 aa, Staphylococcus aureus
DTKRWKNEVEPIVGKTDMFVFPHG

SEQ ID NO: 1715266 - protein, 17 aa, Staphylococcus aureus
DTVKVIKEVELKKPITY

SEQ ID NO: 1715267 - protein, 17 aa, Staphylococcus aureus
EAGATPATKAFGRQNFE

SEQ ID NO: 1715268 - protein, 25 aa, Staphylococcus aureus
EELLRNGNREEIEYQKKHGGEISPL

SEQ ID NO: 1715269 - protein, 21 aa, Staphylococcus aureus
EIENFKFFVQYGDFKDINDYK

SEQ ID NO: 1715270 - protein, 26 aa, Staphylococcus aureus
EIREIEPVINRKASAREQLTTLFNDK

SEQ ID NO: 1715271 - protein, 24 aa, Staphylococcus aureus
EKDAIEFAKKHRKEFEKVGEQFFK

SEQ ID NO: 1715272 - protein, 18 aa, Staphylococcus aureus
ELKHKSKPAQSFNNDVNQ

SEQ ID NO: 1715273 - protein, 24 aa, Staphylococcus aureus
ELNTAMTALKRAIADKADTKASGN

SEQ ID NO: 1715274 - protein, 22 aa, Staphylococcus aureus
ENKVKSVLYFNRGISDIDLRLS

SEQ ID NO: 1715275 - protein, 17 aa, Staphylococcus aureus
ENQVLMIGYTFYHSNKN

SEQ ID NO: 1715276 - protein, 17 aa, Staphylococcus aureus
ESRGVVLEINRNTRTAK

SEQ ID NO: 1715277 - protein, 20 aa, Staphylococcus aureus
ETEFPRIQLFMKSYTGEEDW

SEQ ID NO: 1715278 - protein, 18 aa, Staphylococcus aureus
EVGKLVVFLASDESSFIT

SEQ ID NO: 1715279 - protein, 26 aa, Staphylococcus aureus
EYEAKRLKDHKVDIFGISYSGLCNTK

SEQ ID NO: 1715280 - protein, 26 aa, Staphylococcus aureus
FIQNPPHGATVAWHDNPDTWKNTVGN

SEQ ID NO: 1715281 - protein, 33 aa, Staphylococcus aureus
FKIRNRSGQVIYSWPTVHVYSLEDLSRASDYFS

SEQ ID NO: 1715282 - protein, 20 aa, Staphylococcus aureus
FPYYYVYNDFSDHYPIKAYS

SEQ ID NO: 1715283 - protein, 17 aa, Staphylococcus aureus
GDASYTISFKTQGPTVN

SEQ ID NO: 1715284 - protein, 23 aa, Staphylococcus aureus
GQDINVTAHILIDGETTPITKTA

SEQ ID NO: 1715285 - protein, 18 aa, Staphylococcus aureus
GQKADYPNPIAIPVNGGW

SEQ ID NO: 1715286 - protein, 22 aa, Staphylococcus aureus
GQTPVGRTEFVTVNADGTNVQW

SEQ ID NO: 1715287 - protein, 18 aa, Staphylococcus aureus
GTNVQWSHGAGAGANKPL

SEQ ID NO: 1715288 - protein, 20 aa, Staphylococcus aureus
GTQLYHIVASNAYHKDTEDF

SEQ ID NO: 1715289 - protein, 19 aa, Staphylococcus aureus
GWGPYGRDSFHPTYGNELF

SEQ ID NO: 1715290 - protein, 17 aa, Staphylococcus aureus
GYYGHVMFVERVNNDGS

SEQ ID NO: 1715291 - protein, 23 aa, Staphylococcus aureus
HKSLIYRYDATLGTQITTNDILT

SEQ ID NO: 1715292 - protein, 19 aa, Staphylococcus aureus
HQTQIIKILSKVKPDPPRI

SEQ ID NO: 1715293 - protein, 19 aa, Staphylococcus aureus
IAIRGRIPVQLARKKFPYH

SEQ ID NO: 1715294 - protein, 17 aa, Staphylococcus aureus
IALSLILSLSVTPIANA

SEQ ID NO: 1715295 - protein, 19 aa, Staphylococcus aureus
IDLGDKLQFERMGDVLNSK

SEQ ID NO: 1715296 - protein, 20 aa, Staphylococcus aureus
IDQFLYFDLIYSIKDTKLGN

SEQ ID NO: 1715297 - protein, 17 aa, Staphylococcus aureus
IGVGMILREFYIFRFII

SEQ ID NO: 1715298 - protein, 22 aa, Staphylococcus aureus
IIFPSPYYSPAFTKGEKVDLNT

SEQ ID NO: 1715299 - protein, 21 aa, Staphylococcus aureus
ILTMLKATTTVPGLRNNITGN

SEQ ID NO: 1715300 - protein, 20 aa, Staphylococcus aureus
IPDATITWVSGQAPNKDNTR

SEQ ID NO: 1715301 - protein, 20 aa, Staphylococcus aureus
IPDATITWVSGQAPNKNNTT

SEQ ID NO: 1715302 - protein, 28 aa, Staphylococcus aureus
IQNATGLPTDGFTYKWNNAATGTNDANW

SEQ ID NO: 1715303 - protein, 32 aa, Staphylococcus aureus
IRKYTVGTFSTVIATLVFLGFNTSQAHAAETN

SEQ ID NO: 1715304 - protein, 18 aa, Staphylococcus aureus
ISKFKGKKMDIFGIDYNG

SEQ ID NO: 1715305 - protein, 25 aa, Staphylococcus aureus
ISPLGKLRAGFDLLKKPTQMQDGDI

SEQ ID NO: 1715306 - protein, 18 aa, Staphylococcus aureus
ITHGSGFSSVVTVSDALP

SEQ ID NO: 1715307 - protein, 17 aa, Staphylococcus aureus
ITPNNPSGHLINPTQAM

SEQ ID NO: 1715308 - protein, 17 aa, Staphylococcus aureus
KADQFKYEVTLPQGVTY

SEQ ID NO: 1715309 - protein, 18 aa, Staphylococcus aureus
KDRSAWDATMYSFGTIPR

SEQ ID NO: 1715310 - protein, 21 aa, Staphylococcus aureus
KDTQLIIDEILAIKLPAEVIK

SEQ ID NO: 1715311 - protein, 18 aa, Staphylococcus aureus
KELDFKLRKHLIDKHNLY

SEQ ID NO: 1715312 - protein, 18 aa, Staphylococcus aureus
KFYSGFDKGSVVFHMNDG

SEQ ID NO: 1715313 - protein, 20 aa, Staphylococcus aureus
KKLTDKLKEKQIVKNGDTVT

SEQ ID NO: 1715314 - protein, 23 aa, Staphylococcus aureus
KLVIKRNGNVVTTFTRRNNTSPW

SEQ ID NO: 1715315 - protein, 18 aa, Staphylococcus aureus
KMMKRILVVFLMLAIVLA

SEQ ID NO: 1715316 - protein, 18 aa, Staphylococcus aureus
KNNIGYHFLNESKITVKK

SEQ ID NO: 1715317 - protein, 28 aa, Staphylococcus aureus
KPFSKQAGHPVFYVYAGNQGNASVNLGG

SEQ ID NO: 1715318 - protein, 22 aa, Staphylococcus aureus
KPSKQRKVPMIKVGTHKKLTFV

SEQ ID NO: 1715319 - protein, 24 aa, Staphylococcus aureus
KQAIAGLTPDLAPLQAAKTQLQND

SEQ ID NO: 1715320 - protein, 20 aa, Staphylococcus aureus
KQHAVTDLNQLNGLNNPQRQ

SEQ ID NO: 1715321 - protein, 42 aa, Staphylococcus aureus; identical to SEQ ID NO: 1581191

SEQ ID NO: 1715322 - protein, 21 aa, Staphylococcus aureus
KTAYDQAVAAAKAILNKQTGS

SEQ ID NO: 1715323 - protein, 25 aa, Staphylococcus aureus
KVGTHKKLTFVLWVLLIGSVGFGIY

SEQ ID NO: 1715324 - protein, 21 aa, Staphylococcus aureus
KYEGFPYVFGGASPTTSFDCS

SEQ ID NO: 1715325 - protein, 25 aa, Staphylococcus aureus
LIDPFCGSGTIAIEACLIAQNIAPG

SEQ ID NO: 1715326 - protein, 19 aa, Staphylococcus aureus
LKELDFKLRKHLIDKHNLY

SEQ ID NO: 1715327 - protein, 22 aa, Staphylococcus aureus
LKPLEQRERANVILPNNDRHQI

SEQ ID NO: 1715328 - protein, 17 aa, Staphylococcus aureus
LKQELKNTVTPTKVEEN

SEQ ID NO: 1715329 - protein, 17 aa, Staphylococcus aureus
LLEELRKQLKIKPGHFS

SEQ ID NO: 1715330 - protein, 17 aa, Staphylococcus aureus
LLIVIIFVTSCGGGNKI

SEQ ID NO: 1715331 - protein, 18 aa, Staphylococcus aureus
LNGLRQVVNRTYRIGTTK

SEQ ID NO: 1715332 - protein, 21 aa, Staphylococcus aureus
LNTAMKGLRDSIANEATIKAE

SEQ ID NO: 1715333 - protein, 17 aa, Staphylococcus aureus
LSKTFLIESRELTTVDF

SEQ ID NO: 1715334 - protein, 17 aa, Staphylococcus aureus
LTYYVSNHVLPMINKEY

SEQ ID NO: 1715335 - protein, 20 aa, Staphylococcus aureus
LVLKAKEKAYQDILNAQTTN

SEQ ID NO: 1715336 - protein, 18 aa, Staphylococcus aureus
MHIDGNLKGSSVGYKKLE

SEQ ID NO: 1715337 - protein, 23 aa, Staphylococcus aureus
NEKAQAEAGGRPNYKTTGYSQSN

SEQ ID NO: 1715338 - protein, 21 aa, Staphylococcus aureus
NKADALKAITALKLQMDEELK

SEQ ID NO: 1715339 - protein, 29 aa, Staphylococcus aureus
NKDNTRIGEDITVTAHILIDGETTPITKT

SEQ ID NO: 1715340 - protein, 24 aa, Staphylococcus aureus
NKGPRLVKYINIFYAMIANVPIII

SEQ ID NO: 1715341 - protein, 18 aa, Staphylococcus aureus
NPIFTRKDNQVIVNVAVK

SEQ ID NO: 1715342 - protein, 22 aa, Staphylococcus aureus
NRDIKGDAYLSIHNDALESSNA

SEQ ID NO: 1715343 - protein, 20 aa, Staphylococcus aureus
NTAMKGLRDSIANEATIKAG

SEQ ID NO: 1715344 - protein, 25 aa, Staphylococcus aureus
PATKAFGRQNFEYINGQKPAESPGV

SEQ ID NO: 1715345 - protein, 19 aa, Staphylococcus aureus
PDATITWVSGQAPNKDNTR

SEQ ID NO: 1715346 - protein, 17 aa, Staphylococcus aureus
PGYHGHKVVTPGQASIR

SEQ ID NO: 1715347 - protein, 23 aa, Staphylococcus aureus
PNGGIKAKSSISMNNVTYTTQDE

SEQ ID NO: 1715348 - protein, 17 aa, Staphylococcus aureus
PNSSITITPKAGTGHSV

SEQ ID NO: 1715349 - protein, 21 aa, Staphylococcus aureus
PSVLAHYWGGNKMNIRQDLEE

SEQ ID NO: 1715350 - protein, 23 aa, Staphylococcus aureus
PTDADRLDLQFIPDNTAVADASR

SEQ ID NO: 1715351 - protein, 30 aa, Staphylococcus aureus; identical to SEQ ID NO: 1577500

SEQ ID NO: 1715352 - protein, 27 aa, Staphylococcus aureus
QAGESLNIIASRYGVSVDQLMAANNLR

SEQ ID NO: 1715353 - protein, 24 aa, Staphylococcus aureus
QATTKIWQNGHVDITPNNPSGHLI

SEQ ID NO: 1715354 - protein, 28 aa, Staphylococcus aureus
QNASGLPTDGFTYKWNRDTTGTNDANWA

SEQ ID NO: 1715355 - protein, 41 aa, Staphylococcus aureus
QTGDGYQWVIKFNKGHAPHQNMIFWFALPADQVPVGRTDFV

SEQ ID NO: 1715356 - protein, 25 aa, Staphylococcus aureus
QVINAKYDVIYNGHTFATSLPAKFV

SEQ ID NO: 1715357 - protein, 20 aa, Staphylococcus aureus
RDPNEPSYEEYLNAKRATEE

SEQ ID NO: 1715358 - protein, 17 aa, Staphylococcus aureus
RLKEVDLNDVLKGMINH

SEQ ID NO: 1715359 - protein, 23 aa, Staphylococcus aureus
RNATELNTAMGQLQHAIADKTTT

SEQ ID NO: 1715360 - protein, 42 aa, Staphylococcus aureus
RNIELVGNLLPGDYFGTIRFGRKEQLFEIRVKPHTPTITTTA

SEQ ID NO: 1715361 - protein, 18 aa, Staphylococcus aureus
RQALTPDKAPLQTAKTQL

SEQ ID NO: 1715362 - protein, 32 aa, Staphylococcus aureus; identical to SEQ ID NO: 1581533

SEQ ID NO: 1715363 - protein, 17 aa, Staphylococcus aureus
RYVAAHHPKLPITMTSR

SEQ ID NO: 1715364 - protein, 23 aa, Staphylococcus aureus
SAAKRVPVTVNVYQFEFPQTSYT

SEQ ID NO: 1715365 - protein, 25 aa, Staphylococcus aureus
SANAIIQKPIRTVQEVQSALTNVNR

SEQ ID NO: 1715366 - protein, 20 aa, Staphylococcus aureus
SASDYFKLSNGSAIPDATIT

SEQ ID NO: 1715367 - protein, 19 aa, Staphylococcus aureus
SDAKEIALITAKQTGDGYQ

SEQ ID NO: 1715368 - protein, 18 aa, Staphylococcus aureus
SDITFKVSATDNVNNTTN

SEQ ID NO: 1715369 - protein, 27 aa, Staphylococcus aureus
SDKKNGSLAISGRVSMNQAYNSDITFK

SEQ ID NO: 1715370 - protein, 20 aa, Staphylococcus aureus
SDKPELVAIAEPASNRPKKR

SEQ ID NO: 1715371 - protein, 25 aa, Staphylococcus aureus
SEINSFVPSMHWIAADPKELNDYKY

SEQ ID NO: 1715372 - protein, 17 aa, Staphylococcus aureus
SLAALTILTSVTGIGTT

SEQ ID NO: 1715373 - protein, 19 aa, Staphylococcus aureus
SLKELPKGATVYVSNNPAE

SEQ ID NO: 1715374 - protein, 19 aa, Staphylococcus aureus
SNFKDCKDALYQAAKDLYD

SEQ ID NO: 1715375 - protein, 23 aa, Staphylococcus aureus
SPWVKEASAANVAGIAGTNNGIT

SEQ ID NO: 1715376 - protein, 27 aa, Staphylococcus aureus
STITIRPEDYVVFIPPVGNQIRALIFY

SEQ ID NO: 1715377 - protein, 17 aa, Staphylococcus aureus
STNAQHMNFQFVGTYGP

SEQ ID NO: 1715378 - protein, 23 aa, Staphylococcus aureus
SYVKTPSNKVLGFYPTSANTNAF

SEQ ID NO: 1715379 - protein, 26 aa, Staphylococcus aureus
TDEFVYKIQLPEGVEYVNNSLTKDFP

SEQ ID NO: 1715380 - protein, 24 aa, Staphylococcus aureus
TDGQLWKKVKDSLHDSDIILSNEY

SEQ ID NO: 1715381 - protein, 26 aa, Staphylococcus aureus
TEKPKPWDVYAFPYYYVYNDFSDHYP

SEQ ID NO: 1715382 - protein, 35 aa, Staphylococcus aureus; identical to SEQ ID NO: 1581627

SEQ ID NO: 1715383 - protein, 30 aa, Staphylococcus aureus; identical to SEQ ID NO: 1584980

SEQ ID NO: 1715384 - protein, 23 aa, Staphylococcus aureus
TLNTAMGALRTSIQNDNTTKTSQ

SEQ ID NO: 1715385 - protein, 19 aa, Staphylococcus aureus
TNERIKKEMIDDLNSIIDD

SEQ ID NO: 1715386 - protein, 22 aa, Staphylococcus aureus
TNSKQGATNLVIKDAKKNTELA

SEQ ID NO: 1715387 - protein, 23 aa, Staphylococcus aureus
TNVSGSFEQVAFAKRENATTDKT

SEQ ID NO: 1715388 - protein, 44 aa, Staphylococcus aureus; identical to SEQ ID NO: 1577919

SEQ ID NO: 1715389 - protein, 27 aa, Staphylococcus aureus
TSANTNAFRPGGVNPLNEYQLSQLFTD

SEQ ID NO: 1715390 - protein, 35 aa, Staphylococcus aureus; identical to SEQ ID NO: 1581674

SEQ ID NO: 1715391 - protein, 27 aa, Staphylococcus aureus
TTSRIIGHDAREEWRKNDGVVPVISSL

SEQ ID NO: 1715392 - protein, 25 aa, Staphylococcus aureus
TVLPEIQHNIKFFKNDDTQNIAEKP

SEQ ID NO: 1715393 - protein, 24 aa, Staphylococcus aureus
TYYKYKGAIDKAVLTLLGDGSKSY

SEQ ID NO: 1715394 - protein, 18 aa, Staphylococcus aureus
VATNAYHKDTEDFYITLK

SEQ ID NO: 1715395 - protein, 17 aa, Staphylococcus aureus
VELKKPITYEAGATSDS

SEQ ID NO: 1715396 - protein, 24 aa, Staphylococcus aureus
VGFIAKQGLKKAIQKYGKTVVTSM

SEQ ID NO: 1715397 - protein, 20 aa, Staphylococcus aureus
VGISTRLIRVTYDNRQTEDL

SEQ ID NO: 1715398 - protein, 25 aa, Staphylococcus aureus
VIRRDHVKEAQSLINDYKYTQKYED

SEQ ID NO: 1715399 - protein, 26 aa, Staphylococcus aureus
VKPEEKLYKIGDYVWEDVDKDGVQGT

SEQ ID NO: 1715400 - protein, 21 aa, Staphylococcus aureus
VKQAATARKAQNATVSNATNE

SEQ ID NO: 1715401 - protein, 24 aa, Staphylococcus aureus
VNINKGRLTKSFASNLANMNFLRW

SEQ ID NO: 1715402 - protein, 47 aa, Staphylococcus aureus; identical to SEQ ID NO: 1577525

SEQ ID NO: 1715403 - protein, 22 aa, Staphylococcus aureus
VNRHNGTIINIFDDMSEKDKEE

SEQ ID NO: 1715404 - protein, 25 aa, Staphylococcus aureus
VNTLKNRALNDIGVTSTTAMVNSIR

SEQ ID NO: 1715405 - protein, 30 aa, Staphylococcus aureus
VPSVTVVDNLPGFTLINGGKVGVFSHAMVR

SEQ ID NO: 1715406 - protein, 28 aa, Staphylococcus aureus
VTDIPLDPSALVYLVIPTSQTRDGGSEA

SEQ ID NO: 1715407 - protein, 23 aa, Staphylococcus aureus
VVNAKYDVIYNGHTFATSLPAKF

SEQ ID NO: 1715408 - protein, 23 aa, Staphylococcus aureus
VYKAQLYLTPYGPKQYVEHLNQN

SEQ ID NO: 1715409 - protein, 21 aa, Staphylococcus aureus
YKAQLYLTPYGPKQYVEHLNQ

SEQ ID NO: 1715410 - protein, 23 aa, Staphylococcus aureus
YMLSTVLYPNWGQYKRADLIGQS

SEQ ID NO: 1715411 - protein, 31 aa, Staphylococcus aureus
YPNPIAIPVNGGWRYNYGNQFYVQLVSQYLT

SEQ ID NO: 1715412 - protein, 26 aa, Staphylococcus aureus
YQAQGNVIALGRIKGNDTNDHGDFNG

SEQ ID NO: 1715413 - protein, 25 aa, Staphylococcus aureus
YYGKLSNGKLAWIKSTDLAKELIKY

SEQ ID NO: 1715414 - protein, 17 aa, Staphylococcus aureus
AEAKAAAKQNLGTLNHI

SEQ ID NO: 1715415 - protein, 19 aa, Staphylococcus aureus
AEAKALYLQGYNSAKVQLD

SEQ ID NO: 1715416 - protein, 17 aa, Staphylococcus aureus
AEQSKKTAYDQAVAAAK

SEQ ID NO: 1715417 - protein, 20 aa, Staphylococcus aureus
AGANKPLQQMWEYGVNDPDR

SEQ ID NO: 1715418 - protein, 21 aa, Staphylococcus aureus
AGTQLYHIVATNAYHKDTEDF

SEQ ID NO: 1715419 - protein, 31 aa, Staphylococcus aureus
AITRKGMVSNRLNKFSIRKYTVGTASILVGT

SEQ ID NO: 1715420 - protein, 23 aa, Staphylococcus aureus
AKRLKDHKVDIFGISYSGLCNTK

SEQ ID NO: 1715421 - protein, 19 aa, Staphylococcus aureus
AKSDAKANLGTLTHLNNAQ

SEQ ID NO: 1715422 - protein, 17 aa, Staphylococcus aureus
ALDNFKLEVKKIESENP

SEQ ID NO: 1715423 - protein, 23 aa, Staphylococcus aureus
ALYMSVFLLIIFIVGCRNMKDEQ

SEQ ID NO: 1715424 - protein, 23 aa, Staphylococcus aureus
ANIYYKSIIKITITVKVGTNVQT

SEQ ID NO: 1715425 - protein, 17 aa, Staphylococcus aureus
AQQAIKATAENQVESIK

SEQ ID NO: 1715426 - protein, 26 aa, Staphylococcus aureus
ASEINSFVPSMHWIAANPKDLNDYKY

SEQ ID NO: 1715427 - protein, 24 aa, Staphylococcus aureus
ASPKVGQPAPKVCTPIKKEDKQEV

SEQ ID NO: 1715428 - protein, 19 aa, Staphylococcus aureus
ATTKIWQNGHIDITPNNPS

SEQ ID NO: 1715429 - protein, 17 aa, Staphylococcus aureus
ATTTVPGLRNNITGNEK

SEQ ID NO: 1715430 - protein, 18 aa, Staphylococcus aureus
AVKKLKPTHVLSVSTIKD

SEQ ID NO: 1715431 - protein, 20 aa, Staphylococcus aureus
AYDIHFVKDGFQYNFTSNGT

SEQ ID NO: 1715432 - protein, 17 aa, Staphylococcus aureus
AYNEVKQAATARKAQNA

SEQ ID NO: 1715433 - protein, 21 aa, Staphylococcus aureus
CDLELNKLENQILMLGKTFYQ

SEQ ID NO: 1715434 - protein, 19 aa, Staphylococcus aureus
CVILIFALILVLFTPNVLA

SEQ ID NO: 1715435 - protein, 20 aa, Staphylococcus aureus
DAIEFAKKHRKEFEKVGEQF

SEQ ID NO: 1715436 - protein, 23 aa, Staphylococcus aureus
DARKFMRMFFSGAVEVELDKQGR

SEQ ID NO: 1715437 - protein, 17 aa, Staphylococcus aureus
DATKATVNFTDADQAKQ

SEQ ID NO: 1715438 - protein, 24 aa, Staphylococcus aureus
DFKIRKLLIKKYKLYEGAADKGRI

SEQ ID NO: 1715439 - protein, 22 aa, Staphylococcus aureus
DFVYKVQLPEGVEYVNNSLTKD

SEQ ID NO: 1715440 - protein, 17 aa, Staphylococcus aureus
DGGFYTFELNKKLQTHR

SEQ ID NO: 1715441 - protein, 22 aa, Staphylococcus aureus
DGKDIEYDTEFTIDNKVKKGDT

SEQ ID NO: 1715442 - protein, 20 aa, Staphylococcus aureus
DGRIHPGRIEDMVEKARKEI

SEQ ID NO: 1715443 - protein, 28 aa, Staphylococcus aureus
DIAQGTSMRTTDKYGYYNYAGYSNFIVT

SEQ ID NO: 1715444 - protein, 27 aa, Staphylococcus aureus
DKEEFEAFKKRSPKYNPGMSDHDKTDG

SEQ ID NO: 1715445 - protein, 17 aa, Staphylococcus aureus
DKGKWVIRSEMTTELKN

SEQ ID NO: 1715446 - protein, 19 aa, Staphylococcus aureus
DKGTWIVNSGMNIQLKGGA

SEQ ID NO: 1715447 - protein, 18 aa, Staphylococcus aureus
DLDHARQALTPDKAPLQN

SEQ ID NO: 1715448 - protein, 17 aa, Staphylococcus aureus
DQNTIKQGVNFTDADEA

SEQ ID NO: 1715449 - protein, 23 aa, Staphylococcus aureus
DQNTIKQGVNFTDADEAKRNAYT

SEQ ID NO: 1715450 - protein, 24 aa, Staphylococcus aureus
DSGFYKPTYNLGDYVWEDTNKNGV

SEQ ID NO: 1715451 - protein, 19 aa, Staphylococcus aureus
DSPDTWKNTVGNTHKTAVV

SEQ ID NO: 1715452 - protein, 28 aa, Staphylococcus aureus
EAARTRNPIRLMIGFDYPDGYGNSETLV

SEQ ID NO: 1715453 - protein, 19 aa, Staphylococcus aureus
EAGATPATKAFGRQNFEYI

SEQ ID NO: 1715454 - protein, 23 aa, Staphylococcus aureus
EAVRKIMFALNRFMGNKYSNIDL

SEQ ID NO: 1715455 - protein, 27 aa, Staphylococcus aureus
EFTVTTSLKNNGNFGASFNTDDFVYKI

SEQ ID NO: 1715456 - protein, 27 aa, Staphylococcus aureus
EFTVTTSLKNNGNFGASFNTDDFVYKV

SEQ ID NO: 1715457 - protein, 26 aa, Staphylococcus aureus
EGAVFIKGGDGFDFGHVERFIQNPPH

SEQ ID NO: 1715458 - protein, 20 aa, Staphylococcus aureus
EHSRSDAMILTTFNQSKHQI

SEQ ID NO: 1715459 - protein, 20 aa, Staphylococcus aureus
EKYGYSREKYDAIQKEASKL

SEQ ID NO: 1715460 - protein, 27 aa, Staphylococcus aureus
ENELKAILPFHRSLRVANYDNQAYAAV

SEQ ID NO: 1715461 - protein, 24 aa, Staphylococcus aureus
ENVRNFLKQNIEDINFANDDHPNN

SEQ ID NO: 1715462 - protein, 27 aa, Staphylococcus aureus
FDNLDSGKYKVIFEKPAGLTQTGTNTT

SEQ ID NO: 1715463 - protein, 27 aa, Staphylococcus aureus
FDNLDSGKYKVIFEKPAGLTQTVTNTT

SEQ ID NO: 1715464 - protein, 18 aa, Staphylococcus aureus
FEFFSRDILDDFKGVDRN

SEQ ID NO: 1715465 - protein, 27 aa, Staphylococcus aureus
FESDGTHFAWNYHATGANGADMSAQAP

SEQ ID NO: 1715466 - protein, 24 aa, Staphylococcus aureus
FHGQRLNDVILTYVASTGKMRAEY

SEQ ID NO: 1715467 - protein, 17 aa, Staphylococcus aureus
FIIDEILAIKLPAEVIK

SEQ ID NO: 1715468 - protein, 27 aa, Staphylococcus aureus
FKVPENVSHLKIQFVPKNDAITDARGI

SEQ ID NO: 1715469 - protein, 21 aa, Staphylococcus aureus
FKYEVTLPQGVTYVNNSLTTT

SEQ ID NO: 1715470 - protein, 22 aa, Staphylococcus aureus
FKYEVTLPQGVTYVNNSLTTTF

SEQ ID NO: 1715471 - protein, 17 aa, Staphylococcus aureus
FTDKDWQITGIPRTLHI

SEQ ID NO: 1715472 - protein, 33 aa, Staphylococcus aureus
FWYDLFPKKDLVPFIPYKFVNIYGDNKTIDASS

SEQ ID NO: 1715473 - protein, 26 aa, Staphylococcus aureus
FYNLDLRSKLKFKYMGEVIESKQIKD

SEQ ID NO: 1715474 - protein, 17 aa, Staphylococcus aureus
GELDIAQGTSMRTTDKY

SEQ ID NO: 1715475 - protein, 18 aa, Staphylococcus aureus
GGKSLPNFLESFKDDKYT

SEQ ID NO: 1715476 - protein, 27 aa, Staphylococcus aureus
GGKVGVLSHAMVRTSMFEAGSNRTYQA

SEQ ID NO: 1715477 - protein, 20 aa, Staphylococcus aureus
GGVWSHGIGKHYVWSHYSHN

SEQ ID NO: 1715478 - protein, 25 aa, Staphylococcus aureus
GQNAAPVARQIYPFNGNKTQALQQL

SEQ ID NO: 1715479 - protein, 18 aa, Staphylococcus aureus
GTQCTVGGCVTPQQQEQI

SEQ ID NO: 1715480 - protein, 24 aa, Staphylococcus aureus
HGKIDRPSIGIGLINLKDIPEEER

SEQ ID NO: 1715481 - protein, 18 aa, Staphylococcus aureus
HKNTIIKFNEIFKQGNNL

SEQ ID NO: 1715482 - protein, 18 aa, Staphylococcus aureus
IADGYYWGIIENLENQFY

SEQ ID NO: 1715483 - protein, 22 aa, Staphylococcus aureus
ICVKSCSLLFMLNGNPKPEQLN

SEQ ID NO: 1715484 - protein, 23 aa, Staphylococcus aureus
IEQARLKLKCEIEKDSYYAMSEK

SEQ ID NO: 1715485 - protein, 21 aa, Staphylococcus aureus
IGSAFTETVSHVGNKENPGYY

SEQ ID NO: 1715486 - protein, 23 aa, Staphylococcus aureus
IIFPSPYYSPAFTKGEKVDLNTK

SEQ ID NO: 1715487 - protein, 19 aa, Staphylococcus aureus
IIITKGPVMWGFFGHCSIA

SEQ ID NO: 1715488 - protein, 26 aa, Staphylococcus aureus
INPDIILRLPHGMPEEVKKMFQKEFK

SEQ ID NO: 1715489 - protein, 30 aa, Staphylococcus aureus
IRKHKLGAASVFLGTMIVVGMGQEKEAAAS

SEQ ID NO: 1715490 - protein, 17 aa, Staphylococcus aureus
ISVKECVKDLMERDKKS

SEQ ID NO: 1715491 - protein, 19 aa, Staphylococcus aureus
ITHGSGFSSVVTVSDALPN

SEQ ID NO: 1715492 - protein, 38 aa, Staphylococcus aureus
ITIRPQDYVVFIPPVGKQIRAVVYYNKVVASNMSNAVT

SEQ ID NO: 1715493 - protein, 19 aa, Staphylococcus aureus
ITSFLETFFQLYPTATEKE

SEQ ID NO: 1715494 - protein, 23 aa, Staphylococcus aureus
IYNDGEVIIMTYMPFKDSNTKVS

SEQ ID NO: 1715495 - protein, 20 aa, Staphylococcus aureus
KDLTAELSLNLFIDPTTVTK

SEQ ID NO: 1715496 - protein, 24 aa, Staphylococcus aureus
KDNTRIGEDITVTAHILIDGETTP

SEQ ID NO: 1715497 - protein, 19 aa, Staphylococcus aureus
KEKYEIYKELYKKYKKENP

SEQ ID NO: 1715498 - protein, 18 aa, Staphylococcus aureus
KELDFKLRKQLIDKHDLY

SEQ ID NO: 1715499 - protein, 19 aa, Staphylococcus aureus
KELKVFKSKWQALNKGMIN

SEQ ID NO: 1715500 - protein, 21 aa, Staphylococcus aureus
KFSNFKGKKLDVFGISYNGQC

SEQ ID NO: 1715501 - protein, 20 aa, Staphylococcus aureus
KGPVMWGFFGHCSIAIDDKT

SEQ ID NO: 1715502 - protein, 20 aa, Staphylococcus aureus
KKATARNEITAILNNKLQEI

SEQ ID NO: 1715503 - protein, 35 aa, Staphylococcus aureus; identical to SEQ ID NO: 1581167

SEQ ID NO: 1715504 - protein, 19 aa, Staphylococcus aureus
KNILSRWKIIELFQQSLYR

SEQ ID NO: 1715505 - protein, 19 aa, Staphylococcus aureus
KPDSELIINFTTMQTNSKQ

SEQ ID NO: 1715506 - protein, 18 aa, Staphylococcus aureus
KPELVAIAEPASNRPKKR

SEQ ID NO: 1715507 - protein, 20 aa, Staphylococcus aureus
KPNKTACMYGGVTLHENNQL

SEQ ID NO: 1715508 - protein, 19 aa, Staphylococcus aureus
KPNSAITITPKAGTGHSAS

SEQ ID NO: 1715509 - protein, 24 aa, Staphylococcus aureus
KQNDIWKHFKAVKNNHVYDLEEVP

SEQ ID NO: 1715510 - protein, 19 aa, Staphylococcus aureus
KRNGNVVTTFTRRNNTSPW

SEQ ID NO: 1715511 - protein, 18 aa, Staphylococcus aureus
KSNNLLGLTHERYSYIFD

SEQ ID NO: 1715512 - protein, 20 aa, Staphylococcus aureus
KTDANGIANIKALPSGDYIL

SEQ ID NO: 1715513 - protein, 23 aa, Staphylococcus aureus
KVTGGKTCMYGGITKHEGNHFDN

SEQ ID NO: 1715514 - protein, 19 aa, Staphylococcus aureus
LAQERVIGANVWVDGIQKE

SEQ ID NO: 1715515 - protein, 23 aa, Staphylococcus aureus
LASALVLGACGSHDGDKKEESKK

SEQ ID NO: 1715516 - protein, 29 aa, Staphylococcus aureus
LASLDVVRYVAAHHPKLPITMTSRSANLP

SEQ ID NO: 1715517 - protein, 22 aa, Staphylococcus aureus
LASTLVLGACGSNDGDKKEESK

SEQ ID NO: 1715518 - protein, 18 aa, Staphylococcus aureus
LCTSIIVSGCSFIPKYQT

SEQ ID NO: 1715519 - protein, 17 aa, Staphylococcus aureus
LDAFLVIEEEPVKGRQY

SEQ ID NO: 1715520 - protein, 18 aa, Staphylococcus aureus
LERKKEKYEIYKELYKKY

SEQ ID NO: 1715521 - protein, 18 aa, Staphylococcus aureus
LFLLAMYELGKYVTEKVY

SEQ ID NO: 1715522 - protein, 31 aa, Staphylococcus aureus; identical to SEQ ID NO: 1577575

SEQ ID NO: 1715523 - protein, 17 aa, Staphylococcus aureus
LITAKNHLDDPVSTDGK

SEQ ID NO: 1715524 - protein, 26 aa, Staphylococcus aureus
LITSSQRWGLNQGINANGWMRTDLKG

SEQ ID NO: 1715525 - protein, 25 aa, Staphylococcus aureus
LKNKIDFSKDFNFKVRVANNHQSNT

SEQ ID NO: 1715526 - protein, 20 aa, Staphylococcus aureus
LKPLEQRERANVILPNNDRH

SEQ ID NO: 1715527 - protein, 27 aa, Staphylococcus aureus
LKSWIDDGFMPLIYKGEMMDLSRGRAI

SEQ ID NO: 1715528 - protein, 21 aa, Staphylococcus aureus
LKYPSEYHVDFQVKRNPKTEI

SEQ ID NO: 1715529 - protein, 19 aa, Staphylococcus aureus
LLFLLAMYELGKYVTEQVY

SEQ ID NO: 1715530 - protein, 18 aa, Staphylococcus aureus
LMRNGSREEIEYQKKHGG

SEQ ID NO: 1715531 - protein, 18 aa, Staphylococcus aureus
LNGAMTALKAAIADKERT

SEQ ID NO: 1715532 - protein, 22 aa, Staphylococcus aureus
LNNAMKGLRDSIANETTVKASQ

SEQ ID NO: 1715533 - protein, 18 aa, Staphylococcus aureus
LNQPQRDALRNQINQAQA

SEQ ID NO: 1715534 - protein, 25 aa, Staphylococcus aureus
LPNGGIKAKSSISMNNVTYTTQDEH

SEQ ID NO: 1715535 - protein, 21 aa, Staphylococcus aureus
LRLLFLLAMYELGKYVTEQVY

SEQ ID NO: 1715536 - protein, 17 aa, Staphylococcus aureus
LSNEGMVLYLDRNTRTA

SEQ ID NO: 1715537 - protein, 17 aa, Staphylococcus aureus
LSTITLLMAGVITLNGG

SEQ ID NO: 1715538 - protein, 19 aa, Staphylococcus aureus
MGNPLGLQFANSVTSGIIS

SEQ ID NO: 1715539 - protein, 21 aa, Staphylococcus aureus
MKKPSNMNFHIAISEDNLLTS

SEQ ID NO: 1715540 - protein, 30 aa, Staphylococcus aureus
MSLDTGFYKEPKYNLGDYVWEDTNKDGIQD

SEQ ID NO: 1715541 - protein, 17 aa, Staphylococcus aureus
MTPKYEDLRAYYTKPSF

SEQ ID NO: 1715542 - protein, 19 aa, Staphylococcus aureus
MVFIMLLNIITPLFNKNEA

SEQ ID NO: 1715543 - protein, 20 aa, Staphylococcus aureus
NANGMTVYWYHDNQRALADT

SEQ ID NO: 1715544 - protein, 44 aa, Staphylococcus aureus
NDAITDARGIYQLRDGYKYYDFVDSIGLHSGSHVYVERRTMEPT

SEQ ID NO: 1715545 - protein, 27 aa, Staphylococcus aureus
NDAKAFFSYEWKGLEIAKNLADQAKKD

SEQ ID NO: 1715546 - protein, 20 aa, Staphylococcus aureus
NDGSGYPVGTYINASSKGAP

SEQ ID NO: 1715547 - protein, 22 aa, Staphylococcus aureus
NEKGIKGVYVILKDSNGKELDR

SEQ ID NO: 1715548 - protein, 17 aa, Staphylococcus aureus
NELTQVRPLRIMSPHSV

SEQ ID NO: 1715549 - protein, 27 aa, Staphylococcus aureus
NENLKGWHTGAGMSYLYNSDVKHYRDN

SEQ ID NO: 1715550 - protein, 28 aa, Staphylococcus aureus
NGENLKGWHTGAGMSYLYNSDVKHYRDN

SEQ ID NO: 1715551 - protein, 19 aa, Staphylococcus aureus
NKAKERMLNEQKQEQKEKR

SEQ ID NO: 1715552 - protein, 21 aa, Staphylococcus aureus
NMVDKGVVIWKEKEFEPSDIV

SEQ ID NO: 1715553 - protein, 23 aa, Staphylococcus aureus
NQMIEYGKSQGRDIHYQEGVPSY

SEQ ID NO: 1715554 - protein, 17 aa, Staphylococcus aureus
NTARQGLTLDRQPALTT

SEQ ID NO: 1715555 - protein, 20 aa, Staphylococcus aureus
NTIKQGVNFTDADEAKRNAY

SEQ ID NO: 1715556 - protein, 22 aa, Staphylococcus aureus
NVVNDKAREAITNINATPGATR

SEQ ID NO: 1715557 - protein, 29 aa, Staphylococcus aureus
PIKEKIQHVFKSGCGFDNDSNKGFVYTKI

SEQ ID NO: 1715558 - protein, 19 aa, Staphylococcus aureus
PLQQMWEYGVNDPDRSHDF

SEQ ID NO: 1715559 - protein, 19 aa, Staphylococcus aureus
PLVSYDLFNVIGQYPDKLL

SEQ ID NO: 1715560 - protein, 21 aa, Staphylococcus aureus
PNNPSGHLINPTQAMDIAYTE

SEQ ID NO: 1715561 - protein, 20 aa, Staphylococcus aureus
PRNIPINIWINGNHKTISTN

SEQ ID NO: 1715562 - protein, 28 aa, Staphylococcus aureus
PVGLNAKYYRGDEVSFTMGVSDRHSGLK

SEQ ID NO: 1715563 - protein, 25 aa, Staphylococcus aureus
PVGNQIRALIFYNNVVASNMSNAVT

SEQ ID NO: 1715564 - protein, 23 aa, Staphylococcus aureus
PYNLPTTPWNTLKASDAKEIALI

SEQ ID NO: 1715565 - protein, 18 aa, Staphylococcus aureus
QARYYLHKQYNLYNPSTF

SEQ ID NO: 1715566 - protein, 19 aa, Staphylococcus aureus
QKGGNLKPLEQRERANVIL

SEQ ID NO: 1715567 - protein, 24 aa, Staphylococcus aureus
QKKHPKVLILMGVPGSYLVATDKS

SEQ ID NO: 1715568 - protein, 19 aa, Staphylococcus aureus
QKLSTITLLMAGVITLNGG

SEQ ID NO: 1715569 - protein, 27 aa, Staphylococcus aureus
QNYQARGNVAALGRVNANDSTDHGNFN

SEQ ID NO: 1715570 - protein, 19 aa, Staphylococcus aureus
QPLRINLTSNENFTDKDWQ

SEQ ID NO: 1715571 - protein, 25 aa, Staphylococcus aureus
QQADYTFASLDIFNDLKKRAQTILA

SEQ ID NO: 1715572 - protein, 23 aa, Staphylococcus aureus
QTDKRKTCMYGGVTEHNGNQLDK

SEQ ID NO: 1715573 - protein, 21 aa, Staphylococcus aureus
RDKGTWIINSGMYIQLKGGAL

SEQ ID NO: 1715574 - protein, 22 aa, Staphylococcus aureus
RDKGTWIINSGMYIQLKGGALK

SEQ ID NO: 1715575 - protein, 17 aa, Staphylococcus aureus
REAESEITAAQRVIDNG

SEQ ID NO: 1715576 - protein, 27 aa, Staphylococcus aureus
REEFIFDGVCIYGGVTMHSTADSISKN

SEQ ID NO: 1715577 - protein, 22 aa, Staphylococcus aureus
REIPYRLNEEIVAINGNEITFK

SEQ ID NO: 1715578 - protein, 20 aa, Staphylococcus aureus
RGVINSRQFLSHDLIFPIEY

SEQ ID NO: 1715579 - protein, 29 aa, Staphylococcus aureus
RHSGLKSTTITTLPSGWTSNLTKSDKKNG

SEQ ID NO: 1715580 - protein, 17 aa, Staphylococcus aureus
RIENFKFFGQYANLKEL

SEQ ID NO: 1715581 - protein, 20 aa, Staphylococcus aureus
RKKSELQGAALGNLKQIYYY

SEQ ID NO: 1715582 - protein, 18 aa, Staphylococcus aureus
RKTAIEAMNDSTTEEQQA

SEQ ID NO: 1715583 - protein, 20 aa, Staphylococcus aureus
RNAYNQAVSAAETILNKQTG

SEQ ID NO: 1715584 - protein, 43 aa, Staphylococcus aureus; identical to SEQ ID NO: 1577898

SEQ ID NO: 1715585 - protein, 21 aa, Staphylococcus aureus
RYDVGEKLGFVKTTIEYALKD

SEQ ID NO: 1715586 - protein, 24 aa, Staphylococcus aureus
RYGKTYKGIMPNWEPGKKVHLVGH

SEQ ID NO: 1715587 - protein, 23 aa, Staphylococcus aureus
SAAKRVPVTVNVYQFEFPQTTYT

SEQ ID NO: 1715588 - protein, 18 aa, Staphylococcus aureus
SDIDLKKGDIITEIDGKK

SEQ ID NO: 1715589 - protein, 24 aa, Staphylococcus aureus
SGFRNEYYYLTAIPYTLDEYKKYF

SEQ ID NO: 1715590 - protein, 21 aa, Staphylococcus aureus
SHKGVGWKVEAHLINNMGHDH

SEQ ID NO: 1715591 - protein, 30 aa, Staphylococcus aureus
SIATVLLLLGGLVFAIFAYVDHSNKAKERM

SEQ ID NO: 1715592 - protein, 18 aa, Staphylococcus aureus
SIIVSGCSFIPKYQTKDI

SEQ ID NO: 1715593 - protein, 19 aa, Staphylococcus aureus
SIKLFKADNTPLTITNTTY

SEQ ID NO: 1715594 - protein, 22 aa, Staphylococcus aureus
SLAVALGVTGYAAGTGHQAHAA

SEQ ID NO: 1715595 - protein, 18 aa, Staphylococcus aureus
SPDTWKNTVGNTHKTAVV

SEQ ID NO: 1715596 - protein, 28 aa, Staphylococcus aureus
SPVFNEKNEVIGIHWGGVPNQFNGAVFI

SEQ ID NO: 1715597 - protein, 20 aa, Staphylococcus aureus
SRNIPINIWINGNHKTISTN

SEQ ID NO: 1715598 - protein, 20 aa, Staphylococcus aureus
SSVFYYKTGDMLPEDTTHVR

SEQ ID NO: 1715599 - protein, 17 aa, Staphylococcus aureus
SVSPTIVGVINMQKASS

SEQ ID NO: 1715600 - protein, 29 aa, Staphylococcus aureus
TADKFKDKRLDVFGIPYFYTCLVPKNESR

SEQ ID NO: 1715601 - protein, 18 aa, Staphylococcus aureus
TDAINIYFVPSDLVNPTI

SEQ ID NO: 1715602 - protein, 17 aa, Staphylococcus aureus
TDLAKELIKYNQIGMTL

SEQ ID NO: 1715603 - protein, 18 aa, Staphylococcus aureus
THANGQVSYGARLTQKKP

SEQ ID NO: 1715604 - protein, 27 aa, Staphylococcus aureus
TLDFGDINSAYIIKVVSKYTPTSDGEL

SEQ ID NO: 1715605 - protein, 29 aa, Staphylococcus aureus
TLDSGFYKTPKYNLGNYVWEDTNKDGKQD

SEQ ID NO: 1715606 - protein, 20 aa, Staphylococcus aureus
TLNNLRHIYFFNEKGISEKI

SEQ ID NO: 1715607 - protein, 20 aa, Staphylococcus aureus
TNEAINIYFVPSDLVNPTIS

SEQ ID NO: 1715608 - protein, 25 aa, Staphylococcus aureus
TTAKAAALEEFDEVVQAQIDQAPLN

SEQ ID NO: 1715609 - protein, 24 aa, Staphylococcus aureus
TTIKPRTLNRMAVNTVAAPQQGTN

SEQ ID NO: 1715610 - protein, 23 aa, Staphylococcus aureus
TYQAQGNVLALGRISGTDASNHG

SEQ ID NO: 1715611 - protein, 27 aa, Staphylococcus aureus
VEEFFRAVVINARLTTHIDLIRGGNTH

SEQ ID NO: 1715612 - protein, 26 aa, Staphylococcus aureus
VGALKRFVATVLLLLVFISGCGNDKY

SEQ ID NO: 1715613 - protein, 18 aa, Staphylococcus aureus
VGTASILVGTTLIFGLGN

SEQ ID NO: 1715614 - protein, 20 aa, Staphylococcus aureus
VGTASILVGTTLIFGLSGHE

SEQ ID NO: 1715615 - protein, 17 aa, Staphylococcus aureus
VGTTLIFGLSGHEAKAA

SEQ ID NO: 1715616 - protein, 17 aa, Staphylococcus aureus
VGTYINASSKGAPYNLP

SEQ ID NO: 1715617 - protein, 17 aa, Staphylococcus aureus
VKAKGMFILKKKDDKTY

SEQ ID NO: 1715618 - protein, 21 aa, Staphylococcus aureus
VKPQAKQAIADKVQAQETAID

SEQ ID NO: 1715619 - protein, 19 aa, Staphylococcus aureus
VKQRLKGLGDKVTNPVRYE

SEQ ID NO: 1715620 - protein, 23 aa, Staphylococcus aureus
VLPEIQHNIKFFKNDDGQNIADK

SEQ ID NO: 1715621 - protein, 36 aa, Staphylococcus aureus
VNGYSLINNGKIGFVNSELRRSDMFDKNNPQNYQAK

SEQ ID NO: 1715622 - protein, 24 aa, Staphylococcus aureus
VNTLKNRALNDIGVTSTTAMVNSI

SEQ ID NO: 1715623 - protein, 17 aa, Staphylococcus aureus
VSFTMGVSDRHSGLKST

SEQ ID NO: 1715624 - protein, 22 aa, Staphylococcus aureus
VYKAQLYLSPYGPKQYVEHLNQ

SEQ ID NO: 1715625 - protein, 27 aa, Staphylococcus aureus
WGGVPNEFNGAVFINENVRNFLKQNIE

SEQ ID NO: 1715626 - protein, 19 aa, Staphylococcus aureus
WMRTDLKGSEFTFTPEAPK

SEQ ID NO: 1715627 - protein, 21 aa, Staphylococcus aureus
YDVPFQLQLLFVESGNGIIIS

SEQ ID NO: 1715628 - protein, 17 aa, Staphylococcus aureus
YEAKRLKDHKVDIFGIS

SEQ ID NO: 1715629 - protein, 19 aa, Staphylococcus aureus
YKLKFKVKVGHSVYQSSDG

SEQ ID NO: 1715630 - protein, 17 aa, Staphylococcus aureus
YPNSKLDIITPVDMSSN

SEQ ID NO: 1715631 - protein, 24 aa, Staphylococcus aureus
YQVPKGYTLNKGYDVNTKELTDVT

SEQ ID NO: 1715632 - protein, 24 aa, Staphylococcus aureus
YRYSKGGKHYLIFDKHQKFTRIQI

SEQ ID NO: 1715633 - protein, 19 aa, Staphylococcus aureus
YTFELHKKLQEHRMAGTNI

SEQ ID NO: 1715634 - protein, 21 aa, Staphylococcus aureus
AAKRVPVTVNVYQFEFPQTTY

SEQ ID NO: 1715635 - protein, 22 aa, Staphylococcus aureus
AANGAGAFTIDHVVKNNSTHNA

SEQ ID NO: 1715636 - protein, 23 aa, Staphylococcus aureus
ADEAKRNAYTNAVTQAEQILNKA

SEQ ID NO: 1715637 - protein, 23 aa, Staphylococcus aureus
ADEAKRNAYTNAVTQAEQILNKV

SEQ ID NO: 1715638 - protein, 18 aa, Staphylococcus aureus
ADESWKNKTVKKYEETVT

SEQ ID NO: 1715639 - protein, 18 aa, Staphylococcus aureus
ADKRFAYASTSKAINSAI

SEQ ID NO: 1715640 - protein, 17 aa, Staphylococcus aureus
AEADAAVDAAQKQGLHD

SEQ ID NO: 1715641 - protein, 17 aa, Staphylococcus aureus
AEIAKIEAIQPATTTKD

SEQ ID NO: 1715642 - protein, 34 aa, Staphylococcus aureus; identical to SEQ ID NO: 1580649

SEQ ID NO: 1715643 - protein, 22 aa, Staphylococcus aureus
AGTQLYHIVASNAYHKDTEDFY

SEQ ID NO: 1715644 - protein, 22 aa, Staphylococcus aureus
AKANEQKALIAQTADATTEEKE

SEQ ID NO: 1715645 - protein, 21 aa, Staphylococcus aureus
AKDLNFRTHLSGYHKNYPYYP

SEQ ID NO: 1715646 - protein, 22 aa, Staphylococcus aureus
AKETAKRALASYSNLNNAQSTA

SEQ ID NO: 1715647 - protein, 27 aa, Staphylococcus aureus
ALPNGEIKARSSISMNNVTYTTQDEHG

SEQ ID NO: 1715648 - protein, 30 aa, Staphylococcus aureus
AMTRKGMVSNRLNKFSIRKYTVGTASILVG

SEQ ID NO: 1715649 - protein, 23 aa, Staphylococcus aureus
ANEKGIKGVYVILKDSNGKELDR

SEQ ID NO: 1715650 - protein, 17 aa, Staphylococcus aureus
ANTALGHLNNLNNVQRQ

SEQ ID NO: 1715651 - protein, 17 aa, Staphylococcus aureus
ANVILPNNDRHQITDTT

SEQ ID NO: 1715652 - protein, 23 aa, Staphylococcus aureus
ANVKPAAKQAIADKVQAQETAID

SEQ ID NO: 1715653 - protein, 24 aa, Staphylococcus aureus
AQAKETAKRALASYSNLNNAQSTA

SEQ ID NO: 1715654 - protein, 21 aa, Staphylococcus aureus
AQHMNFQFVGTYGPNKDVVGI

SEQ ID NO: 1715655 - protein, 23 aa, Staphylococcus aureus
AQTLDHAMELLRNSVADNQTTLA

SEQ ID NO: 1715656 - protein, 20 aa, Staphylococcus aureus
ASGYAHIQNATGLPTDGFTY

SEQ ID NO: 1715657 - protein, 21 aa, Staphylococcus aureus
ASILVGTTLIFGIGSQEAKAA

SEQ ID NO: 1715658 - protein, 19 aa, Staphylococcus aureus
ASLALGMLATGVITSNTQS

SEQ ID NO: 1715659 - protein, 21 aa, Staphylococcus aureus
ASSVPAFTVVGVYPASVENST

SEQ ID NO: 1715660 - protein, 22 aa, Staphylococcus aureus
ATELNGAMTVLKAAIADKERTK

SEQ ID NO: 1715661 - protein, 17 aa, Staphylococcus aureus
ATLALGILTTGVFTTES

SEQ ID NO: 1715662 - protein, 22 aa, Staphylococcus aureus
ATTKIWQNGHIDITPNNPSGHL

SEQ ID NO: 1715663 - protein, 18 aa, Staphylococcus aureus
ATVKPKANQAIEVKAEDT

SEQ ID NO: 1715664 - protein, 19 aa, Staphylococcus aureus
AVNYAKSRGSFLVTAIGNQ

SEQ ID NO: 1715665 - protein, 19 aa, Staphylococcus aureus
AYDFFPFKIDKEAMTLKEV

SEQ ID NO: 1715666 - protein, 23 aa, Staphylococcus aureus
DAAKRQIEGATHVSEVTQAQNNA

SEQ ID NO: 1715667 - protein, 36 aa, Staphylococcus aureus; identical to SEQ ID NO: 1574270

SEQ ID NO: 1715668 - protein, 24 aa, Staphylococcus aureus
DDFVYKIQLPEGVEYVNNSLTKDF

SEQ ID NO: 1715669 - protein, 22 aa, Staphylococcus aureus
DEAKRNAYTNAVTQAEQILNKA

SEQ ID NO: 1715670 - protein, 24 aa, Staphylococcus aureus
DEDYEGLDVFVVREGSGKHADNIS

SEQ ID NO: 1715671 - protein, 19 aa, Staphylococcus aureus
DEKSFRKYLAKGYSYNSTG

SEQ ID NO: 1715672 - protein, 17 aa, Staphylococcus aureus
DELDEANQLISDTLKQA

SEQ ID NO: 1715673 - protein, 22 aa, Staphylococcus aureus
DFLYTCRQKIKLLDMNHSEKQQ

SEQ ID NO: 1715674 - protein, 18 aa, Staphylococcus aureus
DFVYKVQLPEGVEYVNNS

SEQ ID NO: 1715675 - protein, 23 aa, Staphylococcus aureus
DKDATRASSAYVNAEPNKKQAYD

SEQ ID NO: 1715676 - protein, 27 aa, Staphylococcus aureus
DKEEFEAFKKRSPKYNPGMSDHDETDG

SEQ ID NO: 1715677 - protein, 23 aa, Staphylococcus aureus
DKLVIKRNGNVVTTFTRHNNTSP

SEQ ID NO: 1715678 - protein, 21 aa, Staphylococcus aureus
DKTAYKMEVTLGNDTYSKDVI

SEQ ID NO: 1715679 - protein, 23 aa, Staphylococcus aureus
DLDHARQALTPDKAPLQNAKTQL

SEQ ID NO: 1715680 - protein, 26 aa, Staphylococcus aureus
DNLDSGKYKVIFEKPAGLTQTGTNTT

SEQ ID NO: 1715681 - protein, 20 aa, Staphylococcus aureus
DPFSVAVEMNKDALQQQVNS

SEQ ID NO: 1715682 - protein, 21 aa, Staphylococcus aureus
DPKISAKVGEVYNDNKRLMLF

SEQ ID NO: 1715683 - protein, 32 aa, Staphylococcus aureus
DQFLQHTILFKGFFTNHSWYNDLLVDFDSKDI

SEQ ID NO: 1715684 - protein, 17 aa, Staphylococcus aureus
DQIPSGYTILATGTPDG

SEQ ID NO: 1715685 - protein, 22 aa, Staphylococcus aureus
DQNTIKQGVNFTDADEAKRNAY

SEQ ID NO: 1715686 - protein, 18 aa, Staphylococcus aureus
DRLDLQFIPDNTAVADAS

SEQ ID NO: 1715687 - protein, 20 aa, Staphylococcus aureus
DSPDTWKNTVGNTHKTAVVT

SEQ ID NO: 1715688 - protein, 20 aa, Staphylococcus aureus
DVKFSIDRAKAMNKDSTVET

SEQ ID NO: 1715689 - protein, 34 aa, Staphylococcus aureus; identical to SEQ ID NO: 1580778

SEQ ID NO: 1715690 - protein, 31 aa, Staphylococcus aureus; identical to SEQ ID NO: 1580783

SEQ ID NO: 1715691 - protein, 17 aa, Staphylococcus aureus
EAIKTKAINDINQTTPA

SEQ ID NO: 1715692 - protein, 18 aa, Staphylococcus aureus
EALIKNKILYHENRNKGK

SEQ ID NO: 1715693 - protein, 20 aa, Staphylococcus aureus
EALKIKGMVLYMNRNTKTTK

SEQ ID NO: 1715694 - protein, 19 aa, Staphylococcus aureus
EAQEAIKASADNQVESIKD

SEQ ID NO: 1715695 - protein, 23 aa, Staphylococcus aureus
EEKLSALYEVDWKTHNVKFVKVL

SEQ ID NO: 1715696 - protein, 20 aa, Staphylococcus aureus
EGQRLIVTYEVDWKNKTVKV

SEQ ID NO: 1715697 - protein, 20 aa, Staphylococcus aureus
EIDLGDKLQFEHMGDVLNSK

SEQ ID NO: 1715698 - protein, 22 aa, Staphylococcus aureus
EIEEFKFFVQYGNFKELENYKE

SEQ ID NO: 1715699 - protein, 21 aa, Staphylococcus aureus
EKEMTREDFGLAPMKTDEAKM

SEQ ID NO: 1715700 - protein, 18 aa, Staphylococcus aureus
EKKVPINLWLDGKQNTVP

SEQ ID NO: 1715701 - protein, 19 aa, Staphylococcus aureus
EKQRITTAFMNKNQNIRGY

SEQ ID NO: 1715702 - protein, 18 aa, Staphylococcus aureus
ELITAKNHLDDPVSTEGK

SEQ ID NO: 1715703 - protein, 21 aa, Staphylococcus aureus
ELLKEKPDLILAHESQKATAN

SEQ ID NO: 1715704 - protein, 23 aa, Staphylococcus aureus
ELNTAMTALKRAIADKADTKASG

SEQ ID NO: 1715705 - protein, 24 aa, Staphylococcus aureus
ENAELRTGPNAAYSVIYKVEKGDH

SEQ ID NO: 1715706 - protein, 18 aa, Staphylococcus aureus
ENTEVLKFASGAQVNDRL

SEQ ID NO: 1715707 - protein, 44 aa, Staphylococcus aureus; identical to SEQ ID NO: 1580029

SEQ ID NO: 1715708 - protein, 24 aa, Staphylococcus aureus
ESGKVYEFHLKKNVKFSDGSALDA

SEQ ID NO: 1715709 - protein, 21 aa, Staphylococcus aureus
ESRAAEPRSVSDYQNANSSYY

SEQ ID NO: 1715710 - protein, 17 aa, Staphylococcus aureus
EVAEADAAVDAAQKQGL

SEQ ID NO: 1715711 - protein, 20 aa, Staphylococcus aureus
EWILALSPQGGYTYTFGTSL

SEQ ID NO: 1715712 - protein, 25 aa, Staphylococcus aureus
EWVQAAKAKPVYGAKEFLKYADKKD

SEQ ID NO: 1715713 - protein, 18 aa, Staphylococcus aureus
FFFTFLIKNNLAYADVGV

SEQ ID NO: 1715714 - protein, 18 aa, Staphylococcus aureus
FFGQYADFKSLKSYNNGD

SEQ ID NO: 1715715 - protein, 17 aa, Staphylococcus aureus
FGANYYYQCYFSKKTND

SEQ ID NO: 1715716 - protein, 18 aa, Staphylococcus aureus
FILLSFIALTLITSPFVN

SEQ ID NO: 1715717 - protein, 24 aa, Staphylococcus aureus
FINANRDAISFAEGDISVTNTPNG

SEQ ID NO: 1715718 - protein, 17 aa, Staphylococcus aureus
FKPVMHLKGDAFNQQLQ

SEQ ID NO: 1715719 - protein, 17 aa, Staphylococcus aureus
FLEKNTKGSVLITSLAG

SEQ ID NO: 1715720 - protein, 26 aa, Staphylococcus aureus
FNDLKKRAQTILAENRNNVPLNKRVS

SEQ ID NO: 1715721 - protein, 20 aa, Staphylococcus aureus
FNIGDIKQYFTLSNGQAIPS

SEQ ID NO: 1715722 - protein, 17 aa, Staphylococcus aureus
FPAVHYSMGGLYVDYDQ

SEQ ID NO: 1715723 - protein, 30 aa, Staphylococcus aureus
FSIRKFNVGIFSALIATVTFISINPTTASA

SEQ ID NO: 1715724 - protein, 29 aa, Staphylococcus aureus
FSIRKFNVGIFSALIATVTFISTNPTTAS

SEQ ID NO: 1715725 - protein, 26 aa, Staphylococcus aureus
GAGANKPLQQMWEYGVNDPDRSHDFK

SEQ ID NO: 1715726 - protein, 20 aa, Staphylococcus aureus
GDKGKWVIRSEMTTELKNEN

SEQ ID NO: 1715727 - protein, 22 aa, Staphylococcus aureus
GDPHALKAFPSAINQDNYPNGG

SEQ ID NO: 1715728 - protein, 21 aa, Staphylococcus aureus
GEFRIVPTTVALTMTLDKLDL

SEQ ID NO: 1715729 - protein, 24 aa, Staphylococcus aureus
GGYAGEILNDLGFKRNKDLQKQVD

SEQ ID NO: 1715730 - protein, 20 aa, Staphylococcus aureus
GLNAILGFLVLTGVIQDPTT

SEQ ID NO: 1715731 - protein, 19 aa, Staphylococcus aureus
GNDIGPVRAAYEEGLNNIN

SEQ ID NO: 1715732 - protein, 24 aa, Staphylococcus aureus
GNNNIKVILPKVQVKPAARQSVSA

SEQ ID NO: 1715733 - protein, 21 aa, Staphylococcus aureus
GNPSTWFYPLGEKKVERKAPK

SEQ ID NO: 1715734 - protein, 20 aa, Staphylococcus aureus
GNQFYSINAGFRKYPSTKES

SEQ ID NO: 1715735 - protein, 17 aa, Staphylococcus aureus
GNQKFYLVQDYNSGNKF

SEQ ID NO: 1715736 - protein, 33 aa, Staphylococcus aureus
GNSPARLMPDKILDLKYKLRVNNVPTPRTVTFN

SEQ ID NO: 1715737 - protein, 22 aa, Staphylococcus aureus
GQGDASYTISFKTQGPTVNKLY

SEQ ID NO: 1715738 - protein, 17 aa, Staphylococcus aureus
GRYVDVFGLKDKDTDQL

SEQ ID NO: 1715739 - protein, 18 aa, Staphylococcus aureus
GTASILVGTTLIFGLSGH

SEQ ID NO: 1715740 - protein, 21 aa, Staphylococcus aureus
GVKDRMGVTVNGRIDTLNKAD

SEQ ID NO: 1715741 - protein, 17 aa, Staphylococcus aureus
GYFYDFDSLKGMQKSIT

SEQ ID NO: 1715742 - protein, 19 aa, Staphylococcus aureus
HGISTLRKVPEIKNSTEDK

SEQ ID NO: 1715743 - protein, 25 aa, Staphylococcus aureus
HKDTEDFYITLKIIDVKQPEGDQRV

SEQ ID NO: 1715744 - protein, 25 aa, Staphylococcus aureus
HNAEAPKVRKARSVDEGSFDITRDS

SEQ ID NO: 1715745 - protein, 19 aa, Staphylococcus aureus
HVILIFALILVISTPNVLA

SEQ ID NO: 1715746 - protein, 19 aa, Staphylococcus aureus
IASSNAQMWKDITLSNKTY

SEQ ID NO: 1715747 - protein, 24 aa, Staphylococcus aureus
IDFGNADSAYVVMVNTKFQYTNSE

SEQ ID NO: 1715748 - protein, 19 aa, Staphylococcus aureus
IDFKLRKYLIDNYGLYGEM

SEQ ID NO: 1715749 - protein, 36 aa, Staphylococcus aureus
IDKLYYAAGGRALEYNQLFMYSQLYVESTQDYQQRL

SEQ ID NO: 1715750 - protein, 25 aa, Staphylococcus aureus
IDLSEKLSFDRMFDVIDSKQIKNIE

SEQ ID NO: 1715751 - protein, 25 aa, Staphylococcus aureus
IDLSEKLSFERMFDVMDSKQIKNIE

SEQ ID NO: 1715752 - protein, 18 aa, Staphylococcus aureus
IENFKFFAQYGSFKDLSK

SEQ ID NO: 1715753 - protein, 22 aa, Staphylococcus aureus
IESRAAEPRSVSDYQNANSSYY

SEQ ID NO: 1715754 - protein, 19 aa, Staphylococcus aureus
IGLHSGSHVYVERRTMEPT

SEQ ID NO: 1715755 - protein, 23 aa, Staphylococcus aureus
IKLRRYLQEEYNIYGHNGTKKGE

SEQ ID NO: 1715756 - protein, 19 aa, Staphylococcus aureus
IKNGTAMPTNLAGGSTTTI

SEQ ID NO: 1715757 - protein, 17 aa, Staphylococcus aureus
IKPEAQQAIKATAENQV

SEQ ID NO: 1715758 - protein, 21 aa, Staphylococcus aureus
IKRIKDNILNFDAYIEPGNSG

SEQ ID NO: 1715759 - protein, 17 aa, Staphylococcus aureus
ILVGTTLIFGLGNQEAK

SEQ ID NO: 1715760 - protein, 17 aa, Staphylococcus aureus
ISLLLGILATGVNTTTE

SEQ ID NO: 1715761 - protein, 18 aa, Staphylococcus aureus
ITKKNVRSVFGFVSNPSL

SEQ ID NO: 1715762 - protein, 19 aa, Staphylococcus aureus
ITLKELIEASMKYSDNTAN

SEQ ID NO: 1715763 - protein, 29 aa, Staphylococcus aureus
ITTNKDGYKYYSFIDNVGLFSGSHLYVKN

SEQ ID NO: 1715764 - protein, 18 aa, Staphylococcus aureus
IVICVLLVLITISQILKH

SEQ ID NO: 1715765 - protein, 24 aa, Staphylococcus aureus
IVKELKPLLKWSEVPANAVGDAVK

SEQ ID NO: 1715766 - protein, 18 aa, Staphylococcus aureus
IWQNGHIDITPNNPSGHL

SEQ ID NO: 1715767 - protein, 19 aa, Staphylococcus aureus
IYNYWKKKNPSLVTNSQIY

SEQ ID NO: 1715768 - protein, 18 aa, Staphylococcus aureus
KASERKTAIEAMNDSTTE

SEQ ID NO: 1715769 - protein, 18 aa, Staphylococcus aureus
KDGFSYDEFFFIQKEEVS

SEQ ID NO: 1715770 - protein, 25 aa, Staphylococcus aureus
KDNTRIGEDITVTAHILIDGETTPI

SEQ ID NO: 1715771 - protein, 23 aa, Staphylococcus aureus
KDTEDFYITLKIIDVKQPEGDQR

SEQ ID NO: 1715772 - protein, 24 aa, Staphylococcus aureus
KDVVGISTRLIRVTYDNRQTEDLT

SEQ ID NO: 1715773 - protein, 24 aa, Staphylococcus aureus
KEDQQCSFDDIFKHFNQQYYGVPI

SEQ ID NO: 1715774 - protein, 17 aa, Staphylococcus aureus
KEGYRDGEFEKGDKGTW

SEQ ID NO: 1715775 - protein, 20 aa, Staphylococcus aureus
KFFGQYADFKSLKSYNNGDV

SEQ ID NO: 1715776 - protein, 37 aa, Staphylococcus aureus
KGLYPGLKINSYRVFGSESAESIWVIKGIIEAAKDDS

SEQ ID NO: 1715777 - protein, 26 aa, Staphylococcus aureus
KGSMLPKVEAALQFLEKNTKGSVLIT

SEQ ID NO: 1715778 - protein, 26 aa, Staphylococcus aureus
KIANRPTDGGLSWSDDHKSLIYRYDA

SEQ ID NO: 1715779 - protein, 25 aa, Staphylococcus aureus
KIPINLWIDSIRTVVPLDIVKTNKK

SEQ ID NO: 1715780 - protein, 20 aa, Staphylococcus aureus
KKATARNEITTILNNKLQEI

SEQ ID NO: 1715781 - protein, 20 aa, Staphylococcus aureus
KKLTDKLKEKQIVKDGDTVT

SEQ ID NO: 1715782 - protein, 19 aa, Staphylococcus aureus
KKLTDKLKEKQIVKNGDTV

SEQ ID NO: 1715783 - protein, 17 aa, Staphylococcus aureus
KKVPINLWLDGKQNTVP

SEQ ID NO: 1715784 - protein, 22 aa, Staphylococcus aureus
KLKDVTGQFDVIYSNDNKTATV

SEQ ID NO: 1715785 - protein, 18 aa, Staphylococcus aureus
KMKVGLVSVAITMLYIMT

SEQ ID NO: 1715786 - protein, 26 aa, Staphylococcus aureus
KNNGSLSITGRVSMNQAFNSDITFKV

SEQ ID NO: 1715787 - protein, 23 aa, Staphylococcus aureus
KQAIAGLTPDLAPLQTAKTQLQN

SEQ ID NO: 1715788 - protein, 43 aa, Staphylococcus aureus; identical to SEQ ID NO: 1598738

SEQ ID NO: 1715789 - protein, 53 aa, Staphylococcus aureus; identical to SEQ ID NO: 1577469

SEQ ID NO: 1715790 - protein, 21 aa, Staphylococcus aureus
KRINLYFKYNLNNYSSMKVTS

SEQ ID NO: 1715791 - protein, 32 aa, Staphylococcus aureus; identical to SEQ ID NO: 1669547

SEQ ID NO: 1715792 - protein, 20 aa, Staphylococcus aureus
KSAHDRYLFVQSPNGPSGSA

SEQ ID NO: 1715793 - protein, 32 aa, Staphylococcus aureus
KSWIDDGFLPLIYKGEMMDLSRGRAISRENET

SEQ ID NO: 1715794 - protein, 17 aa, Staphylococcus aureus
KTAIEAMNDSTTEEQQA

SEQ ID NO: 1715795 - protein, 25 aa, Staphylococcus aureus
KVEEIPFKKERKFNPDLAPGTEKVT

SEQ ID NO: 1715796 - protein, 22 aa, Staphylococcus aureus
KVEKELPNTGSEEMDLPLKEFA

SEQ ID NO: 1715797 - protein, 17 aa, Staphylococcus aureus
KVKQAFINANRDVITLA

SEQ ID NO: 1715798 - protein, 37 aa, Staphylococcus aureus
KVNGYSLINNGKIGFVNSELRRSDMFDKNNPQNYQAR

SEQ ID NO: 1715799 - protein, 17 aa, Staphylococcus aureus
KVPLNAIKIPKSVLTKG

SEQ ID NO: 1715800 - protein, 26 aa, Staphylococcus aureus
KYEDIKARLTLYSYIDKQAVPNETSL

SEQ ID NO: 1715801 - protein, 24 aa, Staphylococcus aureus
KYEIDLSDKLGFERMADVINSEQI

SEQ ID NO: 1715802 - protein, 20 aa, Staphylococcus aureus
KYEVTLPQGVTYINDSLTTT

SEQ ID NO: 1715803 - protein, 20 aa, Staphylococcus aureus
KYEVTLPQGVTYVNNSLTTT

SEQ ID NO: 1715804 - protein, 20 aa, Staphylococcus aureus
KYNHKEILKEIGNLTNNEDK

SEQ ID NO: 1715805 - protein, 18 aa, Staphylococcus aureus
LAEAKAAARQNLGTLNHI

SEQ ID NO: 1715806 - protein, 18 aa, Staphylococcus aureus
LAQERVIGANVWVDGIQK

SEQ ID NO: 1715807 - protein, 22 aa, Staphylococcus aureus
LASALVLGACGSNDGDKKEESK

SEQ ID NO: 1715808 - protein, 21 aa, Staphylococcus aureus
LCASIIVSGCSFIPKNQTKSI

SEQ ID NO: 1715809 - protein, 18 aa, Staphylococcus aureus
LCSLFILTACSTSVDKTS

SEQ ID NO: 1715810 - protein, 17 aa, Staphylococcus aureus
LDNAMGAVQQYIDEQHL

SEQ ID NO: 1715811 - protein, 17 aa, Staphylococcus aureus
LDQAAADKKTQIEQTPN

SEQ ID NO: 1715812 - protein, 23 aa, Staphylococcus aureus
LDVHPIKKPDAGKRLMMILHASL

SEQ ID NO: 1715813 - protein, 17 aa, Staphylococcus aureus
LEGQNVFVVKELIDPNG

SEQ ID NO: 1715814 - protein, 17 aa, Staphylococcus aureus
LFISVIILTIFIMGCDS

SEQ ID NO: 1715815 - protein, 17 aa, Staphylococcus aureus
LFLGFVAVILTVCLIGL

SEQ ID NO: 1715816 - protein, 20 aa, Staphylococcus aureus
LIDPNGRLSTVGGVTKKNNQ

SEQ ID NO: 1715817 - protein, 29 aa, Staphylococcus aureus
LIPNLPNGDYRVEFSNLPKGYEVTPSKQG

SEQ ID NO: 1715818 - protein, 17 aa, Staphylococcus aureus
LITAKNHLDDPVSTEGK

SEQ ID NO: 1715819 - protein, 17 aa, Staphylococcus aureus
LKDGETYTVKFETPAGY

SEQ ID NO: 1715820 - protein, 20 aa, Staphylococcus aureus
LKGSEFTFTPEAPKTITELE

SEQ ID NO: 1715821 - protein, 18 aa, Staphylococcus aureus
LKLYYSGPSFEYKKVTGY

SEQ ID NO: 1715822 - protein, 19 aa, Staphylococcus aureus
LKNAVNIRKNLVPKGGNNG

SEQ ID NO: 1715823 - protein, 18 aa, Staphylococcus aureus
LKPYLKGVDYIGENDVEK

SEQ ID NO: 1715824 - protein, 25 aa, Staphylococcus aureus
LLEELRKQLKIEPGHFSYHEMSPAE

SEQ ID NO: 1715825 - protein, 18 aa, Staphylococcus aureus
LLTACGANQHKENSSKSN

SEQ ID NO: 1715826 - protein, 18 aa, Staphylococcus aureus
LNGDERLREAKQNANTAI

SEQ ID NO: 1715827 - protein, 19 aa, Staphylococcus aureus
LNGLRQVVNRTYRIGTTKR

SEQ ID NO: 1715828 - protein, 22 aa, Staphylococcus aureus
LNISQILTFNFIKDKSYDKDTL

SEQ ID NO: 1715829 - protein, 24 aa, Staphylococcus aureus
LNKADGKFSHFAYVKPNNQSLSSV

SEQ ID NO: 1715830 - protein, 18 aa, Staphylococcus aureus
LNTARQGLTLDRQPALTT

SEQ ID NO: 1715831 - protein, 26 aa, Staphylococcus aureus
LPDDIPPTINNPVGINAKYYRGDEVN

SEQ ID NO: 1715832 - protein, 38 aa, Staphylococcus aureus; identical to SEQ ID NO: 1577481

SEQ ID NO: 1715833 - protein, 17 aa, Staphylococcus aureus
LQAFFDANYHDYRFIDR

SEQ ID NO: 1715834 - protein, 19 aa, Staphylococcus aureus
LQEDPTWKKLNAVKNNRVD

SEQ ID NO: 1715835 - protein, 27 aa, Staphylococcus aureus
LRVNNVPTPRTVTFNDTLTYKTYTQDF

SEQ ID NO: 1715836 - protein, 24 aa, Staphylococcus aureus
LSLPIRAGYSLEIKVPLNAIKIPK

SEQ ID NO: 1715837 - protein, 21 aa, Staphylococcus aureus
LSLSNKWLWQKPNGSIHATLQ

SEQ ID NO: 1715838 - protein, 19 aa, Staphylococcus aureus
LTLLKATTTVPGLRNNIAG

SEQ ID NO: 1715839 - protein, 17 aa, Staphylococcus aureus
LTSNENFTDKDWQITGI

SEQ ID NO: 1715840 - protein, 17 aa, Staphylococcus aureus
LTTHIDLIRGGNTHHEI

SEQ ID NO: 1715841 - protein, 17 aa, Staphylococcus aureus
LTVSAGDKVKAGDQIAY

SEQ ID NO: 1715842 - protein, 19 aa, Staphylococcus aureus
LWKNVRDALKEANIIDKTD

SEQ ID NO: 1715843 - protein, 18 aa, Staphylococcus aureus
MFEKEWILALSPQGGYTY

SEQ ID NO: 1715844 - protein, 25 aa, Staphylococcus aureus
MKNGGKYTFELHKKLQEHRMADVID

SEQ ID NO: 1715845 - protein, 20 aa, Staphylococcus aureus
MLGISFLFLVISITAGCGMG

SEQ ID NO: 1715846 - protein, 30 aa, Staphylococcus aureus; identical to SEQ ID NO: 1578613

SEQ ID NO: 1715847 - protein, 18 aa, Staphylococcus aureus
MTIGLAMNSVYYYKKEKD

SEQ ID NO: 1715848 - protein, 24 aa, Staphylococcus aureus
NALNGDANLQCAKTEATQAIDNLT

SEQ ID NO: 1715849 - protein, 38 aa, Staphylococcus aureus
NDAITDARGIYQLKDGYKYYSFVDSIGLHSGSHVYVER

SEQ ID NO: 1715850 - protein, 46 aa, Staphylococcus aureus
NDAITDARGIYQLRDGYKYYDFVDSIGLHSGSHVYVERRTMEPTAT

SEQ ID NO: 1715851 - protein, 47 aa, Staphylococcus aureus
NDAITDARGIYQLRDGYKYYDFVDSIGLHSGSHVYVERRTMEPTATN

SEQ ID NO: 1715852 - protein, 26 aa, Staphylococcus aureus
NDAKAFFSYEWKGLEIAKNLADQAKK

SEQ ID NO: 1715853 - protein, 27 aa, Staphylococcus aureus
NEIREIEPVISRKASAREQLTTLFNDK

SEQ ID NO: 1715854 - protein, 24 aa, Staphylococcus aureus
NGGHTAGIGGSWAVQDGQDYNSWK

SEQ ID NO: 1715855 - protein, 18 aa, Staphylococcus aureus
NGITAAWANRQQPNNQQA

SEQ ID NO: 1715856 - protein, 17 aa, Staphylococcus aureus
NGITAVWANRQQPNNQQ

SEQ ID NO: 1715857 - protein, 18 aa, Staphylococcus aureus
NGKYRFDNLDSGKYKVIF

SEQ ID NO: 1715858 - protein, 28 aa, Staphylococcus aureus
NIDANNTWKKLTEKLKEKNIVNNGDNVS

SEQ ID NO: 1715859 - protein, 19 aa, Staphylococcus aureus
NIGDIKQYFTLSNGQAIPS

SEQ ID NO: 1715860 - protein, 22 aa, Staphylococcus aureus
NKLRNGVKMIVEQVAHKVSQLY

SEQ ID NO: 1715861 - protein, 19 aa, Staphylococcus aureus
NLTGYKFNPDAKNFKIYEV

SEQ ID NO: 1715862 - protein, 17 aa, Staphylococcus aureus
NNKEFTVTTSLKNNGNF

SEQ ID NO: 1715863 - protein, 24 aa, Staphylococcus aureus
NNLVFPGQVISVGGSDAQNSSNTS

SEQ ID NO: 1715864 - protein, 20 aa, Staphylococcus aureus
NPNGDRFDANDAWKKLTDKL

SEQ ID NO: 1715865 - protein, 26 aa, Staphylococcus aureus
NQDGKRPTEIKVELYQDGKATGKTAT

SEQ ID NO: 1715866 - protein, 17 aa, Staphylococcus aureus
NQFYNIFHLLDQHKYAE

SEQ ID NO: 1715867 - protein, 18 aa, Staphylococcus aureus
NQSEPIILVIFTNKDNKS

SEQ ID NO: 1715868 - protein, 29 aa, Staphylococcus aureus
NRKGMIPNRLNKFSIRKYSVGTASILVGT

SEQ ID NO: 1715869 - protein, 17 aa, Staphylococcus aureus
NRNNVPLNKRVSQADID

SEQ ID NO: 1715870 - protein, 21 aa, Staphylococcus aureus
NSKQGATNLVIKDAKKNTELA

SEQ ID NO: 1715871 - protein, 18 aa, Staphylococcus aureus
NSNWLKYPSEYHVDFQVK

SEQ ID NO: 1715872 - protein, 19 aa, Staphylococcus aureus
NSPARLMPDKILDLRYKLR

SEQ ID NO: 1715873 - protein, 23 aa, Staphylococcus aureus
NTARQGLTLDRQPAFTTLHGASN

SEQ ID NO: 1715874 - protein, 26 aa, Staphylococcus aureus
NYQARGNVAALGRVNANDSTDHGNFN

SEQ ID NO: 1715875 - protein, 23 aa, Staphylococcus aureus
PAANGAGAFTIDHVVKSNSTHNA

SEQ ID NO: 1715876 - protein, 17 aa, Staphylococcus aureus
PDLGTFFLMATTSRIIG

SEQ ID NO: 1715877 - protein, 18 aa, Staphylococcus aureus
PDSELIINFTTMQTNSKQ

SEQ ID NO: 1715878 - protein, 17 aa, Staphylococcus aureus
PEFPERNDEEWLKTTMA

SEQ ID NO: 1715879 - protein, 18 aa, Staphylococcus aureus
PGETSATVTKNWDDNNNQ

SEQ ID NO: 1715880 - protein, 17 aa, Staphylococcus aureus
PHLSLSNKWLWQKPNGS

SEQ ID NO: 1715881 - protein, 19 aa, Staphylococcus aureus
PISTYWSDAKYWAGNAAND

SEQ ID NO: 1715882 - protein, 20 aa, Staphylococcus aureus
PITGELLHQGFVSKYIDVYE

SEQ ID NO: 1715883 - protein, 19 aa, Staphylococcus aureus
PLRDKYRVGTSSTAANPVR

SEQ ID NO: 1715884 - protein, 24 aa, Staphylococcus aureus
PMIEMMFGVHFIKGGMYGMAQGLA

SEQ ID NO: 1715885 - protein, 19 aa, Staphylococcus aureus
PNCATFPNQMIEYGKSQGR

SEQ ID NO: 1715886 - protein, 24 aa, Staphylococcus aureus
PNQMIEYGKSQGRDIHYQEGVPSY

SEQ ID NO: 1715887 - protein, 19 aa, Staphylococcus aureus
PTDADRLDLQFIPDNTAVA

SEQ ID NO: 1715888 - protein, 17 aa, Staphylococcus aureus
PTLAKSIIDQATQAVTD

SEQ ID NO: 1715889 - protein, 19 aa, Staphylococcus aureus
PTPTCIVCRNWLPNFSVLG

SEQ ID NO: 1715890 - protein, 22 aa, Staphylococcus aureus
QAIAGLTPDLAPLQTAKTQLQN

SEQ ID NO: 1715891 - protein, 24 aa, Staphylococcus aureus
QALNEAMKALKESIKDQPQTEASS

SEQ ID NO: 1715892 - protein, 25 aa, Staphylococcus aureus
QELKKYYSGTGYNFQNVSGYREGNK

SEQ ID NO: 1715893 - protein, 24 aa, Staphylococcus aureus
QIKPKVRRKRAALDSIEENNKNQL

SEQ ID NO: 1715894 - protein, 17 aa, Staphylococcus aureus
QITGIPRTLHIENSTNR

SEQ ID NO: 1715895 - protein, 19 aa, Staphylococcus aureus
QKASERKTAIEAMNDSTTE

SEQ ID NO: 1715896 - protein, 26 aa, Staphylococcus aureus
QKEALKAQVTSAGRVSVANGVEHTAT

SEQ ID NO: 1715897 - protein, 19 aa, Staphylococcus aureus
QKERITIYMKHNVKGYKNI

SEQ ID NO: 1715898 - protein, 18 aa, Staphylococcus aureus
QLKGRYVDVFGLKDKDTD

SEQ ID NO: 1715899 - protein, 18 aa, Staphylococcus aureus
QMNAGTQLYHIVASNAYH

SEQ ID NO: 1715900 - protein, 18 aa, Staphylococcus aureus
QMNAGTQLYHIVATNAYH

SEQ ID NO: 1715901 - protein, 26 aa, Staphylococcus aureus
QNTLYKMRWNPAHPGTHQYATDIDWA

SEQ ID NO: 1715902 - protein, 24 aa, Staphylococcus aureus
QPHLSLSGKWLWQKPNGTIHATLQ

SEQ ID NO: 1715903 - protein, 19 aa, Staphylococcus aureus
QQADYTFASLDIFNDLKRR

SEQ ID NO: 1715904 - protein, 19 aa, Staphylococcus aureus
QRLQSAIANKDQTKASENY

SEQ ID NO: 1715905 - protein, 25 aa, Staphylococcus aureus
QVKKIDPKHGFSINELFFIQKEEVS

SEQ ID NO: 1715906 - protein, 17 aa, Staphylococcus aureus
RFEYPLHNRKIVHNQEI

SEQ ID NO: 1715907 - protein, 18 aa, Staphylococcus aureus
RGTALQKVPVNISGIPLD

SEQ ID NO: 1715908 - protein, 19 aa, Staphylococcus aureus
RHAEPMPNIPEMRQVWEPM

SEQ ID NO: 1715909 - protein, 17 aa, Staphylococcus aureus
RKYYEPLIHKNDKEFKE

SEQ ID NO: 1715910 - protein, 18 aa, Staphylococcus aureus
RLQSAIANKDQTKASENY

SEQ ID NO: 1715911 - protein, 23 aa, Staphylococcus aureus
RNATELNTAMGQLQHAIADKTNT

SEQ ID NO: 1715912 - protein, 19 aa, Staphylococcus aureus
RQLRYIYDVYFDRDDRITV

SEQ ID NO: 1715913 - protein, 27 aa, Staphylococcus aureus
RTYSDALMPYNFISSVFKNNDGQPGVL

SEQ ID NO: 1715914 - protein, 19 aa, Staphylococcus aureus
RVILIFALILVISTPNVLA

SEQ ID NO: 1715915 - protein, 18 aa, Staphylococcus aureus
RVKSEIFSLTRNGNLWAK

SEQ ID NO: 1715916 - protein, 23 aa, Staphylococcus aureus
SAANGAGAFTIDHVVKNNSTHNA

SEQ ID NO: 1715917 - protein, 18 aa, Staphylococcus aureus
SANLPSVRGTMIDVSFKY

SEQ ID NO: 1715918 - protein, 19 aa, Staphylococcus aureus
SEDAHPIVLGNTEKVVVVN

SEQ ID NO: 1715919 - protein, 23 aa, Staphylococcus aureus
SEFQLRARLFVDQIVSFAHNSPY

SEQ ID NO: 1715920 - protein, 20 aa, Staphylococcus aureus
SEIKPRMKRSADVAEVAEKE

SEQ ID NO: 1715921 - protein, 20 aa, Staphylococcus aureus
SEKKDLQWDISRLTSNGKSF

SEQ ID NO: 1715922 - protein, 24 aa, Staphylococcus aureus
SKGKITYLKGEAMQYDLSTTGGNS

SEQ ID NO: 1715923 - protein, 24 aa, Staphylococcus aureus
SKIKVSMKNGGYYTFELNKKLQPH

SEQ ID NO: 1715924 - protein, 25 aa, Staphylococcus aureus
SNDAKAFFSYEWKGLEIAKKLADQA

SEQ ID NO: 1715925 - protein, 20 aa, Staphylococcus aureus
SNGFGMPDMNAISMDTSPAF

SEQ ID NO: 1715926 - protein, 17 aa, Staphylococcus aureus
SNLKQGIANKDTVKASE

SEQ ID NO: 1715927 - protein, 28 aa, Staphylococcus aureus
SPVFNEKNEVIGIHWGGVPNEFNGAVFI

SEQ ID NO: 1715928 - protein, 17 aa, Staphylococcus aureus
SSEKYRDADTNKQQEYD

SEQ ID NO: 1715929 - protein, 18 aa, Staphylococcus aureus
SVRGTMIDVSFKYLTKDK

SEQ ID NO: 1715930 - protein, 27 aa, Staphylococcus aureus
SWSAHISLWGAESWGNINQLKGRYVDV

SEQ ID NO: 1715931 - protein, 26 aa, Staphylococcus aureus
TAPKRLNTRMRIAAVQPSSTEAKNVN

SEQ ID NO: 1715932 - protein, 20 aa, Staphylococcus aureus
TAVKQDLTEVQALDQLMDAL

SEQ ID NO: 1715933 - protein, 23 aa, Staphylococcus aureus
TDVKTNARAELLTEMQNKITEIL

SEQ ID NO: 1715934 - protein, 24 aa, Staphylococcus aureus
TEALNLRAKIDLILGDEKDPIRVT

SEQ ID NO: 1715935 - protein, 24 aa, Staphylococcus aureus
TGIKKGWLYGYSEIDSSHFTDRDK

SEQ ID NO: 1715936 - protein, 17 aa, Staphylococcus aureus
TGQAESFLKIYNDNKTI

SEQ ID NO: 1715937 - protein, 17 aa, Staphylococcus aureus
TIHATLLQFSWYSHIQV

SEQ ID NO: 1715938 - protein, 21 aa, Staphylococcus aureus
TIQGKEHFEGYGSVDIQKNPT

SEQ ID NO: 1715939 - protein, 39 aa, Staphylococcus aureus
TITIRPQDYVVFIPPVGKQIRAVVYYNKVVASNMSNAVT

SEQ ID NO: 1715940 - protein, 23 aa, Staphylococcus aureus
TLDIIPKLMLQGSVDLLNEVATS

SEQ ID NO: 1715941 - protein, 21 aa, Staphylococcus aureus
TLKELIEASMAYSDNTANNKI

SEQ ID NO: 1715942 - protein, 22 aa, Staphylococcus aureus
TLNQAMHGLRESIQDNAATKAN

SEQ ID NO: 1715943 - protein, 22 aa, Staphylococcus aureus
TLNQAMHGLRQSIQDNAATKAN

SEQ ID NO: 1715944 - protein, 21 aa, Staphylococcus aureus
TNAKLKVQAYHSSYPNNIGQI

SEQ ID NO: 1715945 - protein, 21 aa, Staphylococcus aureus
TNEAINIYFVPSDLVNPTISV

SEQ ID NO: 1715946 - protein, 24 aa, Staphylococcus aureus
TNEEKGKDIEPVRATYEEGLNNIN

SEQ ID NO: 1715947 - protein, 26 aa, Staphylococcus aureus
TNVNRVNDRLTLAINQLVPLADNSAL

SEQ ID NO: 1715948 - protein, 24 aa, Staphylococcus aureus
TNVTGYKYGNKVTFIDNSQQIDVT

SEQ ID NO: 1715949 - protein, 26 aa, Staphylococcus aureus
TPITKTATYKVVRTVPKQVFETARGV

SEQ ID NO: 1715950 - protein, 18 aa, Staphylococcus aureus
TQEKRINLYFKYNLNNYS

SEQ ID NO: 1715951 - protein, 17 aa, Staphylococcus aureus
TQVLLPGDEYRKYQQRR

SEQ ID NO: 1715952 - protein, 18 aa, Staphylococcus aureus
TQVRPLRIMSPHSVEDGK

SEQ ID NO: 1715953 - protein, 18 aa, Staphylococcus aureus
TSLINFLPIHSLLSALKN

SEQ ID NO: 1715954 - protein, 21 aa, Staphylococcus aureus
TSPWVKEASADNVTGIVGTNN

SEQ ID NO: 1715955 - protein, 25 aa, Staphylococcus aureus
TTDNALWKNVRDALKDANIIDKTDN

SEQ ID NO: 1715956 - protein, 22 aa, Staphylococcus aureus
TTGADGWGFLFSKGNAEEYLTN

SEQ ID NO: 1715957 - protein, 27 aa, Staphylococcus aureus
TTNKDGYKYYSFIDNVGLFSGSHLYVK

SEQ ID NO: 1715958 - protein, 17 aa, Staphylococcus aureus
TTPEGYTPTTVTSGSDI

SEQ ID NO: 1715959 - protein, 25 aa, Staphylococcus aureus
TVGTFSTVIATLVFLGLNTSQAQAA

SEQ ID NO: 1715960 - protein, 28 aa, Staphylococcus aureus
TVNVVNNLPGFTLINGGKVGVFSHAMVR

SEQ ID NO: 1715961 - protein, 17 aa, Staphylococcus aureus
TVSDALPNGGIKAKSSI

SEQ ID NO: 1715962 - protein, 18 aa, Staphylococcus aureus
TVSLFFFTFLIKNNLAYA

SEQ ID NO: 1715963 - protein, 19 aa, Staphylococcus aureus
TVSLFFFTFLIKNNLAYAD

SEQ ID NO: 1715964 - protein, 22 aa, Staphylococcus aureus
TVSLFFFTFLIKNNLAYADVGV

SEQ ID NO: 1715965 - protein, 20 aa, Staphylococcus aureus
TYTKETFVTNLTGYKFNPDA

SEQ ID NO: 1715966 - protein, 21 aa, Staphylococcus aureus
VAEAIERINAAKVSGVKAIEA

SEQ ID NO: 1715967 - protein, 22 aa, Staphylococcus aureus
VAEAIERINAAKVSGVKAIEAT

SEQ ID NO: 1715968 - protein, 18 aa, Staphylococcus aureus
VASNAYHKDTEDFYISLK

SEQ ID NO: 1715969 - protein, 17 aa, Staphylococcus aureus
VATMWESKGKITYLKGE

SEQ ID NO: 1715970 - protein, 20 aa, Staphylococcus aureus
VDEILAIKLPAEAMKVSPKV

SEQ ID NO: 1715971 - protein, 18 aa, Staphylococcus aureus
VEAIKTKAINDINQTAPA

SEQ ID NO: 1715972 - protein, 21 aa, Staphylococcus aureus
VEKELPNTGSEEMDLPLKELA

SEQ ID NO: 1715973 - protein, 22 aa, Staphylococcus aureus
VEVPVKVYPVANAKAPSRDVKG

SEQ ID NO: 1715974 - protein, 19 aa, Staphylococcus aureus
VFGPESWGNINQLRDKYVD

SEQ ID NO: 1715975 - protein, 19 aa, Staphylococcus aureus
VFVVKELIDPNGRLSTVGG

SEQ ID NO: 1715976 - protein, 20 aa, Staphylococcus aureus
VGDAVKRGAINAGLSKSDAG

SEQ ID NO: 1715977 - protein, 23 aa, Staphylococcus aureus
VGLFSGSHLYVKNRDLAPKATNN

SEQ ID NO: 1715978 - protein, 25 aa, Staphylococcus aureus
VGLNAKYYRGDEVSFTMGVSDRHSG

SEQ ID NO: 1715979 - protein, 18 aa, Staphylococcus aureus
VICATQLWHSNHANALVS

SEQ ID NO: 1715980 - protein, 17 aa, Staphylococcus aureus
VIILGIFIIGCDSSSDT

SEQ ID NO: 1715981 - protein, 35 aa, Staphylococcus aureus; identical to SEQ ID NO: 1576388

SEQ ID NO: 1715982 - protein, 22 aa, Staphylococcus aureus
VKFETPAGYLPTKVNGTTDGEK

SEQ ID NO: 1715983 - protein, 20 aa, Staphylococcus aureus
VKTPSNKVLGFYPTNANTNA

SEQ ID NO: 1715984 - protein, 17 aa, Staphylococcus aureus
VKYEVNWKTHEVKIKSI

SEQ ID NO: 1715985 - protein, 17 aa, Staphylococcus aureus
VLEYSFADYLAALDMKP

SEQ ID NO: 1715986 - protein, 19 aa, Staphylococcus aureus
VLILLASGCSGVFDTPEDS

SEQ ID NO: 1715987 - protein, 36 aa, Staphylococcus aureus
VNGYSLINNGKIGFVNSELRRSDMFDKNNPQNYQAR

SEQ ID NO: 1715988 - protein, 26 aa, Staphylococcus aureus
VNKLRDGYLLSDKKYKDWTEHNQDQI

SEQ ID NO: 1715989 - protein, 36 aa, Staphylococcus aureus; identical to SEQ ID NO: 1578289

SEQ ID NO: 1715990 - protein, 21 aa, Staphylococcus aureus
VPDLIRLSKTFLIESRDLTTV

SEQ ID NO: 1715991 - protein, 17 aa, Staphylococcus aureus
VQLTWNNGVAFYSNNAQ

SEQ ID NO: 1715992 - protein, 32 aa, Staphylococcus aureus
VQQLHANPVKKPAGKKELDQAAADKKTQIEQT

SEQ ID NO: 1715993 - protein, 20 aa, Staphylococcus aureus
VRARINGIPAVEVHATKASS

SEQ ID NO: 1715994 - protein, 19 aa, Staphylococcus aureus
VRYEIELNYYSPKSKKDTS

SEQ ID NO: 1715995 - protein, 22 aa, Staphylococcus aureus
VTGGKTCMYGGITKHEGNHFDN

SEQ ID NO: 1715996 - protein, 23 aa, Staphylococcus aureus
VTTEKDNGIAVLEQDVITPTVKP

SEQ ID NO: 1715997 - protein, 19 aa, Staphylococcus aureus
VTVKPLRDKYRVGTSSTAA

SEQ ID NO: 1715998 - protein, 23 aa, Staphylococcus aureus
VTVKPLRDKYRVGTSSTAANPVR

SEQ ID NO: 1715999 - protein, 26 aa, Staphylococcus aureus
VTVPVKRVIPEIVAHSHYTVQGQDFP

SEQ ID NO: 1716000 - protein, 20 aa, Staphylococcus aureus
VVDLKAGIHTADLINTSDIK

SEQ ID NO: 1716001 - protein, 19 aa, Staphylococcus aureus
VVLEYSFADYLAALDMKPV

SEQ ID NO: 1716002 - protein, 19 aa, Staphylococcus aureus
WFISVIILGIFIIGCDSSS

SEQ ID NO: 1716003 - protein, 21 aa, Staphylococcus aureus
WFISVIILGIFIIGCDSSSDT

SEQ ID NO: 1716004 - protein, 27 aa, Staphylococcus aureus
WGGVPNQFNGAVFINENVRNFLKQNIE

SEQ ID NO: 1716005 - protein, 20 aa, Staphylococcus aureus
WKKLTDKLKEKQIVKNGDTV

SEQ ID NO: 1716006 - protein, 22 aa, Staphylococcus aureus
WKTLTSKLKEKGLVTDGQTVTI

SEQ ID NO: 1716007 - protein, 26 aa, Staphylococcus aureus
WSAHIRLWGAESWGNINQLRDRYVDV

SEQ ID NO: 1716008 - protein, 18 aa, Staphylococcus aureus
WSEVPANAVGDAVKRGAI

SEQ ID NO: 1716009 - protein, 17 aa, Staphylococcus aureus
WTQKPKFEYIKNDLKDT

SEQ ID NO: 1716010 - protein, 23 aa, Staphylococcus aureus
YDFFPFKIVKEAMSLKEIDFKLR

SEQ ID NO: 1716011 - protein, 21 aa, Staphylococcus aureus
YDMKAAERLLKSEGYHKNDDG

SEQ ID NO: 1716012 - protein, 21 aa, Staphylococcus aureus
YDVPFQLQLLFVESGNGITIS

SEQ ID NO: 1716013 - protein, 19 aa, Staphylococcus aureus
YEAYERAVNYAKSRGSFLV

SEQ ID NO: 1716014 - protein, 18 aa, Staphylococcus aureus
YENPDLGTFFLMATTSRI

SEQ ID NO: 1716015 - protein, 25 aa, Staphylococcus aureus
YKQAVAKAEALISGTPDVVVTPSEI

SEQ ID NO: 1716016 - protein, 17 aa, Staphylococcus aureus
YLQNEYNIYGFNKTKKG

SEQ ID NO: 1716017 - protein, 19 aa, Staphylococcus aureus
YNAQGNIIAKGIYDSKTNT

SEQ ID NO: 1716018 - protein, 22 aa, Staphylococcus aureus
YNDGEVIIMTYMPFKDSNTKVS

SEQ ID NO: 1716019 - protein, 17 aa, Staphylococcus aureus
YPVGTYINASSKGAPYN

SEQ ID NO: 1716020 - protein, 27 aa, Staphylococcus aureus
YRQHLTDKGAYVWKNLKDYYIGLLGED

SEQ ID NO: 1716021 - protein, 21 aa, Staphylococcus aureus
YTFASLDIFNDLKRRAQTILD

SEQ ID NO: 1716022 - protein, 19 aa, Staphylococcus aureus
YTGAYGVVLLEGISQMMPM

SEQ ID NO: 1716023 - protein, 19 aa, Staphylococcus aureus
YYHFFSIKDPADVYYTKKK

SEQ ID NO: 1716024 - protein, 25 aa, Staphylococcus aureus
AAGGRALEYNQLFMYSQLYVESTQD

SEQ ID NO: 1716025 - protein, 21 aa, Staphylococcus aureus
AAGLIKLKKDFGLAGTVKAIT

SEQ ID NO: 1716026 - protein, 20 aa, Staphylococcus aureus
AAGLIKLKKDFGLAGTVKDI

SEQ ID NO: 1716027 - protein, 22 aa, Staphylococcus aureus
AANGAGAFTIDHVVKSNSTHNA

SEQ ID NO: 1716028 - protein, 24 aa, Staphylococcus aureus
AAVKPKANQVIDAKAEETTESIDQ

SEQ ID NO: 1716029 - protein, 25 aa, Staphylococcus aureus
ADGAKMKDRISVIGYPKGAQTKYKM

SEQ ID NO: 1716030 - protein, 17 aa, Staphylococcus aureus
AEADAAVDAAQTEGLHD

SEQ ID NO: 1716031 - protein, 18 aa, Staphylococcus aureus
AERAVYKVYFKDGTSKYV

SEQ ID NO: 1716032 - protein, 25 aa, Staphylococcus aureus
AGANKPLQQMWEYGVNDPDRSHDFK

SEQ ID NO: 1716033 - protein, 18 aa, Staphylococcus aureus
AGLQYKPQVQRVPGKWTD

SEQ ID NO: 1716034 - protein, 19 aa, Staphylococcus aureus
AGVKVFHYDNGFLHSKTLV

SEQ ID NO: 1716035 - protein, 18 aa, Staphylococcus aureus
AHPNGFYNNGGGLYKVTK

SEQ ID NO: 1716036 - protein, 18 aa, Staphylococcus aureus
AKALDQAMQALRNSIQDQ

SEQ ID NO: 1716037 - protein, 19 aa, Staphylococcus aureus
AKALDQAMQALRNSIQDQQ

SEQ ID NO: 1716038 - protein, 18 aa, Staphylococcus aureus
AKALNRAMDQLSQEITGN

SEQ ID NO: 1716039 - protein, 26 aa, Staphylococcus aureus
AKEIARTDLGRYFDRFADNLDKTQTN

SEQ ID NO: 1716040 - protein, 27 aa, Staphylococcus aureus
AKGDGLNAINPIAPVTVVKQAARDAVT

SEQ ID NO: 1716041 - protein, 17 aa, Staphylococcus aureus
AKKLAKIGIKGNLAGIA

SEQ ID NO: 1716042 - protein, 26 aa, Staphylococcus aureus
AKLDNGQEVIIIWNSWDNGFMTQDAK

SEQ ID NO: 1716043 - protein, 17 aa, Staphylococcus aureus
AKQAIATKANERKAAIA

SEQ ID NO: 1716044 - protein, 18 aa, Staphylococcus aureus
AKQQIAGAVTNADVAYLL

SEQ ID NO: 1716045 - protein, 17 aa, Staphylococcus aureus
AKSDAKANLGTLTHLNN

SEQ ID NO: 1716046 - protein, 17 aa, Staphylococcus aureus
AKSSISMNNVTYTTQDE

SEQ ID NO: 1716047 - protein, 26 aa, Staphylococcus aureus
ALPNGEIKARSSISMNNVTYTTQDEH

SEQ ID NO: 1716048 - protein, 23 aa, Staphylococcus aureus
ANAIIQKPIRSVQEVQTALTNVN

SEQ ID NO: 1716049 - protein, 24 aa, Staphylococcus aureus
ANEKGIKGVYVILKDSNGKELDRT

SEQ ID NO: 1716050 - protein, 20 aa, Staphylococcus aureus
ANGAGAFTIDHVVKNNSTHN

SEQ ID NO: 1716051 - protein, 23 aa, Staphylococcus aureus
ANIYYKSIIKITITVKVGTNMQT

SEQ ID NO: 1716052 - protein, 17 aa, Staphylococcus aureus
ANTALGHLNNLNNAQRQ

SEQ ID NO: 1716053 - protein, 23 aa, Staphylococcus aureus
ANTNAFRPGGVNPLNEYQLSQLF

SEQ ID NO: 1716054 - protein, 17 aa, Staphylococcus aureus
ANYYYQCYFSKKTNDIN

SEQ ID NO: 1716055 - protein, 20 aa, Staphylococcus aureus
ANYYYQCYFSKKTNDINSHQ

SEQ ID NO: 1716056 - protein, 20 aa, Staphylococcus aureus
APLPIAQPLVKIPEGTIQGV

SEQ ID NO: 1716057 - protein, 18 aa, Staphylococcus aureus
APTGTFIASGVVVGKDTL

SEQ ID NO: 1716058 - protein, 24 aa, Staphylococcus aureus
APYNLPTTPWNTLKASDSKEIALM

SEQ ID NO: 1716059 - protein, 20 aa, Staphylococcus aureus
APYSGVTWMGAGTGFVVGNH

SEQ ID NO: 1716060 - protein, 23 aa, Staphylococcus aureus
AQAKESAKRALASYSNLNNAQST

SEQ ID NO: 1716061 - protein, 26 aa, Staphylococcus aureus
AQALNEAMKALKESIKDQPQTEASSK

SEQ ID NO: 1716062 - protein, 23 aa, Staphylococcus aureus
AQALNQAMEALRNSIQDQQQTEA

SEQ ID NO: 1716063 - protein, 18 aa, Staphylococcus aureus
AQARRYLQKDLKLYNNDT

SEQ ID NO: 1716064 - protein, 19 aa, Staphylococcus aureus
AQDYLALKSQIKVDDKVKS

SEQ ID NO: 1716065 - protein, 19 aa, Staphylococcus aureus
ASDYFKLSNGSAIPDATIT

SEQ ID NO: 1716066 - protein, 26 aa, Staphylococcus aureus
ASEINSFVPSMHWIAADPKELNDYKY

SEQ ID NO: 1716067 - protein, 19 aa, Staphylococcus aureus
ASLALSILVTGVITSTAQT

SEQ ID NO: 1716068 - protein, 24 aa, Staphylococcus aureus
ASNRPKKRSRRAAPTDPNATPADP

SEQ ID NO: 1716069 - protein, 27 aa, Staphylococcus aureus
ASTDVKTNARAELLTEMQNKITEILSD

SEQ ID NO: 1716070 - protein, 21 aa, Staphylococcus aureus
ASYTLGEPFKIYKFNKKSDGN

SEQ ID NO: 1716071 - protein, 21 aa, Staphylococcus aureus
ATIKNGTAMPTNLAGGSTTTI

SEQ ID NO: 1716072 - protein, 24 aa, Staphylococcus aureus
ATKAFGRQTFEYINGERPTESPGV

SEQ ID NO: 1716073 - protein, 17 aa, Staphylococcus aureus
ATLAIGILTTGTLTTEA

SEQ ID NO: 1716074 - protein, 24 aa, Staphylococcus aureus
AVTPKVMKKQAAKDEIDQLQTAQT

SEQ ID NO: 1716075 - protein, 17 aa, Staphylococcus aureus
AYDEKVTAAEHIVSGTP

SEQ ID NO: 1716076 - protein, 23 aa, Staphylococcus aureus
DAAKRQIEGATHVNEVTQAQNNA

SEQ ID NO: 1716077 - protein, 20 aa, Staphylococcus aureus
DAAKRQIEGATHVSEVTQAQ

SEQ ID NO: 1716078 - protein, 17 aa, Staphylococcus aureus
DAINIYFVPSDLVNPTI

SEQ ID NO: 1716079 - protein, 49 aa, Staphylococcus aureus
DAITDARGIYQLRDGYKYYDFVDSIGLHSGSHLYVERRIMEPTATNNKE

SEQ ID NO: 1716080 - protein, 18 aa, Staphylococcus aureus
DANATWKSLTKKLEEQGL

SEQ ID NO: 1716081 - protein, 18 aa, Staphylococcus aureus
DATITWVSGQAPNKNNTT

SEQ ID NO: 1716082 - protein, 18 aa, Staphylococcus aureus
DAYNEVKQAATARKAQNA

SEQ ID NO: 1716083 - protein, 25 aa, Staphylococcus aureus
DDFVYKIQLPEGVEYVNNSLTKNFP

SEQ ID NO: 1716084 - protein, 24 aa, Staphylococcus aureus
DDMSMMVGIVLSGFEYRAQKEKYD

SEQ ID NO: 1716085 - protein, 20 aa, Staphylococcus aureus
DDTIVRILIEQHMDKINMHV

SEQ ID NO: 1716086 - protein, 22 aa, Staphylococcus aureus
DEAKRNAYTNAVTQAEQILNKV

SEQ ID NO: 1716087 - protein, 18 aa, Staphylococcus aureus
DEQKRNAYNQAISAAETI

SEQ ID NO: 1716088 - protein, 23 aa, Staphylococcus aureus
DEQKRNAYNQAISAAETILNKQT

SEQ ID NO: 1716089 - protein, 23 aa, Staphylococcus aureus
DFKIRKQLVEKYGLYQGTSKYGK

SEQ ID NO: 1716090 - protein, 34 aa, Staphylococcus aureus
DFKIRNRSGQVIYSWPTVHVYSLEDLSRASDYFS

SEQ ID NO: 1716091 - protein, 19 aa, Staphylococcus aureus
DGKVIVIGIQLYKDREKMY

SEQ ID NO: 1716092 - protein, 18 aa, Staphylococcus aureus
DHQQRLNGLRQVVNRTYR

SEQ ID NO: 1716093 - protein, 24 aa, Staphylococcus aureus
DILKNRPGIHYAPSILEKNKDGQR

SEQ ID NO: 1716094 - protein, 25 aa, Staphylococcus aureus
DILTMLKATTTVPGLRNNITGNEKA

SEQ ID NO: 1716095 - protein, 26 aa, Staphylococcus aureus
DILTMLKATTTVPGLRNNITGNEKAQ

SEQ ID NO: 1716096 - protein, 25 aa, Staphylococcus aureus
DILTMLKATTTVPGLRNNITGNEKS

SEQ ID NO: 1716097 - protein, 28 aa, Staphylococcus aureus
DKAKRDAYTNAVSRAEAILNKTQGANTS

SEQ ID NO: 1716098 - protein, 19 aa, Staphylococcus aureus
DKGKWVIRSEMTTELKNEN

SEQ ID NO: 1716099 - protein, 25 aa, Staphylococcus aureus
DKLVIKRNGNVVTTFTRRNNTSPWV

SEQ ID NO: 1716100 - protein, 19 aa, Staphylococcus aureus
DKPELVAIAEEASNRPKKR

SEQ ID NO: 1716101 - protein, 23 aa, Staphylococcus aureus
DKTAYKMEVTLGNDTYSKDVIVD

SEQ ID NO: 1716102 - protein, 19 aa, Staphylococcus aureus
DLDHARQALTPDKAPLQNA

SEQ ID NO: 1716103 - protein, 23 aa, Staphylococcus aureus
DLDHARQALTPDKAPLQTAKTQL

SEQ ID NO: 1716104 - protein, 20 aa, Staphylococcus aureus
DLKHAKKAYYTVYFKNGGKR

SEQ ID NO: 1716105 - protein, 33 aa, Staphylococcus aureus
DNDAVLGEKVVAYGPIWRLFKVPENVSHLKIQF

SEQ ID NO: 1716106 - protein, 24 aa, Staphylococcus aureus
DNDKNIPCNLWIDGHQTEIELTAV

SEQ ID NO: 1716107 - protein, 17 aa, Staphylococcus aureus
DNELWKNVRDALKEANI

SEQ ID NO: 1716108 - protein, 17 aa, Staphylococcus aureus
DNHQLKLDIQELNQQIS

SEQ ID NO: 1716109 - protein, 31 aa, Staphylococcus aureus
DNYTVIGEKVVAYGPIWRLLKVPENVSHLKI

SEQ ID NO: 1716110 - protein, 19 aa, Staphylococcus aureus
DPKITGTVGQDFTEHKGFN

SEQ ID NO: 1716111 - protein, 19 aa, Staphylococcus aureus
DQFLQHTILFKGFFTDHSW

SEQ ID NO: 1716112 - protein, 19 aa, Staphylococcus aureus
DQLIILTAIDYVYINFNTE

SEQ ID NO: 1716113 - protein, 17 aa, Staphylococcus aureus
DRNELQAFFDANYHDYR

SEQ ID NO: 1716114 - protein, 17 aa, Staphylococcus aureus
DRTACTYGGVTPHEGNK

SEQ ID NO: 1716115 - protein, 23 aa, Staphylococcus aureus
DRYTNFWNQLHWIGNNYKDENRA

SEQ ID NO: 1716116 - protein, 17 aa, Staphylococcus aureus
DSEGMVLHLNRNMRTAT

SEQ ID NO: 1716117 - protein, 18 aa, Staphylococcus aureus
DSELPPLVQSGFNPSFIA

SEQ ID NO: 1716118 - protein, 25 aa, Staphylococcus aureus
DSGFYKPTYNLGDYVWEDTNKNGVQ

SEQ ID NO: 1716119 - protein, 22 aa, Staphylococcus aureus
DTSIFPYTGVVLVNSATGFVVG

SEQ ID NO: 1716120 - protein, 18 aa, Staphylococcus aureus
DVTDKFKITYSNDNKTAT

SEQ ID NO: 1716121 - protein, 20 aa, Staphylococcus aureus
DVTEQFKDKITYGANDSVNV

SEQ ID NO: 1716122 - protein, 35 aa, Staphylococcus aureus
DYKIRNRSGQVIYDWPTVHINSLKDLARASDYFSE

SEQ ID NO: 1716123 - protein, 29 aa, Staphylococcus aureus
EAARTRNPIRLMIGFDYPDAYGNSETLVP

SEQ ID NO: 1716124 - protein, 18 aa, Staphylococcus aureus
EAGATPATKAFGRQNFEY

SEQ ID NO: 1716125 - protein, 18 aa, Staphylococcus aureus
EAGATPATKAFGRQTFEY

SEQ ID NO: 1716126 - protein, 19 aa, Staphylococcus aureus
EAGATPATKAFGRQTFEYI

SEQ ID NO: 1716127 - protein, 20 aa, Staphylococcus aureus
EAYHPKYPTNIGQINQNVTN

SEQ ID NO: 1716128 - protein, 20 aa, Staphylococcus aureus
EDGKNLLSFDVQTNKKKVTA

SEQ ID NO: 1716129 - protein, 19 aa, Staphylococcus aureus
EDLYKGYHLIFKENISLKE

SEQ ID NO: 1716130 - protein, 24 aa, Staphylococcus aureus
EDQGKTRYQGIWKHIDDKGYFEFD

SEQ ID NO: 1716131 - protein, 22 aa, Staphylococcus aureus
EEKEKGIVPVRAAYVEGLENIN

SEQ ID NO: 1716132 - protein, 23 aa, Staphylococcus aureus
EEKLSALYEVDWKTHNVKFIKVL

SEQ ID NO: 1716133 - protein, 19 aa, Staphylococcus aureus
EGQRLIVTYEVDWKNKTVK

SEQ ID NO: 1716134 - protein, 24 aa, Staphylococcus aureus
EIENFKFFVQYGDFKNLKNYKDGD

SEQ ID NO: 1716135 - protein, 21 aa, Staphylococcus aureus
EIENFKFFVQYGNFKDFKDYK

SEQ ID NO: 1716136 - protein, 19 aa, Staphylococcus aureus
EIKAYLKQVDKIKNDEEPI

SEQ ID NO: 1716137 - protein, 28 aa, Staphylococcus aureus
EIREIEPVINRKASAREKLTTLVNDKKQ

SEQ ID NO: 1716138 - protein, 26 aa, Staphylococcus aureus
EKAKAQGLEALDNIQIDSTEKQKAIE

SEQ ID NO: 1716139 - protein, 18 aa, Staphylococcus aureus
EKELKYIYGKIIILDKDG

SEQ ID NO: 1716140 - protein, 24 aa, Staphylococcus aureus
EKIKENKALELLIFNQENKNVTEE

SEQ ID NO: 1716141 - protein, 17 aa, Staphylococcus aureus
EKMTNGQLWKKVKDSLI

SEQ ID NO: 1716142 - protein, 17 aa, Staphylococcus aureus
EKQRITTAFMNKNQNIR

SEQ ID NO: 1716143 - protein, 25 aa, Staphylococcus aureus
ELDRYTNQWNRLHWIGNNYKNQNTV

SEQ ID NO: 1716144 - protein, 18 aa, Staphylococcus aureus
ELITAKNHLDDPVSTDGK

SEQ ID NO: 1716145 - protein, 21 aa, Staphylococcus aureus
ELNGDERLRVAKQNANTAIDA

SEQ ID NO: 1716146 - protein, 17 aa, Staphylococcus aureus
ENFKFFVQYGSFKGIEN

SEQ ID NO: 1716147 - protein, 19 aa, Staphylococcus aureus
ENRNNVPLNKRVSQADIDT

SEQ ID NO: 1716148 - protein, 19 aa, Staphylococcus aureus
ENSELSVVDSLNFQPAKNK

SEQ ID NO: 1716149 - protein, 18 aa, Staphylococcus aureus
ENVNAKLELNSYIDKKEV

SEQ ID NO: 1716150 - protein, 17 aa, Staphylococcus aureus
EPQAPKVSEKVGVQETV

SEQ ID NO: 1716151 - protein, 25 aa, Staphylococcus aureus
EQIKPKVRRKRAALDSIEENNKNQL

SEQ ID NO: 1716152 - protein, 26 aa, Staphylococcus aureus
ERIEKAPNLKLAITAGVGSDHVDLAA

SEQ ID NO: 1716153 - protein, 25 aa, Staphylococcus aureus
ESREVKYTYGYKTGGDFSINQGGLT

SEQ ID NO: 1716154 - protein, 18 aa, Staphylococcus aureus
ETNWKYKFKDLPKYDEGK

SEQ ID NO: 1716155 - protein, 19 aa, Staphylococcus aureus
ETNWKYKFKDLPKYDEGKK

SEQ ID NO: 1716156 - protein, 17 aa, Staphylococcus aureus
EVAEADAAVDAAQTEGL

SEQ ID NO: 1716157 - protein, 21 aa, Staphylococcus aureus
FALKDYETWHTYMLAQETFTG

SEQ ID NO: 1716158 - protein, 26 aa, Staphylococcus aureus
FDNLDSGKYKVIFEKPTGLTQTGTNT

SEQ ID NO: 1716159 - protein, 17 aa, Staphylococcus aureus
FDSVKGVGRTSSNSYSK

SEQ ID NO: 1716160 - protein, 28 aa, Staphylococcus aureus
FENELKAILPFHRSLRVANYDNQSYAAV

SEQ ID NO: 1716161 - protein, 28 aa, Staphylococcus aureus
FIQNPPHGATVAWHDSPDTWKNTVGNTH

SEQ ID NO: 1716162 - protein, 19 aa, Staphylococcus aureus
FKDKITYGANDSVNVDFGS

SEQ ID NO: 1716163 - protein, 21 aa, Staphylococcus aureus
FKFFGQYADFKSLKSYNNGDV

SEQ ID NO: 1716164 - protein, 23 aa, Staphylococcus aureus
FKIRKHLIDHYGLYGEMSTGTVT

SEQ ID NO: 1716165 - protein, 33 aa, Staphylococcus aureus
FKIRNRSGQVIYDWPTVHIYSLEDLSRASDYFS

SEQ ID NO: 1716166 - protein, 22 aa, Staphylococcus aureus
FKNGGKRVIHLNSNIYTANLVH

SEQ ID NO: 1716167 - protein, 23 aa, Staphylococcus aureus
FNDLKRRAQTILDENRNNVPLNK

SEQ ID NO: 1716168 - protein, 20 aa, Staphylococcus aureus
FNIGDIKQYFTLSNGQAIPN

SEQ ID NO: 1716169 - protein, 19 aa, Staphylococcus aureus
FNPDAKNFKIYEVTDQNQF

SEQ ID NO: 1716170 - protein, 26 aa, Staphylococcus aureus
FNTTPKYIKFRHDYNIVEYNDGTFGY

SEQ ID NO: 1716171 - protein, 27 aa, Staphylococcus aureus
FQFTGLTPREMICFGQTQGRSPQLLNR

SEQ ID NO: 1716172 - protein, 23 aa, Staphylococcus aureus
FSHQNLYTWGQCTYHVFNRRAEI

SEQ ID NO: 1716173 - protein, 19 aa, Staphylococcus aureus
FTCLSSNHYGYWNWHIRDV

SEQ ID NO: 1716174 - protein, 29 aa, Staphylococcus aureus
FWATSSDVLKLKANYTIDDSVKEGDTFTF

SEQ ID NO: 1716175 - protein, 25 aa, Staphylococcus aureus
GAGQEVYKIGNYVWEDTNKNGVQDL

SEQ ID NO: 1716176 - protein, 32 aa, Staphylococcus aureus
GANKPLPEMWPYGVNDSRSWDYKIRNRSGQVI

SEQ ID NO: 1716177 - protein, 20 aa, Staphylococcus aureus
GDEIKAHPNGFYNNGGGLYK

SEQ ID NO: 1716178 - protein, 17 aa, Staphylococcus aureus
GDKPVATMWESKGKITY

SEQ ID NO: 1716179 - protein, 21 aa, Staphylococcus aureus
GDSLYKIALEHHLTLNQLYSY

SEQ ID NO: 1716180 - protein, 18 aa, Staphylococcus aureus
GDTSEFEITYGRNMDVTH

SEQ ID NO: 1716181 - protein, 28 aa, Staphylococcus aureus
GDYLEKSRCIPINLWVNGNHKTISTDKV

SEQ ID NO: 1716182 - protein, 21 aa, Staphylococcus aureus
GEFRSIDKYQIAVADTNVQTP

SEQ ID NO: 1716183 - protein, 22 aa, Staphylococcus aureus
GEFRSIDKYQIAVADTNVQTPD

SEQ ID NO: 1716184 - protein, 20 aa, Staphylococcus aureus
GETYTVKFETPAGYLPTKVN

SEQ ID NO: 1716185 - protein, 22 aa, Staphylococcus aureus
GEYGHEVLKMYADNKTINSDKL

SEQ ID NO: 1716186 - protein, 18 aa, Staphylococcus aureus
GGAWFQDPLKIHFEFIDE

SEQ ID NO: 1716187 - protein, 17 aa, Staphylococcus aureus
GGLKDGETYTVKFETPA

SEQ ID NO: 1716188 - protein, 27 aa, Staphylococcus aureus
GISDIDLRLSKQAKYTVHFKNGTKRVV

SEQ ID NO: 1716189 - protein, 23 aa, Staphylococcus aureus
GIYKPKYNLGDYVWEDTNKNGIQ

SEQ ID NO: 1716190 - protein, 18 aa, Staphylococcus aureus
GKDDMSLDTGFYKEPKYN

SEQ ID NO: 1716191 - protein, 19 aa, Staphylococcus aureus
GKDDMSLDTGFYKEPKYNL

SEQ ID NO: 1716192 - protein, 19 aa, Staphylococcus aureus
GKIQRGLIEFHPSSGDSVG

SEQ ID NO: 1716193 - protein, 18 aa, Staphylococcus aureus
GKLIKYISILLIVVLVLS

SEQ ID NO: 1716194 - protein, 23 aa, Staphylococcus aureus
GKMSGHDPNLFVGYKPYSQNPRD

SEQ ID NO: 1716195 - protein, 18 aa, Staphylococcus aureus
GKNLLSFDVQTNKKKVTA

SEQ ID NO: 1716196 - protein, 18 aa, Staphylococcus aureus
GKYQFTGLENGTYKVEFE

SEQ ID NO: 1716197 - protein, 22 aa, Staphylococcus aureus
GLPTDGFTYKWNNAATGTNDAN

SEQ ID NO: 1716198 - protein, 29 aa, Staphylococcus aureus
GLSYSGYCLKNKYIYGGVTFAGDYLEKSR

SEQ ID NO: 1716199 - protein, 23 aa, Staphylococcus aureus
GLTALTILTSLGFAENMSDQPHS

SEQ ID NO: 1716200 - protein, 17 aa, Staphylococcus aureus
GLTPDLAPLQAAKTQLQ

SEQ ID NO: 1716201 - protein, 27 aa, Staphylococcus aureus
GLVLIMFVLCGFIFPLTVTALGQVLFP

SEQ ID NO: 1716202 - protein, 45 aa, Staphylococcus aureus
GNSPARLMPDKILDLKYKLRVNNVPTPRTVTFNDTLTYKTYSQDF

SEQ ID NO: 1716203 - protein, 39 aa, Staphylococcus aureus
GPTIDKLYYAAGGRALEYNQLFMYSQLYVESTQDYQQRL

SEQ ID NO: 1716204 - protein, 20 aa, Staphylococcus aureus
GQFLLKMGIQPEVTKDKTTH

SEQ ID NO: 1716205 - protein, 19 aa, Staphylococcus aureus
GQRQFTLNGQVIQIMDIIN

SEQ ID NO: 1716206 - protein, 18 aa, Staphylococcus aureus
GRLTKSFTSNLNNMNFLR

SEQ ID NO: 1716207 - protein, 18 aa, Staphylococcus aureus
GSSVGYKEIEFIFLENKK

SEQ ID NO: 1716208 - protein, 25 aa, Staphylococcus aureus
GSVNGKSGWVSKAYLGDTAKPTPTP

SEQ ID NO: 1716209 - protein, 17 aa, Staphylococcus aureus
GTFISEYQFYTGNKPVL

SEQ ID NO: 1716210 - protein, 22 aa, Staphylococcus aureus
GVTPLIFPGDVISLVPQNKVKQ

SEQ ID NO: 1716211 - protein, 19 aa, Staphylococcus aureus
HDIGLAERAVYKVYFKDGT

SEQ ID NO: 1716212 - protein, 23 aa, Staphylococcus aureus
HGDPHALKAFPSAINQDNYPNGG

SEQ ID NO: 1716213 - protein, 27 aa, Staphylococcus aureus
HHAIIDRNTGKIIKTGGAITSPDGPIK

SEQ ID NO: 1716214 - protein, 24 aa, Staphylococcus aureus
HKDSEDFYISLKIIDVKQPEGDQR

SEQ ID NO: 1716215 - protein, 25 aa, Staphylococcus aureus
HKDTEDFYISLKIVDVKQPEGDQRV

SEQ ID NO: 1716216 - protein, 37 aa, Staphylococcus aureus
HNAQRVTLKYKWKFGEGIKAGDYFDFTLSDNVETHGI

SEQ ID NO: 1716217 - protein, 17 aa, Staphylococcus aureus
HQNLYTAGQCTWYVFDR

SEQ ID NO: 1716218 - protein, 21 aa, Staphylococcus aureus
HTHYFYNCYPKNANANGSGQT

SEQ ID NO: 1716219 - protein, 29 aa, Staphylococcus aureus
HYRDNFWATADMKRLAGTTTLENEEPKGT

SEQ ID NO: 1716220 - protein, 22 aa, Staphylococcus aureus
ICDNLLLTICHTAFEKLSIFPN

SEQ ID NO: 1716221 - protein, 19 aa, Staphylococcus aureus
IDDKGYFEFDFKRKPYDNL

SEQ ID NO: 1716222 - protein, 20 aa, Staphylococcus aureus
IEEHKNEIIGNIGDQTTDEG

SEQ ID NO: 1716223 - protein, 25 aa, Staphylococcus aureus
IENKVKSVLYFNRGISDIDLRLSKQ

SEQ ID NO: 1716224 - protein, 19 aa, Staphylococcus aureus
IFLLAMYELGKYVTEQVYI

SEQ ID NO: 1716225 - protein, 25 aa, Staphylococcus aureus
IGERELRYAKKATYTVHFKNGTKKV

SEQ ID NO: 1716226 - protein, 23 aa, Staphylococcus aureus
IGQGDASYTISFKTQGPTVNKLY

SEQ ID NO: 1716227 - protein, 19 aa, Staphylococcus aureus
IGSAFTETVSHAGNAEDPG

SEQ ID NO: 1716228 - protein, 21 aa, Staphylococcus aureus
IGSAFTETVSHVGNVEDPGYY

SEQ ID NO: 1716229 - protein, 17 aa, Staphylococcus aureus
IHLNSNIYTANLVHAKD

SEQ ID NO: 1716230 - protein, 19 aa, Staphylococcus aureus
IHSNLKFESHKEENNSSWL

SEQ ID NO: 1716231 - protein, 18 aa, Staphylococcus aureus
IIFGCKIVQTYIEDKQER

SEQ ID NO: 1716232 - protein, 17 aa, Staphylococcus aureus
IILSMALIIIGTATIQS

SEQ ID NO: 1716233 - protein, 17 aa, Staphylococcus aureus
IINSLTFTETVPNRSYA

SEQ ID NO: 1716234 - protein, 26 aa, Staphylococcus aureus
IIQPETKIKPAAREKINQKANELRAQ

SEQ ID NO: 1716235 - protein, 23 aa, Staphylococcus aureus
IKGKTKFANAVVKVDSELGEGQE

SEQ ID NO: 1716236 - protein, 25 aa, Staphylococcus aureus
IKQILRLLFLLAMYELGKYVTEQVY

SEQ ID NO: 1716237 - protein, 18 aa, Staphylococcus aureus
ILGSLLILSACSNNDEKD

SEQ ID NO: 1716238 - protein, 18 aa, Staphylococcus aureus
ILILIVIVAGCDKSDETK

SEQ ID NO: 1716239 - protein, 17 aa, Staphylococcus aureus
ILTILSMVLDFNFKEAQ

SEQ ID NO: 1716240 - protein, 19 aa, Staphylococcus aureus
ILVGTTLIFGLGNQEAKAA

SEQ ID NO: 1716241 - protein, 17 aa, Staphylococcus aureus
IMLPITPNILIEFQEDK

SEQ ID NO: 1716242 - protein, 26 aa, Staphylococcus aureus
INAVTPKVVKKQAAKDEIDQLQATQT

SEQ ID NO: 1716243 - protein, 24 aa, Staphylococcus aureus
INGFSNIVSNEFVFYNASKITIND

SEQ ID NO: 1716244 - protein, 29 aa, Staphylococcus aureus
IQKGGNLKPLEQRERANVILPNNDRHQIT

SEQ ID NO: 1716245 - protein, 24 aa, Staphylococcus aureus
IQNPPHGATVAWHDNPDTWKNTVG

SEQ ID NO: 1716246 - protein, 27 aa, Staphylococcus aureus
IQNPPHGATVAWHDSPDTWKNTVGNTH

SEQ ID NO: 1716247 - protein, 31 aa, Staphylococcus aureus
IRKHKLGAASVFLGTMIVVGMGQDKEAAASE

SEQ ID NO: 1716248 - protein, 24 aa, Staphylococcus aureus
ISDIDLRLSKQAEYTVHFKNGTKK

SEQ ID NO: 1716249 - protein, 24 aa, Staphylococcus aureus
ISDIDLRLSKQAEYTVHFKNGTKR

SEQ ID NO: 1716250 - protein, 26 aa, Staphylococcus aureus
ISDIDLRLSKQAKYTVHFKNGAKRVV

SEQ ID NO: 1716251 - protein, 18 aa, Staphylococcus aureus
ISEGSIYPVLMRLNKKGY

SEQ ID NO: 1716252 - protein, 19 aa, Staphylococcus aureus
ISEGSIYPVLMRLNKKGYV

SEQ ID NO: 1716253 - protein, 18 aa, Staphylococcus aureus
ISLLLGILATGVSTTTEK

SEQ ID NO: 1716254 - protein, 17 aa, Staphylococcus aureus
ISTYWSDAKYWASNAAN

SEQ ID NO: 1716255 - protein, 17 aa, Staphylococcus aureus
ITAGCGIGKEAEVKKSF

SEQ ID NO: 1716256 - protein, 27 aa, Staphylococcus aureus
ITDVDLRLSKQAKYTVVFKNGTKKVID

SEQ ID NO: 1716257 - protein, 24 aa, Staphylococcus aureus
ITIDEAKSIAFNSEDILNFTQNKD

SEQ ID NO: 1716258 - protein, 30 aa, Staphylococcus aureus; identical to SEQ ID NO: 1655407

SEQ ID NO: 1716259 - protein, 20 aa, Staphylococcus aureus
IVASNAYHKDTEDFYISLKI

SEQ ID NO: 1716260 - protein, 17 aa, Staphylococcus aureus
IWQNGHVDITPNNPSGH

SEQ ID NO: 1716261 - protein, 26 aa, Staphylococcus aureus
KADSLTDGQLWLGVKNPLIDAQIISG

SEQ ID NO: 1716262 - protein, 20 aa, Staphylococcus aureus
KAKDEKDGRDSTNQSMVEST

SEQ ID NO: 1716263 - protein, 19 aa, Staphylococcus aureus
KAKDRISVIGYPKGAQTKY

SEQ ID NO: 1716264 - protein, 21 aa, Staphylococcus aureus
KANERKAAIAQTQDITVEEIE

SEQ ID NO: 1716265 - protein, 25 aa, Staphylococcus aureus
KAQALDHAMELLRNSIADNQATLAS

SEQ ID NO: 1716266 - protein, 20 aa, Staphylococcus aureus
KATELNNAMHSLQNGINDET

SEQ ID NO: 1716267 - protein, 24 aa, Staphylococcus aureus
KAYNYKYFYSYSVVNGVKKYFSFS

SEQ ID NO: 1716268 - protein, 36 aa, Staphylococcus aureus
KDADNWTLDSGFYKTPKYSLGDYVWYDSNKDGKQDS

SEQ ID NO: 1716269 - protein, 27 aa, Staphylococcus aureus
KDKGYEWNPQPIKSMKHSGSYMTEKIA

SEQ ID NO: 1716270 - protein, 26 aa, Staphylococcus aureus
KDKGYEWNPQPIKSMKHSGSYMTEKL

SEQ ID NO: 1716271 - protein, 18 aa, Staphylococcus aureus
KDKVLGLFADKNMPLAID

SEQ ID NO: 1716272 - protein, 20 aa, Staphylococcus aureus
KDLHRYYSSESFEFSNISGK

SEQ ID NO: 1716273 - protein, 23 aa, Staphylococcus aureus
KDLVSKAKEKAYQDILNAQTTND

SEQ ID NO: 1716274 - protein, 22 aa, Staphylococcus aureus
KDREKMYYFAYEIKDGKAEINR

SEQ ID NO: 1716275 - protein, 17 aa, Staphylococcus aureus
KDYYNGPTFSHKNISGY

SEQ ID NO: 1716276 - protein, 20 aa, Staphylococcus aureus
KEAMKKYQQRFMAEDEALKK

SEQ ID NO: 1716277 - protein, 18 aa, Staphylococcus aureus
KEEEARAGASAVPGANIN

SEQ ID NO: 1716278 - protein, 20 aa, Staphylococcus aureus
KEHREGFDALVKETREAVAK

SEQ ID NO: 1716279 - protein, 19 aa, Staphylococcus aureus
KELDFKLRKQLIDKHDLYK

SEQ ID NO: 1716280 - protein, 18 aa, Staphylococcus aureus
KELIKAKQQIAGAVTNAD

SEQ ID NO: 1716281 - protein, 17 aa, Staphylococcus aureus
KESRVKEDSKYDTPISD

SEQ ID NO: 1716282 - protein, 18 aa, Staphylococcus aureus
KFYSGFDKGSVVFHINDG

SEQ ID NO: 1716283 - protein, 17 aa, Staphylococcus aureus
KGEMMDLSRGRAISREN

SEQ ID NO: 1716284 - protein, 18 aa, Staphylococcus aureus
KGEMMDLSRGRAISRENE

SEQ ID NO: 1716285 - protein, 17 aa, Staphylococcus aureus
KGGNLKPLEQREHANVI

SEQ ID NO: 1716286 - protein, 17 aa, Staphylococcus aureus
KGLHSIKDIINKAKQDG

SEQ ID NO: 1716287 - protein, 18 aa, Staphylococcus aureus
KGNVCGMMPHPERALEKL

SEQ ID NO: 1716288 - protein, 24 aa, Staphylococcus aureus
KGQSFSIGDIKQYFTLSNGQPIPS

SEQ ID NO: 1716289 - protein, 23 aa, Staphylococcus aureus
KGTWVIRSEMKIQLKGENLESRG

SEQ ID NO: 1716290 - protein, 20 aa, Staphylococcus aureus
KHYKLSLKYRDKLHTMIGGL

SEQ ID NO: 1716291 - protein, 21 aa, Staphylococcus aureus
KISQLNLLFVKDIKKIDIDVK

SEQ ID NO: 1716292 - protein, 22 aa, Staphylococcus aureus
KKDVPFSVTIGNQITTTTADIT

SEQ ID NO: 1716293 - protein, 19 aa, Staphylococcus aureus
KKFKNRAVDVYGLSYSGYC

SEQ ID NO: 1716294 - protein, 19 aa, Staphylococcus aureus
KKHFVRYGTMYIPMDETLA

SEQ ID NO: 1716295 - protein, 19 aa, Staphylococcus aureus
KKHFVRYGTMYISMDETLA

SEQ ID NO: 1716296 - protein, 21 aa, Staphylococcus aureus
KKLHSWLKISTLIDNVKVKDK

SEQ ID NO: 1716297 - protein, 21 aa, Staphylococcus aureus
KKLKEERIVGTAGGGMVAVTV

SEQ ID NO: 1716298 - protein, 23 aa, Staphylococcus aureus
KKNIPRDLNVSLQISNKYINTKR

SEQ ID NO: 1716299 - protein, 20 aa, Staphylococcus aureus
KKVIPYTGSADLAIVQVEED

SEQ ID NO: 1716300 - protein, 18 aa, Staphylococcus aureus
KKYFSFSKSNGFKTGKPA

SEQ ID NO: 1716301 - protein, 19 aa, Staphylococcus aureus
KLKNTWLDVNYGYDKYDES

SEQ ID NO: 1716302 - protein, 22 aa, Staphylococcus aureus
KLNNKYASIGMDFENQDKTLTA

SEQ ID NO: 1716303 - protein, 18 aa, Staphylococcus aureus
KLQEDRMADIIKVTDIDR

SEQ ID NO: 1716304 - protein, 20 aa, Staphylococcus aureus
KLVIKRNGNVVTTFTRHNNT

SEQ ID NO: 1716305 - protein, 21 aa, Staphylococcus aureus
KMCLCLIILSVFIGACGMKKE

SEQ ID NO: 1716306 - protein, 17 aa, Staphylococcus aureus
KNLEDFYDKEGYRDGEF

SEQ ID NO: 1716307 - protein, 24 aa, Staphylococcus aureus
KNPDRRVAQQNAFYSVLKNDNLTE

SEQ ID NO: 1716308 - protein, 23 aa, Staphylococcus aureus
KNRNDEFLFYRTTRLSTVENPEL

SEQ ID NO: 1716309 - protein, 17 aa, Staphylococcus aureus
KNVTGYRYSKGGKHYLI

SEQ ID NO: 1716310 - protein, 19 aa, Staphylococcus aureus
KNYQGMTNLIIKNADNDTV

SEQ ID NO: 1716311 - protein, 18 aa, Staphylococcus aureus
KNYQGMTNLIIKNADNYT

SEQ ID NO: 1716312 - protein, 18 aa, Staphylococcus aureus
KNYQGMTNLVIKNADNDA

SEQ ID NO: 1716313 - protein, 18 aa, Staphylococcus aureus
KPIIFKTKVTSFDNIESA

SEQ ID NO: 1716314 - protein, 18 aa, Staphylococcus aureus
KPLIFKTKVTSLEDIDKA

SEQ ID NO: 1716315 - protein, 18 aa, Staphylococcus aureus
KPNTAQVINAKYDVIYNG

SEQ ID NO: 1716316 - protein, 18 aa, Staphylococcus aureus
KPQAKQAIADKVQAQEKA

SEQ ID NO: 1716317 - protein, 26 aa, Staphylococcus aureus
KQGPPFPFPECGAMSQAYIGYQMQES

SEQ ID NO: 1716318 - protein, 21 aa, Staphylococcus aureus
KQITYTFTDYVDKYEDIKARL

SEQ ID NO: 1716319 - protein, 21 aa, Staphylococcus aureus
KQITYTFTDYVDKYEDIKSRL

SEQ ID NO: 1716320 - protein, 22 aa, Staphylococcus aureus
KRDKGTWIINSGMNIQLKGGAL

SEQ ID NO: 1716321 - protein, 32 aa, Staphylococcus aureus
KRVESNGIATLKGVEPHIVVKPEAQQPIKASA

SEQ ID NO: 1716322 - protein, 17 aa, Staphylococcus aureus
KRYPVKMVDNKVIPTKE

SEQ ID NO: 1716323 - protein, 18 aa, Staphylococcus aureus
KSGTVIGGFPVYEGNKPV

SEQ ID NO: 1716324 - protein, 19 aa, Staphylococcus aureus
KSLDDLIWSFPNLDNERFD

SEQ ID NO: 1716325 - protein, 24 aa, Staphylococcus aureus
KSNNDEIFIETPFSGINESVKHHA

SEQ ID NO: 1716326 - protein, 17 aa, Staphylococcus aureus
KSNRGITDVDLRLSKQA

SEQ ID NO: 1716327 - protein, 25 aa, Staphylococcus aureus
KSWIDDGFMPLIYKGEMMDLSRGRA

SEQ ID NO: 1716328 - protein, 21 aa, Staphylococcus aureus
KTLPNHIILLNIDRQSADSFE

SEQ ID NO: 1716329 - protein, 25 aa, Staphylococcus aureus
KTLQGEIVQGPGFLTMEQSGPSLSN

SEQ ID NO: 1716330 - protein, 17 aa, Staphylococcus aureus
KVAKALKSYYNDIEKDV

SEQ ID NO: 1716331 - protein, 22 aa, Staphylococcus aureus
KVIDLKAGIYTANLINSSDIKN

SEQ ID NO: 1716332 - protein, 23 aa, Staphylococcus aureus
KVIDLKAGIYTANLINTGDIKNI

SEQ ID NO: 1716333 - protein, 26 aa, Staphylococcus aureus
KVPENVSHLKIQFSPKNDAITDARGI

SEQ ID NO: 1716334 - protein, 17 aa, Staphylococcus aureus
KVQVKPAARQSVSAKAE

SEQ ID NO: 1716335 - protein, 17 aa, Staphylococcus aureus
KWLQSRGIIASESMAED

SEQ ID NO: 1716336 - protein, 18 aa, Staphylococcus aureus
KYLDGVKDRMGVTVNGRI

SEQ ID NO: 1716337 - protein, 17 aa, Staphylococcus aureus
KYQFTGLENGTYKVEFE

SEQ ID NO: 1716338 - protein, 23 aa, Staphylococcus aureus
LAETLKAKVIMPVYPKIPHQDYQ

SEQ ID NO: 1716339 - protein, 22 aa, Staphylococcus aureus
LALSLFLAACGQDSDQQKDNNK

SEQ ID NO: 1716340 - protein, 25 aa, Staphylococcus aureus
LALSSFIILSACGQNTEDNHKKDNN

SEQ ID NO: 1716341 - protein, 22 aa, Staphylococcus aureus
LCISLLILIIFVTSCDVDNKIT

SEQ ID NO: 1716342 - protein, 18 aa, Staphylococcus aureus
LCTSIIVSGCSFIPKNQT

SEQ ID NO: 1716343 - protein, 22 aa, Staphylococcus aureus
LDGAMQRLESAIANKDQTKASE

SEQ ID NO: 1716344 - protein, 24 aa, Staphylococcus aureus
LDGAMQRLESAIANKDQTKASENY

SEQ ID NO: 1716345 - protein, 18 aa, Staphylococcus aureus
LDMYPIKNLEDFYDKEGY

SEQ ID NO: 1716346 - protein, 22 aa, Staphylococcus aureus
LEEYPVIWEWDVTIKVTTNKGI

SEQ ID NO: 1716347 - protein, 25 aa, Staphylococcus aureus
LERNFPEYKTEWAPKIKKMIPSYGE

SEQ ID NO: 1716348 - protein, 17 aa, Staphylococcus aureus
LESAIANKDQTKASENY

SEQ ID NO: 1716349 - protein, 21 aa, Staphylococcus aureus
LFNLTSYYTDITWQLDESNKI

SEQ ID NO: 1716350 - protein, 17 aa, Staphylococcus aureus
LGVTGYAASTGHEAHAA

SEQ ID NO: 1716351 - protein, 17 aa, Staphylococcus aureus
LIFPNQVLKVSGSSNST

SEQ ID NO: 1716352 - protein, 30 aa, Staphylococcus aureus; identical to SEQ ID NO: 1583777

SEQ ID NO: 1716353 - protein, 27 aa, Staphylococcus aureus
LIPNLPNGDYRVEFSNLPQGYEVTPSK

SEQ ID NO: 1716354 - protein, 24 aa, Staphylococcus aureus
LISDMTGKIYLQVKLKGQIDKEQL

SEQ ID NO: 1716355 - protein, 26 aa, Staphylococcus aureus
LKDEKREVIDLSDKLEFERMGDVLNS

SEQ ID NO: 1716356 - protein, 21 aa, Staphylococcus aureus
LKDVTGQFDVIYSNDNKTATV

SEQ ID NO: 1716357 - protein, 17 aa, Staphylococcus aureus
LKHAKKAYYTVYFKNGG

SEQ ID NO: 1716358 - protein, 20 aa, Staphylococcus aureus
LKIKEALDWMHKNVYGKNPS

SEQ ID NO: 1716359 - protein, 22 aa, Staphylococcus aureus
LKPLEQREHANVILPNNDRHQI

SEQ ID NO: 1716360 - protein, 19 aa, Staphylococcus aureus
LKYIYGKIIILDKDGTAKD

SEQ ID NO: 1716361 - protein, 18 aa, Staphylococcus aureus
LLDFRRFGGTLHHRTAYA

SEQ ID NO: 1716362 - protein, 18 aa, Staphylococcus aureus
LLTACGANQHKENNSKSN

SEQ ID NO: 1716363 - protein, 17 aa, Staphylococcus aureus
LMATILLSGCSAMENES

SEQ ID NO: 1716364 - protein, 22 aa, Staphylococcus aureus
LNCKSDFWKTLKYKKDKITYYV

SEQ ID NO: 1716365 - protein, 21 aa, Staphylococcus aureus
LNNAMKGLRDSIANETTVKAS

SEQ ID NO: 1716366 - protein, 17 aa, Staphylococcus aureus
LNQPQRDALRNQINQAQ

SEQ ID NO: 1716367 - protein, 24 aa, Staphylococcus aureus
LNTARQGLTLDRQPAFTTLHGASN

SEQ ID NO: 1716368 - protein, 25 aa, Staphylococcus aureus
LPADQVPVGRTDFVTVNSDGTNVQW

SEQ ID NO: 1716369 - protein, 28 aa, Staphylococcus aureus
LPAEAMKVSPKVIQPAPKVCTPIKKEET

SEQ ID NO: 1716370 - protein, 20 aa, Staphylococcus aureus
LPPLVQSGFNPSFIATVSHE

SEQ ID NO: 1716371 - protein, 20 aa, Staphylococcus aureus
LRGTALQKVPVNISGIPLDP

SEQ ID NO: 1716372 - protein, 20 aa, Staphylococcus aureus
LRRYLQEEYNIYGHNNTGKG

SEQ ID NO: 1716373 - protein, 17 aa, Staphylococcus aureus
LRYIYDVYFDRDDRITV

SEQ ID NO: 1716374 - protein, 26 aa, Staphylococcus aureus
LSTEEERLAAKHLVEQALNQAIDQIN

SEQ ID NO: 1716375 - protein, 28 aa, Staphylococcus aureus
LSYSGYCLKNKYMYGGVTLAGDYLEKSR

SEQ ID NO: 1716376 - protein, 27 aa, Staphylococcus aureus
LTFLFVCSLIVCRFFAYKIYFPTDAEN

SEQ ID NO: 1716377 - protein, 18 aa, Staphylococcus aureus
LTHGLDVFAVPELIDTKG

SEQ ID NO: 1716378 - protein, 20 aa, Staphylococcus aureus
LTLLKATTTVPGLRNNIAGN

SEQ ID NO: 1716379 - protein, 18 aa, Staphylococcus aureus
LTQDLFMNDYLRVYTNDD

SEQ ID NO: 1716380 - protein, 25 aa, Staphylococcus aureus
LVKKIDPKHGFSINELFFIQKEEVS

SEQ ID NO: 1716381 - protein, 26 aa, Staphylococcus aureus
LVQDYNTGNKFGWVKEVDVVYNTAKS

SEQ ID NO: 1716382 - protein, 19 aa, Staphylococcus aureus
LVRQIVFDIGKMFGNKNSR

SEQ ID NO: 1716383 - protein, 19 aa, Staphylococcus aureus
LWLYLVLLAVFIGACGMKK

SEQ ID NO: 1716384 - protein, 17 aa, Staphylococcus aureus
LYISIMALSIFIIGCDK

SEQ ID NO: 1716385 - protein, 21 aa, Staphylococcus aureus
LYNAQGNIIAKGIYDSKTNTT

SEQ ID NO: 1716386 - protein, 17 aa, Staphylococcus aureus
MAIGEVIAERKIRYTFT

SEQ ID NO: 1716387 - protein, 27 aa, Staphylococcus aureus
MDAYKEVKQAATARKAQNATVSNTTNE

SEQ ID NO: 1716388 - protein, 25 aa, Staphylococcus aureus
MDEFKIDWNKHGFWGYWSGENHVDK

SEQ ID NO: 1716389 - protein, 24 aa, Staphylococcus aureus
MDRYTNYWNRLHWIGNNHKNQNTV

SEQ ID NO: 1716390 - protein, 21 aa, Staphylococcus aureus
MKEYNDIRLSLKEAIDQFRKD

SEQ ID NO: 1716391 - protein, 25 aa, Staphylococcus aureus
MKNDKGERQFYHYASTVEPATVIFT

SEQ ID NO: 1716392 - protein, 25 aa, Staphylococcus aureus
MKNGGKYTFELHKKLQEHRMAGTNI

SEQ ID NO: 1716393 - protein, 23 aa, Staphylococcus aureus
MNVTYDAANRIITIKSTGGGTGN

SEQ ID NO: 1716394 - protein, 20 aa, Staphylococcus aureus
MRSRGMYLFLNRNTRTAKGY

SEQ ID NO: 1716395 - protein, 25 aa, Staphylococcus aureus
MSFANCALPYVIGEVVEDRKYALVY

SEQ ID NO: 1716396 - protein, 21 aa, Staphylococcus aureus
MSLNGLNNFFIYPGQKLKVTG

SEQ ID NO: 1716397 - protein, 25 aa, Staphylococcus aureus
MSVMILLAGCGKSEEKATLEKDIDK

SEQ ID NO: 1716398 - protein, 25 aa, Staphylococcus aureus
MTALKAAIADKERTKASGNYVNADQ

SEQ ID NO: 1716399 - protein, 18 aa, Staphylococcus aureus
MTGLKRGVANHNQVVQSD

SEQ ID NO: 1716400 - protein, 22 aa, Staphylococcus aureus
NAEQSRSAFAFSKKVDDETVQK

SEQ ID NO: 1716401 - protein, 25 aa, Staphylococcus aureus
NAKDLRAKLDLILGDKENPYKITNE

SEQ ID NO: 1716402 - protein, 19 aa, Staphylococcus aureus
NAKSRYGYVPEGFQKLKND

SEQ ID NO: 1716403 - protein, 19 aa, Staphylococcus aureus
NAMKGLRDSIANETTVKAS

SEQ ID NO: 1716404 - protein, 19 aa, Staphylococcus aureus
NAMKGLRDSIANETTVKTS

SEQ ID NO: 1716405 - protein, 22 aa, Staphylococcus aureus
NAQHMNFQFVGTYGPNKDVVGI

SEQ ID NO: 1716406 - protein, 17 aa, Staphylococcus aureus
NATELNTAMGTLKHAIA

SEQ ID NO: 1716407 - protein, 41 aa, Staphylococcus aureus; identical to SEQ ID NO: 1655081

SEQ ID NO: 1716408 - protein, 18 aa, Staphylococcus aureus
NAYNQAISAAETILNKQT

SEQ ID NO: 1716409 - protein, 17 aa, Staphylococcus aureus
NCTYYAFNRRAQLGRSI

SEQ ID NO: 1716410 - protein, 24 aa, Staphylococcus aureus
NDIELKFAKQAKYTIHFKNGKTQV

SEQ ID NO: 1716411 - protein, 23 aa, Staphylococcus aureus
NDKSRPYVVTTLFSTKDNYTKDN

SEQ ID NO: 1716412 - protein, 27 aa, Staphylococcus aureus
NEKAQAEAGGRPNYRTTGYSQSNATTD

SEQ ID NO: 1716413 - protein, 24 aa, Staphylococcus aureus
NEKLTYRTASDVVINNAQPEVTLT

SEQ ID NO: 1716414 - protein, 17 aa, Staphylococcus aureus
NEKRYPVKMVDNKVIPT

SEQ ID NO: 1716415 - protein, 27 aa, Staphylococcus aureus
NEKSQAEAGGRPNFRTTGYSQSNATTD

SEQ ID NO: 1716416 - protein, 20 aa, Staphylococcus aureus
NELQAFFDANYHDYRFIDRE

SEQ ID NO: 1716417 - protein, 27 aa, Staphylococcus aureus
NENVRNFLKQNIEDIHFANDDQPNNPD

SEQ ID NO: 1716418 - protein, 20 aa, Staphylococcus aureus
NETSFTYDLFYTGTGQAESF

SEQ ID NO: 1716419 - protein, 23 aa, Staphylococcus aureus
NEVKQAATARKAQNATVSNATNE

SEQ ID NO: 1716420 - protein, 19 aa, Staphylococcus aureus
NGGKRVIHLNSNVYTANLV

SEQ ID NO: 1716421 - protein, 18 aa, Staphylococcus aureus
NGKYCFDNLDSGKYKVIF

SEQ ID NO: 1716422 - protein, 20 aa, Staphylococcus aureus
NGNLWAKDNFTPKNKMPVTV

SEQ ID NO: 1716423 - protein, 18 aa, Staphylococcus aureus
NGPCKSKYMYGGVTLSGQ

SEQ ID NO: 1716424 - protein, 26 aa, Staphylococcus aureus
NHVKAMRWPFQYNIGLKTNDPNISLI

SEQ ID NO: 1716425 - protein, 21 aa, Staphylococcus aureus
NITHGSGFSSVVTVSDALPNG

SEQ ID NO: 1716426 - protein, 18 aa, Staphylococcus aureus
NKGVAWKVEAHLINNMGH

SEQ ID NO: 1716427 - protein, 20 aa, Staphylococcus aureus
NKIVPAQDYLALKSQIKVDD

SEQ ID NO: 1716428 - protein, 25 aa, Staphylococcus aureus
NKIVPAQDYLSLKSQITVDDKVKSG

SEQ ID NO: 1716429 - protein, 23 aa, Staphylococcus aureus
NLNDEYVVSPGWTKDEQAKAFEE

SEQ ID NO: 1716430 - protein, 32 aa, Staphylococcus aureus
NLNNMNFLRWVNFPQDYTVTWTNAKIANRPTD

SEQ ID NO: 1716431 - protein, 20 aa, Staphylococcus aureus
NLYTWGQCTYHVFNRRAEIG

SEQ ID NO: 1716432 - protein, 39 aa, Staphylococcus aureus
NNALEQLKAQRINPVVKKNALEAIREVVNKQIEIIKNAD

SEQ ID NO: 1716433 - protein, 20 aa, Staphylococcus aureus
NNAQRQLAIQQINNAETLNK

SEQ ID NO: 1716434 - protein, 25 aa, Staphylococcus aureus
NNEANKFGNGHKVYNDYSIEEHNGN

SEQ ID NO: 1716435 - protein, 26 aa, Staphylococcus aureus
NNIRFLKLKVGKIINVAKVDIIAFDK

SEQ ID NO: 1716436 - protein, 22 aa, Staphylococcus aureus
NNIRLLKDYGVSIYPANISESY

SEQ ID NO: 1716437 - protein, 25 aa, Staphylococcus aureus
NNLITYTFTDYVDRFNSVKMGINYS

SEQ ID NO: 1716438 - protein, 26 aa, Staphylococcus aureus
NNSSWLKYPSEYHVDFQVKRNRKTEI

SEQ ID NO: 1716439 - protein, 18 aa, Staphylococcus aureus
NNWHVHWSVIANDLKYGG

SEQ ID NO: 1716440 - protein, 17 aa, Staphylococcus aureus
NNWHVHWSVVANDLKYG

SEQ ID NO: 1716441 - protein, 18 aa, Staphylococcus aureus
NPDTWKNTVGNTHKTAVV

SEQ ID NO: 1716442 - protein, 20 aa, Staphylococcus aureus
NRHNGTIINIFDDMSEKDKE

SEQ ID NO: 1716443 - protein, 24 aa, Staphylococcus aureus
NRNDELLFYRNTRIATVENPELSF

SEQ ID NO: 1716444 - protein, 19 aa, Staphylococcus aureus
NSNWLKYPSEYHVDFQVKR

SEQ ID NO: 1716445 - protein, 29 aa, Staphylococcus aureus
NSTAPHVHFQRMSGGIGNQYAVDPTSYLQ

SEQ ID NO: 1716446 - protein, 22 aa, Staphylococcus aureus
NTAMGNLKHALAEKDNTKRSVN

SEQ ID NO: 1716447 - protein, 23 aa, Staphylococcus aureus
NTAMGNLKHALAEKDNTKRSVNY

SEQ ID NO: 1716448 - protein, 20 aa, Staphylococcus aureus
NTILFNDFFTGHQWYNDLLV

SEQ ID NO: 1716449 - protein, 19 aa, Staphylococcus aureus
NTNAFRPGGAQQLNEYQLS

SEQ ID NO: 1716450 - protein, 18 aa, Staphylococcus aureus
NTNQLIDVTEQFKDKITY

SEQ ID NO: 1716451 - protein, 17 aa, Staphylococcus aureus
NTPVFSHQNLYTWGQCT

SEQ ID NO: 1716452 - protein, 20 aa, Staphylococcus aureus
NVAKGKYYAGLSYEQDARTW

SEQ ID NO: 1716453 - protein, 24 aa, Staphylococcus aureus
NVLNCKPDFWKTLKYKKDKITYYV

SEQ ID NO: 1716454 - protein, 24 aa, Staphylococcus aureus
NVNRVNDRLTLAINQLVPLADNSA

SEQ ID NO: 1716455 - protein, 24 aa, Staphylococcus aureus
PAANGAGAFTIDHVVKSNSTHNAS

SEQ ID NO: 1716456 - protein, 18 aa, Staphylococcus aureus
PDLIRLNKTFLIESRELT

SEQ ID NO: 1716457 - protein, 18 aa, Staphylococcus aureus
PHALKAFPSAINQDNYPN

SEQ ID NO: 1716458 - protein, 24 aa, Staphylococcus aureus
PITKTATYKVVRTVPKQVFETARG

SEQ ID NO: 1716459 - protein, 19 aa, Staphylococcus aureus
PNAKQAIRDKAAKQREIIN

SEQ ID NO: 1716460 - protein, 24 aa, Staphylococcus aureus
PNDEMKGRIIGREGRNIRTLETLT

SEQ ID NO: 1716461 - protein, 19 aa, Staphylococcus aureus
PNGGIKAKSSISMNNVTYT

SEQ ID NO: 1716462 - protein, 21 aa, Staphylococcus aureus
PNKPDHPFVFWATLKNAASLL

SEQ ID NO: 1716463 - protein, 17 aa, Staphylococcus aureus
PNTAQVINAKYDVIYNG

SEQ ID NO: 1716464 - protein, 22 aa, Staphylococcus aureus
PNVGQPAPKVCTPIKKEDKQEV

SEQ ID NO: 1716465 - protein, 21 aa, Staphylococcus aureus
PRNIPINIWINGNHKTISTNK

SEQ ID NO: 1716466 - protein, 20 aa, Staphylococcus aureus
PTDGFTYKWNNAATGTNDAN

SEQ ID NO: 1716467 - protein, 29 aa, Staphylococcus aureus
PTVTVVDNLPGYTLINGGKVGVFSHAMVR

SEQ ID NO: 1716468 - protein, 20 aa, Staphylococcus aureus
PVATMWESKGKITYLKGEAM

SEQ ID NO: 1716469 - protein, 27 aa, Staphylococcus aureus
PVGINAKYYRGDEVNFTMGVSDRHSGI

SEQ ID NO: 1716470 - protein, 18 aa, Staphylococcus aureus
PVIWEWDVTIKVTTNKGI

SEQ ID NO: 1716471 - protein, 21 aa, Staphylococcus aureus
PVRAAYVEGLENINAASTTGD

SEQ ID NO: 1716472 - protein, 26 aa, Staphylococcus aureus
PVVKPNAKKAIRDKAAKQREIINNTP

SEQ ID NO: 1716473 - protein, 17 aa, Staphylococcus aureus
PYDNLKLNPDDNVSLTF

SEQ ID NO: 1716474 - protein, 20 aa, Staphylococcus aureus
PYNLPTTPWNTLKASDSKEI

SEQ ID NO: 1716475 - protein, 30 aa, Staphylococcus aureus
QAARTGSPIRLMIGFDYPDAFGNGETLVPV

SEQ ID NO: 1716476 - protein, 17 aa, Staphylococcus aureus
QAEAGGRPNYKTTGYSQ

SEQ ID NO: 1716477 - protein, 22 aa, Staphylococcus aureus
QAGESLNIIANRYGVSVDQLMA

SEQ ID NO: 1716478 - protein, 23 aa, Staphylococcus aureus
QAKETAKRALASYSNLNNAQSTA

SEQ ID NO: 1716479 - protein, 24 aa, Staphylococcus aureus
QAKGNVAALGRVNANESTDHGNFN

SEQ ID NO: 1716480 - protein, 17 aa, Staphylococcus aureus
QALTPDKAPLQTAKTQL

SEQ ID NO: 1716481 - protein, 17 aa, Staphylococcus aureus
QDLKYAKKAYYTVYFKN

SEQ ID NO: 1716482 - protein, 30 aa, Staphylococcus aureus; identical to SEQ ID NO: 1578084

SEQ ID NO: 1716483 - protein, 31 aa, Staphylococcus aureus
QEAARTRNPIRLMIGFDYPDGYGNSETLVPV

SEQ ID NO: 1716484 - protein, 28 aa, Staphylococcus aureus
QHTILFKGFFTDHSWYNDLLVDFDSKDI

SEQ ID NO: 1716485 - protein, 17 aa, Staphylococcus aureus
QIEGATHVSEVTQAQNN

SEQ ID NO: 1716486 - protein, 27 aa, Staphylococcus aureus
QKEALKAQVTSAGRVSVANGVEHTATE

SEQ ID NO: 1716487 - protein, 18 aa, Staphylococcus aureus
QKLSTITLLMTGVIALNN

SEQ ID NO: 1716488 - protein, 17 aa, Staphylococcus aureus
QKVSLELSNNFEASLSG

SEQ ID NO: 1716489 - protein, 25 aa, Staphylococcus aureus
QMNAGTQLYHIVASNAYHKDTEDFY

SEQ ID NO: 1716490 - protein, 17 aa, Staphylococcus aureus
QMNAGTQLYHIVATNAY

SEQ ID NO: 1716491 - protein, 23 aa, Staphylococcus aureus
QNAAPVARQIYPFNGNKTQALQQ

SEQ ID NO: 1716492 - protein, 29 aa, Staphylococcus aureus
QNATGLPTDGFTYKWNRDTTGTNDANWSA

SEQ ID NO: 1716493 - protein, 23 aa, Staphylococcus aureus
QNVTIPAIEAIVPQNDPNANDTN

SEQ ID NO: 1716494 - protein, 36 aa, Staphylococcus aureus
QQADYTFASLDIFNGLKRRAQTILDENRNNVPLNNR

SEQ ID NO: 1716495 - protein, 20 aa, Staphylococcus aureus
QQIAKKLKQAFIDDLAVSSE

SEQ ID NO: 1716496 - protein, 27 aa, Staphylococcus aureus
QQIKEIIYRKLATIEVFGDIKSHIVSE

SEQ ID NO: 1716497 - protein, 24 aa, Staphylococcus aureus
QRHLTFSNKWLWQKENGTIHVTLL

SEQ ID NO: 1716498 - protein, 21 aa, Staphylococcus aureus
QRVPGKWTGANFNDVKHAMDT

SEQ ID NO: 1716499 - protein, 30 aa, Staphylococcus aureus
QSLMINHYFAVPGYHAHKFVTPGHASIKIK

SEQ ID NO: 1716500 - protein, 26 aa, Staphylococcus aureus
QSLNNAMKGLRYSIANETTVKASQNY

SEQ ID NO: 1716501 - protein, 17 aa, Staphylococcus aureus
QTEDLTILSKVKPDPPR

SEQ ID NO: 1716502 - protein, 18 aa, Staphylococcus aureus
QTEDLTILSKVKPDPPRI

SEQ ID NO: 1716503 - protein, 29 aa, Staphylococcus aureus
QVQPLNKYPVVFVHGFLGLVGDNAPALYP

SEQ ID NO: 1716504 - protein, 24 aa, Staphylococcus aureus
QYLLKKKIDEYEVYKKMYKKFKEK

SEQ ID NO: 1716505 - protein, 17 aa, Staphylococcus aureus
REAETEITAAQRVIDNG

SEQ ID NO: 1716506 - protein, 17 aa, Staphylococcus aureus
REAITNINATPGATREE

SEQ ID NO: 1716507 - protein, 19 aa, Staphylococcus aureus
REHRRKGSIFMDFRNELKI

SEQ ID NO: 1716508 - protein, 17 aa, Staphylococcus aureus
REIPYRLNEEIDAINGN

SEQ ID NO: 1716509 - protein, 29 aa, Staphylococcus aureus
RFDNLDSGKYKVIFEKPAGLTQTGTNTTE

SEQ ID NO: 1716510 - protein, 27 aa, Staphylococcus aureus
RGTILMTKMMLPLMMNQGGSIVNTSSF

SEQ ID NO: 1716511 - protein, 24 aa, Staphylococcus aureus
RHSGLKSTTITTLPSGWTSNLTKS

SEQ ID NO: 1716512 - protein, 17 aa, Staphylococcus aureus
RKGSIFMDFRNELKILN

SEQ ID NO: 1716513 - protein, 20 aa, Staphylococcus aureus
RKKIPINLWINGVQKEVSLD

SEQ ID NO: 1716514 - protein, 21 aa, Staphylococcus aureus
RKKIPINLWINGVQKEVSLDK

SEQ ID NO: 1716515 - protein, 17 aa, Staphylococcus aureus
RKYSVGTASILVGTTLI

SEQ ID NO: 1716516 - protein, 25 aa, Staphylococcus aureus
RLNNRKAEALQRLDQLTHLNNAQRQ

SEQ ID NO: 1716517 - protein, 25 aa, Staphylococcus aureus
RNATELNTAMGTLKHAIADKTNTLA

SEQ ID NO: 1716518 - protein, 24 aa, Staphylococcus aureus
RNDYKARGVNEYQTLNFKTNLERS

SEQ ID NO: 1716519 - protein, 17 aa, Staphylococcus aureus
RNGNVVTTFTRHNNTSP

SEQ ID NO: 1716520 - protein, 19 aa, Staphylococcus aureus
RQAGQSFIDYVICSTQTFN

SEQ ID NO: 1716521 - protein, 27 aa, Staphylococcus aureus
RQKADLNMFFLFVITGNLIGKATEKEW

SEQ ID NO: 1716522 - protein, 17 aa, Staphylococcus aureus
RQLRYIYDVYFDRDDRI

SEQ ID NO: 1716523 - protein, 18 aa, Staphylococcus aureus
RTKIQEIDRVLASHPDVA

SEQ ID NO: 1716524 - protein, 20 aa, Staphylococcus aureus
RVNAKMRFAVAQPAAVASNN

SEQ ID NO: 1716525 - protein, 22 aa, Staphylococcus aureus
RVVDLKAGIYTADLINTSDIKA

SEQ ID NO: 1716526 - protein, 22 aa, Staphylococcus aureus
SAADYFKLSNGSAIPDATITWV

SEQ ID NO: 1716527 - protein, 17 aa, Staphylococcus aureus
SAIVKANLWLRTADRIK

SEQ ID NO: 1716528 - protein, 17 aa, Staphylococcus aureus
SAMGNLRQAVADKDQVK

SEQ ID NO: 1716529 - protein, 17 aa, Staphylococcus aureus
SDAKANLGTLTHLNNAQ

SEQ ID NO: 1716530 - protein, 17 aa, Staphylococcus aureus
SDGQRQFTLNGQVIQIM

SEQ ID NO: 1716531 - protein, 27 aa, Staphylococcus aureus
SDNKNGSLAITGRVSMNQAFNSDITFK

SEQ ID NO: 1716532 - protein, 28 aa, Staphylococcus aureus
SDNKNGSLAITGRVSMNQAFNSDITFKV

SEQ ID NO: 1716533 - protein, 30 aa, Staphylococcus aureus
SDVPEQKFKKLSNIVGNYWQKEQGYDNKSN

SEQ ID NO: 1716534 - protein, 18 aa, Staphylococcus aureus
SEDAHPIVLGNTEKVVVV

SEQ ID NO: 1716535 - protein, 20 aa, Staphylococcus aureus
SENRNGTVFSYGGVTKKNKG

SEQ ID NO: 1716536 - protein, 19 aa, Staphylococcus aureus
SEQDLPNCATFPNQMIEYG

SEQ ID NO: 1716537 - protein, 24 aa, Staphylococcus aureus
SFLIDSMAGFLLIGLITLLLIPMM

SEQ ID NO: 1716538 - protein, 27 aa, Staphylococcus aureus
SGDYFTIKYSDTVQVYGLNPEDIKNIG

SEQ ID NO: 1716539 - protein, 19 aa, Staphylococcus aureus
SGEDSWKTLTSKLKEKGLV

SEQ ID NO: 1716540 - protein, 25 aa, Staphylococcus aureus
SGFRNEYYYLTAIPYTLDEYKKYFQ

SEQ ID NO: 1716541 - protein, 26 aa, Staphylococcus aureus
SGPSFEYKKVTGYGFIEGKDRFIDFI

SEQ ID NO: 1716542 - protein, 17 aa, Staphylococcus aureus
SGSHVYVERRTMEPTAT

SEQ ID NO: 1716543 - protein, 17 aa, Staphylococcus aureus
SHDFKIRNRSGQVIYSW

SEQ ID NO: 1716544 - protein, 37 aa, Staphylococcus aureus
SHDFKIRNRSGQVIYSWPTVHVYSLEDLSRASDYFSE

SEQ ID NO: 1716545 - protein, 19 aa, Staphylococcus aureus
SIAALTILTSVTGVGTTMV

SEQ ID NO: 1716546 - protein, 20 aa, Staphylococcus aureus
SIKLFKADNTPLTITNTTYG

SEQ ID NO: 1716547 - protein, 24 aa, Staphylococcus aureus
SKIKVTMKNGGYYTFELNKKLQPH

SEQ ID NO: 1716548 - protein, 18 aa, Staphylococcus aureus
SLAALTILTSVTGVGTTL

SEQ ID NO: 1716549 - protein, 20 aa, Staphylococcus aureus
SLAVALGVTGYAASTGHEAH

SEQ ID NO: 1716550 - protein, 19 aa, Staphylococcus aureus
SLIYRYDATLGTQITTNDI

SEQ ID NO: 1716551 - protein, 19 aa, Staphylococcus aureus
SLRKILVVSLSILTILSMV

SEQ ID NO: 1716552 - protein, 18 aa, Staphylococcus aureus
SMAALAILTSVTELSAAV

SEQ ID NO: 1716553 - protein, 27 aa, Staphylococcus aureus
SNDAKAFFSYEWKGLEIAKKLADQAKQ

SEQ ID NO: 1716554 - protein, 17 aa, Staphylococcus aureus
SNEKGWIAGWHTNLDIV

SEQ ID NO: 1716555 - protein, 17 aa, Staphylococcus aureus
SNITKFNPDIHDYKEHR

SEQ ID NO: 1716556 - protein, 17 aa, Staphylococcus aureus
SNLIFPNQVLKVSGSSN

SEQ ID NO: 1716557 - protein, 25 aa, Staphylococcus aureus
SPDGPIKAKNGYIDKDIYNSTTDFY

SEQ ID NO: 1716558 - protein, 24 aa, Staphylococcus aureus
SPLGKLRAGLDLLKKPTQMQDGDI

SEQ ID NO: 1716559 - protein, 24 aa, Staphylococcus aureus
SPLGKLRAGLDLLKKPTQMQNGDI

SEQ ID NO: 1716560 - protein, 19 aa, Staphylococcus aureus
SQEKFLQHDLLFKINGSKI

SEQ ID NO: 1716561 - protein, 19 aa, Staphylococcus aureus
SRAAEPRSVSDYQNANSSY

SEQ ID NO: 1716562 - protein, 18 aa, Staphylococcus aureus
SSEKYRDADTNKQQEYDN

SEQ ID NO: 1716563 - protein, 25 aa, Staphylococcus aureus
SSNAKLPVIFWMHGGGYIAGDKQYK

SEQ ID NO: 1716564 - protein, 27 aa, Staphylococcus aureus
STAPKSLNTRMRMAAIQPNSTDSKNVN

SEQ ID NO: 1716565 - protein, 20 aa, Staphylococcus aureus
STLALTACGEKEKPKKEENK

SEQ ID NO: 1716566 - protein, 23 aa, Staphylococcus aureus
STMASELNTAMSNLQRGINDEAA

SEQ ID NO: 1716567 - protein, 36 aa, Staphylococcus aureus
STTDFYNTYVYKKGMPEFEIATSDVPEQKFKKLSNI

SEQ ID NO: 1716568 - protein, 24 aa, Staphylococcus aureus
STTGKTEFWATSSDVLKLKANYTI

SEQ ID NO: 1716569 - protein, 17 aa, Staphylococcus aureus
SVFYYKTGDMLPEDTTH

SEQ ID NO: 1716570 - protein, 29 aa, Staphylococcus aureus
SVGTASILVGTTLIFGLSGHEAKAAEHTN

SEQ ID NO: 1716571 - protein, 19 aa, Staphylococcus aureus
SVGYKQIEYMFSKEKEDET

SEQ ID NO: 1716572 - protein, 22 aa, Staphylococcus aureus
SVKLTGKENLEFNDEDVVSNVD

SEQ ID NO: 1716573 - protein, 24 aa, Staphylococcus aureus
SVWLVLLFSVMGLWQVSNAAEQHT

SEQ ID NO: 1716574 - protein, 23 aa, Staphylococcus aureus
SYVKTPSNKVLGFYPTNANTNAF

SEQ ID NO: 1716575 - protein, 22 aa, Staphylococcus aureus
TAEEKTEALATIKQITDQAKQG

SEQ ID NO: 1716576 - protein, 24 aa, Staphylococcus aureus
TALKAAIADKERTKASGNYVNADQ

SEQ ID NO: 1716577 - protein, 25 aa, Staphylococcus aureus
TAPKRLNTRMRMAAVQPSSTDSKNV

SEQ ID NO: 1716578 - protein, 19 aa, Staphylococcus aureus
TAVNHDLTEAQALDQLMDA

SEQ ID NO: 1716579 - protein, 26 aa, Staphylococcus aureus
TDARNAVNEKAREAITNINATPGATR

SEQ ID NO: 1716580 - protein, 18 aa, Staphylococcus aureus
TDARNAVNNKAREVITNI

SEQ ID NO: 1716581 - protein, 23 aa, Staphylococcus aureus
TDGLNAILGFLVLTGVIQDPTTK

SEQ ID NO: 1716582 - protein, 26 aa, Staphylococcus aureus
TDIPLDPSALVYLVIPTSQTRDGGSE

SEQ ID NO: 1716583 - protein, 25 aa, Staphylococcus aureus
TEGQLWKKVKDSLIDSKIISGNENE

SEQ ID NO: 1716584 - protein, 22 aa, Staphylococcus aureus
TELNTAMGTLKHAIADKTNTLA

SEQ ID NO: 1716585 - protein, 17 aa, Staphylococcus aureus
TFRNDLFDGYKQNRSAP

SEQ ID NO: 1716586 - protein, 27 aa, Staphylococcus aureus
TGDYNFPKKPFKYGIHYSEIEDFDNFN

SEQ ID NO: 1716587 - protein, 26 aa, Staphylococcus aureus
TGGTPFKTACMYGGVTLHDNNQLEEE

SEQ ID NO: 1716588 - protein, 20 aa, Staphylococcus aureus
TGNTEFWATSSDVLKLKANY

SEQ ID NO: 1716589 - protein, 18 aa, Staphylococcus aureus
THANGQVSYGARPTYNKP

SEQ ID NO: 1716590 - protein, 23 aa, Staphylococcus aureus
TIENRKANGYTMYTDDKQTTASD

SEQ ID NO: 1716591 - protein, 26 aa, Staphylococcus aureus
TIGSGLRILEPNGYWNSTLRWPGSYS

SEQ ID NO: 1716592 - protein, 24 aa, Staphylococcus aureus
TIVPAQDYLSLKSQITVDDKVKSG

SEQ ID NO: 1716593 - protein, 17 aa, Staphylococcus aureus
TKAQDLDGAMQRLQSAI

SEQ ID NO: 1716594 - protein, 23 aa, Staphylococcus aureus
TKYSGEGDLAIVKFSPNEQNKHI

SEQ ID NO: 1716595 - protein, 28 aa, Staphylococcus aureus
TLDSGFYKTPKYNLGNYVWEDTNKDGKQ

SEQ ID NO: 1716596 - protein, 24 aa, Staphylococcus aureus
TLDTDKTKYSWSNSYSNVNGSSTA

SEQ ID NO: 1716597 - protein, 24 aa, Staphylococcus aureus
TLDTDKTKYSWSNSYSSVNGSSTA

SEQ ID NO: 1716598 - protein, 21 aa, Staphylococcus aureus
TMGVICATQLLYSNHANALVT

SEQ ID NO: 1716599 - protein, 27 aa, Staphylococcus aureus
TNIKIYRVPEGYTLNKGYDVNTNDLVD

SEQ ID NO: 1716600 - protein, 17 aa, Staphylococcus aureus
TNNKEFTINTEIGNNGN

SEQ ID NO: 1716601 - protein, 23 aa, Staphylococcus aureus
TNNQLREAMKFDQSFKPSQIKGA

SEQ ID NO: 1716602 - protein, 22 aa, Staphylococcus aureus
TNVSGSFEQVAFAKRENATTDK

SEQ ID NO: 1716603 - protein, 26 aa, Staphylococcus aureus
TNYDYTKLVFAKPIYNDPSLVKSDTN

SEQ ID NO: 1716604 - protein, 26 aa, Staphylococcus aureus
TPATKAFGRQTFEYINGERPTESPGV

SEQ ID NO: 1716605 - protein, 27 aa, Staphylococcus aureus
TPITKTATYKVVRTVPKQVFETARGVL

SEQ ID NO: 1716606 - protein, 18 aa, Staphylococcus aureus
TQLYHIVATNAYHKDTED

SEQ ID NO: 1716607 - protein, 21 aa, Staphylococcus aureus
TSPWVKEASAATVAGIAGTNN

SEQ ID NO: 1716608 - protein, 21 aa, Staphylococcus aureus
TTGNTEFWATSSDVLKLKANY

SEQ ID NO: 1716609 - protein, 19 aa, Staphylococcus aureus
TTLPSGWTSNLTKSDNKNG

SEQ ID NO: 1716610 - protein, 18 aa, Staphylococcus aureus
TTPWNTLKASDSKEIALM

SEQ ID NO: 1716611 - protein, 24 aa, Staphylococcus aureus
TVLKAAIADKERTKASGNYVNADQ

SEQ ID NO: 1716612 - protein, 37 aa, Staphylococcus aureus; identical to SEQ ID NO: 1579425

SEQ ID NO: 1716613 - protein, 24 aa, Staphylococcus aureus
TVPVKRVIPEIVAHSHYTVQGQDF

SEQ ID NO: 1716614 - protein, 28 aa, Staphylococcus aureus
TVTVVDNLPGFTLINGGKVGVFSHAMVR

SEQ ID NO: 1716615 - protein, 25 aa, Staphylococcus aureus
TYGPKGRFGGLVYDTLGFNAVDKKV

SEQ ID NO: 1716616 - protein, 17 aa, Staphylococcus aureus
TYSVEFSTPAGYTPTTA

SEQ ID NO: 1716617 - protein, 20 aa, Staphylococcus aureus
VAAHHPKLPITMTSRSANLP

SEQ ID NO: 1716618 - protein, 23 aa, Staphylococcus aureus
VADTKAKVLDKINAIQTQARVKP

SEQ ID NO: 1716619 - protein, 23 aa, Staphylococcus aureus
VAGDSLYKIALEHHLTLNQLYSY

SEQ ID NO: 1716620 - protein, 21 aa, Staphylococcus aureus
VAKAEALISGTPDVVVTPSEI

SEQ ID NO: 1716621 - protein, 18 aa, Staphylococcus aureus
VDELDEANQLISDTLKQA

SEQ ID NO: 1716622 - protein, 18 aa, Staphylococcus aureus
VDIFALKDYETWHTYMLA

SEQ ID NO: 1716623 - protein, 27 aa, Staphylococcus aureus
VDRFNSVKMGINYSIYMDADTIPVDKK

SEQ ID NO: 1716624 - protein, 17 aa, Staphylococcus aureus
VEIKHFFDYNLPNKALN

SEQ ID NO: 1716625 - protein, 22 aa, Staphylococcus aureus
VESRAAEPRSVSDYQNANSSYY

SEQ ID NO: 1716626 - protein, 18 aa, Staphylococcus aureus
VFGANYYYQCYFSKKTND

SEQ ID NO: 1716627 - protein, 18 aa, Staphylococcus aureus
VGASSILIATLLFLSDGQ

SEQ ID NO: 1716628 - protein, 27 aa, Staphylococcus aureus
VGLNAKYYRGDEVSFTMGVSDRHSGLK

SEQ ID NO: 1716629 - protein, 22 aa, Staphylococcus aureus
VGNQIRALIFYNNVVASNMSNA

SEQ ID NO: 1716630 - protein, 23 aa, Staphylococcus aureus
VIGYPLPAQHNFKQFESTGTIKR

SEQ ID NO: 1716631 - protein, 20 aa, Staphylococcus aureus
VKANERIAIVGYPAPYKNKH

SEQ ID NO: 1716632 - protein, 19 aa, Staphylococcus aureus
VKDALDWLHENAYGKEPDK

SEQ ID NO: 1716633 - protein, 22 aa, Staphylococcus aureus
VKFETPTGYLPTKVNGTTDGEK

SEQ ID NO: 1716634 - protein, 19 aa, Staphylococcus aureus
VKFKEMIQMLLYNNAAFLT

SEQ ID NO: 1716635 - protein, 21 aa, Staphylococcus aureus
VKGAYKTYAYVVSYKPTNGNE

SEQ ID NO: 1716636 - protein, 17 aa, Staphylococcus aureus
VKLFKADNTPLNVTNIT

SEQ ID NO: 1716637 - protein, 27 aa, Staphylococcus aureus
VKPEEKLYKIGDYVWEDVDKDGVQGTD

SEQ ID NO: 1716638 - protein, 17 aa, Staphylococcus aureus
VKPTIYFKLYKQDDNQN

SEQ ID NO: 1716639 - protein, 20 aa, Staphylococcus aureus
VKQAATARKAQNATVSNATN

SEQ ID NO: 1716640 - protein, 17 aa, Staphylococcus aureus
VKQSVKFTDADKAKRDA

SEQ ID NO: 1716641 - protein, 24 aa, Staphylococcus aureus
VLADEIKYPSAKFNQPEAKDKTEL

SEQ ID NO: 1716642 - protein, 20 aa, Staphylococcus aureus
VLGISLLFLVISITAGCGMG

SEQ ID NO: 1716643 - protein, 28 aa, Staphylococcus aureus
VLTTEKFLDFDLLFKNFTWLDGKSAEFK

SEQ ID NO: 1716644 - protein, 24 aa, Staphylococcus aureus
VNALQLRFILDWNSQATRDHISYD

SEQ ID NO: 1716645 - protein, 26 aa, Staphylococcus aureus
VNGDECWNKLTSKLKEKGLLTDGQKV

SEQ ID NO: 1716646 - protein, 25 aa, Staphylococcus aureus
VNINKGRLTKSFASNLANMNFLRWV

SEQ ID NO: 1716647 - protein, 24 aa, Staphylococcus aureus
VNNKAREVITNINATPGATREEKQ

SEQ ID NO: 1716648 - protein, 29 aa, Staphylococcus aureus
VPKQVFETARGVLYPGVSDMYDAKQYVKP

SEQ ID NO: 1716649 - protein, 29 aa, Staphylococcus aureus
VPSVTVVDNLPGFTLINGGKVGVLSHAMV

SEQ ID NO: 1716650 - protein, 23 aa, Staphylococcus aureus
VQQLHANPVKKPSGKTALEQAAA

SEQ ID NO: 1716651 - protein, 39 aa, Staphylococcus aureus
VRDGKAKINAVKTFSEYKKDALAKIADAYNAKVNEADNS

SEQ ID NO: 1716652 - protein, 17 aa, Staphylococcus aureus
VSGMTHLNDAQKQALKG

SEQ ID NO: 1716653 - protein, 19 aa, Staphylococcus aureus
VSMNQAFNSDITFKVSATD

SEQ ID NO: 1716654 - protein, 20 aa, Staphylococcus aureus
VSSVLAFLAFNNAAHAQQQG

SEQ ID NO: 1716655 - protein, 17 aa, Staphylococcus aureus
VTLQYRDGSSTTLDATN

SEQ ID NO: 1716656 - protein, 17 aa, Staphylococcus aureus
VTVKPLRDKYRVGTSST

SEQ ID NO: 1716657 - protein, 19 aa, Staphylococcus aureus
VVALMFVLAACGNNSEKEQ

SEQ ID NO: 1716658 - protein, 24 aa, Staphylococcus aureus
VVDISGRPYLSFNASLSKEKVGTF

SEQ ID NO: 1716659 - protein, 24 aa, Staphylococcus aureus
VVDISGRPYLSFNATLSKEKVGTF

SEQ ID NO: 1716660 - protein, 24 aa, Staphylococcus aureus
VVKPEAQEAIKASADNQVESIKDT

SEQ ID NO: 1716661 - protein, 22 aa, Staphylococcus aureus
VVLLEGISQMMPMIKETPFKDS

SEQ ID NO: 1716662 - protein, 32 aa, Staphylococcus aureus
VWEKRKIFVATEVKKSITLMDEYIEWKTVLIA

SEQ ID NO: 1716663 - protein, 27 aa, Staphylococcus aureus
WESKGKITYLKGEAMQYDLSTTGGNSG

SEQ ID NO: 1716664 - protein, 20 aa, Staphylococcus aureus
WKNKTVKVIDKYSDDNKPYK

SEQ ID NO: 1716665 - protein, 18 aa, Staphylococcus aureus
WLTKEKKLYEFDGSAFES

SEQ ID NO: 1716666 - protein, 23 aa, Staphylococcus aureus
WSAMNKPNVAKVVNAKYDVIYNG

SEQ ID NO: 1716667 - protein, 19 aa, Staphylococcus aureus
YAKRSLWIKFKEGISQLLS

SEQ ID NO: 1716668 - protein, 17 aa, Staphylococcus aureus
YAYGNCTYYAFDRRAQL

SEQ ID NO: 1716669 - protein, 19 aa, Staphylococcus aureus
YAYGNCTYYAFNRRAQLGR

SEQ ID NO: 1716670 - protein, 17 aa, Staphylococcus aureus
YDKVAKALKSYYNDIEK

SEQ ID NO: 1716671 - protein, 24 aa, Staphylococcus aureus
YDTPISDTYYWGVIKNLESQFAEA

SEQ ID NO: 1716672 - protein, 21 aa, Staphylococcus aureus
YGSLYHIEKGKGILDKEGTKV

SEQ ID NO: 1716673 - protein, 20 aa, Staphylococcus aureus
YKARHWLTKEKKLYEFDGSA

SEQ ID NO: 1716674 - protein, 23 aa, Staphylococcus aureus
YKEEDKVIFTPNMQQVSVKLTGK

SEQ ID NO: 1716675 - protein, 33 aa, Staphylococcus aureus
YKIRNRSGQVIYDWPTVHINSLKDLAHASDYFS

SEQ ID NO: 1716676 - protein, 18 aa, Staphylococcus aureus
YLQKDLKLYNNDTLGGKI

SEQ ID NO: 1716677 - protein, 20 aa, Staphylococcus aureus
YMHNNRLTVSAGDKVKAGDQ

SEQ ID NO: 1716678 - protein, 17 aa, Staphylococcus aureus
YNAQGNIIAKGIYDSTT

SEQ ID NO: 1716679 - protein, 19 aa, Staphylococcus aureus
YNAQGNIIAKGIYDSTTNT

SEQ ID NO: 1716680 - protein, 23 aa, Staphylococcus aureus
YNLDLRTKLKFKHMGEAIDSKQI

SEQ ID NO: 1716681 - protein, 26 aa, Staphylococcus aureus
YNPGVTPLIFPGDVISLVPQNKVKQT

SEQ ID NO: 1716682 - protein, 17 aa, Staphylococcus aureus
YPGDKPVATMWESKGKI

SEQ ID NO: 1716683 - protein, 20 aa, Staphylococcus aureus
YPKNDLKGLGGEHNDYDKIT

SEQ ID NO: 1716684 - protein, 24 aa, Staphylococcus aureus
YPKPYKNKHHMFESTGKILSINGN

SEQ ID NO: 1716685 - protein, 25 aa, Staphylococcus aureus
YQAKGNVAALGRVNANDSTDHGNFN

SEQ ID NO: 1716686 - protein, 19 aa, Staphylococcus aureus
YRDNFWATADMTRLPGTTT

SEQ ID NO: 1716687 - protein, 28 aa, Staphylococcus aureus
YTIDAQGNFHYTWTGNWNPSQLTQNNTY

SEQ ID NO: 1716688 - protein, 22 aa, Staphylococcus aureus
YVKTPSNKVLGFYPTNANTNAF

SEQ ID NO: 1716689 - protein, 17 aa, Staphylococcus aureus
YYGKYTFELDKKLQEDR

SEQ ID NO: 1716690 - protein, 18 aa, Staphylococcus aureus
YYNGPTFSHKNISGYKEE

SEQ ID NO: 1716691 - protein, 17 aa, Staphylococcus aureus
YYYQCYFSKKTNDINSH

SEQ ID NO: 1716692 - protein, 17 aa, Staphylococcus aureus
AAAQPAAPVAANAQPQD

SEQ ID NO: 1716693 - protein, 17 aa, Staphylococcus aureus
AAAQPAAPVAANAQTQD

SEQ ID NO: 1716694 - protein, 19 aa, Staphylococcus aureus
AAAQPAAPVAANAQTQDPN

SEQ ID NO: 1716695 - protein, 30 aa, Staphylococcus aureus
AAGGRALEYNQLFMYSQLYLESTQDYQLRL

SEQ ID NO: 1716696 - protein, 19 aa, Staphylococcus aureus
AAGLGTRFLPATKAMPKEM

SEQ ID NO: 1716697 - protein, 20 aa, Staphylococcus aureus
AAGLIKLKKDFGLAGTLKDI

SEQ ID NO: 1716698 - protein, 20 aa, Staphylococcus aureus
AAGLIKLKKDFGLAGTVKAI

SEQ ID NO: 1716699 - protein, 22 aa, Staphylococcus aureus
AAKRVPVTVNVYQFEFPQTSYT

SEQ ID NO: 1716700 - protein, 22 aa, Staphylococcus aureus
AAMNKPNVAKVVNAKYDIIYNG

SEQ ID NO: 1716701 - protein, 22 aa, Staphylococcus aureus
AANGAGAFTINHVVKSNSTHNA

SEQ ID NO: 1716702 - protein, 22 aa, Staphylococcus aureus
AANGASAFTIDHVVKSNSTHNA

SEQ ID NO: 1716703 - protein, 25 aa, Staphylococcus aureus
AARNRTPIQLMIGFDYPDSHGNAET

SEQ ID NO: 1716704 - protein, 18 aa, Staphylococcus aureus
ADADASAKEIARTDLGRY

SEQ ID NO: 1716705 - protein, 19 aa, Staphylococcus aureus
ADATITWVSGQAPNKDNTR

SEQ ID NO: 1716706 - protein, 22 aa, Staphylococcus aureus
ADEIDMVINIGALKDGRFDDVQ

SEQ ID NO: 1716707 - protein, 23 aa, Staphylococcus aureus
ADEKGIKGVYVILKDSNGKELDR

SEQ ID NO: 1716708 - protein, 19 aa, Staphylococcus aureus
ADESLKDAIKDPALENKEH

SEQ ID NO: 1716709 - protein, 20 aa, Staphylococcus aureus
ADESLKDAIKDPALENKEHD

SEQ ID NO: 1716710 - protein, 20 aa, Staphylococcus aureus
ADGTNVQWSNGAGAGANKPL

SEQ ID NO: 1716711 - protein, 24 aa, Staphylococcus aureus
ADKMKSWYERFGFGKSTKGMFDGE

SEQ ID NO: 1716712 - protein, 17 aa, Staphylococcus aureus
ADKNMPLAIDASKDEPS

SEQ ID NO: 1716713 - protein, 17 aa, Staphylococcus aureus
ADNMTLDSGFYKTPKYS

SEQ ID NO: 1716714 - protein, 17 aa, Staphylococcus aureus
ADNWRPIDFQMKNDKGE

SEQ ID NO: 1716715 - protein, 18 aa, Staphylococcus aureus
ADNWRPIDFQMKNDKGER

SEQ ID NO: 1716716 - protein, 20 aa, Staphylococcus aureus
ADQVPVGRTDFVTVNADGTN

SEQ ID NO: 1716717 - protein, 18 aa, Staphylococcus aureus
AEAKRLGFAEADPTDDVE

SEQ ID NO: 1716718 - protein, 21 aa, Staphylococcus aureus
AEEKTEALATIKQITDQAKQG

SEQ ID NO: 1716719 - protein, 17 aa, Staphylococcus aureus
AEHSKTLNVVRGQNNQW

SEQ ID NO: 1716720 - protein, 17 aa, Staphylococcus aureus
AELLTEMQNKITEILNN

SEQ ID NO: 1716721 - protein, 17 aa, Staphylococcus aureus
AENRNGTVFSYGGVTKK

SEQ ID NO: 1716722 - protein, 17 aa, Staphylococcus aureus
AEQLAMISVSPSAITTT

SEQ ID NO: 1716723 - protein, 18 aa, Staphylococcus aureus
AEQSKKTAYDQAVAAAKA

SEQ ID NO: 1716724 - protein, 20 aa, Staphylococcus aureus
AESPGVPKVYTFIGQGDASY

SEQ ID NO: 1716725 - protein, 19 aa, Staphylococcus aureus
AETGMHFTITVKNGLTLQE

SEQ ID NO: 1716726 - protein, 22 aa, Staphylococcus aureus
AETPKVRKARSVDEGSFDITRD

SEQ ID NO: 1716727 - protein, 26 aa, Staphylococcus aureus
AEVTPSLKAERLAKISVSPSAITTTT

SEQ ID NO: 1716728 - protein, 30 aa, Staphylococcus aureus
AEYNQGPAFPFAECGAMSQAYIGYQLQESL

SEQ ID NO: 1716729 - protein, 25 aa, Staphylococcus aureus
AFINANRDAITFAEGDISVTNTPNG

SEQ ID NO: 1716730 - protein, 20 aa, Staphylococcus aureus
AGANKPLQQMWEYGVNDPHR

SEQ ID NO: 1716731 - protein, 23 aa, Staphylococcus aureus
AGANKPLQQMWEYGVNDPHRSHD

SEQ ID NO: 1716732 - protein, 22 aa, Staphylococcus aureus
AGDSLYKIALEHHLTLNHLYSY

SEQ ID NO: 1716733 - protein, 28 aa, Staphylococcus aureus
AGESLNIIASRYGVSVNQLMAANNLRGY

SEQ ID NO: 1716734 - protein, 18 aa, Staphylococcus aureus
AGESWKNKTVKKYGETET

SEQ ID NO: 1716735 - protein, 18 aa, Staphylococcus aureus
AGGRALEYNQLFMYSQLY

SEQ ID NO: 1716736 - protein, 19 aa, Staphylococcus aureus
AGLTPDLAPLQAAKTQLQN

SEQ ID NO: 1716737 - protein, 17 aa, Staphylococcus aureus
AGNGSSASDYFKLSNGS

SEQ ID NO: 1716738 - protein, 17 aa, Staphylococcus aureus
AGQGYRGYGAFVKNDSS

SEQ ID NO: 1716739 - protein, 19 aa, Staphylococcus aureus
AGQGYRGYGAFVKNDSSGN

SEQ ID NO: 1716740 - protein, 22 aa, Staphylococcus aureus
AGTQLYHIVATNAYHKDTEDFY

SEQ ID NO: 1716741 - protein, 19 aa, Staphylococcus aureus
AGYSFAKDIDIRWIDSSEV

SEQ ID NO: 1716742 - protein, 17 aa, Staphylococcus aureus
AIEFAKKHRKEFEKVGE

SEQ ID NO: 1716743 - protein, 19 aa, Staphylococcus aureus
AIESIKLANTNAEVDQAAT

SEQ ID NO: 1716744 - protein, 17 aa, Staphylococcus aureus
AIFVLGILTTSAMITEN

SEQ ID NO: 1716745 - protein, 18 aa, Staphylococcus aureus
AIFVLGILTTSVMITENQ

SEQ ID NO: 1716746 - protein, 20 aa, Staphylococcus aureus
AIQAGREIRVIVSPEEIDDL

SEQ ID NO: 1716747 - protein, 18 aa, Staphylococcus aureus
AITKKGMISNRLNKFSIR

SEQ ID NO: 1716748 - protein, 30 aa, Staphylococcus aureus
AITRKGMVSNRLNKFSIRKYTVGTASILVG

SEQ ID NO: 1716749 - protein, 19 aa, Staphylococcus aureus
AKAAVKQTLGTLTHINNAQ

SEQ ID NO: 1716750 - protein, 30 aa, Staphylococcus aureus
AKAEVTPSLKAERLAKISVSPSAITTTTQG

SEQ ID NO: 1716751 - protein, 18 aa, Staphylococcus aureus
AKALNRVMDQLSQGITGN

SEQ ID NO: 1716752 - protein, 22 aa, Staphylococcus aureus
AKAVKFSIERAKAMNKDTTVET

SEQ ID NO: 1716753 - protein, 19 aa, Staphylococcus aureus
AKDLNFRTHLSGYHKNYPY

SEQ ID NO: 1716754 - protein, 18 aa, Staphylococcus aureus
AKDLVLKAKEKAYQDILN

SEQ ID NO: 1716755 - protein, 22 aa, Staphylococcus aureus
AKEAAKRALASYSNLNNAQSTA

SEQ ID NO: 1716756 - protein, 26 aa, Staphylococcus aureus
AKEIARTDLGRYFDRFADKLDKTQTN

SEQ ID NO: 1716757 - protein, 28 aa, Staphylococcus aureus
AKGDGLNAINPIAPVTVVKQAARDAVSH

SEQ ID NO: 1716758 - protein, 36 aa, Staphylococcus aureus
AKNSAIYKEKVVKLEAPMRAGGSVTYSSNGDGTINV

SEQ ID NO: 1716759 - protein, 18 aa, Staphylococcus aureus
AKQAITTKANERKTAIAQ

SEQ ID NO: 1716760 - protein, 18 aa, Staphylococcus aureus
AKQHIASAVTNADVAYLL

SEQ ID NO: 1716761 - protein, 20 aa, Staphylococcus aureus
AKRVPVTVNVYQFEFPQTSY

SEQ ID NO: 1716762 - protein, 20 aa, Staphylococcus aureus
AKRVPVTVNVYQFEFPQTTY

SEQ ID NO: 1716763 - protein, 20 aa, Staphylococcus aureus
AKTSLALGLLTTGAITVTTQ

SEQ ID NO: 1716764 - protein, 20 aa, Staphylococcus aureus
AKTSLALGLLTTGVITTTTQ

SEQ ID NO: 1716765 - protein, 20 aa, Staphylococcus aureus
AKYDVIYNGHTFATSLPAKF

SEQ ID NO: 1716766 - protein, 17 aa, Staphylococcus aureus
AKYKQIVKNSVKSDSSY

SEQ ID NO: 1716767 - protein, 17 aa, Staphylococcus aureus
ALDQARNGLTVDKAPLE

SEQ ID NO: 1716768 - protein, 19 aa, Staphylococcus aureus
ALEYNQLFMYSQLYVESTQ

SEQ ID NO: 1716769 - protein, 20 aa, Staphylococcus aureus
ALEYNQLFMYSQLYVESTQD

SEQ ID NO: 1716770 - protein, 20 aa, Staphylococcus aureus
ALGEQTFKYINGERPTESPG

SEQ ID NO: 1716771 - protein, 23 aa, Staphylococcus aureus
ALKAAIADKERTKASGNYVNADQ

SEQ ID NO: 1716772 - protein, 27 aa, Staphylococcus aureus
ALPNGEIKARSSISMNNVTYITQDEHG

SEQ ID NO: 1716773 - protein, 26 aa, Staphylococcus aureus
ALPNGVIKARSSITMNNVTYTTQDEH

SEQ ID NO: 1716774 - protein, 25 aa, Staphylococcus aureus
ALSKIFINKDIDIFAGNYGYGCHGG

SEQ ID NO: 1716775 - protein, 19 aa, Staphylococcus aureus
AMETLKHLVDNEIPNAEQT

SEQ ID NO: 1716776 - protein, 19 aa, Staphylococcus aureus
AMNKPNVAKVVNAKYDVIY

SEQ ID NO: 1716777 - protein, 19 aa, Staphylococcus aureus
AMTALKRAIADKADTKTSG

SEQ ID NO: 1716778 - protein, 31 aa, Staphylococcus aureus
AMTRKGMVSNRLNKFSIRKYTVGTASILVGT

SEQ ID NO: 1716779 - protein, 18 aa, Staphylococcus aureus
AMYMSVLLLIIFIGGCGN

SEQ ID NO: 1716780 - protein, 23 aa, Staphylococcus aureus
ANAIIQKPIRSVQEVQSALTNVN

SEQ ID NO: 1716781 - protein, 22 aa, Staphylococcus aureus
ANEIPKAKIDANKDVDKQVQAL

SEQ ID NO: 1716782 - protein, 20 aa, Staphylococcus aureus
ANGAGAFTINHVVKSNSTHN

SEQ ID NO: 1716783 - protein, 25 aa, Staphylococcus aureus
ANPNGRRPGGVQGLNEYQISQLFSD

SEQ ID NO: 1716784 - protein, 20 aa, Staphylococcus aureus
ANPVKKPSGKTALDQAAADK

SEQ ID NO: 1716785 - protein, 23 aa, Staphylococcus aureus
ANRPTDGGLSWSDDHKSLIYRYD

SEQ ID NO: 1716786 - protein, 22 aa, Staphylococcus aureus
ANTNAFRPGGVNPLNEYQLSQL

SEQ ID NO: 1716787 - protein, 20 aa, Staphylococcus aureus
APAATKALGEQTFKYINGER

SEQ ID NO: 1716788 - protein, 17 aa, Staphylococcus aureus
APKRLNAKMRFAVAQPA

SEQ ID NO: 1716789 - protein, 23 aa, Staphylococcus aureus
APKRLNAKMRFAVAQPAAVASNN

SEQ ID NO: 1716790 - protein, 20 aa, Staphylococcus aureus
APLPIAQPLVKLPQIGTQGE

SEQ ID NO: 1716791 - protein, 24 aa, Staphylococcus aureus
APYNLPTTPWNTLKASDAKEIALI

SEQ ID NO: 1716792 - protein, 18 aa, Staphylococcus aureus
AQAEAGGRPNYKTTGYSQ

SEQ ID NO: 1716793 - protein, 23 aa, Staphylococcus aureus
AQAKALYPKVRMYYERSEPVAEA

SEQ ID NO: 1716794 - protein, 23 aa, Staphylococcus aureus
AQALNQAMEALRNSIQDQQQTES

SEQ ID NO: 1716795 - protein, 24 aa, Staphylococcus aureus
AQALNQAMEALRNSIQDQQQTESG

SEQ ID NO: 1716796 - protein, 23 aa, Staphylococcus aureus
AQGNYHYTWTGNWNPSQLTQNNT

SEQ ID NO: 1716797 - protein, 20 aa, Staphylococcus aureus
AQHMNFQFVGTYGPNKDVVG

SEQ ID NO: 1716798 - protein, 28 aa, Staphylococcus aureus
AQKEIKPKFKGLRSYYTKSSLEFKNELG

SEQ ID NO: 1716799 - protein, 17 aa, Staphylococcus aureus
AQLYLTPYGPKQYVEHL

SEQ ID NO: 1716800 - protein, 18 aa, Staphylococcus aureus
AQQAIKASAENQVESIKD

SEQ ID NO: 1716801 - protein, 20 aa, Staphylococcus aureus
ARAAEPRSVSDYQNANSSYY

SEQ ID NO: 1716802 - protein, 22 aa, Staphylococcus aureus
ARGNFNPEFISVLSHKQNEAKK

SEQ ID NO: 1716803 - protein, 18 aa, Staphylococcus aureus
ARKNPGLDIFVVKEAENR

SEQ ID NO: 1716804 - protein, 20 aa, Staphylococcus aureus
ARLKFKSEVEKNGYYAMNEK

SEQ ID NO: 1716805 - protein, 19 aa, Staphylococcus aureus
ARQALTPDKAPLQTAKTQL

SEQ ID NO: 1716806 - protein, 21 aa, Staphylococcus aureus
ARQGLTLDRQPAFTTLHGASN

SEQ ID NO: 1716807 - protein, 27 aa, Staphylococcus aureus
ARTGSPIRLMIGFDYPDAFGNGETLVP

SEQ ID NO: 1716808 - protein, 18 aa, Staphylococcus aureus
ASAAKEIVLMTAKQTGDG

SEQ ID NO: 1716809 - protein, 23 aa, Staphylococcus aureus
ASAKLKLELLPNVQNPVISVTTT

SEQ ID NO: 1716810 - protein, 24 aa, Staphylococcus aureus
ASAKLKLELLPNVQNPVISVTTTM

SEQ ID NO: 1716811 - protein, 17 aa, Staphylococcus aureus
ASATFLLAGCGNDQKED

SEQ ID NO: 1716812 - protein, 18 aa, Staphylococcus aureus
ASDYFSEAGATPATKAFG

SEQ ID NO: 1716813 - protein, 19 aa, Staphylococcus aureus
ASIKIKHFSVVPQINSFKV

SEQ ID NO: 1716814 - protein, 19 aa, Staphylococcus aureus
ASIKINHFCVVPQINSFKA

SEQ ID NO: 1716815 - protein, 18 aa, Staphylococcus aureus
ASLALGLITTGASIVTTQ

SEQ ID NO: 1716816 - protein, 17 aa, Staphylococcus aureus
ASLALGLVTTGASIVTT

SEQ ID NO: 1716817 - protein, 17 aa, Staphylococcus aureus
ASLDVVRYVAVHHPKLP

SEQ ID NO: 1716818 - protein, 34 aa, Staphylococcus aureus; identical to SEQ ID NO: 1586455

SEQ ID NO: 1716819 - protein, 25 aa, Staphylococcus aureus
ASNRPKKRSKRAAPADPNATPADPA

SEQ ID NO: 1716820 - protein, 24 aa, Staphylococcus aureus
ASTDVKTNARAELLNEMQNKITEI

SEQ ID NO: 1716821 - protein, 28 aa, Staphylococcus aureus
ASTDVKTNARAELLTEMQNKITEILSDN

SEQ ID NO: 1716822 - protein, 21 aa, Staphylococcus aureus
ASVIVSTLFLITSQHQAHAAE

SEQ ID NO: 1716823 - protein, 19 aa, Staphylococcus aureus
ASVTLGTLLISGGVTAANA

SEQ ID NO: 1716824 - protein, 18 aa, Staphylococcus aureus
ASVTLGTLLISGGVTPAA

SEQ ID NO: 1716825 - protein, 18 aa, Staphylococcus aureus
ATADMKRLADTTTLENEE

SEQ ID NO: 1716826 - protein, 21 aa, Staphylococcus aureus
ATEKEARKLLSEMKTESDRKY

SEQ ID NO: 1716827 - protein, 32 aa, Staphylococcus aureus; identical to SEQ ID NO: 1582018

SEQ ID NO: 1716828 - protein, 19 aa, Staphylococcus aureus
ATELNNAMHSLQNGINDET

SEQ ID NO: 1716829 - protein, 25 aa, Staphylococcus aureus
ATGLPTDGFTYKWNNAATGTNDANW

SEQ ID NO: 1716830 - protein, 18 aa, Staphylococcus aureus
ATHTSIYEIDWEKHTVKL

SEQ ID NO: 1716831 - protein, 44 aa, Staphylococcus aureus
ATIKNSALEQLKAQRINPVVKKNTLEAIREVVNKQIEIIKNADA

SEQ ID NO: 1716832 - protein, 17 aa, Staphylococcus aureus
ATLALGILTTGTLTTEA

SEQ ID NO: 1716833 - protein, 18 aa, Staphylococcus aureus
ATLALGILTTGVFTAESK

SEQ ID NO: 1716834 - protein, 28 aa, Staphylococcus aureus
ATLDFGDINSAYIIKVVSKYTPTSDGEL

SEQ ID NO: 1716835 - protein, 19 aa, Staphylococcus aureus
ATPEHNYQFGGAMIESQKL

SEQ ID NO: 1716836 - protein, 18 aa, Staphylococcus aureus
ATTKIWQNGHIDITPNNP

SEQ ID NO: 1716837 - protein, 18 aa, Staphylococcus aureus
ATTKIWQNGHVDITPNNP

SEQ ID NO: 1716838 - protein, 19 aa, Staphylococcus aureus
ATTKIWQNGHVDITPNNPS

SEQ ID NO: 1716839 - protein, 18 aa, Staphylococcus aureus
ATTTVPGLRNNITGNEKA

SEQ ID NO: 1716840 - protein, 18 aa, Staphylococcus aureus
ATTTVPGLRNNIVGNEKA

SEQ ID NO: 1716841 - protein, 19 aa, Staphylococcus aureus
AVIADKERTKASGNYVNAD

SEQ ID NO: 1716842 - protein, 18 aa, Staphylococcus aureus
AVNHDLAEAQALDQLMDA

SEQ ID NO: 1716843 - protein, 28 aa, Staphylococcus aureus
AVNTSAPRMRAFSLAAVAADAPAAGTDI

SEQ ID NO: 1716844 - protein, 23 aa, Staphylococcus aureus
AVPESKLGNIVPEYKEINNRVNV

SEQ ID NO: 1716845 - protein, 24 aa, Staphylococcus aureus
AVTPKVMKKQAAKDEIDQLQAVQT

SEQ ID NO: 1716846 - protein, 23 aa, Staphylococcus aureus
AVYKAQLYLSPYGPKQYVEHLNQ

SEQ ID NO: 1716847 - protein, 25 aa, Staphylococcus aureus
AVYKAQLYLSPYGPKQYVEHLNQNT

SEQ ID NO: 1716848 - protein, 22 aa, Staphylococcus aureus
AYVKPLNQFKLGTVTVSGTVTQ

SEQ ID NO: 1716849 - protein, 18 aa, Staphylococcus aureus
CKSKYMYGGVTLSGQYLN

SEQ ID NO: 1716850 - protein, 19 aa, Staphylococcus aureus
CTSLILGGCSLMHKDQTKD

SEQ ID NO: 1716851 - protein, 22 aa, Staphylococcus aureus
DAAKRQIEGATHVNEVTQAQNN

SEQ ID NO: 1716852 - protein, 20 aa, Staphylococcus aureus
DADNMTLDSGFYKTPKYSLG

SEQ ID NO: 1716853 - protein, 17 aa, Staphylococcus aureus
DAGFYTFELNKKLQTHR

SEQ ID NO: 1716854 - protein, 37 aa, Staphylococcus aureus
DAITDARGIYQLKDGYKYYSFVDSIGLHSGSHVYVER

SEQ ID NO: 1716855 - protein, 39 aa, Staphylococcus aureus
DAITDARGIYQLRDGYKYYDFVDSIGLHSGSHVYVERRT

SEQ ID NO: 1716856 - protein, 43 aa, Staphylococcus aureus
DAITDTRGIYQLKDGYKYYDFVDSIGLHSGSHVYVERRTMEPT

SEQ ID NO: 1716857 - protein, 49 aa, Staphylococcus aureus
DAITDVRGIYQLRDGYKYYDFVDSIGLHSGSHLYVERRIMEPTATNNKE

SEQ ID NO: 1716858 - protein, 17 aa, Staphylococcus aureus
DAKRIVILEYSFADALA

SEQ ID NO: 1716859 - protein, 18 aa, Staphylococcus aureus
DALILKMQGFISSRTTYY

SEQ ID NO: 1716860 - protein, 26 aa, Staphylococcus aureus
DANEKGIKGVYVILKDSNGKELDRTT

SEQ ID NO: 1716861 - protein, 18 aa, Staphylococcus aureus
DATITWVSGQAPNKDNTC

SEQ ID NO: 1716862 - protein, 34 aa, Staphylococcus aureus
DAVGTPLKRCAIVNRHNGKIINIFDDMSEKDKEE

SEQ ID NO: 1716863 - protein, 26 aa, Staphylococcus aureus
DAVGTPLKRCAIVNRHNGTIVNIFDD

SEQ ID NO: 1716864 - protein, 23 aa, Staphylococcus aureus
DAVKRQIEGATHVNEVTQAQNNA

SEQ ID NO: 1716865 - protein, 18 aa, Staphylococcus aureus
DAYTNAVAHAEDILSKAN

SEQ ID NO: 1716866 - protein, 17 aa, Staphylococcus aureus
DDAKRLANTLLNSDNTN

SEQ ID NO: 1716867 - protein, 19 aa, Staphylococcus aureus
DDKQFFPPYAVSAVATNEL

SEQ ID NO: 1716868 - protein, 25 aa, Staphylococcus aureus
DEDYEGLDVFVVREGSGKHADNISI

SEQ ID NO: 1716869 - protein, 18 aa, Staphylococcus aureus
DEGSHCQIARNIATTMSH

SEQ ID NO: 1716870 - protein, 17 aa, Staphylococcus aureus
DEHGRAIDVTRNESVDS

SEQ ID NO: 1716871 - protein, 22 aa, Staphylococcus aureus
DEKKKYIAFKMEITAKKDDKDL

SEQ ID NO: 1716872 - protein, 20 aa, Staphylococcus aureus
DEMVFELPITATERASIKHS

SEQ ID NO: 1716873 - protein, 17 aa, Staphylococcus aureus
DESWKNKTVKKYGETET

SEQ ID NO: 1716874 - protein, 34 aa, Staphylococcus aureus
DFKIRNRSGQVIYDWPTVHINSLKDLARAGDYFS

SEQ ID NO: 1716875 - protein, 35 aa, Staphylococcus aureus; identical to SEQ ID NO: 1579511

SEQ ID NO: 1716876 - protein, 26 aa, Staphylococcus aureus
DFNEKLTYRTASDVVINNAQPEVTLT

SEQ ID NO: 1716877 - protein, 23 aa, Staphylococcus aureus
DFVYKIQLPEGVEYVNNSLTKDF

SEQ ID NO: 1716878 - protein, 18 aa, Staphylococcus aureus
DGELDIAQGTSMRTTDKY

SEQ ID NO: 1716879 - protein, 21 aa, Staphylococcus aureus
DGETYTVKFETPTGYLPTKVN

SEQ ID NO: 1716880 - protein, 23 aa, Staphylococcus aureus
DGKDIEYDTEFTIDNKVKKGDTM

SEQ ID NO: 1716881 - protein, 21 aa, Staphylococcus aureus
DGLNAILGFLVLTGVIQDPTT

SEQ ID NO: 1716882 - protein, 22 aa, Staphylococcus aureus
DGNMLKPWFVNSVENPVSKRQF

SEQ ID NO: 1716883 - protein, 19 aa, Staphylococcus aureus
DGSGYPVGTYINASSKGAP

SEQ ID NO: 1716884 - protein, 18 aa, Staphylococcus aureus
DGTNVQWSHGAEAGANKP

SEQ ID NO: 1716885 - protein, 18 aa, Staphylococcus aureus
DHKAELSITKKDEKGKIS

SEQ ID NO: 1716886 - protein, 18 aa, Staphylococcus aureus
DHVKEAQNLINDYKYTQI

SEQ ID NO: 1716887 - protein, 26 aa, Staphylococcus aureus
DILTMLKATTTVAGLRNNIAGNEKAQ

SEQ ID NO: 1716888 - protein, 26 aa, Staphylococcus aureus
DILTMLKATTTVPGLRNNIVGNEKAQ

SEQ ID NO: 1716889 - protein, 25 aa, Staphylococcus aureus
DIPLDPSALVYLVIPTSQTRDGGSE

SEQ ID NO: 1716890 - protein, 17 aa, Staphylococcus aureus
DITFKVSATDNVNNTTN

SEQ ID NO: 1716891 - protein, 23 aa, Staphylococcus aureus
DITRIASSNVQMWKDITLSNKTY

SEQ ID NO: 1716892 - protein, 23 aa, Staphylococcus aureus
DKDATRASSAYVNAEPNKKQSYD

SEQ ID NO: 1716893 - protein, 21 aa, Staphylococcus aureus
DKDKVLGLFADKNMPLAIDAS

SEQ ID NO: 1716894 - protein, 27 aa, Staphylococcus aureus
DKEEFEAFKKRSPKYNPGMSDQAEMDN

SEQ ID NO: 1716895 - protein, 27 aa, Staphylococcus aureus
DKEEFEAFKKRSPKYNPGMSDQAETDN

SEQ ID NO: 1716896 - protein, 18 aa, Staphylococcus aureus
DKEGYRDGEFEKGDKGMW

SEQ ID NO: 1716897 - protein, 19 aa, Staphylococcus aureus
DKEGYRDGEFEKGDKGMWT

SEQ ID NO: 1716898 - protein, 22 aa, Staphylococcus aureus
DKEIPNGIELSIKFSDNKINTV

SEQ ID NO: 1716899 - protein, 17 aa, Staphylococcus aureus
DKGKWVIRSEMTTEMKN

SEQ ID NO: 1716900 - protein, 18 aa, Staphylococcus aureus
DKGTWVVRSEMIIQPKGK

SEQ ID NO: 1716901 - protein, 19 aa, Staphylococcus aureus
DKHTIPSDITDDFTPVDIT

SEQ ID NO: 1716902 - protein, 25 aa, Staphylococcus aureus
DKKNGSLAISGRVSMNQAYNSDITF

SEQ ID NO: 1716903 - protein, 25 aa, Staphylococcus aureus
DKKNGSLAITGRVSMNQAFNSNITF

SEQ ID NO: 1716904 - protein, 22 aa, Staphylococcus aureus
DKLVIKRNGSVVTTYTRHNNTS

SEQ ID NO: 1716905 - protein, 18 aa, Staphylococcus aureus
DKSKVVGYIEIPDADIKE

SEQ ID NO: 1716906 - protein, 21 aa, Staphylococcus aureus
DKTAYKMEVTLGNDAYSEEII

SEQ ID NO: 1716907 - protein, 24 aa, Staphylococcus aureus
DKTAYKMEVTLGNDTYSKDVIVDY

SEQ ID NO: 1716908 - protein, 27 aa, Staphylococcus aureus
DKYEDIKARLTLYSYIDKQAVPNETSL

SEQ ID NO: 1716909 - protein, 25 aa, Staphylococcus aureus
DLINEKYLIKMGKVAPWRTQSTTTP

SEQ ID NO: 1716910 - protein, 23 aa, Staphylococcus aureus
DLKKYLYIKRMIWPFQYNISLKT

SEQ ID NO: 1716911 - protein, 21 aa, Staphylococcus aureus
DLPTDIDFSIQFSDNKINTIK

SEQ ID NO: 1716912 - protein, 24 aa, Staphylococcus aureus
DLSEKLSFDRMFDVMDSKQIKNIE

SEQ ID NO: 1716913 - protein, 32 aa, Staphylococcus aureus
DLSLPIRAGYSLEIKVPLNAIKIPKSVLTKGN

SEQ ID NO: 1716914 - protein, 26 aa, Staphylococcus aureus
DLSLPIRAGYSLEIKVPLNVIKIPKS

SEQ ID NO: 1716915 - protein, 23 aa, Staphylococcus aureus
DLYQSIWKKICVNGTANALSTVL

SEQ ID NO: 1716916 - protein, 21 aa, Staphylococcus aureus
DMSGWTKEDVIAFENLTNIKV

SEQ ID NO: 1716917 - protein, 19 aa, Staphylococcus aureus
DNAKEAIATKANERKTAIA

SEQ ID NO: 1716918 - protein, 18 aa, Staphylococcus aureus
DNELWKNVRDALKEANII

SEQ ID NO: 1716919 - protein, 18 aa, Staphylococcus aureus
DNREKFSIFDDVTVSDIH

SEQ ID NO: 1716920 - protein, 18 aa, Staphylococcus aureus
DNYKVFVQFNERIDTEGQ

SEQ ID NO: 1716921 - protein, 22 aa, Staphylococcus aureus
DPHLGHALAVVANAKINDQEKL

SEQ ID NO: 1716922 - protein, 18 aa, Staphylococcus aureus
DPHRSHDFKIRNRSGQVI

SEQ ID NO: 1716923 - protein, 18 aa, Staphylococcus aureus
DPKFKRADAIKVNGDIRK

SEQ ID NO: 1716924 - protein, 23 aa, Staphylococcus aureus
DPKFKRADAIKVNRDIRKFDKIL

SEQ ID NO: 1716925 - protein, 25 aa, Staphylococcus aureus
DPKRVPSLYSIIPMIEMMFGVHFIK

SEQ ID NO: 1716926 - protein, 27 aa, Staphylococcus aureus
DPNATPADPWAAAAGNGGAPVAITAPY

SEQ ID NO: 1716927 - protein, 20 aa, Staphylococcus aureus
DQIPSGYSILATGTPDGVHN

SEQ ID NO: 1716928 - protein, 19 aa, Staphylococcus aureus
DQLLKVARTELALQPNERY

SEQ ID NO: 1716929 - protein, 22 aa, Staphylococcus aureus
DQRVINHYGSLIPLTPLDNSLL

SEQ ID NO: 1716930 - protein, 19 aa, Staphylococcus aureus
DQVPVGRTDFVTVNSDGTN

SEQ ID NO: 1716931 - protein, 20 aa, Staphylococcus aureus
DRLLKHDLLFHDMFVNVASK

SEQ ID NO: 1716932 - protein, 26 aa, Staphylococcus aureus
DSDKFKISQILTFNFIKDKSYDKDTL

SEQ ID NO: 1716933 - protein, 19 aa, Staphylococcus aureus
DSEGMVLHLNRNMRTATGH

SEQ ID NO: 1716934 - protein, 20 aa, Staphylococcus aureus
DSPDTWKHTVGNTHKTAVVT

SEQ ID NO: 1716935 - protein, 17 aa, Staphylococcus aureus
DTMTVKYDKHTIPSDIT

SEQ ID NO: 1716936 - protein, 25 aa, Staphylococcus aureus
DTNDFPITWFYPLGEKKVERKAPKL

SEQ ID NO: 1716937 - protein, 26 aa, Staphylococcus aureus
DTNGFPIAWFYPLGEKKVERKAPKLE

SEQ ID NO: 1716938 - protein, 26 aa, Staphylococcus aureus
DTNIFPYTGVVAFNSATGFVVGKNTI

SEQ ID NO: 1716939 - protein, 32 aa, Staphylococcus aureus
DTNVFPYNGVVSFKDATGFAIEKNTIITNKHV

SEQ ID NO: 1716940 - protein, 18 aa, Staphylococcus aureus
DTSKLIDVTDKFKITYSN

SEQ ID NO: 1716941 - protein, 17 aa, Staphylococcus aureus
DVAYLLHDEKNEIREIE

SEQ ID NO: 1716942 - protein, 21 aa, Staphylococcus aureus
DVFVVKELIDPNGRVSTVGGV

SEQ ID NO: 1716943 - protein, 21 aa, Staphylococcus aureus
DVKDAEKLLKEAGYHKNSDGI

SEQ ID NO: 1716944 - protein, 18 aa, Staphylococcus aureus
DVLLGGGAKYFGKSNGNL

SEQ ID NO: 1716945 - protein, 18 aa, Staphylococcus aureus
DVLLGGGAKYLGKSNGNL

SEQ ID NO: 1716946 - protein, 24 aa, Staphylococcus aureus
DVTDEFKNKMTYGSNQSVNLDFGD

SEQ ID NO: 1716947 - protein, 17 aa, Staphylococcus aureus
DVVGISTRLIRVTYDNR

SEQ ID NO: 1716948 - protein, 22 aa, Staphylococcus aureus
DVVGISTRLIRVTYDNRQTEDL

SEQ ID NO: 1716949 - protein, 23 aa, Staphylococcus aureus
DVVGISTRLIRVTYDNRQTEDLT

SEQ ID NO: 1716950 - protein, 21 aa, Staphylococcus aureus
DYAGYPWPGYDDIVSEIIDSN

SEQ ID NO: 1716951 - protein, 17 aa, Staphylococcus aureus
DYFIYKIALVGKDDKKY

SEQ ID NO: 1716952 - protein, 20 aa, Staphylococcus aureus
DYLNAPKFVIKKEVDAGVYT

SEQ ID NO: 1716953 - protein, 22 aa, Staphylococcus aureus
EAAKRQIEGATHVNEVTQAQNN

SEQ ID NO: 1716954 - protein, 28 aa, Staphylococcus aureus
EAARTRNPIRLMIGFDYPDAYGNSETLV

SEQ ID NO: 1716955 - protein, 29 aa, Staphylococcus aureus
EAARTRNPIRLMIGFDYPDGYGNSETLVP

SEQ ID NO: 1716956 - protein, 29 aa, Staphylococcus aureus
EAGAPASTKAFGRQIFEYINGERPTESPG

SEQ ID NO: 1716957 - protein, 30 aa, Staphylococcus aureus; identical to SEQ ID NO: 1580014

SEQ ID NO: 1716958 - protein, 24 aa, Staphylococcus aureus
EAKALNQAMEALRNSIQDQQQTES

SEQ ID NO: 1716959 - protein, 23 aa, Staphylococcus aureus
EAKEVKEVKAPKETKAVKPAAKA

SEQ ID NO: 1716960 - protein, 19 aa, Staphylococcus aureus
EAKIKEPFIINEKDEKKKY

SEQ ID NO: 1716961 - protein, 23 aa, Staphylococcus aureus
EALNQAMEALRNSIQDQQQTEAG

SEQ ID NO: 1716962 - protein, 20 aa, Staphylococcus aureus
EAMDTYRKKLFAELDALNKF

SEQ ID NO: 1716963 - protein, 17 aa, Staphylococcus aureus
EANAPAATKALGEQTFK

SEQ ID NO: 1716964 - protein, 17 aa, Staphylococcus aureus
EDGKNLLSFDVQTNKKK

SEQ ID NO: 1716965 - protein, 22 aa, Staphylococcus aureus
EDKTSNKWGVTQNIQFDFVKDK

SEQ ID NO: 1716966 - protein, 18 aa, Staphylococcus aureus
EDLSRASDYFSEAGATPA

SEQ ID NO: 1716967 - protein, 24 aa, Staphylococcus aureus
EDLYNKLDMILGYEEDERKSKKPI

SEQ ID NO: 1716968 - protein, 19 aa, Staphylococcus aureus
EDTADLLVTTAMTKNINSQ

SEQ ID NO: 1716969 - protein, 24 aa, Staphylococcus aureus
EEKTSCLYGGVTIHDGNQLDEERV

SEQ ID NO: 1716970 - protein, 25 aa, Staphylococcus aureus
EELRKQLKIKPGHFSYHEMSPAEMP

SEQ ID NO: 1716971 - protein, 17 aa, Staphylococcus aureus
EERKEKFLAKNKDNPVV

SEQ ID NO: 1716972 - protein, 22 aa, Staphylococcus aureus
EEVAEADAAVDAAQKQGLHDIQ

SEQ ID NO: 1716973 - protein, 30 aa, Staphylococcus aureus
EFDEKLESIPAYYQLHGDKIIGFDTEGGVS

SEQ ID NO: 1716974 - protein, 24 aa, Staphylococcus aureus
EFEETSALPGRKTGSLVGLSQIDS

SEQ ID NO: 1716975 - protein, 19 aa, Staphylococcus aureus
EGIIKQISELPISYEENLS

SEQ ID NO: 1716976 - protein, 19 aa, Staphylococcus aureus
EGKAGQFVTGPWNINEYQE

SEQ ID NO: 1716977 - protein, 24 aa, Staphylococcus aureus
EGKVFRENQKWMTPLGRLGKPEEV

SEQ ID NO: 1716978 - protein, 19 aa, Staphylococcus aureus
EGTGRSAIMTTIGGITTPN

SEQ ID NO: 1716979 - protein, 26 aa, Staphylococcus aureus
EHAKELRAKLDIILGEEKKPNRITNE

SEQ ID NO: 1716980 - protein, 24 aa, Staphylococcus aureus
EIEDFKFFVQYGDFKDINDYKDGD

SEQ ID NO: 1716981 - protein, 23 aa, Staphylococcus aureus
EIEDFKFFVQYGNFKDFKDYKNG

SEQ ID NO: 1716982 - protein, 18 aa, Staphylococcus aureus
EIEKRLSQKKAFQIEFGR

SEQ ID NO: 1716983 - protein, 24 aa, Staphylococcus aureus
EIENFKFFLQYGNFKDFKDYKDGD

SEQ ID NO: 1716984 - protein, 24 aa, Staphylococcus aureus
EIENFKFFVQYGDFKDLSKYKDGD

SEQ ID NO: 1716985 - protein, 23 aa, Staphylococcus aureus
EIENFKFFVQYGNFKDINDYKNG

SEQ ID NO: 1716986 - protein, 23 aa, Staphylococcus aureus
EIENFKFFVQYGNFKDYKNGDIS

SEQ ID NO: 1716987 - protein, 19 aa, Staphylococcus aureus
EIEPDWNIHVYERLDRPAI

SEQ ID NO: 1716988 - protein, 21 aa, Staphylococcus aureus
EIEQAKAQLAQALQDIKDLVK

SEQ ID NO: 1716989 - protein, 17 aa, Staphylococcus aureus
EIGTPKSLTNTLILLNG

SEQ ID NO: 1716990 - protein, 22 aa, Staphylococcus aureus
EINPKYKDLRTYYTKPSLEFEK

SEQ ID NO: 1716991 - protein, 25 aa, Staphylococcus aureus
EIREIEPVINRKASAREQLTTLLND

SEQ ID NO: 1716992 - protein, 17 aa, Staphylococcus aureus
EIVKGPEYLTMENKTLQ

SEQ ID NO: 1716993 - protein, 18 aa, Staphylococcus aureus
EIVQGPDFLTMEQNRPSL

SEQ ID NO: 1716994 - protein, 27 aa, Staphylococcus aureus
EKAQAEAGGRPNFRTTGYSQSNATTDG

SEQ ID NO: 1716995 - protein, 32 aa, Staphylococcus aureus
EKEPWSQPPSGYKWYDPKTFKAGSYGSEKGAD

SEQ ID NO: 1716996 - protein, 20 aa, Staphylococcus aureus
EKGNVCGMMPHPERALETLL

SEQ ID NO: 1716997 - protein, 23 aa, Staphylococcus aureus
EKIAHAYAYGGPNMAVKSLEKLM

SEQ ID NO: 1716998 - protein, 18 aa, Staphylococcus aureus
EKKKFTAPIKTFAPDSDK

SEQ ID NO: 1716999 - protein, 21 aa, Staphylococcus aureus
EKKKFTAPIKTFAPKSDEILS

SEQ ID NO: 1717000 - protein, 21 aa, Staphylococcus aureus
EKKLKELIKLHRLLSETYKIM

SEQ ID NO: 1717001 - protein, 30 aa, Staphylococcus aureus
EKNAFRITNERIKNEMIYDLNSIIDDFFME

SEQ ID NO: 1717002 - protein, 20 aa, Staphylococcus aureus
EKNFGVYFTPQLKEFIQNNI

SEQ ID NO: 1717003 - protein, 19 aa, Staphylococcus aureus
EKNPYVSKALELKDKSNKS

SEQ ID NO: 1717004 - protein, 20 aa, Staphylococcus aureus
EKPMANVLVTLTYPDGTTKS

SEQ ID NO: 1717005 - protein, 17 aa, Staphylococcus aureus
EKQALKDRINQILSTRS

SEQ ID NO: 1717006 - protein, 19 aa, Staphylococcus aureus
EKQRIITAFMNKNQNIRGY

SEQ ID NO: 1717007 - protein, 20 aa, Staphylococcus aureus
EKQRIITAFMNKNQNIRGYL

SEQ ID NO: 1717008 - protein, 25 aa, Staphylococcus aureus
EKSQAEAGGRPNFRTTGYSQSNATT

SEQ ID NO: 1717009 - protein, 24 aa, Staphylococcus aureus
EKTKDVSAQKVWEGTQKVKPTIYF

SEQ ID NO: 1717010 - protein, 21 aa, Staphylococcus aureus
ELDFKLRKQLISQSGLYSKGL

SEQ ID NO: 1717011 - protein, 19 aa, Staphylococcus aureus
ELDYRLRERAIKQHGLYSN

SEQ ID NO: 1717012 - protein, 23 aa, Staphylococcus aureus
ELERVKNEEIFKIENITDSTQTK

SEQ ID NO: 1717013 - protein, 19 aa, Staphylococcus aureus
ELGLKTASTWKKFEVYEGD

SEQ ID NO: 1717014 - protein, 21 aa, Staphylococcus aureus
ELIDIKGGIYSVGGITKKNVR

SEQ ID NO: 1717015 - protein, 21 aa, Staphylococcus aureus
ELNTAMGQLKHAIADKTTTLA

SEQ ID NO: 1717016 - protein, 24 aa, Staphylococcus aureus
ELNTAMTALKRAIADKAETKASGN

SEQ ID NO: 1717017 - protein, 17 aa, Staphylococcus aureus
ENFKFFGQYADFKDLKN

SEQ ID NO: 1717018 - protein, 26 aa, Staphylococcus aureus
ENFTDRDWQITGIPRTLHIENSTNRP

SEQ ID NO: 1717019 - protein, 25 aa, Staphylococcus aureus
ENKLKIKDAIKWLHHNVYGKDPDKK

SEQ ID NO: 1717020 - protein, 23 aa, Staphylococcus aureus
ENLYNKLDLIVGRSDDEREERHP

SEQ ID NO: 1717021 - protein, 24 aa, Staphylococcus aureus
ENVRNFLKQNIEDINFANDDNPNN

SEQ ID NO: 1717022 - protein, 24 aa, Staphylococcus aureus
ENVRNFLKQNIEDINFANDDQPNN

SEQ ID NO: 1717023 - protein, 26 aa, Staphylococcus aureus
EQIKPKVRRKRAALDNIDESNNNQLD

SEQ ID NO: 1717024 - protein, 17 aa, Staphylococcus aureus
EQKRNAYNQAISAAETI

SEQ ID NO: 1717025 - protein, 20 aa, Staphylococcus aureus
ERLAAKHLVEQALNQAIDQI

SEQ ID NO: 1717026 - protein, 26 aa, Staphylococcus aureus
ERYGKTYKGIMPNWEPGKKVHLVGHS

SEQ ID NO: 1717027 - protein, 17 aa, Staphylococcus aureus
ESGRTYLWDSAKDLDNK

SEQ ID NO: 1717028 - protein, 20 aa, Staphylococcus aureus
ESIGYLADCYGFVQKGIQNM

SEQ ID NO: 1717029 - protein, 21 aa, Staphylococcus aureus
ESIGYLADCYGFVQKGIQNMN

SEQ ID NO: 1717030 - protein, 21 aa, Staphylococcus aureus
ESPGAPKVYTFIGKGDASYTI

SEQ ID NO: 1717031 - protein, 21 aa, Staphylococcus aureus
ESQFSKALAIIEEYQYGEKEY

SEQ ID NO: 1717032 - protein, 25 aa, Staphylococcus aureus
ESREKELLKYFPSDYKKPEEKTSDT

SEQ ID NO: 1717033 - protein, 17 aa, Staphylococcus aureus
ESRGMVLYINRNTRTTK

SEQ ID NO: 1717034 - protein, 26 aa, Staphylococcus aureus
ETDPIYKREYKHFYTPEEAQRAQENS

SEQ ID NO: 1717035 - protein, 18 aa, Staphylococcus aureus
ETLNTGKVLYAFYQNPKL

SEQ ID NO: 1717036 - protein, 18 aa, Staphylococcus aureus
ETLNTGKVLYAFYQNPKV

SEQ ID NO: 1717037 - protein, 26 aa, Staphylococcus aureus
ETNYDYTKLVFAKPIYNDPSLVKSDT

SEQ ID NO: 1717038 - protein, 27 aa, Staphylococcus aureus
ETNYDYTKLVFAKPIYNDPSLVKSDTN

SEQ ID NO: 1717039 - protein, 21 aa, Staphylococcus aureus
ETREAVAKAGESWKNKTVKKY

SEQ ID NO: 1717040 - protein, 18 aa, Staphylococcus aureus
ETVNDLYLIVKKLSQGDV

SEQ ID NO: 1717041 - protein, 19 aa, Staphylococcus aureus
ETYTVKFETPAGYLPTKVN

SEQ ID NO: 1717042 - protein, 23 aa, Staphylococcus aureus
EVAEAIERINAAKVSGVKAIEAT

SEQ ID NO: 1717043 - protein, 28 aa, Staphylococcus aureus
EVLFPDKSLKLSYKVNVTNIDTPKNIDF

SEQ ID NO: 1717044 - protein, 20 aa, Staphylococcus aureus
EVPNETNLNLTFATADKETS

SEQ ID NO: 1717045 - protein, 25 aa, Staphylococcus aureus
EWVQAAKAKPVYGAKEFLKYADEKG

SEQ ID NO: 1717046 - protein, 27 aa, Staphylococcus aureus
EYEAKRLKDHKVDIFGISYSGLCNTKY

SEQ ID NO: 1717047 - protein, 31 aa, Staphylococcus aureus
EYKQYRERYLKAGLSPVKFYDYNLYDFTMKE

SEQ ID NO: 1717048 - protein, 17 aa, Staphylococcus aureus
FANTYAFMVTKETAKKY

SEQ ID NO: 1717049 - protein, 18 aa, Staphylococcus aureus
FASLDIFNDLKRRAQTIL

SEQ ID NO: 1717050 - protein, 18 aa, Staphylococcus aureus
FDGTGPFKLGEHKKDETA

SEQ ID NO: 1717051 - protein, 29 aa, Staphylococcus aureus
FDNLDSGKYKVIFEKPAGLIQTGTNTTED

SEQ ID NO: 1717052 - protein, 27 aa, Staphylococcus aureus
FDNLDSGKYKVIFEKPAGLKQTGTNTT

SEQ ID NO: 1717053 - protein, 26 aa, Staphylococcus aureus
FDNLDSGKYKVIFEKPAGLTQTGTNT

SEQ ID NO: 1717054 - protein, 22 aa, Staphylococcus aureus
FDYPDGHGNAETLVPVNLTVLP

SEQ ID NO: 1717055 - protein, 19 aa, Staphylococcus aureus
FEFDFKRKPYDNLKLNPDD

SEQ ID NO: 1717056 - protein, 17 aa, Staphylococcus aureus
FEKLKMTIKLRVHESIV

SEQ ID NO: 1717057 - protein, 18 aa, Staphylococcus aureus
FEMTIHLKGFEASQTLEN

SEQ ID NO: 1717058 - protein, 17 aa, Staphylococcus aureus
FETPAGYLPTKENGTTD

SEQ ID NO: 1717059 - protein, 17 aa, Staphylococcus aureus
FFFTFLIKNNLAYADVG

SEQ ID NO: 1717060 - protein, 19 aa, Staphylococcus aureus
FFSQYGSFRGLKNYKDGDY

SEQ ID NO: 1717061 - protein, 19 aa, Staphylococcus aureus
FGFPKYNYKISKKLDKLIE

SEQ ID NO: 1717062 - protein, 18 aa, Staphylococcus aureus
FGHVERFIQNPPHGATVA

SEQ ID NO: 1717063 - protein, 18 aa, Staphylococcus aureus
FGILVILAIIAVVYVAAK

SEQ ID NO: 1717064 - protein, 23 aa, Staphylococcus aureus
FIAVISVLLAFHLKQHYDQTTNE

SEQ ID NO: 1717065 - protein, 23 aa, Staphylococcus aureus
FIGKGDASYTISFKTQGPTTNKL

SEQ ID NO: 1717066 - protein, 17 aa, Staphylococcus aureus
FILLLFIALTWTTSPLV

SEQ ID NO: 1717067 - protein, 24 aa, Staphylococcus aureus
FINANRDAITFAEGDISVTNTPNG

SEQ ID NO: 1717068 - protein, 35 aa, Staphylococcus aureus
FIQNPPHGATVAWHDSPDTWKHTVGNTHKTVVVTL

SEQ ID NO: 1717069 - protein, 29 aa, Staphylococcus aureus
FIQNPPHGATVAWHDSPDTWKNTVGNTHK

SEQ ID NO: 1717070 - protein, 17 aa, Staphylococcus aureus
FIRILVLVLTITSVTGV

SEQ ID NO: 1717071 - protein, 18 aa, Staphylococcus aureus
FKDEVGQPELRRNSMDAF

SEQ ID NO: 1717072 - protein, 17 aa, Staphylococcus aureus
FKFIAGVGPNNFIDISA

SEQ ID NO: 1717073 - protein, 17 aa, Staphylococcus aureus
FKHGLSSFIEALEQDVI

SEQ ID NO: 1717074 - protein, 19 aa, Staphylococcus aureus
FKINGSKILKTEFNNKSLS

SEQ ID NO: 1717075 - protein, 34 aa, Staphylococcus aureus
FKIRNRSGQVIYDWPTVHIYSLEDLSRASDYFSE

SEQ ID NO: 1717076 - protein, 33 aa, Staphylococcus aureus
FKIRNRSGQVIYEWPTVHINSLRDLARAGDYFS

SEQ ID NO: 1717077 - protein, 24 aa, Staphylococcus aureus
FKKAAPKAKIVYVGADEKNLINSM

SEQ ID NO: 1717078 - protein, 17 aa, Staphylococcus aureus
FKKAPKVNVGSLADNKN

SEQ ID NO: 1717079 - protein, 21 aa, Staphylococcus aureus
FKKEFKPVMHLKGDAFNQQLQ

SEQ ID NO: 1717080 - protein, 19 aa, Staphylococcus aureus
FKLMFKDGEIIDFSAGKGE

SEQ ID NO: 1717081 - protein, 19 aa, Staphylococcus aureus
FKLRKHLIDNNGLYNTEPK

SEQ ID NO: 1717082 - protein, 23 aa, Staphylococcus aureus
FKLRKHLIEKYGLYKTISKDGRI

SEQ ID NO: 1717083 - protein, 23 aa, Staphylococcus aureus
FKLRKHLIEKYGLYKTISKDGRV

SEQ ID NO: 1717084 - protein, 24 aa, Staphylococcus aureus
FKLRKHLIEKYGLYKTISKHGSVK

SEQ ID NO: 1717085 - protein, 27 aa, Staphylococcus aureus
FKPSQIKCAILFGGFYNMQTVRETEFP

SEQ ID NO: 1717086 - protein, 20 aa, Staphylococcus aureus
FKRADAIKVNGDIRKFDKIL

SEQ ID NO: 1717087 - protein, 17 aa, Staphylococcus aureus
FKSAPKVNVGSLTDNKN

SEQ ID NO: 1717088 - protein, 21 aa, Staphylococcus aureus
FKVIPPYGHNSHRMHVPSFQN

SEQ ID NO: 1717089 - protein, 22 aa, Staphylococcus aureus
FKYEVTLPQAVTYGNDSLTTTF

SEQ ID NO: 1717090 - protein, 17 aa, Staphylococcus aureus
FLMGEDVYIPGKEGDAL

SEQ ID NO: 1717091 - protein, 25 aa, Staphylococcus aureus
FNDLKRRAQTILAENRNNVPLNKRV

SEQ ID NO: 1717092 - protein, 21 aa, Staphylococcus aureus
FNDLKRRAQTILDENRNNVPL

SEQ ID NO: 1717093 - protein, 18 aa, Staphylococcus aureus
FNERIDANNTWKNLTNKL

SEQ ID NO: 1717094 - protein, 18 aa, Staphylococcus aureus
FNIAGAFNPNVRKLDGAV

SEQ ID NO: 1717095 - protein, 19 aa, Staphylococcus aureus
FPVLNKEGKVVYVVTISPK

SEQ ID NO: 1717096 - protein, 24 aa, Staphylococcus aureus
FQQRSYKGLDVFFVQEKRDKHDIF

SEQ ID NO: 1717097 - protein, 18 aa, Staphylococcus aureus
FQSAPSIGGNGSFNYSKS

SEQ ID NO: 1717098 - protein, 24 aa, Staphylococcus aureus
FRNKGGHAEAFFPSKLPLINLRMN

SEQ ID NO: 1717099 - protein, 30 aa, Staphylococcus aureus
FSIRKFNVGIFSALIATVTFISTNPTTASA

SEQ ID NO: 1717100 - protein, 18 aa, Staphylococcus aureus
FSNSTLWQKDNGTIHATS

SEQ ID NO: 1717101 - protein, 36 aa, Staphylococcus aureus
FTSNLANMNFLRWVNFPQDYTVSWTNAKIASRPTDG

SEQ ID NO: 1717102 - protein, 36 aa, Staphylococcus aureus
FTSNLTNMNFLRWISFPQDYTVTWTNAKIANRPTDG

SEQ ID NO: 1717103 - protein, 26 aa, Staphylococcus aureus
FTTELFTLKKGESFKQKSKVLKPMIT

SEQ ID NO: 1717104 - protein, 19 aa, Staphylococcus aureus
FTTLFWKTSLGEFNMLKNK

SEQ ID NO: 1717105 - protein, 19 aa, Staphylococcus aureus
FTTPEGKALIRAYVGKPGD

SEQ ID NO: 1717106 - protein, 25 aa, Staphylococcus aureus
FTVTTSLKNNGNFGASFNTDDFVYK

SEQ ID NO: 1717107 - protein, 26 aa, Staphylococcus aureus
FTVTTSLKNNGNFGASFNTDDFVYQV

SEQ ID NO: 1717108 - protein, 23 aa, Staphylococcus aureus
FVIKKEVDAGVYTHVKRHYIYKE

SEQ ID NO: 1717109 - protein, 19 aa, Staphylococcus aureus
FVTVNADGTNVQWSNGAGA

SEQ ID NO: 1717110 - protein, 21 aa, Staphylococcus aureus
GADPMTFLGLGGIGDVIVTCT

SEQ ID NO: 1717111 - protein, 25 aa, Staphylococcus aureus
GAGANKPLQQMWEYGVNDPHRSHDF

SEQ ID NO: 1717112 - protein, 21 aa, Staphylococcus aureus
GALKSRAMVLYINRNTRTAKG

SEQ ID NO: 1717113 - protein, 31 aa, Staphylococcus aureus; identical to SEQ ID NO: 1587793

SEQ ID NO: 1717114 - protein, 28 aa, Staphylococcus aureus
GANKPLPQMWPNGVNDSRSWDFKIRNRS

SEQ ID NO: 1717115 - protein, 23 aa, Staphylococcus aureus
GANKPLQQMWEYGVNDPDRSHDF

SEQ ID NO: 1717116 - protein, 23 aa, Staphylococcus aureus
GANKRKHILASKHNWNKVTKNNW

SEQ ID NO: 1717117 - protein, 19 aa, Staphylococcus aureus
GARHKIDLGDILSDSQEKT

SEQ ID NO: 1717118 - protein, 21 aa, Staphylococcus aureus
GASGCAPEHTFQAYDKSHNEL

SEQ ID NO: 1717119 - protein, 24 aa, Staphylococcus aureus
GASTHPGAGVPIVLTSAKITVDEI

SEQ ID NO: 1717120 - protein, 24 aa, Staphylococcus aureus
GATVSDYYYWKIIDSLEAQFTGAI

SEQ ID NO: 1717121 - protein, 17 aa, Staphylococcus aureus
GDASYTISFKTQGPTID

SEQ ID NO: 1717122 - protein, 19 aa, Staphylococcus aureus
GDASYTISFKTQGPTVNKL

SEQ ID NO: 1717123 - protein, 17 aa, Staphylococcus aureus
GDIGIDNLRNFYTKKDF

SEQ ID NO: 1717124 - protein, 19 aa, Staphylococcus aureus
GDITSAYVVMVNTKFQYTN

SEQ ID NO: 1717125 - protein, 19 aa, Staphylococcus aureus
GDIVKGYVIYHNDDEKNVE

SEQ ID NO: 1717126 - protein, 20 aa, Staphylococcus aureus
GDKGKWVIRSEITTELKNEN

SEQ ID NO: 1717127 - protein, 22 aa, Staphylococcus aureus
GDKGTWGISSAMVKQPKGKIMR

SEQ ID NO: 1717128 - protein, 24 aa, Staphylococcus aureus
GDKGTWVISSAMVKQPKGKIMRSR

SEQ ID NO: 1717129 - protein, 22 aa, Staphylococcus aureus
GDPHALKAFASAINQDNYPNGG

SEQ ID NO: 1717130 - protein, 18 aa, Staphylococcus aureus
GDQALKFIRSRKEEGAGG

SEQ ID NO: 1717131 - protein, 25 aa, Staphylococcus aureus
GDQKLARDQLQAVTTVNALPNLNHA

SEQ ID NO: 1717132 - protein, 17 aa, Staphylococcus aureus
GDSRQAANYSIGGVTKT

SEQ ID NO: 1717133 - protein, 20 aa, Staphylococcus aureus
GDVLFQFSQTLARFIPTEVS

SEQ ID NO: 1717134 - protein, 28 aa, Staphylococcus aureus
GDYLEKSRCIPINLWVNGEHQTISTDKV

SEQ ID NO: 1717135 - protein, 22 aa, Staphylococcus aureus
GEFRIVPTTVALTMTLDKLDLP

SEQ ID NO: 1717136 - protein, 27 aa, Staphylococcus aureus
GENLKGWHTGAGMSYLYNSDVRHYRDN

SEQ ID NO: 1717137 - protein, 18 aa, Staphylococcus aureus
GEQFFKDNFGLKVKATNV

SEQ ID NO: 1717138 - protein, 17 aa, Staphylococcus aureus
GETLVPVNLTVLPEIQH

SEQ ID NO: 1717139 - protein, 23 aa, Staphylococcus aureus
GFNAGKILFHLNDGSSFSYDLFD

SEQ ID NO: 1717140 - protein, 24 aa, Staphylococcus aureus
GFSEKRKTDGLVVVGTVNYDVPFQ

SEQ ID NO: 1717141 - protein, 27 aa, Staphylococcus aureus
GGKVGVFSHAMVRTSMFDSADAKNYQA

SEQ ID NO: 1717142 - protein, 17 aa, Staphylococcus aureus
GGLKDGETYTVKFETPT

SEQ ID NO: 1717143 - protein, 25 aa, Staphylococcus aureus
GGLKDGETYTVKFETPTGYLPTKVN

SEQ ID NO: 1717144 - protein, 25 aa, Staphylococcus aureus
GGVPNEFNGAVFINENVRNFLKQNI

SEQ ID NO: 1717145 - protein, 22 aa, Staphylococcus aureus
GHASIRIHHFCAVPQINSFKVI

SEQ ID NO: 1717146 - protein, 20 aa, Staphylococcus aureus
GHSFKHWPKSTLTITPSFTS

SEQ ID NO: 1717147 - protein, 18 aa, Staphylococcus aureus
GIALSKDEKVLWVTETTA

SEQ ID NO: 1717148 - protein, 17 aa, Staphylococcus aureus
GIGVGVATGFVVALQGR

SEQ ID NO: 1717149 - protein, 17 aa, Staphylococcus aureus
GIGVGVVAGFVVALQGR

SEQ ID NO: 1717150 - protein, 22 aa, Staphylococcus aureus
GIKKGWLYGYSEIDSSHFTDRD

SEQ ID NO: 1717151 - protein, 17 aa, Staphylococcus aureus
GILSISIGMFLALGMSN

SEQ ID NO: 1717152 - protein, 17 aa, Staphylococcus aureus
GINKIIPAYDEFKSAPK

SEQ ID NO: 1717153 - protein, 18 aa, Staphylococcus aureus
GINKIIPAYDEFMSAPKV

SEQ ID NO: 1717154 - protein, 24 aa, Staphylococcus aureus
GIRLSRAKRRFMYKEAMKALEKMA

SEQ ID NO: 1717155 - protein, 18 aa, Staphylococcus aureus
GISTLRKVPEIKNSTEDK

SEQ ID NO: 1717156 - protein, 19 aa, Staphylococcus aureus
GISTRLIRVTYDNRQTEDL

SEQ ID NO: 1717157 - protein, 25 aa, Staphylococcus aureus
GIYKDWKPGQKIHLVGHSMGGQTIR

SEQ ID NO: 1717158 - protein, 18 aa, Staphylococcus aureus
GKAKMSYNKLVAKKLQLF

SEQ ID NO: 1717159 - protein, 22 aa, Staphylococcus aureus
GKALFAASFVTHFSGQTPHIHF

SEQ ID NO: 1717160 - protein, 17 aa, Staphylococcus aureus
GKDDMSLDTGFYKEPKY

SEQ ID NO: 1717161 - protein, 17 aa, Staphylococcus aureus
GKEDLAIVHVHETSTEG

SEQ ID NO: 1717162 - protein, 17 aa, Staphylococcus aureus
GKEPAVVAEEFLKKYHY

SEQ ID NO: 1717163 - protein, 17 aa, Staphylococcus aureus
GKKPASINAYNNSMHAL

SEQ ID NO: 1717164 - protein, 19 aa, Staphylococcus aureus
GKKVADLKTNFSKSAPQKN

SEQ ID NO: 1717165 - protein, 17 aa, Staphylococcus aureus
GKNLLSFDVQTNKKKVT

SEQ ID NO: 1717166 - protein, 17 aa, Staphylococcus aureus
GKPLVVIYGDYKCPFCK

SEQ ID NO: 1717167 - protein, 20 aa, Staphylococcus aureus
GKSDASYTISFKTQGPTIDK

SEQ ID NO: 1717168 - protein, 21 aa, Staphylococcus aureus
GKTEFWATSSDVLKLKANYTI

SEQ ID NO: 1717169 - protein, 33 aa, Staphylococcus aureus
GKTEFWATSSDVLKLKANYTIDDSVKEGDTFTF

SEQ ID NO: 1717170 - protein, 26 aa, Staphylococcus aureus
GKVGVFSHAMVRTSMFDSGDAKNYQA

SEQ ID NO: 1717171 - protein, 17 aa, Staphylococcus aureus
GKYCFDNLDSGKYKVIF

SEQ ID NO: 1717172 - protein, 23 aa, Staphylococcus aureus
GLCISLLILIIFVTSCGGNKITG

SEQ ID NO: 1717173 - protein, 25 aa, Staphylococcus aureus
GLLFFILVLRISYIMITGHSNGQDL

SEQ ID NO: 1717174 - protein, 20 aa, Staphylococcus aureus
GLNAVLGFLVLTGVIQDPTT

SEQ ID NO: 1717175 - protein, 22 aa, Staphylococcus aureus
GLSKDFKISRYSSSGKIDIYNL

SEQ ID NO: 1717176 - protein, 17 aa, Staphylococcus aureus
GLTIGKDKGYEWNPQSI

SEQ ID NO: 1717177 - protein, 17 aa, Staphylococcus aureus
GLTPDLAPLQTAKTQLQ

SEQ ID NO: 1717178 - protein, 18 aa, Staphylococcus aureus
GLTPDLAPLQTAKTQLQN

SEQ ID NO: 1717179 - protein, 20 aa, Staphylococcus aureus
GMHKKYFIALLMIKITIKNC

SEQ ID NO: 1717180 - protein, 22 aa, Staphylococcus aureus
GMTQGRYELIYEGLKNQSTEFL

SEQ ID NO: 1717181 - protein, 28 aa, Staphylococcus aureus
GNDNIKVILPKVQVKPAARQSVGVKAEA

SEQ ID NO: 1717182 - protein, 29 aa, Staphylococcus aureus
GNEKSQAEAGGRPNFRTTGYSQSNATTDG

SEQ ID NO: 1717183 - protein, 17 aa, Staphylococcus aureus
GNIKLGNGSTIIDQNTE

SEQ ID NO: 1717184 - protein, 19 aa, Staphylococcus aureus
GNIVDIDFDSVPQIHGQNK

SEQ ID NO: 1717185 - protein, 17 aa, Staphylococcus aureus
GNKEEIAYHQAHGGEIS

SEQ ID NO: 1717186 - protein, 21 aa, Staphylococcus aureus
GNLWLLGLLCMRKAQANRNEG

SEQ ID NO: 1717187 - protein, 19 aa, Staphylococcus aureus
GNQFYSINAGFRKYPSTKE

SEQ ID NO: 1717188 - protein, 45 aa, Staphylococcus aureus
GNSPARLMPDKILDLKYKLRVNNVPTPRTVTFNDTLTYKTYTQDF

SEQ ID NO: 1717189 - protein, 24 aa, Staphylococcus aureus
GNTVTEIYNGQAFTTTNNPIREGY

SEQ ID NO: 1717190 - protein, 17 aa, Staphylococcus aureus
GNYYFPVLNKEGKVVYV

SEQ ID NO: 1717191 - protein, 19 aa, Staphylococcus aureus
GPTLRLFKVPDNVNNLKIQ

SEQ ID NO: 1717192 - protein, 19 aa, Staphylococcus aureus
GQFLIKMGIQPEVTKDKTV

SEQ ID NO: 1717193 - protein, 21 aa, Staphylococcus aureus
GQGDASYTISFKTQGPTVNKL

SEQ ID NO: 1717194 - protein, 26 aa, Staphylococcus aureus
GQPELRRNSMDAFPVLAYSFSNKEND

SEQ ID NO: 1717195 - protein, 22 aa, Staphylococcus aureus
GQQRPTFIPTLAPKEEKETNIK

SEQ ID NO: 1717196 - protein, 27 aa, Staphylococcus aureus
GQSAKELRAKLDLIIGEEKNAFRITNE

SEQ ID NO: 1717197 - protein, 23 aa, Staphylococcus aureus
GQSFSIGDIKQYFTLSNGQPIPS

SEQ ID NO: 1717198 - protein, 17 aa, Staphylococcus aureus
GQSICAFSSPFLKAQAK

SEQ ID NO: 1717199 - protein, 17 aa, Staphylococcus aureus
GREKFSIFDDVTVSNMH

SEQ ID NO: 1717200 - protein, 18 aa, Staphylococcus aureus
GRIHPGRIEDMVEKARKE

SEQ ID NO: 1717201 - protein, 23 aa, Staphylococcus aureus
GRLIEKTCMYGGVTEHDGNQIDK

SEQ ID NO: 1717202 - protein, 17 aa, Staphylococcus aureus
GRLTKSFTSNLNNMNFL

SEQ ID NO: 1717203 - protein, 17 aa, Staphylococcus aureus
GRPNYKSSGYSQSNPTT

SEQ ID NO: 1717204 - protein, 17 aa, Staphylococcus aureus
GSDIADATITWVSGQAP

SEQ ID NO: 1717205 - protein, 24 aa, Staphylococcus aureus
GSDIADATITWVSGQAPNKDNTRI

SEQ ID NO: 1717206 - protein, 23 aa, Staphylococcus aureus
GSKKTCMYGGITLNENNTNNRIQ

SEQ ID NO: 1717207 - protein, 20 aa, Staphylococcus aureus
GSNLDKAAVENALSQVANAK

SEQ ID NO: 1717208 - protein, 17 aa, Staphylococcus aureus
GSSVGYKEIEFIFLENK

SEQ ID NO: 1717209 - protein, 20 aa, Staphylococcus aureus
GSTFKSYGLAAAIQEGAFDP

SEQ ID NO: 1717210 - protein, 26 aa, Staphylococcus aureus
GSVNGKSGWVSKAYLFDTAKPTPTPT

SEQ ID NO: 1717211 - protein, 25 aa, Staphylococcus aureus
GSVNGKSGWVSKAYLVDTAKPTPAP

SEQ ID NO: 1717212 - protein, 17 aa, Staphylococcus aureus
GTALQKVPVNISGIPLD

SEQ ID NO: 1717213 - protein, 19 aa, Staphylococcus aureus
GTASILVGTTLIFGLSGHE

SEQ ID NO: 1717214 - protein, 17 aa, Staphylococcus aureus
GTINVYNNIPYKWENSQ

SEQ ID NO: 1717215 - protein, 21 aa, Staphylococcus aureus
GTLLISGGVTPAANAAQHDEA

SEQ ID NO: 1717216 - protein, 19 aa, Staphylococcus aureus
GTNVQWSHGAGAGAGANKP

SEQ ID NO: 1717217 - protein, 17 aa, Staphylococcus aureus
GTNVQWSNGAGAGANKP

SEQ ID NO: 1717218 - protein, 17 aa, Staphylococcus aureus
GTTTGKKPASITAYNNS

SEQ ID NO: 1717219 - protein, 17 aa, Staphylococcus aureus
GTVLSGFEYRAQKEKYD

SEQ ID NO: 1717220 - protein, 21 aa, Staphylococcus aureus
GTWVIRSEMKIQLKGENLESR

SEQ ID NO: 1717221 - protein, 25 aa, Staphylococcus aureus
GTYKVEFETPLGYTPTQVGSGTDEG

SEQ ID NO: 1717222 - protein, 23 aa, Staphylococcus aureus
GVASVIVSTLFLITSQHQAQAAE

SEQ ID NO: 1717223 - protein, 19 aa, Staphylococcus aureus
GVKANSFVIAGHRWSAYDE

SEQ ID NO: 1717224 - protein, 17 aa, Staphylococcus aureus
GVSDVYDAKQYVKPVND

SEQ ID NO: 1717225 - protein, 24 aa, Staphylococcus aureus
GVSTARKVPDIKNGSVVMATGKIL

SEQ ID NO: 1717226 - protein, 28 aa, Staphylococcus aureus
GVTSTAKVPPIMAGDQVLANGVIDSDGN

SEQ ID NO: 1717227 - protein, 25 aa, Staphylococcus aureus
GVVLLEGISQIFPMIKETPFKTTQD

SEQ ID NO: 1717228 - protein, 18 aa, Staphylococcus aureus
GVVSVLAATMFVVSSHEA

SEQ ID NO: 1717229 - protein, 21 aa, Staphylococcus aureus
GVVVLEGISQMMPMIKESPFK

SEQ ID NO: 1717230 - protein, 34 aa, Staphylococcus aureus
HAIRKKSIGVASVLVGTLIGFGLLSSKEADASEN

SEQ ID NO: 1717231 - protein, 17 aa, Staphylococcus aureus
HANGQVSYGARPTYNKP

SEQ ID NO: 1717232 - protein, 22 aa, Staphylococcus aureus
HATSLQFSWYSHIQVYGPESWG

SEQ ID NO: 1717233 - protein, 24 aa, Staphylococcus aureus
HDGNELIIDDWIYSIEVLANKDYE

SEQ ID NO: 1717234 - protein, 24 aa, Staphylococcus aureus
HDIGPREQVNFLLLDKNNETQYYH

SEQ ID NO: 1717235 - protein, 23 aa, Staphylococcus aureus
HDIGPREQVNFQLLDKNNETQYY

SEQ ID NO: 1717236 - protein, 29 aa, Staphylococcus aureus
HDKEHPDPHIIGLVALPYLNASRDFGNAH

SEQ ID NO: 1717237 - protein, 23 aa, Staphylococcus aureus
HDRNELQGFFDANYHDYRFIDRE

SEQ ID NO: 1717238 - protein, 21 aa, Staphylococcus aureus
HEDYDYTLMVFAQPITNNPDD

SEQ ID NO: 1717239 - protein, 17 aa, Staphylococcus aureus
HEVEQTIYVNPLKLNAK

SEQ ID NO: 1717240 - protein, 22 aa, Staphylococcus aureus
HFVAKGPEVNRFITQNKVNHPF

SEQ ID NO: 1717241 - protein, 21 aa, Staphylococcus aureus
HGGEISPLFTGGHNNMVASIT

SEQ ID NO: 1717242 - protein, 17 aa, Staphylococcus aureus
HGNGQVSYGARPTYNKP

SEQ ID NO: 1717243 - protein, 24 aa, Staphylococcus aureus
HHGYSKVHVPYAITVNGTSQNILS

SEQ ID NO: 1717244 - protein, 26 aa, Staphylococcus aureus
HHHHGGYDPHVWLDPKINQTFAKEIK

SEQ ID NO: 1717245 - protein, 20 aa, Staphylococcus aureus
HIYGHGLKGYGAKDIPYANN

SEQ ID NO: 1717246 - protein, 17 aa, Staphylococcus aureus
HKAELSITKKDEKGKIL

SEQ ID NO: 1717247 - protein, 25 aa, Staphylococcus aureus
HKDSEDFYISLKIIDVKQPEGDQRV

SEQ ID NO: 1717248 - protein, 25 aa, Staphylococcus aureus
HKDTEDFYISLKIIDVKQPEGDQRV

SEQ ID NO: 1717249 - protein, 22 aa, Staphylococcus aureus
HKSLIYRYDATLGTAITTNDIL

SEQ ID NO: 1717250 - protein, 26 aa, Staphylococcus aureus
HLTEREKRVIKREHVREAQKLVENYK

SEQ ID NO: 1717251 - protein, 32 aa, Staphylococcus aureus
HNAQRVTLKYKWKFGEGIKAGDYFDFTLSDNV

SEQ ID NO: 1717252 - protein, 23 aa, Staphylococcus aureus
HNIYDLKPLKSFVYGRTILLGDV

SEQ ID NO: 1717253 - protein, 25 aa, Staphylococcus aureus
HNKDLDFAFGLSMTSKNVARYESIN

SEQ ID NO: 1717254 - protein, 27 aa, Staphylococcus aureus
HNQGLAFPFAECGAMSQAYIGYQLQES

SEQ ID NO: 1717255 - protein, 25 aa, Staphylococcus aureus
HPDLVKIVGRLNYRTSYGQNVLKHS

SEQ ID NO: 1717256 - protein, 29 aa, Staphylococcus aureus
HPSQSLIIKHHFVVPGYHAHKFVTPGHAS

SEQ ID NO: 1717257 - protein, 19 aa, Staphylococcus aureus
HQTQIIKILAKVKPDPPRI

SEQ ID NO: 1717258 - protein, 18 aa, Staphylococcus aureus
HQTQIIKILSKVKPDPPR

SEQ ID NO: 1717259 - protein, 19 aa, Staphylococcus aureus
HRPYGGVVPQGMTQAQYTE

SEQ ID NO: 1717260 - protein, 21 aa, Staphylococcus aureus
HSGLKSTTITTLPSGWTSNLT

SEQ ID NO: 1717261 - protein, 33 aa, Staphylococcus aureus
HSGNLYTAGQCTWYVYDKVGGEIGSTWGNANNW

SEQ ID NO: 1717262 - protein, 17 aa, Staphylococcus aureus
HSNLKFESHKEEKNSNW

SEQ ID NO: 1717263 - protein, 18 aa, Staphylococcus aureus
HTATELNTAMIALKRAIA

SEQ ID NO: 1717264 - protein, 24 aa, Staphylococcus aureus
HTFATSLPAKFVVKDVQPAKPTVT

SEQ ID NO: 1717265 - protein, 22 aa, Staphylococcus aureus
HTSVKGKVALSINNKFINLGDS

SEQ ID NO: 1717266 - protein, 23 aa, Staphylococcus aureus
HTSVKGKVALSINNKFINLGDST

SEQ ID NO: 1717267 - protein, 17 aa, Staphylococcus aureus
HTVGNTHKTAVVTLPNG

SEQ ID NO: 1717268 - protein, 18 aa, Staphylococcus aureus
HVILIFALILVISTPNVL

SEQ ID NO: 1717269 - protein, 19 aa, Staphylococcus aureus
HWHGLEIDGKVDGGPSQVI

SEQ ID NO: 1717270 - protein, 20 aa, Staphylococcus aureus
IADATITWVSGQAPNKDNTR

SEQ ID NO: 1717271 - protein, 21 aa, Staphylococcus aureus
IADATITWVSGQAPNKDNTRI

SEQ ID NO: 1717272 - protein, 23 aa, Staphylococcus aureus
IADKDATKALVNFTDADQAKQQA

SEQ ID NO: 1717273 - protein, 18 aa, Staphylococcus aureus
IAEVKAKTTGLITENSND

SEQ ID NO: 1717274 - protein, 20 aa, Staphylococcus aureus
IAGLNPDLAPLQTAKTQLQN

SEQ ID NO: 1717275 - protein, 19 aa, Staphylococcus aureus
IALKELIEASMKYSDNTAN

SEQ ID NO: 1717276 - protein, 17 aa, Staphylococcus aureus
IALSLIFSLSITPIANG

SEQ ID NO: 1717277 - protein, 24 aa, Staphylococcus aureus
IAPKKAEHFHIFMGNDNDALLKRM

SEQ ID NO: 1717278 - protein, 25 aa, Staphylococcus aureus
IASRPTDGGLSWSDDHKSLIYRYDA

SEQ ID NO: 1717279 - protein, 17 aa, Staphylococcus aureus
IATAGLATIAFAGHDAQ

SEQ ID NO: 1717280 - protein, 22 aa, Staphylococcus aureus
IAVISVLLAFHLKQHYDQTTNE

SEQ ID NO: 1717281 - protein, 17 aa, Staphylococcus aureus
IAVLTILTSITGVGTTV

SEQ ID NO: 1717282 - protein, 28 aa, Staphylococcus aureus
IAVMLFLTGCGKSQEKATLEKDIDNLQK

SEQ ID NO: 1717283 - protein, 21 aa, Staphylococcus aureus
ICDNLLLTICHTAFEKLSIFP

SEQ ID NO: 1717284 - protein, 23 aa, Staphylococcus aureus
ICVKSCSLLFMLNGNPKPEQLNK

SEQ ID NO: 1717285 - protein, 24 aa, Staphylococcus aureus
ICVKSCSLLFMLNGNPRPEQLNKA

SEQ ID NO: 1717286 - protein, 25 aa, Staphylococcus aureus
ICVKSCSLLFMLNGSPRPEQLNKAS

SEQ ID NO: 1717287 - protein, 18 aa, Staphylococcus aureus
IDDEGMVLFLNRNTKKAT

SEQ ID NO: 1717288 - protein, 19 aa, Staphylococcus aureus
IDFDSVPHIHGFNKHTEII

SEQ ID NO: 1717289 - protein, 18 aa, Staphylococcus aureus
IDFDSVPQIHGFNKHNEI

SEQ ID NO: 1717290 - protein, 24 aa, Staphylococcus aureus
IDFGNADSAYVVMVNTKFQYTTSE

SEQ ID NO: 1717291 - protein, 17 aa, Staphylococcus aureus
IDGEGGYVDGYIETIEE

SEQ ID NO: 1717292 - protein, 19 aa, Staphylococcus aureus
IDGLVTKLQAALIDNQAAI

SEQ ID NO: 1717293 - protein, 36 aa, Staphylococcus aureus
IDKLYYAAGGRALEYNQLFMYSQLYVESTQDQQQRL

SEQ ID NO: 1717294 - protein, 18 aa, Staphylococcus aureus
IDLGDKLQFERMGDVLNS

SEQ ID NO: 1717295 - protein, 17 aa, Staphylococcus aureus
IDLKSGIYTADLINTSD

SEQ ID NO: 1717296 - protein, 25 aa, Staphylococcus aureus
IDLSEKLSFDRMFDVMDSKKIKNIE

SEQ ID NO: 1717297 - protein, 25 aa, Staphylococcus aureus
IDLSEKLSFERMFDVMDSKKIKNIE

SEQ ID NO: 1717298 - protein, 17 aa, Staphylococcus aureus
IDNRQSLGFTITTNKNM

SEQ ID NO: 1717299 - protein, 27 aa, Staphylococcus aureus
IDPKRVPSLYSIISMIEMMFGVHFIKG

SEQ ID NO: 1717300 - protein, 17 aa, Staphylococcus aureus
IDPLFKITKQEVSPQTV

SEQ ID NO: 1717301 - protein, 45 aa, Staphylococcus aureus; identical to SEQ ID NO: 1582956

SEQ ID NO: 1717302 - protein, 17 aa, Staphylococcus aureus
IDRENAVSGTFNYVKGI

SEQ ID NO: 1717303 - protein, 31 aa, Staphylococcus aureus
IEANDAWKKLVDKLKEKDIVKVGDKVTIHSK

SEQ ID NO: 1717304 - protein, 23 aa, Staphylococcus aureus
IEFKIKKGIKWHDGNELKIDDWI

SEQ ID NO: 1717305 - protein, 19 aa, Staphylococcus aureus
IEIIFSRSKEEIIYYIDSV

SEQ ID NO: 1717306 - protein, 18 aa, Staphylococcus aureus
IENFKFFAQYGNFIDLTK

SEQ ID NO: 1717307 - protein, 19 aa, Staphylococcus aureus
IENFKFFAQYGNFKDLMNY

SEQ ID NO: 1717308 - protein, 18 aa, Staphylococcus aureus
IENFKFFSQYGDFKGLKN

SEQ ID NO: 1717309 - protein, 20 aa, Staphylococcus aureus
IENRKAHGYTLYTDDKQTTN

SEQ ID NO: 1717310 - protein, 17 aa, Staphylococcus aureus
IENRKANGYTLYTDDKQ

SEQ ID NO: 1717311 - protein, 20 aa, Staphylococcus aureus
IENRKANGYTLYTDDKQTTA

SEQ ID NO: 1717312 - protein, 26 aa, Staphylococcus aureus
IEQIKPKVIRKRAALDSIEENNKNQL

SEQ ID NO: 1717313 - protein, 25 aa, Staphylococcus aureus
IESRSAEPRSVSSYQNADSSYYVEN

SEQ ID NO: 1717314 - protein, 18 aa, Staphylococcus aureus
IFGVPYFYTCIIPKSEPD

SEQ ID NO: 1717315 - protein, 18 aa, Staphylococcus aureus
IFIVFRFSSVTDKTTQNK

SEQ ID NO: 1717316 - protein, 27 aa, Staphylococcus aureus
IFNDLKKRAQTILAENRNNVPLNKRVS

SEQ ID NO: 1717317 - protein, 18 aa, Staphylococcus aureus
IGALKDGRFDDVQQDIEA

SEQ ID NO: 1717318 - protein, 21 aa, Staphylococcus aureus
IGQDSDIYASVMIAQAILESD

SEQ ID NO: 1717319 - protein, 17 aa, Staphylococcus aureus
IGSTWGNANNWAAAAQG

SEQ ID NO: 1717320 - protein, 25 aa, Staphylococcus aureus
IIDVDLRLSKQAKYTVNFKNGTKKV

SEQ ID NO: 1717321 - protein, 18 aa, Staphylococcus aureus
IIGLSAFVAYYGGKCAAH

SEQ ID NO: 1717322 - protein, 18 aa, Staphylococcus aureus
IIIKSIAALTILTSITGV

SEQ ID NO: 1717323 - protein, 19 aa, Staphylococcus aureus
IIKGSLAFALVSGVIVCSG

SEQ ID NO: 1717324 - protein, 17 aa, Staphylococcus aureus
IIVSGCSFIPKNQTKDI

SEQ ID NO: 1717325 - protein, 20 aa, Staphylococcus aureus
IKAGDYFDFTLSDNVETHGI

SEQ ID NO: 1717326 - protein, 17 aa, Staphylococcus aureus
IKAKSSISMNNVTYTTQ

SEQ ID NO: 1717327 - protein, 19 aa, Staphylococcus aureus
IKDHETIDSFALSQETFTG

SEQ ID NO: 1717328 - protein, 17 aa, Staphylococcus aureus
IKIKHFSVVPQINSFKV

SEQ ID NO: 1717329 - protein, 17 aa, Staphylococcus aureus
IKKEMIDDLNSIIDDFF

SEQ ID NO: 1717330 - protein, 23 aa, Staphylococcus aureus
IKKGKTAQAMFIYELRGDGNINL

SEQ ID NO: 1717331 - protein, 21 aa, Staphylococcus aureus
IKKGWLYGYSEIDSSHFTDRD

SEQ ID NO: 1717332 - protein, 20 aa, Staphylococcus aureus
IKKNPKCIVVLEYSFADYLA

SEQ ID NO: 1717333 - protein, 19 aa, Staphylococcus aureus
IKKSMKYDFIAYYDKDENR

SEQ ID NO: 1717334 - protein, 20 aa, Staphylococcus aureus
IKLDTARIIGIKNLNAPTKV

SEQ ID NO: 1717335 - protein, 17 aa, Staphylococcus aureus
IKLFKADNTPLTITNTT

SEQ ID NO: 1717336 - protein, 19 aa, Staphylococcus aureus
IKLSDKFLSHDFIVPINNP

SEQ ID NO: 1717337 - protein, 17 aa, Staphylococcus aureus
IKNGSVVMATGEVLEGG

SEQ ID NO: 1717338 - protein, 18 aa, Staphylococcus aureus
IKNGTAMPTNLAGGSTTT

SEQ ID NO: 1717339 - protein, 26 aa, Staphylococcus aureus
IKNTLSNLLSFWKSSIKNTLSNLLSF

SEQ ID NO: 1717340 - protein, 23 aa, Staphylococcus aureus
IKPKVRRKRAALDNIDESNNNQL

SEQ ID NO: 1717341 - protein, 20 aa, Staphylococcus aureus
IKPNSAITITPKAGTGHSAS

SEQ ID NO: 1717342 - protein, 25 aa, Staphylococcus aureus
IKQILRLIFLLAMYELGKYVTEQVY

SEQ ID NO: 1717343 - protein, 20 aa, Staphylococcus aureus
IKRNGNVVTTFTRRNNTSPW

SEQ ID NO: 1717344 - protein, 27 aa, Staphylococcus aureus
IKRVNKLVIGISLLFLVISITAGCGMG

SEQ ID NO: 1717345 - protein, 26 aa, Staphylococcus aureus
IKRVNKLVLGISFLLLIISIVAGCGT

SEQ ID NO: 1717346 - protein, 17 aa, Staphylococcus aureus
IKSAVADQFGVGVVKSI

SEQ ID NO: 1717347 - protein, 17 aa, Staphylococcus aureus
ILARGNFNPEFISVLSH

SEQ ID NO: 1717348 - protein, 17 aa, Staphylococcus aureus
ILFNDFFTGHQWYNDLL

SEQ ID NO: 1717349 - protein, 17 aa, Staphylococcus aureus
ILFQKAQEVDSIDKLDN

SEQ ID NO: 1717350 - protein, 35 aa, Staphylococcus aureus
ILKAGHWYCYVYCYLRDDFRLLKLNRVIHLQELES

SEQ ID NO: 1717351 - protein, 22 aa, Staphylococcus aureus
ILKNKPGIHYAPPILEKNKDGQ

SEQ ID NO: 1717352 - protein, 17 aa, Staphylococcus aureus
ILLNIDRQSADSFEGSD

SEQ ID NO: 1717353 - protein, 24 aa, Staphylococcus aureus
ILTMLKATTTVPGLRNNITGNEKA

SEQ ID NO: 1717354 - protein, 20 aa, Staphylococcus aureus
ILTMLKATTTVPGLRNNIVG

SEQ ID NO: 1717355 - protein, 19 aa, Staphylococcus aureus
ILVSSILVYFTIEKNNKEI

SEQ ID NO: 1717356 - protein, 18 aa, Staphylococcus aureus
IMALSIFIIGCDKSSVTA

SEQ ID NO: 1717357 - protein, 25 aa, Staphylococcus aureus
IMMNEYRAKAALKKNDFKSMAEAKV

SEQ ID NO: 1717358 - protein, 18 aa, Staphylococcus aureus
IMMNEYRAKAALRSNNFA

SEQ ID NO: 1717359 - protein, 17 aa, Staphylococcus aureus
INAKYYRGDEVNFTMGV

SEQ ID NO: 1717360 - protein, 17 aa, Staphylococcus aureus
INANRDVITLAEGDISV

SEQ ID NO: 1717361 - protein, 17 aa, Staphylococcus aureus
INEKGYFDFDFKKNPFD

SEQ ID NO: 1717362 - protein, 25 aa, Staphylococcus aureus
INFGDIDSAYIVKVVSKYTPGAEDD

SEQ ID NO: 1717363 - protein, 25 aa, Staphylococcus aureus
INGFSNLVSNEFAFLHPHKITTNDL

SEQ ID NO: 1717364 - protein, 23 aa, Staphylococcus aureus
INHKLIGWGVEAHKIMNNGWGPY

SEQ ID NO: 1717365 - protein, 17 aa, Staphylococcus aureus
INIKEKSNFFVVVNHVK

SEQ ID NO: 1717366 - protein, 20 aa, Staphylococcus aureus
INSQFYWGAKYNVFVSSESK

SEQ ID NO: 1717367 - protein, 17 aa, Staphylococcus aureus
INTTLTFDDPAISTNDN

SEQ ID NO: 1717368 - protein, 20 aa, Staphylococcus aureus
IPAYDEFKSAPKVNVGSLTD

SEQ ID NO: 1717369 - protein, 17 aa, Staphylococcus aureus
IPELHVAQIKMTKMHAN

SEQ ID NO: 1717370 - protein, 20 aa, Staphylococcus aureus
IQNATGLPTDGFTYKWNNAA

SEQ ID NO: 1717371 - protein, 27 aa, Staphylococcus aureus
IQTQARVKPAADREVDNAYNTRKQEIQ

SEQ ID NO: 1717372 - protein, 22 aa, Staphylococcus aureus
IRPTHVAVCWDMGQSTFRNDLF

SEQ ID NO: 1717373 - protein, 22 aa, Staphylococcus aureus
IRPTHVAVCWDMGQSTFRNDMF

SEQ ID NO: 1717374 - protein, 17 aa, Staphylococcus aureus
ISAKVGENYNGNKGLML

SEQ ID NO: 1717375 - protein, 31 aa, Staphylococcus aureus; identical to SEQ ID NO: 1574627

SEQ ID NO: 1717376 - protein, 18 aa, Staphylococcus aureus
ISFLETFFQLYPTATEKE

SEQ ID NO: 1717377 - protein, 26 aa, Staphylococcus aureus
ISKQAGHPVFYVYAGNQGNASVNLGG

SEQ ID NO: 1717378 - protein, 28 aa, Staphylococcus aureus
ISPYKGILRVGAGTGFVVGKNTILTNRH

SEQ ID NO: 1717379 - protein, 17 aa, Staphylococcus aureus
ISQMMPMIKESPFKTTQ

SEQ ID NO: 1717380 - protein, 17 aa, Staphylococcus aureus
ISTFKGKKLDIFGIDYN

SEQ ID NO: 1717381 - protein, 17 aa, Staphylococcus aureus
ISYRSGFDNKVCNNTLH

SEQ ID NO: 1717382 - protein, 29 aa, Staphylococcus aureus
ITDSSKKKALNWWDYEIGTPKSLTNTLIL

SEQ ID NO: 1717383 - protein, 28 aa, Staphylococcus aureus
ITDSSKKKALNWWDYEIGTPRALTNTLI

SEQ ID NO: 1717384 - protein, 23 aa, Staphylococcus aureus
ITIRPEDYVVFIPPVGNQIRALI

SEQ ID NO: 1717385 - protein, 27 aa, Staphylococcus aureus
ITIRPQDYVVFIPPVGKQIRAVVYYNK

SEQ ID NO: 1717386 - protein, 25 aa, Staphylococcus aureus
ITKTATYKVVRTVPKHVFETARGVL

SEQ ID NO: 1717387 - protein, 20 aa, Staphylococcus aureus
ITLKDFGIKDVIILEKGTVG

SEQ ID NO: 1717388 - protein, 17 aa, Staphylococcus aureus
ITNPLLHEFGTKQYPDE

SEQ ID NO: 1717389 - protein, 18 aa, Staphylococcus aureus
ITTLPSGWTSNLTKSDKK

SEQ ID NO: 1717390 - protein, 19 aa, Staphylococcus aureus
ITTLPSGWTSNLTKSDKKN

SEQ ID NO: 1717391 - protein, 42 aa, Staphylococcus aureus
ITTNKDGYKYYSFIDNVGLFSGSHLYVKNRDLAPKATNNKEF

SEQ ID NO: 1717392 - protein, 42 aa, Staphylococcus aureus
ITTNKDGYKYYSFIDNVGLFSGSHLYVKNRDLAPKATNNKEY

SEQ ID NO: 1717393 - protein, 24 aa, Staphylococcus aureus
ITTPYIVVVNGHIDPNSKGDLALR

SEQ ID NO: 1717394 - protein, 17 aa, Staphylococcus aureus
IVDEAKALNRAMDQLSQ

SEQ ID NO: 1717395 - protein, 17 aa, Staphylococcus aureus
IVDEAKALNRVMDQLSQ

SEQ ID NO: 1717396 - protein, 22 aa, Staphylococcus aureus
IVELKEKGMFVIKKKDDNTYEC

SEQ ID NO: 1717397 - protein, 17 aa, Staphylococcus aureus
IVICVLLVLITISQILK

SEQ ID NO: 1717398 - protein, 24 aa, Staphylococcus aureus
IVKVVVANIGYEGQYHVRIINQDI

SEQ ID NO: 1717399 - protein, 24 aa, Staphylococcus aureus
IVNRLPKSMPQYHVGHIQQIRQIQ

SEQ ID NO: 1717400 - protein, 17 aa, Staphylococcus aureus
IVNRLPTSMPQYHVGHI

SEQ ID NO: 1717401 - protein, 18 aa, Staphylococcus aureus
IVVFILFFNVYDLSYAQG

SEQ ID NO: 1717402 - protein, 23 aa, Staphylococcus aureus
IVYKKPKPLAGLNGESHDFTTTH

SEQ ID NO: 1717403 - protein, 17 aa, Staphylococcus aureus
IWQNGHIDITPNNPSGH

SEQ ID NO: 1717404 - protein, 17 aa, Staphylococcus aureus
IYASVMIAQAILESDSG

SEQ ID NO: 1717405 - protein, 23 aa, Staphylococcus aureus
IYFEKDGKLGFYVQKTQKEHGVG

SEQ ID NO: 1717406 - protein, 21 aa, Staphylococcus aureus
IYKGEMMDLSRGRAISRENET

SEQ ID NO: 1717407 - protein, 20 aa, Staphylococcus aureus
IYKGKKWIYMVFIMVINVLG

SEQ ID NO: 1717408 - protein, 17 aa, Staphylococcus aureus
IYPVFPIPERRRFLYQI

SEQ ID NO: 1717409 - protein, 24 aa, Staphylococcus aureus
IYSPSSYKILSSVGESEDAKGGNL

SEQ ID NO: 1717410 - protein, 20 aa, Staphylococcus aureus
KADMLRLNKYGVDGVFTNFA

SEQ ID NO: 1717411 - protein, 24 aa, Staphylococcus aureus
KADVKSKINAASNIAGVNTVKQQG

SEQ ID NO: 1717412 - protein, 20 aa, Staphylococcus aureus
KAEKDGRDSTNQSMVESTTE

SEQ ID NO: 1717413 - protein, 26 aa, Staphylococcus aureus
KAEKVPMLKAERLAMINITTGANTAT

SEQ ID NO: 1717414 - protein, 27 aa, Staphylococcus aureus
KAKRDAYTNAVSRAEAILNKTQGANTS

SEQ ID NO: 1717415 - protein, 25 aa, Staphylococcus aureus
KAKRDAYTNAVSRAETILNKTQGAN

SEQ ID NO: 1717416 - protein, 18 aa, Staphylococcus aureus
KAKSIGIINEKCVNYSEA

SEQ ID NO: 1717417 - protein, 18 aa, Staphylococcus aureus
KAKYKQIVKNSVKSDSSY

SEQ ID NO: 1717418 - protein, 17 aa, Staphylococcus aureus
KALMVGATYFNEHRDEV

SEQ ID NO: 1717419 - protein, 20 aa, Staphylococcus aureus
KALYEKYKEWYKKHKEINPT

SEQ ID NO: 1717420 - protein, 19 aa, Staphylococcus aureus
KANENLGLNPSHEGEKDPE

SEQ ID NO: 1717421 - protein, 20 aa, Staphylococcus aureus
KANERKAAIAQTQDITAEEI

SEQ ID NO: 1717422 - protein, 20 aa, Staphylococcus aureus
KANLWLRTADRIKIVVGRFN

SEQ ID NO: 1717423 - protein, 22 aa, Staphylococcus aureus
KANNRFSHVAFIKPNNGKTTSV

SEQ ID NO: 1717424 - protein, 19 aa, Staphylococcus aureus
KANQAIEVKAEDTKESIDQ

SEQ ID NO: 1717425 - protein, 24 aa, Staphylococcus aureus
KAQALDHAMELLRNSVADNQATLA

SEQ ID NO: 1717426 - protein, 20 aa, Staphylococcus aureus
KASAAKEIALITAKQTGDGY

SEQ ID NO: 1717427 - protein, 18 aa, Staphylococcus aureus
KASGGVRNLEDFNKMVEA

SEQ ID NO: 1717428 - protein, 17 aa, Staphylococcus aureus
KATARNEITTALNNKLQ

SEQ ID NO: 1717429 - protein, 18 aa, Staphylococcus aureus
KCTGDLKGSSIGHKDIEF

SEQ ID NO: 1717430 - protein, 24 aa, Staphylococcus aureus
KDAAKRQIEGVTHVNEVTQAQNNA

SEQ ID NO: 1717431 - protein, 22 aa, Staphylococcus aureus
KDATRASSAYVNAEPNKKQAFD

SEQ ID NO: 1717432 - protein, 22 aa, Staphylococcus aureus
KDATRASSAYVNAEPNKKQAYD

SEQ ID NO: 1717433 - protein, 17 aa, Staphylococcus aureus
KDEKVLWVTETTANRLH

SEQ ID NO: 1717434 - protein, 19 aa, Staphylococcus aureus
KDGFSIDEFFFIQKEEVSL

SEQ ID NO: 1717435 - protein, 26 aa, Staphylococcus aureus
KDGRLFVCYLGDFKSTGGIFAATENG

SEQ ID NO: 1717436 - protein, 28 aa, Staphylococcus aureus
KDKEEFEAFKKRSPKYNPGMSDHDETDG

SEQ ID NO: 1717437 - protein, 26 aa, Staphylococcus aureus
KDKGYEWNPQSIKSMKHSGSYMTEKI

SEQ ID NO: 1717438 - protein, 24 aa, Staphylococcus aureus
KDKKGNDVVLVYKKVRDGFDVQVI

SEQ ID NO: 1717439 - protein, 20 aa, Staphylococcus aureus
KDKQTIIQYIVNYDVNITEK

SEQ ID NO: 1717440 - protein, 17 aa, Staphylococcus aureus
KDLVLKAKEKAYQDILN

SEQ ID NO: 1717441 - protein, 17 aa, Staphylococcus aureus
KDNQVIVNVAVKYLDQE

SEQ ID NO: 1717442 - protein, 21 aa, Staphylococcus aureus
KDPKISGIVGQDFTEHKNYML

SEQ ID NO: 1717443 - protein, 23 aa, Staphylococcus aureus
KDSEDFYISLKIIDVKQPEGDQR

SEQ ID NO: 1717444 - protein, 25 aa, Staphylococcus aureus
KDSKIKVIMKDGGYYTFELNKNYKQ

SEQ ID NO: 1717445 - protein, 24 aa, Staphylococcus aureus
KDSLRTVMCTSEINKNDGYDEPEY

SEQ ID NO: 1717446 - protein, 20 aa, Staphylococcus aureus
KDTEDFYITLKIIDVKQPEG

SEQ ID NO: 1717447 - protein, 20 aa, Staphylococcus aureus
KDVIYRKLATIEAFEDIKSH

SEQ ID NO: 1717448 - protein, 20 aa, Staphylococcus aureus
KDVTGQFDVIYSNDNKTATV

SEQ ID NO: 1717449 - protein, 24 aa, Staphylococcus aureus
KDVVGISTRLIRITYDNRQTEELT

SEQ ID NO: 1717450 - protein, 24 aa, Staphylococcus aureus
KDVVGISTRLIRVTYDNRQTEDLN

SEQ ID NO: 1717451 - protein, 23 aa, Staphylococcus aureus
KEADASWKKKTVKNYDESVTKAH

SEQ ID NO: 1717452 - protein, 18 aa, Staphylococcus aureus
KEDVIAFENLTNIKVNLK

SEQ ID NO: 1717453 - protein, 25 aa, Staphylococcus aureus
KEEFEAFKKRSPKYNPGMSDQAEMD

SEQ ID NO: 1717454 - protein, 34 aa, Staphylococcus aureus; identical to SEQ ID NO: 1581132

SEQ ID NO: 1717455 - protein, 25 aa, Staphylococcus aureus
KEGKAFRENQKWMTPLGRLGKPEEV

SEQ ID NO: 1717456 - protein, 20 aa, Staphylococcus aureus
KEGKAGQFVTGPWNINEYQE

SEQ ID NO: 1717457 - protein, 17 aa, Staphylococcus aureus
KEGYRDGEFEKGDKGMW

SEQ ID NO: 1717458 - protein, 20 aa, Staphylococcus aureus
KEHGVGKCVSGIAGGAVTGG

SEQ ID NO: 1717459 - protein, 25 aa, Staphylococcus aureus
KEIARTDLGRYFDRFADKLDKTQTN

SEQ ID NO: 1717460 - protein, 21 aa, Staphylococcus aureus
KEIDLGDKLQFEHMGDVLNSK

SEQ ID NO: 1717461 - protein, 25 aa, Staphylococcus aureus
KEKQALKDRINQILQQGHNDINNAL

SEQ ID NO: 1717462 - protein, 19 aa, Staphylococcus aureus
KELDFKLRKQLIEKNNLYG

SEQ ID NO: 1717463 - protein, 20 aa, Staphylococcus aureus
KELKVFKSKWQVLNKGMINL

SEQ ID NO: 1717464 - protein, 19 aa, Staphylococcus aureus
KELRKRYNIPTEKAPKLLL

SEQ ID NO: 1717465 - protein, 17 aa, Staphylococcus aureus
KEMIDDLNSIIDDFFME

SEQ ID NO: 1717466 - protein, 17 aa, Staphylococcus aureus
KEMMDDLNSIIDDFFMD

SEQ ID NO: 1717467 - protein, 19 aa, Staphylococcus aureus
KERAHGNETYVLLNNTSHN

SEQ ID NO: 1717468 - protein, 25 aa, Staphylococcus aureus
KESFYYDLFCIKGNLPDQYLQIYND

SEQ ID NO: 1717469 - protein, 17 aa, Staphylococcus aureus
KESRVKEESKYDSPMSN

SEQ ID NO: 1717470 - protein, 18 aa, Staphylococcus aureus
KETVKKYQQRFMAEDDAL

SEQ ID NO: 1717471 - protein, 17 aa, Staphylococcus aureus
KEYKDALDKLKTRVLEE

SEQ ID NO: 1717472 - protein, 17 aa, Staphylococcus aureus
KFEAYYKSAKNLPDDTM

SEQ ID NO: 1717473 - protein, 20 aa, Staphylococcus aureus
KFMSCIKSAVADQFGVGVVK

SEQ ID NO: 1717474 - protein, 20 aa, Staphylococcus aureus
KFNPDAKNFKIYEVTDQNQF

SEQ ID NO: 1717475 - protein, 28 aa, Staphylococcus aureus
KFNTTPQYIKFRHDYNIVEYNDGTFGYG

SEQ ID NO: 1717476 - protein, 17 aa, Staphylococcus aureus
KFRGIKIQVLLPGNDKS

SEQ ID NO: 1717477 - protein, 33 aa, Staphylococcus aureus
KFSIRKYTVGTFSTVIATLVFLGLNTSQAQATE

SEQ ID NO: 1717478 - protein, 19 aa, Staphylococcus aureus
KFTHVAYVKPLNQFKLGTV

SEQ ID NO: 1717479 - protein, 19 aa, Staphylococcus aureus
KGASVGYKEIEFIFLENKK

SEQ ID NO: 1717480 - protein, 26 aa, Staphylococcus aureus
KGATVSDYYYWKIIDSLEAQFTGAID

SEQ ID NO: 1717481 - protein, 25 aa, Staphylococcus aureus
KGDGLNAINPIAPVTVVKQAAKDAV

SEQ ID NO: 1717482 - protein, 26 aa, Staphylococcus aureus
KGDGLNVINPIAPVTVVKQAARDAVS

SEQ ID NO: 1717483 - protein, 25 aa, Staphylococcus aureus
KGDTFKITVPKELNLNGVTSTAKVP

SEQ ID NO: 1717484 - protein, 26 aa, Staphylococcus aureus
KGHAPHENMIYWFALPAGQTPVGRTE

SEQ ID NO: 1717485 - protein, 27 aa, Staphylococcus aureus
KGLKNKRTLIVVIAFVLFIIFLFLLLN

SEQ ID NO: 1717486 - protein, 26 aa, Staphylococcus aureus
KGMISNRLNKFSIRKYTVGTASILVG

SEQ ID NO: 1717487 - protein, 17 aa, Staphylococcus aureus
KGMWVVRSEMIIQPKGK

SEQ ID NO: 1717488 - protein, 24 aa, Staphylococcus aureus
KGQSFSIGDIKQYFTLSNGQAIPS

SEQ ID NO: 1717489 - protein, 17 aa, Staphylococcus aureus
KGTWVVRSEMIIQPKGK

SEQ ID NO: 1717490 - protein, 17 aa, Staphylococcus aureus
KHTIPSDITDDFTPVDI

SEQ ID NO: 1717491 - protein, 17 aa, Staphylococcus aureus
KHYKLSLKYRDKLQTMI

SEQ ID NO: 1717492 - protein, 24 aa, Staphylococcus aureus
KIAQYRSCLFVAVRNRIMKMMPNA

SEQ ID NO: 1717493 - protein, 27 aa, Staphylococcus aureus
KIASRPTDGGLSWSDDHKSLIYRYDAT

SEQ ID NO: 1717494 - protein, 17 aa, Staphylococcus aureus
KIDDWIYSIEVLANKDY

SEQ ID NO: 1717495 - protein, 24 aa, Staphylococcus aureus
KIEFKIKKGIKWHDGNELIIDDWI

SEQ ID NO: 1717496 - protein, 23 aa, Staphylococcus aureus
KIGSEYNGAVYFTPQIKDFIQKH

SEQ ID NO: 1717497 - protein, 24 aa, Staphylococcus aureus
KIGSEYNGAVYFTPQIKEFIQKHI

SEQ ID NO: 1717498 - protein, 17 aa, Staphylococcus aureus
KIIDYPGKEDVSVIQVE

SEQ ID NO: 1717499 - protein, 17 aa, Staphylococcus aureus
KIINYPGKEDVSVIKVE

SEQ ID NO: 1717500 - protein, 19 aa, Staphylococcus aureus
KIKEALDWMHKNVYGKNPS

SEQ ID NO: 1717501 - protein, 17 aa, Staphylococcus aureus
KIKVGLVSVAITMLYIM

SEQ ID NO: 1717502 - protein, 18 aa, Staphylococcus aureus
KINGSKILKTEFNNKSLS

SEQ ID NO: 1717503 - protein, 24 aa, Staphylococcus aureus
KIPINLWIDSIRTVVPLDIVKTNK

SEQ ID NO: 1717504 - protein, 24 aa, Staphylococcus aureus
KIVEAWPAGLIVLSGQSGVGKSTF

SEQ ID NO: 1717505 - protein, 19 aa, Staphylococcus aureus
KKAAIAKIEAIQPATTTKD

SEQ ID NO: 1717506 - protein, 21 aa, Staphylococcus aureus
KKDKYKVFVQFDERIDTEGQK

SEQ ID NO: 1717507 - protein, 17 aa, Staphylococcus aureus
KKEPVVSLEYDFEHKQR

SEQ ID NO: 1717508 - protein, 17 aa, Staphylococcus aureus
KKFKNRAVDVYGLSYSG

SEQ ID NO: 1717509 - protein, 24 aa, Staphylococcus aureus
KKGDTLSAIALKYKTTVSNIQNTD

SEQ ID NO: 1717510 - protein, 22 aa, Staphylococcus aureus
KKGKTAQAMFIYEIRGDGNINL

SEQ ID NO: 1717511 - protein, 26 aa, Staphylococcus aureus
KKGMKEARKGVGYKAAIEVHTTLFSR

SEQ ID NO: 1717512 - protein, 18 aa, Staphylococcus aureus
KKIIDYPGKEDVSVIQVE

SEQ ID NO: 1717513 - protein, 26 aa, Staphylococcus aureus
KKINPKFKGLRSYYTKPSLEFKNELG

SEQ ID NO: 1717514 - protein, 22 aa, Staphylococcus aureus
KKKLKDALEWLHKNAYGKDPDK

SEQ ID NO: 1717515 - protein, 23 aa, Staphylococcus aureus
KKKVILVSGVKLIKVKKKMTKKM

SEQ ID NO: 1717516 - protein, 23 aa, Staphylococcus aureus
KKKVKDALEWLHKNAYGKEPGKK

SEQ ID NO: 1717517 - protein, 18 aa, Staphylococcus aureus
KKLQEHRMADAIDGTSID

SEQ ID NO: 1717518 - protein, 24 aa, Staphylococcus aureus
KKNKGKHKLAIALDLDETVLDNSP

SEQ ID NO: 1717519 - protein, 22 aa, Staphylococcus aureus
KKSDLVKYSLPISSITAKGQKL

SEQ ID NO: 1717520 - protein, 30 aa, Staphylococcus aureus
KKTNHIKAMRWPFQYNIGLKTNDKYVSLIN

SEQ ID NO: 1717521 - protein, 23 aa, Staphylococcus aureus
KKVAPKAKIVYVGADEKNLINSM

SEQ ID NO: 1717522 - protein, 24 aa, Staphylococcus aureus
KKVIDLKAGIYTADLINTSEIKAI

SEQ ID NO: 1717523 - protein, 22 aa, Staphylococcus aureus
KKVKDALEWLHKNAYGKEPDKK

SEQ ID NO: 1717524 - protein, 18 aa, Staphylococcus aureus
KKVTDSLHDSDIILSNEY

SEQ ID NO: 1717525 - protein, 19 aa, Staphylococcus aureus
KKYDKEIEEVTSLEAKDRN

SEQ ID NO: 1717526 - protein, 23 aa, Staphylococcus aureus
KKYKFSKPYTFSSAVLVIRENKK

SEQ ID NO: 1717527 - protein, 20 aa, Staphylococcus aureus
KLCLCLIILSIFIGGCGMKK

SEQ ID NO: 1717528 - protein, 20 aa, Staphylococcus aureus
KLCLCLIILSVFIGACGMKK

SEQ ID NO: 1717529 - protein, 21 aa, Staphylococcus aureus
KLCLCLIILSVFIGACGMKKE

SEQ ID NO: 1717530 - protein, 21 aa, Staphylococcus aureus
KLCLCLMILSVFISACGMKKE

SEQ ID NO: 1717531 - protein, 31 aa, Staphylococcus aureus
KLKDYYTGTSFDYKNLKGYREGNIATFIFNS

SEQ ID NO: 1717532 - protein, 20 aa, Staphylococcus aureus
KLKEKHIVKVGDKVTIHSKD

SEQ ID NO: 1717533 - protein, 23 aa, Staphylococcus aureus
KLNNIRILPYYIITLNNSIFEKV

SEQ ID NO: 1717534 - protein, 22 aa, Staphylococcus aureus
KLNNKYASIGMDFENQDKILTA

SEQ ID NO: 1717535 - protein, 24 aa, Staphylococcus aureus
KLNNRKSEALQRLDQLTHLNNAQR

SEQ ID NO: 1717536 - protein, 29 aa, Staphylococcus aureus
KLPAEAMKVSPKVIQPAPKVCTPIKKEET

SEQ ID NO: 1717537 - protein, 17 aa, Staphylococcus aureus
KLQEHRMADVIDGTNID

SEQ ID NO: 1717538 - protein, 18 aa, Staphylococcus aureus
KLQEHRMGDVIDGTKIKE

SEQ ID NO: 1717539 - protein, 30 aa, Staphylococcus aureus
KLQQAARNRTPIQLMIGFDYPDSHGNAETL

SEQ ID NO: 1717540 - protein, 21 aa, Staphylococcus aureus
KLRKYLQEEYNIYGHNGTKKG

SEQ ID NO: 1717541 - protein, 21 aa, Staphylococcus aureus
KLRRYLQEEYNIYGHNNNGKG

SEQ ID NO: 1717542 - protein, 19 aa, Staphylococcus aureus
KLVIKRNGNVVTTFTRHNN

SEQ ID NO: 1717543 - protein, 18 aa, Staphylococcus aureus
KLVIKRNGNVVTTFTRRN

SEQ ID NO: 1717544 - protein, 24 aa, Staphylococcus aureus
KMRRIYRRKLTYILKRLKPYKEQL

SEQ ID NO: 1717545 - protein, 20 aa, Staphylococcus aureus
KNAEIAKIEAIQPATTTKDD

SEQ ID NO: 1717546 - protein, 25 aa, Staphylococcus aureus
KNGGKYTFELHKKLQENRMADVIDG

SEQ ID NO: 1717547 - protein, 25 aa, Staphylococcus aureus
KNGTPISNGYFWGKIDSLESQFSKA

SEQ ID NO: 1717548 - protein, 20 aa, Staphylococcus aureus
KNKIGAVLLVGLFGLLFFIL

SEQ ID NO: 1717549 - protein, 23 aa, Staphylococcus aureus
KNLKIEYKNGVGTYYANVNGSIE

SEQ ID NO: 1717550 - protein, 25 aa, Staphylococcus aureus
KNNGSLSITGRVSMNQAFNSDITFK

SEQ ID NO: 1717551 - protein, 17 aa, Staphylococcus aureus
KNNLRFKYRGMKIQVLL

SEQ ID NO: 1717552 - protein, 17 aa, Staphylococcus aureus
KNNLRFKYRGMKTQVLL

SEQ ID NO: 1717553 - protein, 17 aa, Staphylococcus aureus
KNNNWHVHWSVIANDLK

SEQ ID NO: 1717554 - protein, 23 aa, Staphylococcus aureus
KNQDPIVLVHGFNGFTDDINPSV

SEQ ID NO: 1717555 - protein, 22 aa, Staphylococcus aureus
KNQDPIVLVHGFNGFTDDINSS

SEQ ID NO: 1717556 - protein, 17 aa, Staphylococcus aureus
KNVTGFKYTDEGKHYLE

SEQ ID NO: 1717557 - protein, 17 aa, Staphylococcus aureus
KNYQGMTNLVIKNADND

SEQ ID NO: 1717558 - protein, 17 aa, Staphylococcus aureus
KPELVAIAEEASNRPKK

SEQ ID NO: 1717559 - protein, 20 aa, Staphylococcus aureus
KPILERKNVTGFKYTDEGKH

SEQ ID NO: 1717560 - protein, 17 aa, Staphylococcus aureus
KPISIYSPSSYKILSSV

SEQ ID NO: 1717561 - protein, 17 aa, Staphylococcus aureus
KPKELTVQFVPSQNAGT

SEQ ID NO: 1717562 - protein, 19 aa, Staphylococcus aureus
KPLEQRERANVILPNNDRH

SEQ ID NO: 1717563 - protein, 18 aa, Staphylococcus aureus
KPLIFKTKVTSLEDIEKA

SEQ ID NO: 1717564 - protein, 19 aa, Staphylococcus aureus
KPQAKQAIADKVQAQEKAI

SEQ ID NO: 1717565 - protein, 19 aa, Staphylococcus aureus
KPRVTRSADVVEASDVSEV

SEQ ID NO: 1717566 - protein, 23 aa, Staphylococcus aureus
KPSIELKNLDGLYRQKVTDKGVY

SEQ ID NO: 1717567 - protein, 18 aa, Staphylococcus aureus
KPTDLGVSEVTRFNVGNE

SEQ ID NO: 1717568 - protein, 23 aa, Staphylococcus aureus
KQAGHPVFYVYAGNQGNASVNLG

SEQ ID NO: 1717569 - protein, 24 aa, Staphylococcus aureus
KQAVAKAEALISGTPDVVVTPSEI

SEQ ID NO: 1717570 - protein, 27 aa, Staphylococcus aureus
KQGPPFPFPECGAMSQAYIGYQMQESL

SEQ ID NO: 1717571 - protein, 19 aa, Staphylococcus aureus
KQITYTFTDYVDKYEDIKA

SEQ ID NO: 1717572 - protein, 22 aa, Staphylococcus aureus
KQITYTFTDYVDKYEDIKARLT

SEQ ID NO: 1717573 - protein, 53 aa, Staphylococcus aureus
KQTGDGYQWVIKFNKGHAPHENMIFWFALPADQVPVGRTDFVTVNADGTNVQW

SEQ ID NO: 1717574 - protein, 43 aa, Staphylococcus aureus
KQTGDGYQWVIKFNKGHAPHENMIYWFALPADQVPVGRTDFVT

SEQ ID NO: 1717575 - protein, 24 aa, Staphylococcus aureus
KQTYPRLRVTGVSFEAVGLPDCIT

SEQ ID NO: 1717576 - protein, 23 aa, Staphylococcus aureus
KRDKGTWIINSGMNIQLKGGALK

SEQ ID NO: 1717577 - protein, 20 aa, Staphylococcus aureus
KRKDIYVKWQKYMIDELPGL

SEQ ID NO: 1717578 - protein, 21 aa, Staphylococcus aureus
KRLNAKMRFAVAQPAAVASNN

SEQ ID NO: 1717579 - protein, 22 aa, Staphylococcus aureus
KRLSQKKAFQIEFGRKGTNLTY

SEQ ID NO: 1717580 - protein, 19 aa, Staphylococcus aureus
KRMIWPFQYNISLKTKDSN

SEQ ID NO: 1717581 - protein, 20 aa, Staphylococcus aureus
KRNAYNQAISAAETILNKQT

SEQ ID NO: 1717582 - protein, 21 aa, Staphylococcus aureus
KRNAYNQAVSAAETILNKQTG

SEQ ID NO: 1717583 - protein, 18 aa, Staphylococcus aureus
KRNGNVVTTFTRRNNTSP

SEQ ID NO: 1717584 - protein, 21 aa, Staphylococcus aureus
KRVNAKIRFAVAQPAAVASNN

SEQ ID NO: 1717585 - protein, 22 aa, Staphylococcus aureus
KRVNAKMRFAVAQPAAVASNNV

SEQ ID NO: 1717586 - protein, 25 aa, Staphylococcus aureus
KRVNKLVLGISFLFLIISIFAGCGT

SEQ ID NO: 1717587 - protein, 17 aa, Staphylococcus aureus
KRVPVTVNVYQFEFPQT

SEQ ID NO: 1717588 - protein, 29 aa, Staphylococcus aureus
KRYEPEIERARLKFKSEVEKNGYYTMNEK

SEQ ID NO: 1717589 - protein, 21 aa, Staphylococcus aureus
KSASMGNALGFTNNQSGGAGQ

SEQ ID NO: 1717590 - protein, 24 aa, Staphylococcus aureus
KSDLVKYSLPISSITVKGQKLTIK

SEQ ID NO: 1717591 - protein, 31 aa, Staphylococcus aureus
KSDRGISDIDLRLSKQAKYTVYFKNGAKRVI

SEQ ID NO: 1717592 - protein, 18 aa, Staphylococcus aureus
KSFYSIRKSSLGVASVAI

SEQ ID NO: 1717593 - protein, 21 aa, Staphylococcus aureus
KSIAKDAHCIGQDNDIYASVM

SEQ ID NO: 1717594 - protein, 17 aa, Staphylococcus aureus
KSKYMYGGVTLSGQYLN

SEQ ID NO: 1717595 - protein, 17 aa, Staphylococcus aureus
KSTAKQAIADKVQAQET

SEQ ID NO: 1717596 - protein, 18 aa, Staphylococcus aureus
KSVKWGVKANEFVTPDGK

SEQ ID NO: 1717597 - protein, 20 aa, Staphylococcus aureus
KTAYDQAVAAAKAILNKQTD

SEQ ID NO: 1717598 - protein, 18 aa, Staphylococcus aureus
KTAYKMEVTLGNDAYSEE

SEQ ID NO: 1717599 - protein, 18 aa, Staphylococcus aureus
KTAYKMEVTLGNDTYSEE

SEQ ID NO: 1717600 - protein, 19 aa, Staphylococcus aureus
KTAYKMEVTLGNDTYSEEI

SEQ ID NO: 1717601 - protein, 21 aa, Staphylococcus aureus
KTAYKMEVTLGNDVYSEEIIV

SEQ ID NO: 1717602 - protein, 24 aa, Staphylococcus aureus
KTFSHKFFVSKSWINNAPTKEDIA

SEQ ID NO: 1717603 - protein, 20 aa, Staphylococcus aureus
KTHGLDVFAVPELVDLDGRI

SEQ ID NO: 1717604 - protein, 17 aa, Staphylococcus aureus
KTIKWGVKANSFVIAGH

SEQ ID NO: 1717605 - protein, 19 aa, Staphylococcus aureus
KTITYKFTDYVDRYENVNA

SEQ ID NO: 1717606 - protein, 25 aa, Staphylococcus aureus
KTKDDSYWKDLIVEGKRVTTVSKDT

SEQ ID NO: 1717607 - protein, 20 aa, Staphylococcus aureus
KTPKPLAGLNGESHDFTTTH

SEQ ID NO: 1717608 - protein, 37 aa, Staphylococcus aureus; identical to SEQ ID NO: 1577858

SEQ ID NO: 1717609 - protein, 26 aa, Staphylococcus aureus
KTVEGGPTLRLFKVPDNVRNLKIQFV

SEQ ID NO: 1717610 - protein, 18 aa, Staphylococcus aureus
KTVKINLPEHVTKAEPSE

SEQ ID NO: 1717611 - protein, 17 aa, Staphylococcus aureus
KTVKINLPEHVTKAQPS

SEQ ID NO: 1717612 - protein, 25 aa, Staphylococcus aureus
KVAKAKEAAKRALASYSNLNNAQST

SEQ ID NO: 1717613 - protein, 28 aa, Staphylococcus aureus
KVDNAADLSESYFVNPENFEDVTNSVNI

SEQ ID NO: 1717614 - protein, 22 aa, Staphylococcus aureus
KVGEQFFKDNFGLKVKATNVVG

SEQ ID NO: 1717615 - protein, 23 aa, Staphylococcus aureus
KVGSEYNGAVYFTPQIKDFIQKH

SEQ ID NO: 1717616 - protein, 22 aa, Staphylococcus aureus
KVIDLKAGIYTANLINSSDIKS

SEQ ID NO: 1717617 - protein, 23 aa, Staphylococcus aureus
KVIKGKTKFANAVVKVDSELGEA

SEQ ID NO: 1717618 - protein, 26 aa, Staphylococcus aureus
KVIKGKTKFANAVVKVYSELGEAQLF

SEQ ID NO: 1717619 - protein, 21 aa, Staphylococcus aureus
KVIPYAGSADLAIVEVEEDSV

SEQ ID NO: 1717620 - protein, 21 aa, Staphylococcus aureus
KVKDALEWLHKNAYGKEPTDK

SEQ ID NO: 1717621 - protein, 27 aa, Staphylococcus aureus
KVKKAYDYKYFYSYKVVKGVKKYFSFS

SEQ ID NO: 1717622 - protein, 18 aa, Staphylococcus aureus
KVKQAFINANRDIITLAE

SEQ ID NO: 1717623 - protein, 38 aa, Staphylococcus aureus
KVNGYSLINNGKIGFVNSELRRSDMFDKNNPQNYQAKG

SEQ ID NO: 1717624 - protein, 17 aa, Staphylococcus aureus
KVPDNVRNLKIQFVSKN

SEQ ID NO: 1717625 - protein, 26 aa, Staphylococcus aureus
KVPENVSHLKIQFSPKNDAITDVRGI

SEQ ID NO: 1717626 - protein, 18 aa, Staphylococcus aureus
KVPLNVIKIPKSVLTKGN

SEQ ID NO: 1717627 - protein, 20 aa, Staphylococcus aureus
KVPMKIFPAVHYSMGGLYVD

SEQ ID NO: 1717628 - protein, 22 aa, Staphylococcus aureus
KVPTLKAERLAMINITAGANSA

SEQ ID NO: 1717629 - protein, 35 aa, Staphylococcus aureus
KVQQLHANPVKKPAGKTALDQAAADRKTQIEQTPN

SEQ ID NO: 1717630 - protein, 18 aa, Staphylococcus aureus
KVVKGVKKYFSFSQSNDY

SEQ ID NO: 1717631 - protein, 18 aa, Staphylococcus aureus
KVVKGVKKYFSFSQSNGY

SEQ ID NO: 1717632 - protein, 21 aa, Staphylococcus aureus
KVYDFHLKKNVKFSDGSALDA

SEQ ID NO: 1717633 - protein, 17 aa, Staphylococcus aureus
KVYKHIGSDELAESVYA

SEQ ID NO: 1717634 - protein, 26 aa, Staphylococcus aureus
KYDSPMSNWYYWGKVKSLESQFADAI

SEQ ID NO: 1717635 - protein, 25 aa, Staphylococcus aureus
KYEDIKSRLTLYSYIDKKTVPNETS

SEQ ID NO: 1717636 - protein, 26 aa, Staphylococcus aureus
KYEDIKSRLTLYSYIDKKTVPNETSL

SEQ ID NO: 1717637 - protein, 19 aa, Staphylococcus aureus
KYGKSQGRDTQYLNRMPSY

SEQ ID NO: 1717638 - protein, 17 aa, Staphylococcus aureus
KYLDGVKDRMGVTVNGR

SEQ ID NO: 1717639 - protein, 20 aa, Staphylococcus aureus
KYYRGDEVSFTMGVSDRHSG

SEQ ID NO: 1717640 - protein, 20 aa, Staphylococcus aureus
KYYTDKYFKYKGTIDKTVLS

SEQ ID NO: 1717641 - protein, 20 aa, Staphylococcus aureus
KYYTDKYFKYKGTIDKTVQS

SEQ ID NO: 1717642 - protein, 24 aa, Staphylococcus aureus
LAELTCLNPVQLRRVTTQLVDLKM

SEQ ID NO: 1717643 - protein, 17 aa, Staphylococcus aureus
LAIGSAYAFNIQGGTEM

SEQ ID NO: 1717644 - protein, 21 aa, Staphylococcus aureus
LASTLVLGACGSNDTDKKEES

SEQ ID NO: 1717645 - protein, 24 aa, Staphylococcus aureus
LAYKELEQAVALIRTMPQRQQTSR

SEQ ID NO: 1717646 - protein, 19 aa, Staphylococcus aureus
LCIGTSVLILLVSGCSGVF

SEQ ID NO: 1717647 - protein, 20 aa, Staphylococcus aureus
LCIILLILIIFVTSCDGDNK

SEQ ID NO: 1717648 - protein, 17 aa, Staphylococcus aureus
LCISLLILIIFVTSCDG

SEQ ID NO: 1717649 - protein, 20 aa, Staphylococcus aureus
LCISLLILSIFVTSCDSDNK

SEQ ID NO: 1717650 - protein, 24 aa, Staphylococcus aureus
LDFKLRKYLIEKYGLYKTISKDGR

SEQ ID NO: 1717651 - protein, 19 aa, Staphylococcus aureus
LDFKLRQYLIQDFDLYKKF

SEQ ID NO: 1717652 - protein, 18 aa, Staphylococcus aureus
LDFRVRQTLIKNKKLYNG

SEQ ID NO: 1717653 - protein, 17 aa, Staphylococcus aureus
LDHARQALTPDKAPLQN

SEQ ID NO: 1717654 - protein, 29 aa, Staphylococcus aureus
LDIAQGTSMRTTDKYGYYNYAGYSNFIVT

SEQ ID NO: 1717655 - protein, 20 aa, Staphylococcus aureus
LDIFGVPYFYTCIIPKSEPD

SEQ ID NO: 1717656 - protein, 24 aa, Staphylococcus aureus
LDINTASTWKKFEVYENNQKLPVR

SEQ ID NO: 1717657 - protein, 17 aa, Staphylococcus aureus
LDPKLWYFAAGSTTTTI

SEQ ID NO: 1717658 - protein, 19 aa, Staphylococcus aureus
LDPKLWYFAAGSTTTTIKQ

SEQ ID NO: 1717659 - protein, 20 aa, Staphylococcus aureus
LDVFVVREGFGRQADNNSIG

SEQ ID NO: 1717660 - protein, 21 aa, Staphylococcus aureus
LDYSCSAFLMYIGIDIDVTDQ

SEQ ID NO: 1717661 - protein, 21 aa, Staphylococcus aureus
LEDGKIRYTFTNDVEHKVEVT

SEQ ID NO: 1717662 - protein, 25 aa, Staphylococcus aureus
LEDLSRASDYFSEAGATAATKAFGR

SEQ ID NO: 1717663 - protein, 26 aa, Staphylococcus aureus
LEGGQEVIMIWNPWDRGFMTQDAESN

SEQ ID NO: 1717664 - protein, 18 aa, Staphylococcus aureus
LEKALPQLSAGSNMQDYN

SEQ ID NO: 1717665 - protein, 23 aa, Staphylococcus aureus
LEKKIESGMSYFITQPVYSKEKI

SEQ ID NO: 1717666 - protein, 27 aa, Staphylococcus aureus
LESTQDYQLRLDGLRQTVNRTYRIGTT

SEQ ID NO: 1717667 - protein, 17 aa, Staphylococcus aureus
LFISVIILSIFIIGCNS

SEQ ID NO: 1717668 - protein, 18 aa, Staphylococcus aureus
LFLGFVAVILTVCLIGLL

SEQ ID NO: 1717669 - protein, 18 aa, Staphylococcus aureus
LFLLAMYELGKYVTEQIY

SEQ ID NO: 1717670 - protein, 17 aa, Staphylococcus aureus
LFLLAMYELGKYVTEQV

SEQ ID NO: 1717671 - protein, 18 aa, Staphylococcus aureus
LFLLAMYELGKYVTEQVF

SEQ ID NO: 1717672 - protein, 20 aa, Staphylococcus aureus
LFNLTSYYTDITWQLDESNK

SEQ ID NO: 1717673 - protein, 23 aa, Staphylococcus aureus
LFNVPSAIILLEYDGVVYIGYDN

SEQ ID NO: 1717674 - protein, 17 aa, Staphylococcus aureus
LFSGNSFATALTTNEII

SEQ ID NO: 1717675 - protein, 17 aa, Staphylococcus aureus
LGFESDITFTLRNLEDT

SEQ ID NO: 1717676 - protein, 19 aa, Staphylococcus aureus
LGISFLFLVISITAGCGIG

SEQ ID NO: 1717677 - protein, 17 aa, Staphylococcus aureus
LGKMYKTYFFKKGESKS

SEQ ID NO: 1717678 - protein, 19 aa, Staphylococcus aureus
LGLIVPIATPFQGSKATTN

SEQ ID NO: 1717679 - protein, 24 aa, Staphylococcus aureus
LGVASVIVSTLFLITSQHQAQAAE

SEQ ID NO: 1717680 - protein, 19 aa, Staphylococcus aureus
LHKQLDALVAQKDAEKKVA

SEQ ID NO: 1717681 - protein, 18 aa, Staphylococcus aureus
LIDPNGRVSTVGGVTKKN

SEQ ID NO: 1717682 - protein, 22 aa, Staphylococcus aureus
LIDSRYLNSALYYLEDYIIYAI

SEQ ID NO: 1717683 - protein, 21 aa, Staphylococcus aureus
LIPKFEAYYKSAKNLPDDTMK

SEQ ID NO: 1717684 - protein, 28 aa, Staphylococcus aureus
LIPNLPNGDYRVEFSNLPQGYEVTPSKQ

SEQ ID NO: 1717685 - protein, 21 aa, Staphylococcus aureus
LIVTSTLVFSSMPFQNAHADT

SEQ ID NO: 1717686 - protein, 17 aa, Staphylococcus aureus
LIYRYDATLGTQITTND

SEQ ID NO: 1717687 - protein, 19 aa, Staphylococcus aureus
LKADQFKYEVTLPQAVTYG

SEQ ID NO: 1717688 - protein, 17 aa, Staphylococcus aureus
LKDGETYTVKFETPTGY

SEQ ID NO: 1717689 - protein, 20 aa, Staphylococcus aureus
LKELDFKLRKHLIDKHNLYK

SEQ ID NO: 1717690 - protein, 18 aa, Staphylococcus aureus
LKELDFKLRKHLIDNHDL

SEQ ID NO: 1717691 - protein, 19 aa, Staphylococcus aureus
LKELDFKLRKHLIDNNGLY

SEQ ID NO: 1717692 - protein, 22 aa, Staphylococcus aureus
LKELDFKLRKQLIEKHNLYGNM

SEQ ID NO: 1717693 - protein, 22 aa, Staphylococcus aureus
LKGSEFTFTPEAPKTITELEKK

SEQ ID NO: 1717694 - protein, 18 aa, Staphylococcus aureus
LKIKPGHFSYHEMSPAEM

SEQ ID NO: 1717695 - protein, 22 aa, Staphylococcus aureus
LKILNPNGYWNSTLTWPGSYSV

SEQ ID NO: 1717696 - protein, 17 aa, Staphylococcus aureus
LKKDFGLAGTVKDITSN

SEQ ID NO: 1717697 - protein, 20 aa, Staphylococcus aureus
LKKRTHFNIAGAFNPNVRKL

SEQ ID NO: 1717698 - protein, 18 aa, Staphylococcus aureus
LKKTWLDVNYGYDQYDEN

SEQ ID NO: 1717699 - protein, 19 aa, Staphylococcus aureus
LKMTIKLRVHESIVERLLD

SEQ ID NO: 1717700 - protein, 17 aa, Staphylococcus aureus
LKNGHIMIQSFSDESLK

SEQ ID NO: 1717701 - protein, 21 aa, Staphylococcus aureus
LKNKPGIHYAPPILEKNKDGQ

SEQ ID NO: 1717702 - protein, 17 aa, Staphylococcus aureus
LKNLDGLYRQHLTDKGA

SEQ ID NO: 1717703 - protein, 17 aa, Staphylococcus aureus
LKQELKTTVTPTKVEEN

SEQ ID NO: 1717704 - protein, 27 aa, Staphylococcus aureus
LKRGQRQMELIKILFQKAQEVDSIDKL

SEQ ID NO: 1717705 - protein, 19 aa, Staphylococcus aureus
LKSDQFKYEVTLPQGVTYV

SEQ ID NO: 1717706 - protein, 32 aa, Staphylococcus aureus
LKSDRGISDIDLRLSKQAKYTVYFKNGTKKVI

SEQ ID NO: 1717707 - protein, 17 aa, Staphylococcus aureus
LKVLSAPSIDYGLIGFV

SEQ ID NO: 1717708 - protein, 20 aa, Staphylococcus aureus
LKYAKKAYYTVYFKNGGKRI

SEQ ID NO: 1717709 - protein, 21 aa, Staphylococcus aureus
LKYNPKEARAHWDKAKKELGK

SEQ ID NO: 1717710 - protein, 21 aa, Staphylococcus aureus
LKYPSEYHVDFQVKRNRKTEI

SEQ ID NO: 1717711 - protein, 18 aa, Staphylococcus aureus
LLAGCGSQNLAPLEEKTT

SEQ ID NO: 1717712 - protein, 18 aa, Staphylococcus aureus
LLEVYRIIGELYGKSVEH

SEQ ID NO: 1717713 - protein, 18 aa, Staphylococcus aureus
LLISGGVTPAANAAQHDE

SEQ ID NO: 1717714 - protein, 25 aa, Staphylococcus aureus
LLITMAVVTWKVWKIEKHTRKPVIS

SEQ ID NO: 1717715 - protein, 21 aa, Staphylococcus aureus
LLKAKPDLILAHESQKATANK

SEQ ID NO: 1717716 - protein, 18 aa, Staphylococcus aureus
LLKHDLLFHDMFLNDAWK

SEQ ID NO: 1717717 - protein, 23 aa, Staphylococcus aureus
LLKKKIDEYELYKKWYKSSNKNT

SEQ ID NO: 1717718 - protein, 17 aa, Staphylococcus aureus
LLLNFIFILILSGCSKE

SEQ ID NO: 1717719 - protein, 21 aa, Staphylococcus aureus
LLSPHYVEFSIKPGTTLTKEK

SEQ ID NO: 1717720 - protein, 17 aa, Staphylococcus aureus
LLSQGFVSKNIDVYESP

SEQ ID NO: 1717721 - protein, 18 aa, Staphylococcus aureus
LLTHDLLFHDMFLNDASK

SEQ ID NO: 1717722 - protein, 17 aa, Staphylococcus aureus
LNAKYYRGDEVSFTMGV

SEQ ID NO: 1717723 - protein, 25 aa, Staphylococcus aureus
LNGAMTALKAAQKYTDADREKQAAY

SEQ ID NO: 1717724 - protein, 17 aa, Staphylococcus aureus
LNGDEKLAAAKQTAKSD

SEQ ID NO: 1717725 - protein, 18 aa, Staphylococcus aureus
LNIKGMVLKLNRNTRSAK

SEQ ID NO: 1717726 - protein, 23 aa, Staphylococcus aureus
LNKADGKFSHFAYVKPNNQSLSS

SEQ ID NO: 1717727 - protein, 22 aa, Staphylococcus aureus
LNQELREAIKNPAIKDKDHSAP

SEQ ID NO: 1717728 - protein, 18 aa, Staphylococcus aureus
LNTAMGQLQHGIDDENTT

SEQ ID NO: 1717729 - protein, 25 aa, Staphylococcus aureus
LPADQVPVGRTDFVTVNADGTNVQW

SEQ ID NO: 1717730 - protein, 17 aa, Staphylococcus aureus
LPATSFAKINSEIKQVS

SEQ ID NO: 1717731 - protein, 24 aa, Staphylococcus aureus
LPNGGIKAKSSISMNNVTYTTQDE

SEQ ID NO: 1717732 - protein, 17 aa, Staphylococcus aureus
LPQSVYLDASDKNKYKD

SEQ ID NO: 1717733 - protein, 20 aa, Staphylococcus aureus
LPSMVALMLVGSAVTAHQVQ

SEQ ID NO: 1717734 - protein, 22 aa, Staphylococcus aureus
LPTDGFTYKWNRDTTGTNDANW

SEQ ID NO: 1717735 - protein, 20 aa, Staphylococcus aureus
LPTDIDFSIQFSDNKINTIK

SEQ ID NO: 1717736 - protein, 28 aa, Staphylococcus aureus
LPYAELALGAGMAFLIRRFTKKDHQTEE

SEQ ID NO: 1717737 - protein, 17 aa, Staphylococcus aureus
LQDALKRALDDFHREVK

SEQ ID NO: 1717738 - protein, 19 aa, Staphylococcus aureus
LQKNMEVISYRSGFDNKVC

SEQ ID NO: 1717739 - protein, 27 aa, Staphylococcus aureus
LQLAYKELEQAVALIRTMPQRQQTSRR

SEQ ID NO: 1717740 - protein, 30 aa, Staphylococcus aureus
LQQAARNRTPIQLMIGFDYPDGHGNAETLV

SEQ ID NO: 1717741 - protein, 34 aa, Staphylococcus aureus
LQQAARTGSPIRLMIGFDYPDAFGNGETLVPVNL

SEQ ID NO: 1717742 - protein, 17 aa, Staphylococcus aureus
LQQMWEYGVNDPDRSHD

SEQ ID NO: 1717743 - protein, 25 aa, Staphylococcus aureus
LRDLARAGDYFSEANAPAATKALGE

SEQ ID NO: 1717744 - protein, 24 aa, Staphylococcus aureus
LREGDSRQATNYSIGGVTKTNSQP

SEQ ID NO: 1717745 - protein, 17 aa, Staphylococcus aureus
LREVYPITTKKSPVLKL

SEQ ID NO: 1717746 - protein, 20 aa, Staphylococcus aureus
LRGDGNINLNVHKYSEDKTV

SEQ ID NO: 1717747 - protein, 19 aa, Staphylococcus aureus
LRGTALQKVPVTVSGVPLD

SEQ ID NO: 1717748 - protein, 20 aa, Staphylococcus aureus
LRLLFLLAMYELGKYVTEQV

SEQ ID NO: 1717749 - protein, 17 aa, Staphylococcus aureus
LRPSLIVADEPVSALDV

SEQ ID NO: 1717750 - protein, 18 aa, Staphylococcus aureus
LRPSLIVADEPVSALDVS

SEQ ID NO: 1717751 - protein, 19 aa, Staphylococcus aureus
LRSGAMASVAPVISEVKRL

SEQ ID NO: 1717752 - protein, 19 aa, Staphylococcus aureus
LRSKLKFKYMGGSHRKQTN

SEQ ID NO: 1717753 - protein, 20 aa, Staphylococcus aureus
LRYIYDVYFDRDDCITVPTD

SEQ ID NO: 1717754 - protein, 18 aa, Staphylococcus aureus
LSGHEAKAAEHTNGELNQ

SEQ ID NO: 1717755 - protein, 17 aa, Staphylococcus aureus
LSIISMSTLSKVQASED

SEQ ID NO: 1717756 - protein, 17 aa, Staphylococcus aureus
LSKDEKVLWVTETTANR

SEQ ID NO: 1717757 - protein, 18 aa, Staphylococcus aureus
LSKDVFKSKASQVTVVKQ

SEQ ID NO: 1717758 - protein, 17 aa, Staphylococcus aureus
LSKTFLIESRDLTTVDF

SEQ ID NO: 1717759 - protein, 18 aa, Staphylococcus aureus
LSKTFLIESRELTTVDFE

SEQ ID NO: 1717760 - protein, 18 aa, Staphylococcus aureus
LSLYPTKNLEDFYDKEGF

SEQ ID NO: 1717761 - protein, 23 aa, Staphylococcus aureus
LSLYPTKNLEGFYDKEGFRDEEF

SEQ ID NO: 1717762 - protein, 26 aa, Staphylococcus aureus
LSNGSAIPDATITWVSGQAPNKNNTT

SEQ ID NO: 1717763 - protein, 18 aa, Staphylococcus aureus
LSTITLLMAGGITFNDSE

SEQ ID NO: 1717764 - protein, 19 aa, Staphylococcus aureus
LTDGTVVQAGWSNYGGGNQ

SEQ ID NO: 1717765 - protein, 18 aa, Staphylococcus aureus
LTELALRFNQGINTDGDA

SEQ ID NO: 1717766 - protein, 17 aa, Staphylococcus aureus
LTFKLRKDAKWSNGDPV

SEQ ID NO: 1717767 - protein, 30 aa, Staphylococcus aureus
LTFLFVCSLIVCGFFAYKIYFPADAKNKSE

SEQ ID NO: 1717768 - protein, 17 aa, Staphylococcus aureus
LTFNLVIQTAEFPSWKD

SEQ ID NO: 1717769 - protein, 18 aa, Staphylococcus aureus
LTGFILILLLEGIFTNSA

SEQ ID NO: 1717770 - protein, 17 aa, Staphylococcus aureus
LTGFILILLLEGIFTNT

SEQ ID NO: 1717771 - protein, 18 aa, Staphylococcus aureus
LTILTILTSLGFAENISN

SEQ ID NO: 1717772 - protein, 23 aa, Staphylococcus aureus
LTILTILTSLGFAENISNQPHSI

SEQ ID NO: 1717773 - protein, 20 aa, Staphylococcus aureus
LTILTSLGFAENISNQPHSI

SEQ ID NO: 1717774 - protein, 18 aa, Staphylococcus aureus
LTLLKATTTVPGLRNNIA

SEQ ID NO: 1717775 - protein, 18 aa, Staphylococcus aureus
LTMLKATTTVPGLRNNIT

SEQ ID NO: 1717776 - protein, 18 aa, Staphylococcus aureus
LTNIKVNLKGSGFVSHQS

SEQ ID NO: 1717777 - protein, 17 aa, Staphylococcus aureus
LVIKRNGNVVTTFTRRN

SEQ ID NO: 1717778 - protein, 17 aa, Staphylococcus aureus
LVLLIILIVGYVIMTKI

SEQ ID NO: 1717779 - protein, 22 aa, Staphylococcus aureus
LVSFKYKVKKMVLQERIDNVLK

SEQ ID NO: 1717780 - protein, 19 aa, Staphylococcus aureus
LYISVMILIFAIAGCGKSD

SEQ ID NO: 1717781 - protein, 22 aa, Staphylococcus aureus
LYKRGLHPTLIHRSDKINKLMD

SEQ ID NO: 1717782 - protein, 17 aa, Staphylococcus aureus
LYLESTQDYQLRLDGLR

SEQ ID NO: 1717783 - protein, 17 aa, Staphylococcus aureus
LYNCISMIVKIGIVCMH

SEQ ID NO: 1717784 - protein, 29 aa, Staphylococcus aureus
MAQRTGVSAATWAAIIARESNGQVNAYNP

SEQ ID NO: 1717785 - protein, 18 aa, Staphylococcus aureus
MAQRTGVSASTWAAIIAR

SEQ ID NO: 1717786 - protein, 30 aa, Staphylococcus aureus; identical to SEQ ID NO: 1578831

SEQ ID NO: 1717787 - protein, 20 aa, Staphylococcus aureus
MCFTCLSSNHYGYWNWHIRD

SEQ ID NO: 1717788 - protein, 27 aa, Staphylococcus aureus
MDAYKEVKQAATARKAQNATVSNATDE

SEQ ID NO: 1717789 - protein, 29 aa, Staphylococcus aureus
MDLYQICWNGFYWAGANYKNFKTRTFKST

SEQ ID NO: 1717790 - protein, 25 aa, Staphylococcus aureus
MGGQTIRLMEEFLRNGNKEEIAYHQ

SEQ ID NO: 1717791 - protein, 24 aa, Staphylococcus aureus
MGGQTIRLMEEFVRNGNKEEIAYH

SEQ ID NO: 1717792 - protein, 21 aa, Staphylococcus aureus
MGQFLLKMGIQPEVTKDKTTH

SEQ ID NO: 1717793 - protein, 18 aa, Staphylococcus aureus
MGVMFNRTNEGLLDFRRF

SEQ ID NO: 1717794 - protein, 24 aa, Staphylococcus aureus
MIDELPGLPMFQGKSITIVNDKVR

SEQ ID NO: 1717795 - protein, 19 aa, Staphylococcus aureus
MIGGLEFYQGNKPVITLKE

SEQ ID NO: 1717796 - protein, 19 aa, Staphylococcus aureus
MIKAIQFADIYLMALPTKA

SEQ ID NO: 1717797 - protein, 26 aa, Staphylococcus aureus
MKNGGKYTFELHKKLQEHRMADVIDG

SEQ ID NO: 1717798 - protein, 25 aa, Staphylococcus aureus
MKNGGKYTFELHKKLQEHRMADVIE

SEQ ID NO: 1717799 - protein, 21 aa, Staphylococcus aureus
MKNGGYYTFELNKKLQPHRMG

SEQ ID NO: 1717800 - protein, 20 aa, Staphylococcus aureus
MKSGVRFFDIRGRASADNMI

SEQ ID NO: 1717801 - protein, 17 aa, Staphylococcus aureus
MLGICLVLLIILIVGYV

SEQ ID NO: 1717802 - protein, 26 aa, Staphylococcus aureus
MNKIFRILTVSLFFFTFLIKNNLAYA

SEQ ID NO: 1717803 - protein, 25 aa, Staphylococcus aureus
MPDKILDLKYKLRVNNVPTPRTVTF

SEQ ID NO: 1717804 - protein, 28 aa, Staphylococcus aureus
MQNASGLPTDGFTYKWNNAATGTNDANW

SEQ ID NO: 1717805 - protein, 23 aa, Staphylococcus aureus
MQTFHEFSVYNLTMEEYNEISKS

SEQ ID NO: 1717806 - protein, 25 aa, Staphylococcus aureus
MQTNDMKAPLATVSKGSNSANQDML

SEQ ID NO: 1717807 - protein, 17 aa, Staphylococcus aureus
MSDEILQQFEAVKDDKA

SEQ ID NO: 1717808 - protein, 26 aa, Staphylococcus aureus
MSLPKKLFLWVFGILVILAIIAVVYV

SEQ ID NO: 1717809 - protein, 26 aa, Staphylococcus aureus
MTDGQLWKKVRDSLHDSDIILSNEYE

SEQ ID NO: 1717810 - protein, 33 aa, Staphylococcus aureus
MTIKDKGYFDFDFKTKRFDNLELKKNDDISLTF

SEQ ID NO: 1717811 - protein, 23 aa, Staphylococcus aureus
MTLCTFVIIPLFFKILDYQIKLD

SEQ ID NO: 1717812 - protein, 19 aa, Staphylococcus aureus
MTQLKQGIANKAQIKGSEN

SEQ ID NO: 1717813 - protein, 25 aa, Staphylococcus aureus
MTVLKAAIADKERTKASGNYVNADQ

SEQ ID NO: 1717814 - protein, 17 aa, Staphylococcus aureus
MYVAFSVYGMMVTYGFN

SEQ ID NO: 1717815 - protein, 17 aa, Staphylococcus aureus
NAAKVSGVKAIEATTTA

SEQ ID NO: 1717816 - protein, 25 aa, Staphylococcus aureus
NAAPVARQIYPFIGNKTQALQQLPN

SEQ ID NO: 1717817 - protein, 22 aa, Staphylococcus aureus
NAAPVVRQIYPFNGNKTQALQQ

SEQ ID NO: 1717818 - protein, 18 aa, Staphylococcus aureus
NADQRNGFIQSLKDDPSQ

SEQ ID NO: 1717819 - protein, 22 aa, Staphylococcus aureus
NAEQSRSAFAFSKKLDDETVQK

SEQ ID NO: 1717820 - protein, 22 aa, Staphylococcus aureus
NAFYEILHLPNLNEEQRNGFIQ

SEQ ID NO: 1717821 - protein, 21 aa, Staphylococcus aureus
NAIEFAKKHRKEFEKVGEQFF

SEQ ID NO: 1717822 - protein, 20 aa, Staphylococcus aureus
NAKLKVQAYHSSYPNNIGQI

SEQ ID NO: 1717823 - protein, 18 aa, Staphylococcus aureus
NAMKGLRDSIANETTVKA

SEQ ID NO: 1717824 - protein, 19 aa, Staphylococcus aureus
NANGMTVYWYHDNQRALVD

SEQ ID NO: 1717825 - protein, 22 aa, Staphylococcus aureus
NANLWLRTADRIKIVVGRFNAT

SEQ ID NO: 1717826 - protein, 18 aa, Staphylococcus aureus
NAQRQLAIQQINNAETLN

SEQ ID NO: 1717827 - protein, 18 aa, Staphylococcus aureus
NASGLPTDGFTYKWNNAA

SEQ ID NO: 1717828 - protein, 26 aa, Staphylococcus aureus
NATGLPTDGFTHKWNRDTTGTNDANW

SEQ ID NO: 1717829 - protein, 27 aa, Staphylococcus aureus
NATGLPTDGFTYKWNRDTTGTNDANWS

SEQ ID NO: 1717830 - protein, 41 aa, Staphylococcus aureus
NAVKEGKAKINAVKTFSEYKKDALAKIADAYNAKVNEEDNS

SEQ ID NO: 1717831 - protein, 21 aa, Staphylococcus aureus
NAVNEKAREAITNINATPGAT

SEQ ID NO: 1717832 - protein, 24 aa, Staphylococcus aureus
NAVTPKVVKKQAAKDEIDQLQATQ

SEQ ID NO: 1717833 - protein, 20 aa, Staphylococcus aureus
NAYGVYFTPEIKKFIAENID

SEQ ID NO: 1717834 - protein, 32 aa, Staphylococcus aureus
NDAILGEKVVAYGPIWRLFKVPENVSHLKIQF

SEQ ID NO: 1717835 - protein, 24 aa, Staphylococcus aureus
NDAKAFFSYEGKGLEIAKNLADQA

SEQ ID NO: 1717836 - protein, 22 aa, Staphylococcus aureus
NDALLKRMDYWPTYYPSKLNKD

SEQ ID NO: 1717837 - protein, 20 aa, Staphylococcus aureus
NDGSGYPVGTYINASNKGAP

SEQ ID NO: 1717838 - protein, 24 aa, Staphylococcus aureus
NDGSGYPVGTYINASNKGAPYNLP

SEQ ID NO: 1717839 - protein, 22 aa, Staphylococcus aureus
NDGSGYPVGTYINASSKGAPYN

SEQ ID NO: 1717840 - protein, 25 aa, Staphylococcus aureus
NDIELKFAKQAKYTIHFKNGKTQVV

SEQ ID NO: 1717841 - protein, 17 aa, Staphylococcus aureus
NDKVHFTNIDIAIDKGH

SEQ ID NO: 1717842 - protein, 22 aa, Staphylococcus aureus
NDLKLDYINYWIGKYRSHPYNK

SEQ ID NO: 1717843 - protein, 18 aa, Staphylococcus aureus
NDSASVLVTPQLQATTEG

SEQ ID NO: 1717844 - protein, 30 aa, Staphylococcus aureus
NDTILKSWIDDGFMPLIYKGEMMDLSRGRA

SEQ ID NO: 1717845 - protein, 17 aa, Staphylococcus aureus
NEALVRQGLAKVAYVYK

SEQ ID NO: 1717846 - protein, 18 aa, Staphylococcus aureus
NEEQRNGFIQSLKDDPSQ

SEQ ID NO: 1717847 - protein, 23 aa, Staphylococcus aureus
NEKAQAEAGGRPNYKSSGYSQSN

SEQ ID NO: 1717848 - protein, 23 aa, Staphylococcus aureus
NEKAQAEAGGRPNYKTTGYSQAN

SEQ ID NO: 1717849 - protein, 19 aa, Staphylococcus aureus
NEKRYPVKMVDNKVIPTKE

SEQ ID NO: 1717850 - protein, 26 aa, Staphylococcus aureus
NENVRNFLKQNIEDIHFANDDQPNNP

SEQ ID NO: 1717851 - protein, 20 aa, Staphylococcus aureus
NEPFEVTIYLKGFEANQTLE

SEQ ID NO: 1717852 - protein, 20 aa, Staphylococcus aureus
NERIRKEMMDDLNSIIDDFF

SEQ ID NO: 1717853 - protein, 19 aa, Staphylococcus aureus
NETSLNLTFATAGKETSQN

SEQ ID NO: 1717854 - protein, 23 aa, Staphylococcus aureus
NFGDCCMYGGLTFNSSENERDKL

SEQ ID NO: 1717855 - protein, 23 aa, Staphylococcus aureus
NFGDIDSAYIVKVVSKYTPGAED

SEQ ID NO: 1717856 - protein, 25 aa, Staphylococcus aureus
NFTDKGWQITGIPRTLHIENSTNRT

SEQ ID NO: 1717857 - protein, 19 aa, Staphylococcus aureus
NFTDRDWQITGIPRTLHIE

SEQ ID NO: 1717858 - protein, 24 aa, Staphylococcus aureus
NFTKSIAIEYGRDGIRANAIAPGT

SEQ ID NO: 1717859 - protein, 24 aa, Staphylococcus aureus
NFWNNLHWIGYNIKNQKRATHTSI

SEQ ID NO: 1717860 - protein, 19 aa, Staphylococcus aureus
NGAGAFTIDHVVKSNSTHN

SEQ ID NO: 1717861 - protein, 26 aa, Staphylococcus aureus
NGAKRVIDLKAGIYTADLINTSEIKA

SEQ ID NO: 1717862 - protein, 26 aa, Staphylococcus aureus
NGDPVTAYDFVYAWRKLVDPKTGSEY

SEQ ID NO: 1717863 - protein, 17 aa, Staphylococcus aureus
NGGIKAKSSISMNNVTY

SEQ ID NO: 1717864 - protein, 18 aa, Staphylococcus aureus
NGGKYTFELHKKLQEHRM

SEQ ID NO: 1717865 - protein, 19 aa, Staphylococcus aureus
NGGKYTFELHKKLQEHRMA

SEQ ID NO: 1717866 - protein, 17 aa, Staphylococcus aureus
NGGKYTFELHKKLQENR

SEQ ID NO: 1717867 - protein, 35 aa, Staphylococcus aureus; identical to SEQ ID NO: 1575906

SEQ ID NO: 1717868 - protein, 31 aa, Staphylococcus aureus
NGNKLDANEAWKKLTDKLKEKNIVKDGDTVT

SEQ ID NO: 1717869 - protein, 17 aa, Staphylococcus aureus
NGTTWSWSYEAANGQTA

SEQ ID NO: 1717870 - protein, 35 aa, Staphylococcus aureus
NGYSLINNGKIGFVNSELRRSDMFDKNNPQNYQAR

SEQ ID NO: 1717871 - protein, 26 aa, Staphylococcus aureus
NHIKSMRWPFQYNIGLKTNDPNVSLI

SEQ ID NO: 1717872 - protein, 27 aa, Staphylococcus aureus
NHIKSMRWPFQYNIGLKTNDSNVSLIN

SEQ ID NO: 1717873 - protein, 17 aa, Staphylococcus aureus
NIAQFRYDHYLQLFNEI

SEQ ID NO: 1717874 - protein, 38 aa, Staphylococcus aureus
NIELVGNLLPGDYFGTIRFGRKEQLFEIRVKPHTPRIT

SEQ ID NO: 1717875 - protein, 40 aa, Staphylococcus aureus
NIELVGNLLPGDYFGTIRFGRKEQLFEIRVKPHTPTITTT

SEQ ID NO: 1717876 - protein, 19 aa, Staphylococcus aureus
NIGDIKQYFTLSNGQAIPN

SEQ ID NO: 1717877 - protein, 18 aa, Staphylococcus aureus
NIIDIDFDSVPQIHGFNK

SEQ ID NO: 1717878 - protein, 21 aa, Staphylococcus aureus
NIIIKSIAALTILTSITGVGT

SEQ ID NO: 1717879 - protein, 17 aa, Staphylococcus aureus
NINKGRLTKSFTSNLAN

SEQ ID NO: 1717880 - protein, 25 aa, Staphylococcus aureus
NIPKEYKKPVELMMNYFKALNSTIV

SEQ ID NO: 1717881 - protein, 26 aa, Staphylococcus aureus
NISGIPLDPSALVYLVAPTNQTTNGG

SEQ ID NO: 1717882 - protein, 17 aa, Staphylococcus aureus
NKAAYNVIQEIGKSKSE

SEQ ID NO: 1717883 - protein, 18 aa, Staphylococcus aureus
NKAEELANSIINNINKAT

SEQ ID NO: 1717884 - protein, 26 aa, Staphylococcus aureus
NKAYDYKYFYSYKVVKGVKKYFSFSQ

SEQ ID NO: 1717885 - protein, 30 aa, Staphylococcus aureus
NKDNTRIGEDINVTAHILIDGETTPITKTA

SEQ ID NO: 1717886 - protein, 19 aa, Staphylococcus aureus
NKEKLSITRQMLLKMKFKM

SEQ ID NO: 1717887 - protein, 22 aa, Staphylococcus aureus
NKGGHAEAFFPSKLPLINLRMN

SEQ ID NO: 1717888 - protein, 25 aa, Staphylococcus aureus
NKIVPAQDYLALKSQIKVDDKVKSG

SEQ ID NO: 1717889 - protein, 19 aa, Staphylococcus aureus
NKIVPAQDYLSLKSQITVD

SEQ ID NO: 1717890 - protein, 24 aa, Staphylococcus aureus
NKLRDGYLLSDKNYKDWTEHNQDQ

SEQ ID NO: 1717891 - protein, 19 aa, Staphylococcus aureus
NKMNLPIDFNQVIIGGDSA

SEQ ID NO: 1717892 - protein, 20 aa, Staphylococcus aureus
NKMNLPIDFNQVIIGGDSAG

SEQ ID NO: 1717893 - protein, 23 aa, Staphylococcus aureus
NKNIIIKSIAALTILTSITGAGT

SEQ ID NO: 1717894 - protein, 19 aa, Staphylococcus aureus
NKNVRIYQNFTYNRVYPNS

SEQ ID NO: 1717895 - protein, 19 aa, Staphylococcus aureus
NKPNTAQVINAKYDVIYNG

SEQ ID NO: 1717896 - protein, 17 aa, Staphylococcus aureus
NKTVKVVEKYSDQNKPY

SEQ ID NO: 1717897 - protein, 17 aa, Staphylococcus aureus
NLAGGYKSSLKLIDDLY

SEQ ID NO: 1717898 - protein, 17 aa, Staphylococcus aureus
NLGDYVWEDTNKDGKQD

SEQ ID NO: 1717899 - protein, 31 aa, Staphylococcus aureus
NLKTYYTGASFDLRGLSGYKEGDKVIFPQNG

SEQ ID NO: 1717900 - protein, 20 aa, Staphylococcus aureus
NLQKLLAPYHKAKTLERQVY

SEQ ID NO: 1717901 - protein, 18 aa, Staphylococcus aureus
NLTNKLKGQKIIKDGDKV

SEQ ID NO: 1717902 - protein, 20 aa, Staphylococcus aureus
NLTSNENFTDKGWQITGIPR

SEQ ID NO: 1717903 - protein, 22 aa, Staphylococcus aureus
NLYNAQGNIIAKGIYDSKTNTT

SEQ ID NO: 1717904 - protein, 18 aa, Staphylococcus aureus
NMNFQFVGTYGPNKDVVG

SEQ ID NO: 1717905 - protein, 20 aa, Staphylococcus aureus
NNAMKGLRDSIANETTVKAS

SEQ ID NO: 1717906 - protein, 21 aa, Staphylococcus aureus
NNETSFTYDLFYTGTGQAESF

SEQ ID NO: 1717907 - protein, 17 aa, Staphylococcus aureus
NNGLSMVPLGTKNQVIL

SEQ ID NO: 1717908 - protein, 17 aa, Staphylococcus aureus
NNGLSMVPWGTNNQVIL

SEQ ID NO: 1717909 - protein, 23 aa, Staphylococcus aureus
NNGNVTLHYCDGSSTTLDATNVM

SEQ ID NO: 1717910 - protein, 24 aa, Staphylococcus aureus
NNGSLSITGRVSMNQAFNSDITFK

SEQ ID NO: 1717911 - protein, 23 aa, Staphylococcus aureus
NNGWCAGYSMSALLNATYNTNKY

SEQ ID NO: 1717912 - protein, 22 aa, Staphylococcus aureus
NNGWCAGYTMSALLNATYNTDR

SEQ ID NO: 1717913 - protein, 21 aa, Staphylococcus aureus
NNIRLLKDYGVSIYPVNISES

SEQ ID NO: 1717914 - protein, 26 aa, Staphylococcus aureus
NNPAEQGRFLKFFVDAGLIKVKKGVK

SEQ ID NO: 1717915 - protein, 18 aa, Staphylococcus aureus
NNQKLPVRLVSYSPVPED

SEQ ID NO: 1717916 - protein, 19 aa, Staphylococcus aureus
NNQKLPVRLVSYSPVPEDH

SEQ ID NO: 1717917 - protein, 20 aa, Staphylococcus aureus
NNQKLPVRLVSYSPVPEDHA

SEQ ID NO: 1717918 - protein, 18 aa, Staphylococcus aureus
NNSLNWWDYEIGTPRALT

SEQ ID NO: 1717919 - protein, 18 aa, Staphylococcus aureus
NNTSFWFDLFPKKELVPF

SEQ ID NO: 1717920 - protein, 24 aa, Staphylococcus aureus
NPDLIKSAAKPAALETQYKAAAPK

SEQ ID NO: 1717921 - protein, 17 aa, Staphylococcus aureus
NPDTWKNTVGNTHKTAV

SEQ ID NO: 1717922 - protein, 19 aa, Staphylococcus aureus
NPKLLFKGAGNIKGSSVGY

SEQ ID NO: 1717923 - protein, 17 aa, Staphylococcus aureus
NPNAKNFKIYEVTDQNQ

SEQ ID NO: 1717924 - protein, 19 aa, Staphylococcus aureus
NPSGHLINPTQAMDIAYTE

SEQ ID NO: 1717925 - protein, 18 aa, Staphylococcus aureus
NPSGHLINPTQVMDIAYT

SEQ ID NO: 1717926 - protein, 25 aa, Staphylococcus aureus
NRAYDYKYYYSYKVVKGVKKYFSFA

SEQ ID NO: 1717927 - protein, 17 aa, Staphylococcus aureus
NRKANGYTLYTDDKQTT

SEQ ID NO: 1717928 - protein, 24 aa, Staphylococcus aureus
NRKKVDYKAGISITKEDKNGTISH

SEQ ID NO: 1717929 - protein, 25 aa, Staphylococcus aureus
NRLPTSMPQYHVGHIQQIRQIQAHI

SEQ ID NO: 1717930 - protein, 18 aa, Staphylococcus aureus
NRNFVVKYEVNWKTHEIK

SEQ ID NO: 1717931 - protein, 18 aa, Staphylococcus aureus
NRNGTVFSYGGVTKKNQG

SEQ ID NO: 1717932 - protein, 22 aa, Staphylococcus aureus
NRPENITKFDWDKHDYRNKLEN

SEQ ID NO: 1717933 - protein, 19 aa, Staphylococcus aureus
NRPKKRSRRAAPTDPNATP

SEQ ID NO: 1717934 - protein, 21 aa, Staphylococcus aureus
NRPYFDLRNLSGYREGNTVTF

SEQ ID NO: 1717935 - protein, 20 aa, Staphylococcus aureus
NRYTLHRFNVEYALEPQQLI

SEQ ID NO: 1717936 - protein, 39 aa, Staphylococcus aureus
NSALEQLKAQRINPEVKKNALEAIREVVNKQIEIIKNAD

SEQ ID NO: 1717937 - protein, 19 aa, Staphylococcus aureus
NSDITFKVSATDNVNNTTN

SEQ ID NO: 1717938 - protein, 29 aa, Staphylococcus aureus
NSKEIEYARVWYQLISTRNDLKGIKNVYV

SEQ ID NO: 1717939 - protein, 19 aa, Staphylococcus aureus
NSNITFKVAATDNVNNTTN

SEQ ID NO: 1717940 - protein, 17 aa, Staphylococcus aureus
NSPVYSLTDGTVVQAGW

SEQ ID NO: 1717941 - protein, 23 aa, Staphylococcus aureus
NSSYTLGEAFKIYKFNQKSDGNY

SEQ ID NO: 1717942 - protein, 30 aa, Staphylococcus aureus
NSTAPHVHFQRMAGGIGNQYAVDPTSYLQS

SEQ ID NO: 1717943 - protein, 37 aa, Staphylococcus aureus; identical to SEQ ID NO: 1580415

SEQ ID NO: 1717944 - protein, 20 aa, Staphylococcus aureus
NSTVKLFKADNTPLNVTNIT

SEQ ID NO: 1717945 - protein, 23 aa, Staphylococcus aureus
NTAMGNLKHALAEKDTTKRSVNY

SEQ ID NO: 1717946 - protein, 20 aa, Staphylococcus aureus
NTGKVLYAFYQNPKVVKAAI

SEQ ID NO: 1717947 - protein, 24 aa, Staphylococcus aureus
NTKDGIKPLLAKKWEVSEDGKTYT

SEQ ID NO: 1717948 - protein, 20 aa, Staphylococcus aureus
NTNAFRPGGAQQLNEYQLSQ

SEQ ID NO: 1717949 - protein, 18 aa, Staphylococcus aureus
NTRIETIKVSEKLSKVDV

SEQ ID NO: 1717950 - protein, 17 aa, Staphylococcus aureus
NTTELNTAMGQLKHAIA

SEQ ID NO: 1717951 - protein, 40 aa, Staphylococcus aureus
NTVTIRPQDYVVFIPPVGKQIRAVVYYNKVVASNMSNAVT

SEQ ID NO: 1717952 - protein, 40 aa, Staphylococcus aureus
NTVTIRPQDYVVFIPPVGKQIRAVVYYNKVVGSNMSNAVT

SEQ ID NO: 1717953 - protein, 18 aa, Staphylococcus aureus
NTWVIDSFYFRYKQQNYI

SEQ ID NO: 1717954 - protein, 19 aa, Staphylococcus aureus
NTYDGTGFVIARTSDTDIT

SEQ ID NO: 1717955 - protein, 25 aa, Staphylococcus aureus
NVEVPVKVYPVANAKAPSRDLKGQN

SEQ ID NO: 1717956 - protein, 25 aa, Staphylococcus aureus
NVGLFSGSHLYVKNRDLAPKATNNK

SEQ ID NO: 1717957 - protein, 26 aa, Staphylococcus aureus
NVGLFSGSHLYVKNRDLAPKATNNKE

SEQ ID NO: 1717958 - protein, 19 aa, Staphylococcus aureus
NVTLHYRDGSSTALDATNV

SEQ ID NO: 1717959 - protein, 18 aa, Staphylococcus aureus
NVTLQYRDGSSTTLDATN

SEQ ID NO: 1717960 - protein, 20 aa, Staphylococcus aureus
NVVYNIPELHVAQIKMTKMH

SEQ ID NO: 1717961 - protein, 25 aa, Staphylococcus aureus
NWIDEGFMPLIYKGEMMDLSRGRAI

SEQ ID NO: 1717962 - protein, 18 aa, Staphylococcus aureus
NYTYVIKNGNGYYYVTPN

SEQ ID NO: 1717963 - protein, 17 aa, Staphylococcus aureus
PAADESLKDAIKDPALE

SEQ ID NO: 1717964 - protein, 24 aa, Staphylococcus aureus
PADQVPVGRTDFVTVNSDGTNVQW

SEQ ID NO: 1717965 - protein, 17 aa, Staphylococcus aureus
PAPKVCTPIKKEDKQEV

SEQ ID NO: 1717966 - protein, 21 aa, Staphylococcus aureus
PAQDYLSLKSQITVDDKVKSG

SEQ ID NO: 1717967 - protein, 42 aa, Staphylococcus aureus
PARLMPDKILDLKFKLRVNNVPTPRTVTFNDTLTYKTYTQDF

SEQ ID NO: 1717968 - protein, 42 aa, Staphylococcus aureus
PARLMPDKILDLKYKLRVNNVPTPRTVTFNDTLTYKTYTQDF

SEQ ID NO: 1717969 - protein, 17 aa, Staphylococcus aureus
PAYDEFKNSPKVNVSNL

SEQ ID NO: 1717970 - protein, 20 aa, Staphylococcus aureus
PDDIPPTINNPVGLNAKYYR

SEQ ID NO: 1717971 - protein, 28 aa, Staphylococcus aureus
PDNVLNCKPEFWKTLKYKKDKVTYYVYL

SEQ ID NO: 1717972 - protein, 24 aa, Staphylococcus aureus
PDTGELKGALGVEKIFDSNLSGSK

SEQ ID NO: 1717973 - protein, 17 aa, Staphylococcus aureus
PEGWHEWVQAAKAKPVY

SEQ ID NO: 1717974 - protein, 17 aa, Staphylococcus aureus
PEISAKVGENYNGNKGL

SEQ ID NO: 1717975 - protein, 17 aa, Staphylococcus aureus
PEKLKELVRNDSNTDHS

SEQ ID NO: 1717976 - protein, 18 aa, Staphylococcus aureus
PEKLKELVRNDSNTDHST

SEQ ID NO: 1717977 - protein, 27 aa, Staphylococcus aureus
PEKPKRVAVLTGFYVGDFIKLGIKPIA

SEQ ID NO: 1717978 - protein, 29 aa, Staphylococcus aureus
PEQLYKYYYDRGYTLTWDNGLVLYSNKAN

SEQ ID NO: 1717979 - protein, 20 aa, Staphylococcus aureus
PEQMRQAIEFVKKHKLKHLL

SEQ ID NO: 1717980 - protein, 23 aa, Staphylococcus aureus
PFFIGIMPIASYKNALFLHNEVP

SEQ ID NO: 1717981 - protein, 17 aa, Staphylococcus aureus
PGPYGHVAYVERVNGDG

SEQ ID NO: 1717982 - protein, 19 aa, Staphylococcus aureus
PGYHAHKFVTPGHASIKIN

SEQ ID NO: 1717983 - protein, 31 aa, Staphylococcus aureus; identical to SEQ ID NO: 1578630

SEQ ID NO: 1717984 - protein, 31 aa, Staphylococcus aureus
PHEGQRAILKYKLKFENGLHQGDFFDFTLSK

SEQ ID NO: 1717985 - protein, 17 aa, Staphylococcus aureus
PHFSLSNKWLWQKPNGS

SEQ ID NO: 1717986 - protein, 18 aa, Staphylococcus aureus
PHIEVKRERGMFTTVKSD

SEQ ID NO: 1717987 - protein, 23 aa, Staphylococcus aureus
PHLSLSNKWLWQKPNGSIHATLQ

SEQ ID NO: 1717988 - protein, 38 aa, Staphylococcus aureus; identical to SEQ ID NO: 1576028

SEQ ID NO: 1717989 - protein, 29 aa, Staphylococcus aureus
PIKEKIQHVFKSGCGFDNDSNKGFIYTKI

SEQ ID NO: 1717990 - protein, 41 aa, Staphylococcus aureus
PILQGWDHVDFIGVDFLDFKRKGSELANFYIGIINDLLSVE

SEQ ID NO: 1717991 - protein, 22 aa, Staphylococcus aureus
PKDPKRIAVVAPTYAGGLKKLG

SEQ ID NO: 1717992 - protein, 19 aa, Staphylococcus aureus
PKFEAYYKSAKNLPDDTMK

SEQ ID NO: 1717993 - protein, 19 aa, Staphylococcus aureus
PKGPTGFMIPTIVQWLKQQ

SEQ ID NO: 1717994 - protein, 21 aa, Staphylococcus aureus
PKGQSEPIVLVIFTNKDNKSD

SEQ ID NO: 1717995 - protein, 23 aa, Staphylococcus aureus
PKKGGFFEEIERTFKEISEELNE

SEQ ID NO: 1717996 - protein, 18 aa, Staphylococcus aureus
PKLLLKCTGDLKGSSIGH

SEQ ID NO: 1717997 - protein, 23 aa, Staphylococcus aureus
PKRVNAKIRFAVAQPAAVASNNV

SEQ ID NO: 1717998 - protein, 21 aa, Staphylococcus aureus
PKSQYSGVISKMFDSFEHNKP

SEQ ID NO: 1717999 - protein, 18 aa, Staphylococcus aureus
PKYNPGMSDQAEMDNESE

SEQ ID NO: 1718000 - protein, 18 aa, Staphylococcus aureus
PLQQMWEYGVNDPHRSHD

SEQ ID NO: 1718001 - protein, 17 aa, Staphylococcus aureus
PLRINLTSNENFTDKDW

SEQ ID NO: 1718002 - protein, 25 aa, Staphylococcus aureus
PMIEMMFGVHFIKGGMYGMVQGLAQ

SEQ ID NO: 1718003 - protein, 19 aa, Staphylococcus aureus
PNFDKLVEETKKAVKEADD

SEQ ID NO: 1718004 - protein, 18 aa, Staphylococcus aureus
PNKTACMYGGVTLHDNNR

SEQ ID NO: 1718005 - protein, 17 aa, Staphylococcus aureus
PNNARERNIELVGNLLP

SEQ ID NO: 1718006 - protein, 23 aa, Staphylococcus aureus
PNVNGKYSIVTVDYTGQAMVTDP

SEQ ID NO: 1718007 - protein, 27 aa, Staphylococcus aureus
PPQGCPFHTRCPIAQDMCKKSMPELKD

SEQ ID NO: 1718008 - protein, 28 aa, Staphylococcus aureus
PPQGCPFHTRCPIAQDMCKKSMPELKDI

SEQ ID NO: 1718009 - protein, 25 aa, Staphylococcus aureus
PPVEGRGVINSRQFLSHDLNFPIEY

SEQ ID NO: 1718010 - protein, 26 aa, Staphylococcus aureus
PPVGHQIRALIYYNNVVASNMSNAVT

SEQ ID NO: 1718011 - protein, 26 aa, Staphylococcus aureus
PPVGKQIRALIYYNKVVASNMSNAVT

SEQ ID NO: 1718012 - protein, 26 aa, Staphylococcus aureus
PPVGKQIRAVVYYNKVVASNMSNAVT

SEQ ID NO: 1718013 - protein, 26 aa, Staphylococcus aureus
PPVGNQIRALIFYNNVVASNMSNAVT

SEQ ID NO: 1718014 - protein, 18 aa, Staphylococcus aureus
PRNIPINLWVNGKQNTIS

SEQ ID NO: 1718015 - protein, 19 aa, Staphylococcus aureus
PRYEKAYKIPNEQLNKENG

SEQ ID NO: 1718016 - protein, 20 aa, Staphylococcus aureus
PSDITDDFTPVDITDPSGEV

SEQ ID NO: 1718017 - protein, 19 aa, Staphylococcus aureus
PSGEVIAKGTFDLNTKTIT

SEQ ID NO: 1718018 - protein, 22 aa, Staphylococcus aureus
PSIELKNLDGLYRQKVTDKGVY

SEQ ID NO: 1718019 - protein, 30 aa, Staphylococcus aureus
PSVTVVDNLPGFTFINGGKVGVFSHAMVRT

SEQ ID NO: 1718020 - protein, 28 aa, Staphylococcus aureus
PSVTVVDNLPGFTLINGGKVGVLSHAMV

SEQ ID NO: 1718021 - protein, 24 aa, Staphylococcus aureus
PTATHATRSYAIIKPSNDESKSKY

SEQ ID NO: 1718022 - protein, 23 aa, Staphylococcus aureus
PTDKKVGWKVIFNNMMNQNWGPY

SEQ ID NO: 1718023 - protein, 17 aa, Staphylococcus aureus
PTDLGVSEVTRFNVGNE

SEQ ID NO: 1718024 - protein, 17 aa, Staphylococcus aureus
PTIDKLYYAAGGRALEY

SEQ ID NO: 1718025 - protein, 34 aa, Staphylococcus aureus
PTLKETKGKIVLFNRMGDTYIKSGYGADTSGIQW

SEQ ID NO: 1718026 - protein, 17 aa, Staphylococcus aureus
PTLVQMVTLSSDNSKSA

SEQ ID NO: 1718027 - protein, 26 aa, Staphylococcus aureus
PTNANPNVRRPGGVQELNEYQISQLF

SEQ ID NO: 1718028 - protein, 29 aa, Staphylococcus aureus
PTNATTNAFRPGGVQELNEYQLSQLFTDQ

SEQ ID NO: 1718029 - protein, 22 aa, Staphylococcus aureus
PTNCAVAGCASNKLAIQPVIAT

SEQ ID NO: 1718030 - protein, 26 aa, Staphylococcus aureus
PVFNEKNEVIGIHWGGVPNQFNGAVF

SEQ ID NO: 1718031 - protein, 24 aa, Staphylococcus aureus
PVGKQIRAVVYYNKVVASNMSNAV

SEQ ID NO: 1718032 - protein, 20 aa, Staphylococcus aureus
PVKHVIPEIVAHSHYTVQGQ

SEQ ID NO: 1718033 - protein, 17 aa, Staphylococcus aureus
PWVKEASAATVAGIAGT

SEQ ID NO: 1718034 - protein, 25 aa, Staphylococcus aureus
PYNLPTSPWNTLKASAAKEIVLMTA

SEQ ID NO: 1718035 - protein, 24 aa, Staphylococcus aureus
PYNLPTTPWNTLKASAAKEIALIT

SEQ ID NO: 1718036 - protein, 19 aa, Staphylococcus aureus
PYNLPTTPWNTLKASDSKE

SEQ ID NO: 1718037 - protein, 23 aa, Staphylococcus aureus
PYNLPTTPWNTLKASDSKEIALM

SEQ ID NO: 1718038 - protein, 20 aa, Staphylococcus aureus
PYTGAYGVVLLEGISQIFPM

SEQ ID NO: 1718039 - protein, 17 aa, Staphylococcus aureus
QAARDAVSHDAQQHIAE

SEQ ID NO: 1718040 - protein, 17 aa, Staphylococcus aureus
QADYTFASLDIFNDLKR

SEQ ID NO: 1718041 - protein, 17 aa, Staphylococcus aureus
QAIAGLNPDLAPLQTAK

SEQ ID NO: 1718042 - protein, 17 aa, Staphylococcus aureus
QAIAGLTPDLAPLQAAK

SEQ ID NO: 1718043 - protein, 17 aa, Staphylococcus aureus
QAIAGLTPDLAPLQTAK

SEQ ID NO: 1718044 - protein, 25 aa, Staphylococcus aureus
QAQGNVIALGRIRGNDTNDHGDFNG

SEQ ID NO: 1718045 - protein, 17 aa, Staphylococcus aureus
QATNYSIGGVTKSNSVQ

SEQ ID NO: 1718046 - protein, 17 aa, Staphylococcus aureus
QAVAKAEALLNKQSGTN

SEQ ID NO: 1718047 - protein, 17 aa, Staphylococcus aureus
QAYDEKVTVAENIVSGT

SEQ ID NO: 1718048 - protein, 22 aa, Staphylococcus aureus
QDGKRPEKVSVNLLANGEKVET

SEQ ID NO: 1718049 - protein, 17 aa, Staphylococcus aureus
QDGTVSYGARPTYKKPS

SEQ ID NO: 1718050 - protein, 17 aa, Staphylococcus aureus
QDINVTAHILIDGETTP

SEQ ID NO: 1718051 - protein, 22 aa, Staphylococcus aureus
QDINVTAHILIDGETTPITKTA

SEQ ID NO: 1718052 - protein, 17 aa, Staphylococcus aureus
QDLPNCATFPNQMIEYG

SEQ ID NO: 1718053 - protein, 30 aa, Staphylococcus aureus; identical to SEQ ID NO: 1579808

SEQ ID NO: 1718054 - protein, 22 aa, Staphylococcus aureus
QEKLIYWNPWDTELSIQDADSS

SEQ ID NO: 1718055 - protein, 17 aa, Staphylococcus aureus
QEMMKYGKSQGRDTQYL

SEQ ID NO: 1718056 - protein, 26 aa, Staphylococcus aureus
QFDNSWCAGFSMAALLNATKNTDTYN

SEQ ID NO: 1718057 - protein, 23 aa, Staphylococcus aureus
QFVKSIAKDAHRIGQDSDIYASV

SEQ ID NO: 1718058 - protein, 18 aa, Staphylococcus aureus
QGDFFDFTLSKNVNTHGV

SEQ ID NO: 1718059 - protein, 22 aa, Staphylococcus aureus
QGNPSTWFYPLGKKKVERTTPK

SEQ ID NO: 1718060 - protein, 17 aa, Staphylococcus aureus
QGYRGYGAFVKNDSSGN

SEQ ID NO: 1718061 - protein, 27 aa, Staphylococcus aureus
QHTILFKGFFTNHSWYNDLLVDFDSKD

SEQ ID NO: 1718062 - protein, 19 aa, Staphylococcus aureus
QIEFGRKGTNLTYQDKLKI

SEQ ID NO: 1718063 - protein, 25 aa, Staphylococcus aureus
QIKPKVRRKRAALDNIDESNNNQLD

SEQ ID NO: 1718064 - protein, 26 aa, Staphylococcus aureus
QINPELIKSAAKPAALETQYKAAAPN

SEQ ID NO: 1718065 - protein, 26 aa, Staphylococcus aureus
QINPELIKSAAKPAALETQYKAVAPK

SEQ ID NO: 1718066 - protein, 22 aa, Staphylococcus aureus
QIVSKGPEVNRFITQNKVNHRF

SEQ ID NO: 1718067 - protein, 22 aa, Staphylococcus aureus
QKANELRAKINQDKEATAEERQ

SEQ ID NO: 1718068 - protein, 20 aa, Staphylococcus aureus
QKASERKTAIEAMNDSTTEE

SEQ ID NO: 1718069 - protein, 23 aa, Staphylococcus aureus
QKASERKTAIEAMNDSTTEEQQA

SEQ ID NO: 1718070 - protein, 24 aa, Staphylococcus aureus
QKEINPKFKGLRSYYTKPSLEFKN

SEQ ID NO: 1718071 - protein, 27 aa, Staphylococcus aureus
QKEINPKFKGLRSYYTKSSLEFKNELG

SEQ ID NO: 1718072 - protein, 32 aa, Staphylococcus aureus
QKGGNLKPLEQRECANVILPNNDRHQITDTTN

SEQ ID NO: 1718073 - protein, 18 aa, Staphylococcus aureus
QKGGNLKPLEQRERANVI

SEQ ID NO: 1718074 - protein, 17 aa, Staphylococcus aureus
QKLSTITLLMAGAITLN

SEQ ID NO: 1718075 - protein, 17 aa, Staphylococcus aureus
QKLSTITLLMAGGITFN

SEQ ID NO: 1718076 - protein, 17 aa, Staphylococcus aureus
QKLSTITLLMAGVIILN

SEQ ID NO: 1718077 - protein, 18 aa, Staphylococcus aureus
QKLSTITLLMAGVIILNG

SEQ ID NO: 1718078 - protein, 17 aa, Staphylococcus aureus
QKLSTITLLMAGVITLN

SEQ ID NO: 1718079 - protein, 18 aa, Staphylococcus aureus
QKLSTITLLMAGVITLSD

SEQ ID NO: 1718080 - protein, 19 aa, Staphylococcus aureus
QKLSTITLLMVGVITLNNG

SEQ ID NO: 1718081 - protein, 18 aa, Staphylococcus aureus
QLEKLLRDDIKTIRTDID

SEQ ID NO: 1718082 - protein, 17 aa, Staphylococcus aureus
QLHGDKIIGFDTEGGVS

SEQ ID NO: 1718083 - protein, 18 aa, Staphylococcus aureus
QLNLLYVKDIKNIDIDVK

SEQ ID NO: 1718084 - protein, 26 aa, Staphylococcus aureus
QLTAEEKTEALAMIKQITDQAKKGIT

SEQ ID NO: 1718085 - protein, 18 aa, Staphylococcus aureus
QLTHAFKQAKDNLHGDQK

SEQ ID NO: 1718086 - protein, 19 aa, Staphylococcus aureus
QLTHAFKQAKDNLHGDQKL

SEQ ID NO: 1718087 - protein, 17 aa, Staphylococcus aureus
QMDEELKTARTNADVDA

SEQ ID NO: 1718088 - protein, 26 aa, Staphylococcus aureus
QMFGYPEQRYGYYYNSYQLTWDNGLV

SEQ ID NO: 1718089 - protein, 24 aa, Staphylococcus aureus
QMTWFKNKMSVHWLDKDNMSLQMM

SEQ ID NO: 1718090 - protein, 24 aa, Staphylococcus aureus
QMTWFKNKMSVHWLNKENMSLQMM

SEQ ID NO: 1718091 - protein, 24 aa, Staphylococcus aureus
QNAFYEILHLPNLTEEQRNGFIQS

SEQ ID NO: 1718092 - protein, 24 aa, Staphylococcus aureus
QNGNQPKVRIFEYLGNNEDIAKSV

SEQ ID NO: 1718093 - protein, 17 aa, Staphylococcus aureus
QNLRTAAYHKELLSDKI

SEQ ID NO: 1718094 - protein, 23 aa, Staphylococcus aureus
QNPPHGATVAWHDSPDTWKNTVG

SEQ ID NO: 1718095 - protein, 34 aa, Staphylococcus aureus
QNPPHGSTVAWHDSPDTWKHTVGNTHKTAVVTLP

SEQ ID NO: 1718096 - protein, 25 aa, Staphylococcus aureus
QNRANKRMVWPFQYNIGLTSKDQNT

SEQ ID NO: 1718097 - protein, 24 aa, Staphylococcus aureus
QNVTIPAIEAIVPQKDPNANDTNS

SEQ ID NO: 1718098 - protein, 24 aa, Staphylococcus aureus
QNVTIPAIEAIVPQNDPNANDTNN

SEQ ID NO: 1718099 - protein, 23 aa, Staphylococcus aureus
QPFGATIPYYFTGHEGPDSCCID

SEQ ID NO: 1718100 - protein, 19 aa, Staphylococcus aureus
QPLRINLTSNENFTDKGWQ

SEQ ID NO: 1718101 - protein, 19 aa, Staphylococcus aureus
QPLRINLTSNENFTDRDWQ

SEQ ID NO: 1718102 - protein, 25 aa, Staphylococcus aureus
QQADYTFASLDIFNDLKRRAQTILA

SEQ ID NO: 1718103 - protein, 18 aa, Staphylococcus aureus
QQERITLYLKHNTKEPNT

SEQ ID NO: 1718104 - protein, 18 aa, Staphylococcus aureus
QQHLTFSNKTLWQKDNGT

SEQ ID NO: 1718105 - protein, 24 aa, Staphylococcus aureus
QRHLTFSNKWLWQKDNGTIHATLL

SEQ ID NO: 1718106 - protein, 24 aa, Staphylococcus aureus
QRHLTFSNKWLWQKENGTIHATLL

SEQ ID NO: 1718107 - protein, 17 aa, Staphylococcus aureus
QRITTAFMNKNQNIRGY

SEQ ID NO: 1718108 - protein, 19 aa, Staphylococcus aureus
QRLQSAIANKDQTKANENY

SEQ ID NO: 1718109 - protein, 17 aa, Staphylococcus aureus
QRQFTLNGQVIQIMDII

SEQ ID NO: 1718110 - protein, 18 aa, Staphylococcus aureus
QRQFTLNGQVIQIMDIIN

SEQ ID NO: 1718111 - protein, 18 aa, Staphylococcus aureus
QTEDLNIISKVKPDPPRI

SEQ ID NO: 1718112 - protein, 41 aa, Staphylococcus aureus
QTGDGYQWVIKFNKGHAPHENMIFWFALPADQVPVGRTDFV

SEQ ID NO: 1718113 - protein, 42 aa, Staphylococcus aureus
QTGDGYQWVIKFNKGHAPHQNMIFWFALPADQVPVGRTDFVT

SEQ ID NO: 1718114 - protein, 19 aa, Staphylococcus aureus
QTNDMKASLATVSNGSNSA

SEQ ID NO: 1718115 - protein, 18 aa, Staphylococcus aureus
QTPVGRTEFVTVNADGTN

SEQ ID NO: 1718116 - protein, 22 aa, Staphylococcus aureus
QTYPRLRVTGASFEALGLPDCI

SEQ ID NO: 1718117 - protein, 21 aa, Staphylococcus aureus
QTYPRLRVTGASFEAVGLPDC

SEQ ID NO: 1718118 - protein, 26 aa, Staphylococcus aureus
QVAYKELEQAVALIRTMPQRQQTSRR

SEQ ID NO: 1718119 - protein, 26 aa, Staphylococcus aureus
QVSYTPKRHAAVVFEAGQFGADQHYG

SEQ ID NO: 1718120 - protein, 21 aa, Staphylococcus aureus
QVVNRTYRIGTTKRVEVSQGN

SEQ ID NO: 1718121 - protein, 23 aa, Staphylococcus aureus
QYLLKKKIDEYKQYRERYLKAGL

SEQ ID NO: 1718122 - protein, 18 aa, Staphylococcus aureus
RAAEPRSVSDYQNANSSY

SEQ ID NO: 1718123 - protein, 19 aa, Staphylococcus aureus
RASDYFSEAGATPATKAFG

SEQ ID NO: 1718124 - protein, 27 aa, Staphylococcus aureus
RDGDISVGAFFRARLGNEVLENLIEPL

SEQ ID NO: 1718125 - protein, 38 aa, Staphylococcus aureus
RDGKAKINAVKTFSEYKKDALAKIADAYNAKVNEADNS

SEQ ID NO: 1718126 - protein, 22 aa, Staphylococcus aureus
RDKGTWIINSGMNIQFKGGALK

SEQ ID NO: 1718127 - protein, 20 aa, Staphylococcus aureus
RDKGTWIINSGMNIQLKGGA

SEQ ID NO: 1718128 - protein, 21 aa, Staphylococcus aureus
RDKGTWIINSGMNIQLKGGAL

SEQ ID NO: 1718129 - protein, 22 aa, Staphylococcus aureus
RDMNGHALPLTKDGNFYQTNVD

SEQ ID NO: 1718130 - protein, 18 aa, Staphylococcus aureus
RDSFHPTYGNELFLAGRQ

SEQ ID NO: 1718131 - protein, 18 aa, Staphylococcus aureus
REAESEITAAQRIIDNGD

SEQ ID NO: 1718132 - protein, 18 aa, Staphylococcus aureus
REAESEITAAQRVIDNGD

SEQ ID NO: 1718133 - protein, 27 aa, Staphylococcus aureus
REAVEKADDSWKKKTVKKYGETETKSP

SEQ ID NO: 1718134 - protein, 20 aa, Staphylococcus aureus
REGDSRQATNYSIGGVTKSN

SEQ ID NO: 1718135 - protein, 21 aa, Staphylococcus aureus
REGDSRQATNYSIGGVTKSNS

SEQ ID NO: 1718136 - protein, 18 aa, Staphylococcus aureus
REHVREAQKLVENYKDTH

SEQ ID NO: 1718137 - protein, 30 aa, Staphylococcus aureus; identical to SEQ ID NO: 1577735

SEQ ID NO: 1718138 - protein, 18 aa, Staphylococcus aureus
RGAVFPGVSDVYDAKQYV

SEQ ID NO: 1718139 - protein, 19 aa, Staphylococcus aureus
RGDGNINLNVHKYSEDKTV

SEQ ID NO: 1718140 - protein, 24 aa, Staphylococcus aureus
RGISDLDLKFAKQAKYTVHFKNGK

SEQ ID NO: 1718141 - protein, 20 aa, Staphylococcus aureus
RGNFNPEFISVLSHKQKDVK

SEQ ID NO: 1718142 - protein, 21 aa, Staphylococcus aureus
RGNFNPEFISVLSHKQNEAKK

SEQ ID NO: 1718143 - protein, 17 aa, Staphylococcus aureus
RGTALQKVPVTVTDIPL

SEQ ID NO: 1718144 - protein, 27 aa, Staphylococcus aureus
RGTFLMTKMMLPLMMTQGGSIVNTSSF

SEQ ID NO: 1718145 - protein, 18 aa, Staphylococcus aureus
RGYPIGQILIPGRDEGHM

SEQ ID NO: 1718146 - protein, 18 aa, Staphylococcus aureus
RHSSDKPELVAIAEPASN

SEQ ID NO: 1718147 - protein, 20 aa, Staphylococcus aureus
RIGEDITVTAHILIDGETTP

SEQ ID NO: 1718148 - protein, 23 aa, Staphylococcus aureus
RIRKYLLEKEHLYSNYNSGELII

SEQ ID NO: 1718149 - protein, 20 aa, Staphylococcus aureus
RIWLYLVLLAVFIGACGMKK

SEQ ID NO: 1718150 - protein, 20 aa, Staphylococcus aureus
RIWLYLVLLAVFISACNVKE

SEQ ID NO: 1718151 - protein, 17 aa, Staphylococcus aureus
RKLNSKEFYNIKRKDKQ

SEQ ID NO: 1718152 - protein, 28 aa, Staphylococcus aureus
RKNGRKSVFLMLNIKKGIFMTHPNLRQA

SEQ ID NO: 1718153 - protein, 20 aa, Staphylococcus aureus
RKTIMTELAKDIGLEQDIVT

SEQ ID NO: 1718154 - protein, 19 aa, Staphylococcus aureus
RKYKLPYRKNYKVKMKNNK

SEQ ID NO: 1718155 - protein, 33 aa, Staphylococcus aureus; identical to SEQ ID NO: 1579828

SEQ ID NO: 1718156 - protein, 23 aa, Staphylococcus aureus
RLIEKKCMYGGVTEHDGNQIDKN

SEQ ID NO: 1718157 - protein, 19 aa, Staphylococcus aureus
RLIEKTCMYGGVTEHDGNQ

SEQ ID NO: 1718158 - protein, 18 aa, Staphylococcus aureus
RLIFVESDNGITITTFTP

SEQ ID NO: 1718159 - protein, 17 aa, Staphylococcus aureus
RLKSRGMVLKLDRNKRT

SEQ ID NO: 1718160 - protein, 19 aa, Staphylococcus aureus
RLLKHDLLFHDMFVNDDWK

SEQ ID NO: 1718161 - protein, 19 aa, Staphylococcus aureus
RLNGGFFGEVFTVYYNDKY

SEQ ID NO: 1718162 - protein, 17 aa, Staphylococcus aureus
RLNGGFFGQDFTVYYND

SEQ ID NO: 1718163 - protein, 21 aa, Staphylococcus aureus
RLNGLRQVVNRTYRIGTTKRV

SEQ ID NO: 1718164 - protein, 27 aa, Staphylococcus aureus
RLNGLRQVVNRTYRIGTTKRVEVSQGN

SEQ ID NO: 1718165 - protein, 18 aa, Staphylococcus aureus
RLQSAIANKDQTKANENY

SEQ ID NO: 1718166 - protein, 19 aa, Staphylococcus aureus
RLSKKKIFIVFRFSSVTDK

SEQ ID NO: 1718167 - protein, 20 aa, Staphylococcus aureus
RLWLYLVLLAVFISACGMKE

SEQ ID NO: 1718168 - protein, 19 aa, Staphylococcus aureus
RLYRPSLYERLGSDTNLSF

SEQ ID NO: 1718169 - protein, 20 aa, Staphylococcus aureus
RNATELNTAMGQLQHAIADK

SEQ ID NO: 1718170 - protein, 22 aa, Staphylococcus aureus
RNATELNTAMGQLQHAIADKTT

SEQ ID NO: 1718171 - protein, 42 aa, Staphylococcus aureus
RNIELVGNLLPGDYFGTIRFGRKEQLFEIGVKPHTPTITTTA

SEQ ID NO: 1718172 - protein, 25 aa, Staphylococcus aureus
RNNTCKWSSIIWRSPDTKKAKRNKR

SEQ ID NO: 1718173 - protein, 17 aa, Staphylococcus aureus
RNNVPLNKRVSQVDIDS

SEQ ID NO: 1718174 - protein, 23 aa, Staphylococcus aureus
RNNYKARGVNEYQTLNYKTNLER

SEQ ID NO: 1718175 - protein, 17 aa, Staphylococcus aureus
RNTRSAKGFYYVNAIKK

SEQ ID NO: 1718176 - protein, 21 aa, Staphylococcus aureus
RNTRSAKGFYYVNAVKKDEDG

SEQ ID NO: 1718177 - protein, 17 aa, Staphylococcus aureus
RNYTVKYEVNWKTHEIK

SEQ ID NO: 1718178 - protein, 26 aa, Staphylococcus aureus
RPNTKKAKRNKCIQRNNTCKWSSIIW

SEQ ID NO: 1718179 - protein, 37 aa, Staphylococcus aureus
RPTESPGVPRVYTFIGKGDASYTISFKTQGPTIDKLY

SEQ ID NO: 1718180 - protein, 21 aa, Staphylococcus aureus
RPTHVAVCWDMGQSTFRNDLF

SEQ ID NO: 1718181 - protein, 22 aa, Staphylococcus aureus
RPTHVAVCWDMGQSTFRNDMFD

SEQ ID NO: 1718182 - protein, 19 aa, Staphylococcus aureus
RPTSIPTLAPKEEKETNTN

SEQ ID NO: 1718183 - protein, 18 aa, Staphylococcus aureus
RQALTPDKAPLQNAKTQL

SEQ ID NO: 1718184 - protein, 26 aa, Staphylococcus aureus
RQHRIPVIFIRLVLDKHFDDVSSSNK

SEQ ID NO: 1718185 - protein, 33 aa, Staphylococcus aureus
RQKVTDKGVYVWKDRKDYFVGLLGKDIEKYPQG

SEQ ID NO: 1718186 - protein, 17 aa, Staphylococcus aureus
RQLRYIYDVYFDRDDCI

SEQ ID NO: 1718187 - protein, 19 aa, Staphylococcus aureus
RQTEELTILSKVKPDPPRI

SEQ ID NO: 1718188 - protein, 20 aa, Staphylococcus aureus
RRDHVKEAQNLINDYKYTQK

SEQ ID NO: 1718189 - protein, 17 aa, Staphylococcus aureus
RSAKGFYYVNAIKKDEN

SEQ ID NO: 1718190 - protein, 18 aa, Staphylococcus aureus
RSDSIMILSINPKTKKTE

SEQ ID NO: 1718191 - protein, 17 aa, Staphylococcus aureus
RSIESRAAEPRSVSDYQ

SEQ ID NO: 1718192 - protein, 20 aa, Staphylococcus aureus
RTAKGYYFVRTFYRKYKLPY

SEQ ID NO: 1718193 - protein, 26 aa, Staphylococcus aureus
RTGVSASTWAAIIARESNGQVNAYNP

SEQ ID NO: 1718194 - protein, 18 aa, Staphylococcus aureus
RTLIFPYVPDKAVYNAIV

SEQ ID NO: 1718195 - protein, 31 aa, Staphylococcus aureus
RTVPKHVFETARGVLYPGVSDMYDAKQYVKP

SEQ ID NO: 1718196 - protein, 35 aa, Staphylococcus aureus
RVETNGIATLKGVQPHIVIKPEAQQAIKASAENQV

SEQ ID NO: 1718197 - protein, 25 aa, Staphylococcus aureus
RVNNVPTPRTVTFNDTLTYKTFSQD

SEQ ID NO: 1718198 - protein, 21 aa, Staphylococcus aureus
RYSIGMFLALGMSNKAYADEI

SEQ ID NO: 1718199 - protein, 22 aa, Staphylococcus aureus
RYVAAHHPKLPITMTSRSANLP

SEQ ID NO: 1718200 - protein, 24 aa, Staphylococcus aureus
RYYWYDMMPDPGFTQSKYLMIYRG

SEQ ID NO: 1718201 - protein, 20 aa, Staphylococcus aureus
SAADYFKLSNGSAIPDATIT

SEQ ID NO: 1718202 - protein, 18 aa, Staphylococcus aureus
SAHLPSVRGTMIDVTFKY

SEQ ID NO: 1718203 - protein, 28 aa, Staphylococcus aureus
SAKEIARTDLGRYFDRFADKLDKTQTNT

SEQ ID NO: 1718204 - protein, 26 aa, Staphylococcus aureus
SANAIIQKPIRSVQEVQSALTNVNRV

SEQ ID NO: 1718205 - protein, 27 aa, Staphylococcus aureus
SANPNGRRPGGVQGLNEYQISQLFSDE

SEQ ID NO: 1718206 - protein, 30 aa, Staphylococcus aureus
SAPSLPILRRGQHYKLHFDFDATPAGSVYF

SEQ ID NO: 1718207 - protein, 21 aa, Staphylococcus aureus
SASDYFKLSNGSAIPDATITW

SEQ ID NO: 1718208 - protein, 18 aa, Staphylococcus aureus
SDAKEIALITAKQTGDGY

SEQ ID NO: 1718209 - protein, 21 aa, Staphylococcus aureus
SDGNVIYTFTDYVNTKDDVKA

SEQ ID NO: 1718210 - protein, 21 aa, Staphylococcus aureus
SDGQRQFTLNGQVIQIMDIIN

SEQ ID NO: 1718211 - protein, 18 aa, Staphylococcus aureus
SDITDDFTPVDITDPSGE

SEQ ID NO: 1718212 - protein, 17 aa, Staphylococcus aureus
SDITFKVSATDNVNNTT

SEQ ID NO: 1718213 - protein, 28 aa, Staphylococcus aureus
SDKKNGSLAITGRVSMNQAFNSNITFKV

SEQ ID NO: 1718214 - protein, 17 aa, Staphylococcus aureus
SDTSEFEISYGRNLDIT

SEQ ID NO: 1718215 - protein, 24 aa, Staphylococcus aureus
SDVVKSSFGYHIIKADKPTDFNSQ

SEQ ID NO: 1718216 - protein, 17 aa, Staphylococcus aureus
SDWLSTNFGVRFRYNAL

SEQ ID NO: 1718217 - protein, 17 aa, Staphylococcus aureus
SEDAHPIVLGNTEKVVV

SEQ ID NO: 1718218 - protein, 19 aa, Staphylococcus aureus
SEGPFGHVAYVESVNSDGS

SEQ ID NO: 1718219 - protein, 19 aa, Staphylococcus aureus
SEIKPRMKRSADVAEVAEK

SEQ ID NO: 1718220 - protein, 19 aa, Staphylococcus aureus
SELNTAMSNLQRGINDEAA

SEQ ID NO: 1718221 - protein, 22 aa, Staphylococcus aureus
SERTKRLKLKQLLNSRNVEKDL

SEQ ID NO: 1718222 - protein, 27 aa, Staphylococcus aureus
SESNVKGLGIISHRTINASAAEELSYI

SEQ ID NO: 1718223 - protein, 37 aa, Staphylococcus aureus
SFASNLANMNFLRWVNFPQDYTVTWTNAKIANRPTDG

SEQ ID NO: 1718224 - protein, 38 aa, Staphylococcus aureus
SFTSNLANMNFLRWVNFPQDYTVSWTNAKIASRPTDGG

SEQ ID NO: 1718225 - protein, 25 aa, Staphylococcus aureus
SFYNLNLRCKLAFKYMGEVIESKQI

SEQ ID NO: 1718226 - protein, 27 aa, Staphylococcus aureus
SGESLNIIASRYGVSVDQLMAANNLRG

SEQ ID NO: 1718227 - protein, 17 aa, Staphylococcus aureus
SGEVIAKGTFDLNTKTI

SEQ ID NO: 1718228 - protein, 23 aa, Staphylococcus aureus
SGLPIHEWLMLKQFSKYKSAPSL

SEQ ID NO: 1718229 - protein, 18 aa, Staphylococcus aureus
SGYGHIQNATGLPTDGFT

SEQ ID NO: 1718230 - protein, 17 aa, Staphylococcus aureus
SHDFKIRNRSGQVIYDW

SEQ ID NO: 1718231 - protein, 37 aa, Staphylococcus aureus
SHDFKIRNRSGQVIYEWPTVHINSLRDLARAGDYFSE

SEQ ID NO: 1718232 - protein, 18 aa, Staphylococcus aureus
SIAALTILTSVTGVGTTM

SEQ ID NO: 1718233 - protein, 38 aa, Staphylococcus aureus
SIEAKSSALPLVILAAVARYGINYAIKTYGKKATQTAI

SEQ ID NO: 1718234 - protein, 23 aa, Staphylococcus aureus
SIGLHSGSHVYVERRTMEPTATN

SEQ ID NO: 1718235 - protein, 17 aa, Staphylococcus aureus
SIIDDFFIETKLNRPKH

SEQ ID NO: 1718236 - protein, 29 aa, Staphylococcus aureus
SISPYKGILRVGAGTGFVVGKNTILTNRH

SEQ ID NO: 1718237 - protein, 17 aa, Staphylococcus aureus
SKFKGKKLDIFGIDYNG

SEQ ID NO: 1718238 - protein, 23 aa, Staphylococcus aureus
SKGKITYLKGEAMQYDLSTTGGN

SEQ ID NO: 1718239 - protein, 22 aa, Staphylococcus aureus
SKNQCTWWAFKRRAQVGKPVSN

SEQ ID NO: 1718240 - protein, 24 aa, Staphylococcus aureus
SKQAGHPVFYVYAGNQGNASVNLG

SEQ ID NO: 1718241 - protein, 24 aa, Staphylococcus aureus
SKSIFPSCRVAYMVLPYSIMKKYH

SEQ ID NO: 1718242 - protein, 22 aa, Staphylococcus aureus
SKSPYHRIVSLMPSNTEILYEL

SEQ ID NO: 1718243 - protein, 20 aa, Staphylococcus aureus
SKVVKKQAAKDEIDQLQVAQ

SEQ ID NO: 1718244 - protein, 19 aa, Staphylococcus aureus
SKYAYVLYPGLSKSDFKPK

SEQ ID NO: 1718245 - protein, 19 aa, Staphylococcus aureus
SLAVALGVTGYAASTGHEA

SEQ ID NO: 1718246 - protein, 28 aa, Staphylococcus aureus
SLDTGFYKEPKYNLGDYVWEDTNKDGIQ

SEQ ID NO: 1718247 - protein, 18 aa, Staphylococcus aureus
SLIYRYDATLGTAITTND

SEQ ID NO: 1718248 - protein, 26 aa, Staphylococcus aureus
SLKDLARAGDYFSEAGAPASTKAFGR

SEQ ID NO: 1718249 - protein, 23 aa, Staphylococcus aureus
SLKELPKGATVYVFNNPAEQGRF

SEQ ID NO: 1718250 - protein, 29 aa, Staphylococcus aureus
SLMINHYFAVPGYHAHKFVTPGHASIKIN

SEQ ID NO: 1718251 - protein, 25 aa, Staphylococcus aureus
SLNNAMKGLRYSIANETTVKASQNY

SEQ ID NO: 1718252 - protein, 27 aa, Staphylococcus aureus
SLRDLARAGDYFSEANAPAATKALGEQ

SEQ ID NO: 1718253 - protein, 22 aa, Staphylococcus aureus
SLRYIHDIWGYIAPNTKKEKQP

SEQ ID NO: 1718254 - protein, 20 aa, Staphylococcus aureus
SLSNKWLWQKPNGSIHATLQ

SEQ ID NO: 1718255 - protein, 17 aa, Staphylococcus aureus
SMAALAILTSATGINAA

SEQ ID NO: 1718256 - protein, 25 aa, Staphylococcus aureus
SMIEMMFGVHFIKGGMYGMAQGLAQ

SEQ ID NO: 1718257 - protein, 17 aa, Staphylococcus aureus
SMNQAFNSDITFKVSAT

SEQ ID NO: 1718258 - protein, 24 aa, Staphylococcus aureus
SNAKLPVIFWMHGGGYIAGDKQYK

SEQ ID NO: 1718259 - protein, 21 aa, Staphylococcus aureus
SNANGMTVYWYHDNQRALADT

SEQ ID NO: 1718260 - protein, 25 aa, Staphylococcus aureus
SNDAKAFFSYEWKGLEIAKKLADDE

SEQ ID NO: 1718261 - protein, 28 aa, Staphylococcus aureus
SNDAKAFFSYEWKGLEIAKKLADEAKKD

SEQ ID NO: 1718262 - protein, 23 aa, Staphylococcus aureus
SNDEKQRIITAFMNKNQNIRGYL

SEQ ID NO: 1718263 - protein, 19 aa, Staphylococcus aureus
SNGSAIPDATITWVSGQAP

SEQ ID NO: 1718264 - protein, 23 aa, Staphylococcus aureus
SNKYGISIAKLKSLNNLTSNLIF

SEQ ID NO: 1718265 - protein, 20 aa, Staphylococcus aureus
SNLKALGFVPKYTVETGLKD

SEQ ID NO: 1718266 - protein, 26 aa, Staphylococcus aureus
SNWIYEGFMPLIYKGEMMDLSRGRAI

SEQ ID NO: 1718267 - protein, 17 aa, Staphylococcus aureus
SPDTWKNTVGNTHKTAV

SEQ ID NO: 1718268 - protein, 20 aa, Staphylococcus aureus
SPDVYPGMEEQLLASLKRHH

SEQ ID NO: 1718269 - protein, 20 aa, Staphylococcus aureus
SPDVYPGMEQQLLASLKKHH

SEQ ID NO: 1718270 - protein, 24 aa, Staphylococcus aureus
SPKLKLYADKFIDTYMNISKDSKE

SEQ ID NO: 1718271 - protein, 25 aa, Staphylococcus aureus
SPLGKLRAGLDLLKKPTQMRDGDIS

SEQ ID NO: 1718272 - protein, 27 aa, Staphylococcus aureus
SPVFNEKNKVIGIHWGGVPNEFNGAVF

SEQ ID NO: 1718273 - protein, 24 aa, Staphylococcus aureus
SPVPEDHAYIRFPVSDGTQELKIV

SEQ ID NO: 1718274 - protein, 19 aa, Staphylococcus aureus
SPWVKEASAANVTGIAGTN

SEQ ID NO: 1718275 - protein, 19 aa, Staphylococcus aureus
SPWVKEASAANVTGIVGTN

SEQ ID NO: 1718276 - protein, 19 aa, Staphylococcus aureus
SPWVKEASAATVAGIAGTN

SEQ ID NO: 1718277 - protein, 24 aa, Staphylococcus aureus
SQERKTNWVKCGLGTVGGAGTGGL

SEQ ID NO: 1718278 - protein, 18 aa, Staphylococcus aureus
SQIEGASTVAGVKQVSTT

SEQ ID NO: 1718279 - protein, 17 aa, Staphylococcus aureus
SQKVGMNGYKLLKLNLS

SEQ ID NO: 1718280 - protein, 17 aa, Staphylococcus aureus
SQLDKAKSIGIINEKCV

SEQ ID NO: 1718281 - protein, 20 aa, Staphylococcus aureus
SRAAEPRSVSSYQNADSSYY

SEQ ID NO: 1718282 - protein, 28 aa, Staphylococcus aureus
SREVKYTYGYKTGGDFSINRGGLPGNIT

SEQ ID NO: 1718283 - protein, 17 aa, Staphylococcus aureus
SRNDVAFVYPKNQSEPI

SEQ ID NO: 1718284 - protein, 20 aa, Staphylococcus aureus
SRTKEALPLNKSNQTSQREI

SEQ ID NO: 1718285 - protein, 23 aa, Staphylococcus aureus
SSDKHYRLFLKYSDKQQTIIGGH

SEQ ID NO: 1718286 - protein, 19 aa, Staphylococcus aureus
SSDTSEFEITYGRNMDVTH

SEQ ID NO: 1718287 - protein, 17 aa, Staphylococcus aureus
SSLFVATLTTATLVSST

SEQ ID NO: 1718288 - protein, 19 aa, Staphylococcus aureus
SSNGFKVDRHPTRGSILQT

SEQ ID NO: 1718289 - protein, 24 aa, Staphylococcus aureus
SSQYTGSWHNIWYLYNSDPVNAKK

SEQ ID NO: 1718290 - protein, 24 aa, Staphylococcus aureus
SSSRNMAALKICRSTKTAIYHTIQ

SEQ ID NO: 1718291 - protein, 20 aa, Staphylococcus aureus
SSVGYKQIEYMFSKEKEDET

SEQ ID NO: 1718292 - protein, 19 aa, Staphylococcus aureus
SSVLAHYWGGNKMNIRQDL

SEQ ID NO: 1718293 - protein, 27 aa, Staphylococcus aureus
STAPKRLNTRMRIAAVQPSSTDSKNVN

SEQ ID NO: 1718294 - protein, 24 aa, Staphylococcus aureus
STEEERLAAKHLVEQALNQAIDQI

SEQ ID NO: 1718295 - protein, 29 aa, Staphylococcus aureus
STITIRPEDYVVFIPPVGHQIRALIYYNN

SEQ ID NO: 1718296 - protein, 19 aa, Staphylococcus aureus
STMASELNTAMSNLQRGIN

SEQ ID NO: 1718297 - protein, 27 aa, Staphylococcus aureus
SVAPKRLNAKMRFAVAQPAAVASNNVN

SEQ ID NO: 1718298 - protein, 25 aa, Staphylococcus aureus
SVENRKANGYKLFKGDIEITTSDVN

SEQ ID NO: 1718299 - protein, 25 aa, Staphylococcus aureus
SVENRKANGYKLYKDDIEITTSDVN

SEQ ID NO: 1718300 - protein, 18 aa, Staphylococcus aureus
SVMARGLREFPIDITAIV

SEQ ID NO: 1718301 - protein, 25 aa, Staphylococcus aureus
SWIDDGFMPLIYKGEMMDLSRGRAI

SEQ ID NO: 1718302 - protein, 17 aa, Staphylococcus aureus
SYFADKGLHSIKDIINK

SEQ ID NO: 1718303 - protein, 17 aa, Staphylococcus aureus
SYQLTWDNGLVLYSNKA

SEQ ID NO: 1718304 - protein, 23 aa, Staphylococcus aureus
SYVKTPSNKVLGFYPTNANPNVR

SEQ ID NO: 1718305 - protein, 21 aa, Staphylococcus aureus
TAGLATIAFAGHDAQAAEQNN

SEQ ID NO: 1718306 - protein, 22 aa, Staphylococcus aureus
TAGYTFPLAMLKNEAGINATKD

SEQ ID NO: 1718307 - protein, 17 aa, Staphylococcus aureus
TAHLPSVRGTMIDVTFK

SEQ ID NO: 1718308 - protein, 18 aa, Staphylococcus aureus
TAKELLATAVQRLAADHT

SEQ ID NO: 1718309 - protein, 19 aa, Staphylococcus aureus
TASESKPRVTRSADVAEAK

SEQ ID NO: 1718310 - protein, 33 aa, Staphylococcus aureus; identical to SEQ ID NO: 1579413

SEQ ID NO: 1718311 - protein, 24 aa, Staphylococcus aureus
TATYKVVSTVPKHVFETNRGAVFP

SEQ ID NO: 1718312 - protein, 18 aa, Staphylococcus aureus
TAVVKFFNVFGPRQDPKS

SEQ ID NO: 1718313 - protein, 19 aa, Staphylococcus aureus
TAYDQAVAAAKAILNKQTG

SEQ ID NO: 1718314 - protein, 25 aa, Staphylococcus aureus
TDAARAIDALPHLNNAQKADVKSKI

SEQ ID NO: 1718315 - protein, 28 aa, Staphylococcus aureus
TDARNAVNDKAREAITNINATPGATREE

SEQ ID NO: 1718316 - protein, 21 aa, Staphylococcus aureus
TDGQLWKKVTDSLHDSDIILS

SEQ ID NO: 1718317 - protein, 25 aa, Staphylococcus aureus
TDGQLWKNVRDALKEANIIDGNENE

SEQ ID NO: 1718318 - protein, 25 aa, Staphylococcus aureus
TDGQLWKNVRDALKEASIIDKTDQE

SEQ ID NO: 1718319 - protein, 17 aa, Staphylococcus aureus
TDGQRQFTLNGQVIQVL

SEQ ID NO: 1718320 - protein, 30 aa, Staphylococcus aureus
TDKKKQWIKRYKLHKALQILIMVQMQIKML

SEQ ID NO: 1718321 - protein, 21 aa, Staphylococcus aureus
TDKRKTCMYGGVTEHNGNQLD

SEQ ID NO: 1718322 - protein, 49 aa, Staphylococcus aureus
TDMTPKYEDLRAYYTKPSFEFEKQFGFMLKPWTTVRFMNVIPNRFIYKI

SEQ ID NO: 1718323 - protein, 24 aa, Staphylococcus aureus
TDSELWKNVRDALKDANIIDKTNN

SEQ ID NO: 1718324 - protein, 25 aa, Staphylococcus aureus
TDTIYKREYKHFYTPEEAQRAQENS

SEQ ID NO: 1718325 - protein, 25 aa, Staphylococcus aureus
TEALNLRAKIDLILGDEKDPIRVTN

SEQ ID NO: 1718326 - protein, 17 aa, Staphylococcus aureus
TEFWKWYKQQTDFNFDE

SEQ ID NO: 1718327 - protein, 25 aa, Staphylococcus aureus
TEINPKFKDLRAYYTKPSLEFKNEI

SEQ ID NO: 1718328 - protein, 27 aa, Staphylococcus aureus
TEINPKFKDLRAYYTKPSLEFKNEIGI

SEQ ID NO: 1718329 - protein, 18 aa, Staphylococcus aureus
TELFTLKKGSSFKQKAKP

SEQ ID NO: 1718330 - protein, 25 aa, Staphylococcus aureus
TELNGAMTALKAVIADKERTKASGN

SEQ ID NO: 1718331 - protein, 35 aa, Staphylococcus aureus
TESPGAPKVYTFIGKGDASYTISFKTQGPTTNKLY

SEQ ID NO: 1718332 - protein, 22 aa, Staphylococcus aureus
TESPGVPKVYTFIGKSDASYTI

SEQ ID NO: 1718333 - protein, 18 aa, Staphylococcus aureus
TFELHKKLQEHRMADVID

SEQ ID NO: 1718334 - protein, 17 aa, Staphylococcus aureus
TFELNKKLQEHRMGDVI

SEQ ID NO: 1718335 - protein, 23 aa, Staphylococcus aureus
TGDGYQWVIKFNKGHAPHENMIY

SEQ ID NO: 1718336 - protein, 40 aa, Staphylococcus aureus
TGDGYQWVIKFNKGHAPHQNMIFWFALPADQVPVGRTDFV

SEQ ID NO: 1718337 - protein, 25 aa, Staphylococcus aureus
TGIPLDPSSLVYIVYPNEHTRDGGT

SEQ ID NO: 1718338 - protein, 19 aa, Staphylococcus aureus
TGKVLYAFYQNPKLVNAAI

SEQ ID NO: 1718339 - protein, 17 aa, Staphylococcus aureus
TGLKRGVANHNQVVQSD

SEQ ID NO: 1718340 - protein, 17 aa, Staphylococcus aureus
TGNGASASDYFKLSNGS

SEQ ID NO: 1718341 - protein, 19 aa, Staphylococcus aureus
TGNTEFWATSSDVLKLKAN

SEQ ID NO: 1718342 - protein, 43 aa, Staphylococcus aureus
TGPIIELGLKTASTWKKFEVYEGDKKLPVELVSYDSDKDYAYI

SEQ ID NO: 1718343 - protein, 24 aa, Staphylococcus aureus
TGSKKGWLYGYSEIDSSHFTDRDK

SEQ ID NO: 1718344 - protein, 25 aa, Staphylococcus aureus
THGDPHALKAFPFAINQDNYPNGGF

SEQ ID NO: 1718345 - protein, 20 aa, Staphylococcus aureus
THPNLRQAVVNAIDQDQFIK

SEQ ID NO: 1718346 - protein, 23 aa, Staphylococcus aureus
TIHATLLQFSWYSHIQVYGPESW

SEQ ID NO: 1718347 - protein, 19 aa, Staphylococcus aureus
TILTSLGFAENISDQSHSI

SEQ ID NO: 1718348 - protein, 18 aa, Staphylococcus aureus
TINNPVGLNAKYYRGDEV

SEQ ID NO: 1718349 - protein, 26 aa, Staphylococcus aureus
TIPPEDFTVFIPPVGKQIRALIYYNK

SEQ ID NO: 1718350 - protein, 21 aa, Staphylococcus aureus
TIQGKEHFEGYGSVDIQKKPT

SEQ ID NO: 1718351 - protein, 40 aa, Staphylococcus aureus
TITIPPEDFTVFIPPVGKQIRALIYYNKVVASNMSNAVTI

SEQ ID NO: 1718352 - protein, 25 aa, Staphylococcus aureus
TITIRPQDYIVFIPPVGKQIRAVVY

SEQ ID NO: 1718353 - protein, 19 aa, Staphylococcus aureus
TKAEELLKQTTYPTMDPNT

SEQ ID NO: 1718354 - protein, 22 aa, Staphylococcus aureus
TKAFGRQTFEYINGERPTESPG

SEQ ID NO: 1718355 - protein, 26 aa, Staphylococcus aureus
TKDDVKATLTMPAYIDPENVKKTGNV

SEQ ID NO: 1718356 - protein, 18 aa, Staphylococcus aureus
TKEDNKGIISHDVSEFKI

SEQ ID NO: 1718357 - protein, 17 aa, Staphylococcus aureus
TKIQEIDRVLASHPDVA

SEQ ID NO: 1718358 - protein, 19 aa, Staphylococcus aureus
TKKATGYYFVNKVYDDISK

SEQ ID NO: 1718359 - protein, 17 aa, Staphylococcus aureus
TKKIDGWVTLIAMILRK

SEQ ID NO: 1718360 - protein, 17 aa, Staphylococcus aureus
TKKNIGYHFLDKPKITV

SEQ ID NO: 1718361 - protein, 20 aa, Staphylococcus aureus
TKKNIGYHFLNKAKITVKKE

SEQ ID NO: 1718362 - protein, 19 aa, Staphylococcus aureus
TKKNIGYHFLNKSKINVKK

SEQ ID NO: 1718363 - protein, 23 aa, Staphylococcus aureus
TKNKEGIGYFGYNFYIQNKDKLK

SEQ ID NO: 1718364 - protein, 18 aa, Staphylococcus aureus
TKNLEDFYDKEGFRDEEF

SEQ ID NO: 1718365 - protein, 42 aa, Staphylococcus aureus
TKPSLEFKNEIGIILKKWTTIRFMNIVPDYFIYKIALVGKDD

SEQ ID NO: 1718366 - protein, 47 aa, Staphylococcus aureus
TKPSLEFKNEIGIILKKWTTIRFMNIVPDYFIYKIALVGKDDKKYGE

SEQ ID NO: 1718367 - protein, 47 aa, Staphylococcus aureus
TKPSLEFKNELGIIIKKWTTIRFMNIVPDYFIYKIALVGKDDKKYGE

SEQ ID NO: 1718368 - protein, 25 aa, Staphylococcus aureus
TKQILRLLFLLAMYELGKYVTEQVY

SEQ ID NO: 1718369 - protein, 20 aa, Staphylococcus aureus
TKTITYKFTDYVDRYENVNA

SEQ ID NO: 1718370 - protein, 18 aa, Staphylococcus aureus
TLALTACGEKEKPKKEEN

SEQ ID NO: 1718371 - protein, 31 aa, Staphylococcus aureus; identical to SEQ ID NO: 1577749

SEQ ID NO: 1718372 - protein, 32 aa, Staphylococcus aureus
TLENRGWDFDGSYGWQCFDLVNVYWNHIYGHG

SEQ ID NO: 1718373 - protein, 17 aa, Staphylococcus aureus
TLGICLVLLIILIGGYF

SEQ ID NO: 1718374 - protein, 22 aa, Staphylococcus aureus
TMGVICATQLWHSNHANALVTE

SEQ ID NO: 1718375 - protein, 17 aa, Staphylococcus aureus
TNAFRPGGAQQLNEYQL

SEQ ID NO: 1718376 - protein, 29 aa, Staphylococcus aureus
TNDAKAFFSYEWKGLEIAKNLADQAKKDD

SEQ ID NO: 1718377 - protein, 25 aa, Staphylococcus aureus
TNEEKGKDIGPVRAAYEEGLNNINT

SEQ ID NO: 1718378 - protein, 18 aa, Staphylococcus aureus
TNKFGLRDKTEWICYKTD

SEQ ID NO: 1718379 - protein, 25 aa, Staphylococcus aureus
TNNQLRKAMKFDQSFKPSQIKCAIL

SEQ ID NO: 1718380 - protein, 18 aa, Staphylococcus aureus
TNNTYRQTIYVNPSGDNV

SEQ ID NO: 1718381 - protein, 23 aa, Staphylococcus aureus
TNVAPYSGVTWMGAGTGFVVGNH

SEQ ID NO: 1718382 - protein, 24 aa, Staphylococcus aureus
TNVAPYSGVTWMGAGTGFVVGNHT

SEQ ID NO: 1718383 - protein, 25 aa, Staphylococcus aureus
TNVNRVNDRLTLAINQLVPLADNSA

SEQ ID NO: 1718384 - protein, 20 aa, Staphylococcus aureus
TNVRGSFEQVAFAKRKNATT

SEQ ID NO: 1718385 - protein, 22 aa, Staphylococcus aureus
TNVRGSFEQVAFAKRKNATTDK

SEQ ID NO: 1718386 - protein, 23 aa, Staphylococcus aureus
TNVSGSFEQVAFAKRENAITDKT

SEQ ID NO: 1718387 - protein, 24 aa, Staphylococcus aureus
TPAYYKLYGDKIVGFDTNDFPITW

SEQ ID NO: 1718388 - protein, 18 aa, Staphylococcus aureus
TPEAVILSGFDPIRREIA

SEQ ID NO: 1718389 - protein, 22 aa, Staphylococcus aureus
TPGICLVLLIILIGGYVIMTKT

SEQ ID NO: 1718390 - protein, 26 aa, Staphylococcus aureus
TPITKTATYKVVRTVPKQVFETTRGV

SEQ ID NO: 1718391 - protein, 32 aa, Staphylococcus aureus
TPSNVEQAIDWCIKHNVDIVNISFGFPKYNYK

SEQ ID NO: 1718392 - protein, 24 aa, Staphylococcus aureus
TPTYYKLYGDKIVGFDTNDFPITW

SEQ ID NO: 1718393 - protein, 26 aa, Staphylococcus aureus
TQELKKYYSGTGYNFQNVSGYREGNK

SEQ ID NO: 1718394 - protein, 17 aa, Staphylococcus aureus
TQFIIDEILAIKLPAEV

SEQ ID NO: 1718395 - protein, 17 aa, Staphylococcus aureus
TQFIVDEILAIKLPAEE

SEQ ID NO: 1718396 - protein, 17 aa, Staphylococcus aureus
TQLYHITATNAYHKDTE

SEQ ID NO: 1718397 - protein, 17 aa, Staphylococcus aureus
TQLYHIVATNAYHKDTE

SEQ ID NO: 1718398 - protein, 18 aa, Staphylococcus aureus
TQVRPLRIMSPHSVENGK

SEQ ID NO: 1718399 - protein, 20 aa, Staphylococcus aureus
TRDVKIVSSIEYGENIHEDY

SEQ ID NO: 1718400 - protein, 30 aa, Staphylococcus aureus
TSEGAVFIKGGDGFDFGHVERFIQNPPHGS

SEQ ID NO: 1718401 - protein, 17 aa, Staphylococcus aureus
TSKLIDVTDKFKITYSN

SEQ ID NO: 1718402 - protein, 18 aa, Staphylococcus aureus
TSLINFLPIQSLLSALKN

SEQ ID NO: 1718403 - protein, 19 aa, Staphylococcus aureus
TSNGTTWSWSYEAANGQTT

SEQ ID NO: 1718404 - protein, 23 aa, Staphylococcus aureus
TSNLIFPNQVLKVSGSSNSTSNS

SEQ ID NO: 1718405 - protein, 25 aa, Staphylococcus aureus
TTDEISKLKQAFINANRDVITLAEG

SEQ ID NO: 1718406 - protein, 29 aa, Staphylococcus aureus
TTEGAVFIKGGDDFDFGHVERFIQNPPHG

SEQ ID NO: 1718407 - protein, 23 aa, Staphylococcus aureus
TTGADGWGFLFSKGNAEEYLTNG

SEQ ID NO: 1718408 - protein, 25 aa, Staphylococcus aureus
TTIKPRTLNRLAVNTVAAPQQGTNV

SEQ ID NO: 1718409 - protein, 17 aa, Staphylococcus aureus
TTLKSWIDDGFMPLIYK

SEQ ID NO: 1718410 - protein, 19 aa, Staphylococcus aureus
TTLPNGWTSNLTKADKNNG

SEQ ID NO: 1718411 - protein, 18 aa, Staphylococcus aureus
TTLPNGWTSNLTKSDNKN

SEQ ID NO: 1718412 - protein, 19 aa, Staphylococcus aureus
TTLPSGWTSNLTKADKNNG

SEQ ID NO: 1718413 - protein, 18 aa, Staphylococcus aureus
TTLPSGWTSNLTKSDNKN

SEQ ID NO: 1718414 - protein, 25 aa, Staphylococcus aureus
TTPKYIKFRHDYNIVEYNDGTFEYG

SEQ ID NO: 1718415 - protein, 18 aa, Staphylococcus aureus
TTSESPTLVQMVTLSSDN

SEQ ID NO: 1718416 - protein, 18 aa, Staphylococcus aureus
TTTGKKPASINAYNNSMH

SEQ ID NO: 1718417 - protein, 18 aa, Staphylococcus aureus
TTTVPGLRNNIAGNEKAQ

SEQ ID NO: 1718418 - protein, 31 aa, Staphylococcus aureus; identical to SEQ ID NO: 1578282

SEQ ID NO: 1718419 - protein, 18 aa, Staphylococcus aureus
TVAWHDSPDTWKHTVGNT

SEQ ID NO: 1718420 - protein, 24 aa, Staphylococcus aureus
TVFAALTLVVAGIPIWQLNSSQKN

SEQ ID NO: 1718421 - protein, 26 aa, Staphylococcus aureus
TVGTASILVGTTLIFGLGNQEAKAAE

SEQ ID NO: 1718422 - protein, 28 aa, Staphylococcus aureus
TVGTFSTVIATLVFLGFNTSQAHAAETN

SEQ ID NO: 1718423 - protein, 28 aa, Staphylococcus aureus
TVIGEKVVAYGPIWRLLKVPENVSHLKI

SEQ ID NO: 1718424 - protein, 23 aa, Staphylococcus aureus
TVKGAYKTYAYVVSYTPTNGDEK

SEQ ID NO: 1718425 - protein, 24 aa, Staphylococcus aureus
TVKPKANQAIEAKAEDTKESIDHS

SEQ ID NO: 1718426 - protein, 23 aa, Staphylococcus aureus
TVNEKAREAITNINATPGATREE

SEQ ID NO: 1718427 - protein, 30 aa, Staphylococcus aureus
TVPKQVFETTRGVLYPGVSDMYDAKQYVKP

SEQ ID NO: 1718428 - protein, 18 aa, Staphylococcus aureus
TVSESKPRVTRSADVVEA

SEQ ID NO: 1718429 - protein, 29 aa, Staphylococcus aureus
TVSGVPLDPSALVYLVIPTSQTRDGGSEA

SEQ ID NO: 1718430 - protein, 29 aa, Staphylococcus aureus
TVTDIPLDPSALVYLVIPTSQTRDGGSEA

SEQ ID NO: 1718431 - protein, 28 aa, Staphylococcus aureus
TVTGIPLDPSSLVYIVYPNEHTRDGGTE

SEQ ID NO: 1718432 - protein, 39 aa, Staphylococcus aureus; identical to SEQ ID NO: 1579129

SEQ ID NO: 1718433 - protein, 25 aa, Staphylococcus aureus
TVVDNLPGYTLINGGKVGVFSHAMV

SEQ ID NO: 1718434 - protein, 18 aa, Staphylococcus aureus
TYDEFKKAPKVNVGSLAD

SEQ ID NO: 1718435 - protein, 29 aa, Staphylococcus aureus
TYHFESDGTYFAWNYHATGANGADMSAQA

SEQ ID NO: 1718436 - protein, 27 aa, Staphylococcus aureus
TYHNKELDFAFGLSMTSKNIARYENIN

SEQ ID NO: 1718437 - protein, 18 aa, Staphylococcus aureus
TYILEMIGQLKSQFQDLE

SEQ ID NO: 1718438 - protein, 26 aa, Staphylococcus aureus
TYSDALMPYNFMSSVFKNNDGKSGVL

SEQ ID NO: 1718439 - protein, 18 aa, Staphylococcus aureus
TYSVEFSTPAGYTPTTAN

SEQ ID NO: 1718440 - protein, 17 aa, Staphylococcus aureus
TYTVKFETPAGYLPTKE

SEQ ID NO: 1718441 - protein, 20 aa, Staphylococcus aureus
VAAHHPKLPITMTSRTAHLP

SEQ ID NO: 1718442 - protein, 22 aa, Staphylococcus aureus
VADTKAKVLDKINAIQTQARVK

SEQ ID NO: 1718443 - protein, 29 aa, Staphylococcus aureus
VAEAIERINKAKVSGVKAIEATTTAQELE

SEQ ID NO: 1718444 - protein, 18 aa, Staphylococcus aureus
VAGIPIWQLNSSQKNINK

SEQ ID NO: 1718445 - protein, 24 aa, Staphylococcus aureus
VAPNNKFTMYRVFGSKKNRTALGI

SEQ ID NO: 1718446 - protein, 21 aa, Staphylococcus aureus
VAPYSGVTWMGAGTGFVVGNQ

SEQ ID NO: 1718447 - protein, 17 aa, Staphylococcus aureus
VCTPIKKEETHESRKVE

SEQ ID NO: 1718448 - protein, 17 aa, Staphylococcus aureus
VCVLTIGAYFLGHQTTK

SEQ ID NO: 1718449 - protein, 25 aa, Staphylococcus aureus
VDAVLKRFNVALGDIEAVITEKEHS

SEQ ID NO: 1718450 - protein, 25 aa, Staphylococcus aureus
VDAVLKRFNVTLGDIEAVITEKENS

SEQ ID NO: 1718451 - protein, 19 aa, Staphylococcus aureus
VDELKRYIGENQFAKGSML

SEQ ID NO: 1718452 - protein, 24 aa, Staphylococcus aureus
VDGITALHRTYFVFAENKKVLYQE

SEQ ID NO: 1718453 - protein, 24 aa, Staphylococcus aureus
VDIFALKDYETWHTYMLAQETFTG

SEQ ID NO: 1718454 - protein, 22 aa, Staphylococcus aureus
VDYAGYPWPGYDDIVSEIIESN

SEQ ID NO: 1718455 - protein, 19 aa, Staphylococcus aureus
VEKAFAIQAGREIRVIVSP

SEQ ID NO: 1718456 - protein, 18 aa, Staphylococcus aureus
VEKDGRDSTNQSMVESTT

SEQ ID NO: 1718457 - protein, 21 aa, Staphylococcus aureus
VELKEKGMFVIKKKDDNTYEC

SEQ ID NO: 1718458 - protein, 26 aa, Staphylococcus aureus
VESRAAEPRSVSSYQNADSSYYVENA

SEQ ID NO: 1718459 - protein, 17 aa, Staphylococcus aureus
VEVKAKGMFILKKKDDK

SEQ ID NO: 1718460 - protein, 19 aa, Staphylococcus aureus
VEVKAKGMFILKKKDDNTY

SEQ ID NO: 1718461 - protein, 22 aa, Staphylococcus aureus
VEVPVKVYPVANAKAPSRDLKG

SEQ ID NO: 1718462 - protein, 24 aa, Staphylococcus aureus
VFDSKGGFYFTDFRGYSTNPLGGV

SEQ ID NO: 1718463 - protein, 18 aa, Staphylococcus aureus
VFETNRGAVFPGVSDVYD

SEQ ID NO: 1718464 - protein, 18 aa, Staphylococcus aureus
VGDFIKLGIKPIAVSDIT

SEQ ID NO: 1718465 - protein, 19 aa, Staphylococcus aureus
VGGGFEIMENFKIDKNTFT

SEQ ID NO: 1718466 - protein, 17 aa, Staphylococcus aureus
VGIASVTLGTLLISGGV

SEQ ID NO: 1718467 - protein, 26 aa, Staphylococcus aureus
VGINAKYYRGDEVNFTMGVSDRHSGI

SEQ ID NO: 1718468 - protein, 18 aa, Staphylococcus aureus
VGLLIFTTLFWKTSLGEF

SEQ ID NO: 1718469 - protein, 27 aa, Staphylococcus aureus
VGLNAKYYRGDEVSFTMGVSDRHSGIK

SEQ ID NO: 1718470 - protein, 19 aa, Staphylococcus aureus
VGNQIRALIFYNNVVASNM

SEQ ID NO: 1718471 - protein, 28 aa, Staphylococcus aureus
VGQPELRRNSMDAFPVLAYSFSNKENDL

SEQ ID NO: 1718472 - protein, 24 aa, Staphylococcus aureus
VGTASILVGTTLIFGLGNQEAKAA

SEQ ID NO: 1718473 - protein, 17 aa, Staphylococcus aureus
VGTTLIFGLGNQEAKAA

SEQ ID NO: 1718474 - protein, 17 aa, Staphylococcus aureus
VGTYINASNKGAPYNLP

SEQ ID NO: 1718475 - protein, 24 aa, Staphylococcus aureus
VGVFKPHAVRDMNGHALPLTKDGN

SEQ ID NO: 1718476 - protein, 18 aa, Staphylococcus aureus
VGYKEIEIIFSRSKEEII

SEQ ID NO: 1718477 - protein, 18 aa, Staphylococcus aureus
VGYKRLEIDFSKEDRDIS

SEQ ID NO: 1718478 - protein, 22 aa, Staphylococcus aureus
VHADKSGKVILINGDTDAKKVK

SEQ ID NO: 1718479 - protein, 19 aa, Staphylococcus aureus
VIDLGDKLQFERMGDVLNS

SEQ ID NO: 1718480 - protein, 25 aa, Staphylococcus aureus
VIHACVLLFIIISIALIFHRLQTKT

SEQ ID NO: 1718481 - protein, 28 aa, Staphylococcus aureus
VIILLIGALGFAIYAAINHSTSSIHNNE

SEQ ID NO: 1718482 - protein, 27 aa, Staphylococcus aureus
VIIVLIGTLGFAIYAAINHSTSSSNNQ

SEQ ID NO: 1718483 - protein, 18 aa, Staphylococcus aureus
VIKPEAQQAIKATAENQV

SEQ ID NO: 1718484 - protein, 19 aa, Staphylococcus aureus
VINHYGSLIPLTPLDNSLL

SEQ ID NO: 1718485 - protein, 19 aa, Staphylococcus aureus
VINHYSSLIPLTPLDSSLL

SEQ ID NO: 1718486 - protein, 25 aa, Staphylococcus aureus
VIRRDHVKEAQSLVENYKDIQSAEA

SEQ ID NO: 1718487 - protein, 24 aa, Staphylococcus aureus
VISDAYCCVLVLRGELLDQHKDVA

SEQ ID NO: 1718488 - protein, 22 aa, Staphylococcus aureus
VKANEISSRLSVTSKDTQNLKT

SEQ ID NO: 1718489 - protein, 23 aa, Staphylococcus aureus
VKANLWLRTADRIKIVVGRFNAT

SEQ ID NO: 1718490 - protein, 21 aa, Staphylococcus aureus
VKATELNNAMHSLQNGINDET

SEQ ID NO: 1718491 - protein, 20 aa, Staphylococcus aureus
VKDALDWLHENAYGKEPDKK

SEQ ID NO: 1718492 - protein, 20 aa, Staphylococcus aureus
VKDRMGVTVNGRIDTLNKAD

SEQ ID NO: 1718493 - protein, 19 aa, Staphylococcus aureus
VKGPEYLTMENKTLQGEIV

SEQ ID NO: 1718494 - protein, 19 aa, Staphylococcus aureus
VKKHFSFSKSHGYKIVKPA

SEQ ID NO: 1718495 - protein, 21 aa, Staphylococcus aureus
VKKTGNVTLATGIGSTTANKT

SEQ ID NO: 1718496 - protein, 22 aa, Staphylococcus aureus
VKPKANQAIEAKAEETKESIDQ

SEQ ID NO: 1718497 - protein, 21 aa, Staphylococcus aureus
VKPTAKQAIADKVQAQETAID

SEQ ID NO: 1718498 - protein, 17 aa, Staphylococcus aureus
VKQAARDAVSHDAQQHI

SEQ ID NO: 1718499 - protein, 21 aa, Staphylococcus aureus
VKQEILYRIGEYYYGSDDTLI

SEQ ID NO: 1718500 - protein, 19 aa, Staphylococcus aureus
VKSKINAASNIAGVNTVKQ

SEQ ID NO: 1718501 - protein, 22 aa, Staphylococcus aureus
VKTPRYEKAYKVPNQQLKQENG
